United States Patent 8,877,916 (PROMOTER, PROMOTER CONTROL ELEMENTS, AND COMBINATIONS, AND USES THEREOF) - sequence listing, part 21

SEQ ID NO: 34487 - DNA, 3000 bp, Unknown
  misc_feature (1)..( 3000): 2750-1469P.txt file - cDNA_ID_3078738; gDNA_ID_1620822; Annot_ID_169520
atgacgaggttaaacggttgaagagttttcttggggaagaaagtatgatagaagttgtgtttcctgaagtttgattgcaaacgaaaagggacttcctggagtttgagatcaaagtactactacatttcatctagtttattttcatataattctgtgcaacttttaacttattaattgtttcatgtcacgttgctctttgcagaatacaatagtttttgaatttaatctctttaaagactctagtttagataaatcaacccatattaaagttgcaaagtccaaagaatcgagttaaacaaaattttaattttgacctgattctgtttttttttttttttaaatttattttcttaagtttccaacaaaccattgaaccgattcatttctcctaagaccaagtccagcaatagtttttagtgggtttctatgttagatttctaagtaaaatgggctcaacagaaagaaaaacagaacaatccatttaggatcgttcctaaaattgggtttttcgcgacccaatagaaacccatacgtggcttcactttattgggtaaaagttttgactcaaccaaaaaaaatacacacgcgttttaatttttttcttcttctctctcatttcttcgtgttcctacagagactccaaagtcgattggaatcgaaaaacaaactcggttcttttgatttcgagaagtttctgttcccgattcctccgccaatcaaaatcacggtgagtcctcatccttctgattccggtggtgatggttcgaactcgaagtcttcttccgacgacgagtttgttagcttggactcttccacttctggcttatgttcttcttccggcaagtttttcgatcttattaaatttctggttcttaatcttatttcaagaaattgaagctcaagattgtttgattgagtgggaagattttgcataaatgtaggattggataaatttgtaagtgcttttaggttctgaattttgcaatagatcgttgattgagaagctgttaaaaatcattagatgatgtggtcttcaagtttttttttgcttttactgattagtgtttttgtagtgttttttctgcattgtttgcatctgttgttctccagagctgtgattggtttataaaggttatactttcttgattcaaatgtgagcagttatcagatccattttgttgaaaaagatgcaaaaggttgttctgttgtgtgtgtgagtgagttattgattatggttgtctaagtgtctcttttaactctgtttttatgtttagtgtctgtttcaagtgtgtttttatgtttagtgtctgttttaagtctatgttttatgtttaagtgtacgcctatgttaatcaatgagttgtttcagtttatgagtttgagttgtttcagtttggcactttcagttttagtttatgagtttgagttgtttcactttcactttcattttcagtttcagtttatgtgtttgagttatgttgtttctttttcactttcactttcagtttcactttcagtttcagtttcaggaaatggattctcttgtgttgttgttgtttttacgcaagagtgacaaacacttggtcagattgagatttatggccatagtttatttctttactcttcttcttcattagcaatgtcaaggttaaacagcttcacttcagttctgttctatttttgatctagtctccaagattacttggttttttactgatgtagaacatgtgagaaagaagaaaatgaagaggaacaatacagaagcagaagctgatgcttcttcctcagacacatcttcaggttaacttgttgaaataaaatcaaaaggttaacttcaatatggttttagttcagtttgatcaaacatctagttaggtaactgtatgtatatattttctcaactttaactttagtttgggttacattggtgtggtgagactagagaaagtgttttctcacgtttgctatacttatatttagttttgtgttgaaaatgctgaatccttttgttgctatacttaagcttgttaatgttattggccatagcatataattacactgatacggaattaagttcagaatccgatttactttcatgaaaaatcatgttggttatctactctctcaatctaatcttgatttaattccagagtcatataattttctttttttcaaattttttttcttttagaaacccacttaagaattctaccaatggactataaaattttcaaaaactctaaaaaatctctaaactacaaaactatccaaatttattaataaaaaatacataaaaactttatttagaaactaatcactggacttgctctaattaattagaaaatcaatattcgttgtagacagatgtgtcatgtgtgattgccatttgttttagccagattgaatataattttctaaatttctaaagctataggagaaagtaaatctattgctacaacttcagttgtaaatataacaaatatttcatgcagttttgaaatcaagtttctataacaaatatatgttctagactaatttgaggtaatcgatcatttgatatttattgattcaaaatttgtaatttttgaaatttctctttaaataattggtttttgagatacataagaaaattcatgttttgactttcttacccaagatgccatgtttaaagatgcacacgtatacctcatattaaaatgcaaattgtaacctatcgtatcatttgtataataaagatgcttctgatttttgtttttcttcgtaataacttattgtataataagacaagaactgtcacgagccactgttattttcgatcaactttatattttatcaatggttttgctagctagcagttggtcccatcttggaacacaagaaaaacgagtaatatgtcaacattatactttttggtgggttgggtaatgtgtcggtgggtgctttcgttatatatgattgtatcagattgctctatctgtcttacgagagaccaaaacgatg

SEQ ID NO: 34488 - DNA, 3003 bp, Unknown
  misc_feature (1)..( 3003): 2750-1469P.txt file - cDNA_ID_3078742; gDNA_ID_1620822; Annot_ID_169519
ttgcatctaaattatagcgcgacaccaattaaacaacagccatatgatcaactttttccgtcatatttatttgacttttttattcattttgacaagctgagcacctcagtgtttaagaaggccagagtgtgtaccttaaaatcattaacatgaaatcagagtaggagtccctttcatggatttcgtcctacaaagtgatacacgggtcagtgaccaatatagaccaattacaaaatcaatttacagaagaagagcacaaagaagaatacctaagataaacaaacagaaacaagatggcagatataagtgatttttaaaataatgttgttttttcacttaaaattttaatcctgccgcggaaccaggacatgtagtgaatggaaaagtatacttaataaacacatgaaaaacatattatgaatcaaaaacaagaatttgttaccacaataatgtgagttatatcaggaacagagctgttaacgcctttgcctataagcaccctcaatagaatgccattcgtgcagaaaacaactgatgactctcttccaccttcactttgcagccgaacctagacaatgatatattgagagaagattttttctgtagccctgagaacttgtgtgtctatcatataaataagtatgtataagaacaaagaccccttaccttgtagccgacagttctcccaatagtttcacctctttcccaagatattcgatcagaaacttcaaattaggaaaagaaggcattaagtaaggagttagctgcttatacggcatgcatttgaattacaaagctgaaaacttcataagagttgaatcagatagatactaacctgaaatagctgagatacgacgtggttgggtgcaaatgattttgcatgcttctttcttactatgccacatatgatctagaagatattgaggcacctaaaatatcaagaactgaggcacctgagaaacctcacaaatgaaagaaaaaagaaaaaaaaaatcgaaactactatttgaaacagaatacgatttatatataccaagtgatatgatcatatcatgtacaaggacagaaaccttattccacaacacttaaactcgattttttacaatgttttgaaaactgacaagctgaacctagaaaatcataacctgtgatgaataactatacttgactccagcagtaaaaatcaatacagaataaagagcaacagtgaaaaacactgaagcgtttgactctagtgaactacaaacaaaaagaggaaagacgcacctgagtagttttcccacaaccagtttcaccagcaataagaacaacctgcatttcgaataagaatgaataaagactctttcaaaatgaatggaaatccccactaaaagcacaatgacgaaattcacatcctgaatcctaatatagaggaacaaattaaatatctaaagacccatataacctgattggattccactgcagatataatggcatcgcgaaaagatgcgatgggaagctttgatcgtgcttcaaagatctgtaacatcattcaaataaaaggatatttcttttactcaacagtgcatgattccaactttctgaaacagggttctgtaaagaaaatattacaatcttttgaaaatacatataactgctaacctctcgaaaatgtctttcttttttcagtctagaactcagagataccacgttattttcaatatcgtgttttgtcatatgaggtttcttgaagaaatcatctttccaattactgttgacgtttcccgtagtatatatacccagtgatgtccctgtagtatcgccgtcacaaggtggatagcgagtaaataagtcgtgcagaacagctttagcctctggtggaaatgacacacatttgagcttctttggagatattctcgtctttcttataccgcctgctttctgaaatctggtttcatagcgatgcttgctgtatgactttgaaatcccatctccttctttttctttctgatttctggcttcatacatacgcctcttgtctgactttgaaatgccatctcctttgaaaagagaaagacgcctttcttccccactcctacagaaaatccaagaagattagaaactcaagtagtagatgaaacccaaaacttgcataataccccaaacgtcagacaaaattggattaagctgtaactgacccgttactttttgatcggagacccatagttcggcacatctgatgaataatgccacgttcgctatttgtaagttgctgctcaaagacgtaagctacacaatagaaagccaacacactttccaattcaaccaaacagaaaaagacagaacattccgatagatagaaatcaccaaagctaactataactttaaaaccattgcaagtagagagtatcggagctcatctgaagattagcagaagaaacacaattaagaacaaaggaagaaactttttaaattccttgggtcgaagaggtaaactcacaatcgttcccggaggcgcgaaaatcctcaaggaccttggtggcccaagccccagtggcttcgcagagacgagtatgcttcgtatccttcttcttcttcgccatcgctttcaaaggtttcttttctctcaatacttgtgagcagagactatgtggcggtaatgtgagcttccagagagacgctcgttgatgagagtgttccggttttgctctccgcctccctccttgccctactttcccttttttccacaaacatttttttaagaaaagaaaaaaaaaactccttattgaataacttggagtcttttgggctttttgggccttttgggccagaaggaaattaacagaaaacagtgatcgggaagacctgcaccgcacctgattcattccctcgcaccctttcgtttcaaatttcaaaacaacggcattttctctctcattttctgcgtgtttctcgggaaaatcgtcagcctgattgttttcttggtcaatcactgtttcgctcttgaggaaatcaaatgatatg

SEQ ID NO: 34489 - DNA, 3000 bp, Unknown; identical to SEQ ID NO: 5872
  misc_feature (1)..( 3000): 2750-1469P.txt file - cDNA_ID_3078746; gDNA_ID_1620822; Annot_ID_169518

SEQ ID NO: 34490 - DNA, 3000 bp, Unknown; identical to SEQ ID NO: 5877
  misc_feature (1)..( 3000): 2750-1469P.txt file - cDNA_ID_3078784; gDNA_ID_1620823; Annot_ID_169606

SEQ ID NO: 34491 - DNA, 3000 bp, Unknown; identical to SEQ ID NO: 5879
  misc_feature (1)..( 3000): 2750-1469P.txt file - cDNA_ID_3078792; gDNA_ID_1620823; Annot_ID_57845

SEQ ID NO: 34492 - DNA, 3000 bp, Unknown; identical to SEQ ID NO: 5894
  misc_feature (1)..( 3000): 2750-1469P.txt file - cDNA_ID_3078792; gDNA_ID_1620823; Annot_ID_169604

SEQ ID NO: 34493 - DNA, 3003 bp, Unknown; identical to SEQ ID NO: 21632
  misc_feature (1)..( 3003): 2750-1469P.txt file - cDNA_ID_3078796; gDNA_ID_1620823; Annot_ID_169603

SEQ ID NO: 34494 - DNA, 3003 bp, Unknown
  misc_feature (1)..( 3003): 2750-1469P.txt file - cDNA_ID_3078859; gDNA_ID_1620824; Annot_ID_169640
atctactatgattcttagtgatgttttcattttgactttgatgtttatcatttagttgaatctcttggagagctaattttgagttttgggttgggttttagattaagaacagaaacataaggaagaggatacatgtacgtgtggagcatgtgcaacagtcaaggtgtgatgaggagtttaatctctggaagaagcagaacgatgtgcttaaggctgcaacagtcaaggtgtgatgatgagtttagtctcaggaaaaagcaaaacgatgtgtttaaggctgctgctaaagctaaatgtgaaactattagcactaagagacaacctaaaggtcctaaaccttgtttcatggttgaaggtatgaccttggagactgtcactcccattcccaatgttgtcaacgatctcaaaggtggctattgagttgtttccattttcttcattctcttctaagaatttttgcacttgctttgttctttttatgatgtttttgtatcaaacaagactgaattctatattgtacgagttcagattttgttaggaaagatggtttatcccaatcctttacctgttccatttgtatttaaaatcgtttctgcatttttcagaaaactgatactttgggaaaagttgagacatctaatctctttcagtgttagcaatttataccacacaaaaataaacagagagagcaatcgaaacaaaatctctttgtaaagttgggaagtgcagacagaccttttaattgcaaaccttttaattcctttgcagcttcacacaattgcctcctcttcattcattagttaaatgtttgagtttgctatttttgttttaactgagcttatgatttatcacaaaattttattgttataattatatatatttaactaaaaattattactccttaccaaaaaaaaactaaaaactattactagctaaacaaatactttttattgatgtaaatatatttaaattacatttttttatattcagaatataactaaaaaagtaaataaaagaattacatgaaaattatcgtagcggcgtcgaaacgaacaaagaaacctgcggttgcggcagcggctgcggcagcgtctgcggcaacaaaacgaacaacaacctgcggtagtgtttgccgccaccgctaccgcagccgctgccgcaaccgccagcgttaatgaaacgaacatgctaaatatatatatttttttccaaaagttaacggtaaataactcaatatatatagatatatataactcgatcaccttacttatttatctaataaatttataaacattactcaatatcctgaaaaattgagttaaactagtcatgaactagtctttaacagtaacgtaacgtatataagtagaagcactcaattttaattagttctattgaatttgttatcttcgttctatccattttacaccatttatcttactcgttttgttttgtctttttataaaacttactcggtttttttgataaacctaactcctttggttagtagttaatttccttcgttttgcttttccaattctatgcatattgttttaaccattttattactccgtttccgtttgtttcactacaattatttggagctacagtactacagtagtatatagttctatgttcatatcaagattgtcttcttgggaaacacttgccctttgactggatttgttatattaaaaattgtgcaagcacgtgtttgctaaaatttaaaatgagaagctgtgagctaaaagcttcgctgttaggttcatcaactagtctgtctggtgcttcaaaggaatgatgacacaagcaatgatgtaattggcaaaaaggtagttttgtcgtttagtgcttttaaatcgagaggcaggggatagatcagagtgatccggtatgggtcgcagattttgttcggtcccgacatgtttttagttctatttaaatactttataagtaaaaataattctattgtctcgtctctattatttacataaattgtatgtacattaattgtaagggaagtatgtatataactataaatctaaaaatcttagattaataaataatacatcaaaatgcctaacttacatatatgtatttatttatttctataatgaatacagtttttaattaagaagtgaaaatgtctcgtcacacttttcaaataggtcatttggagatatatcacatatcgaacgaatccatgatccctccaggcttcatccagttcactttgacctcactcactcttcttctttctttcagaaaatgatttatataacttttcttcttcttttaaacatatatatttaacaattttttataataatttctatagaattcttttaatatatatatccacaaatccacatagttttgaataatctttagataaactagtcctctccttcgatgaatacttcacgcgtactagttttttttcttcatgaatacttgtcgttgtgatgcagcattttgaaacatgaatatcttaaagccttttgcccaaaaaaaaaaagaatatcttaatgcctaatacttggattacgtatttatgtaccagtatcgcgatcaaaacaatcaccttttattcagtcaaattaaacataatttatgattcatatatcctcaaaaacatattacaaaattaccaggtatctttgtatgctatacaccactattctaaatttaaaaattaatatagagtaatatatactattaagttttaaaaatcgagattcatattaatataaaacatcttactaaaacaatgatcaaagttttattcatatgctcaataacatttttatgattaaattaagcatacgtcgagcatcattagttaggttccaagtacaaaagcccatttagattattttagcccgtttaaggcccaatatgttctgcttcacctcttgcttaggagccgttgccgacttctgggagcgacgccgacgacgaaagggtaaacacgccgccgttgattcagccggagaatcaatg

SEQ ID NO: 34495 - DNA, 3000 bp, Unknown; identical to SEQ ID NO: 5917
  misc_feature (1)..( 3000): 2750-1469P.txt file - cDNA_ID_3078902; gDNA_ID_1620831; Annot_ID_169673

SEQ ID NO: 34496 - DNA, 3003 bp, Unknown
  misc_feature (1)..( 3003): 2750-1469P.txt file - cDNA_ID_3078911; gDNA_ID_1620831; Annot_ID_169665
cactatgttccttagacgagcaattccttgcagcaatcaagaaaagggccaatgcagctagatttgaagagaggacggtgaattcaacggaggaagtggttgagattatccgccaattttacgagtgcgatattttattggtgggaaaatcttccaaaggacctatggtttcaagattaccggttatgaagatagagtgtccagaactgggaccggtcggaaacttgatcgtgtcaaatgagatttctacttcagtgtctgttttggtggttcaacaatacaccgggaaaggtccttctgtggtgggttccgtctctgtcccggtggtggagacgccatgaaaatctggaaacagaggattgtgttttctttaccttgaagcacaaaccatgatggataacacgaaacactcttatgtatcaacatgcatgaatcaaacgactcccctttttatgaatttgtaagataaaacatatttatgaatttgagtcactgattatatcatatccttaaaacatatgatttgatggatagattattcaagttgttaagagttcaaaattttgaccaaagatatttatattttggtaagtcgatccttttttcaaaggaatacttcatatagtaattttagatactacaattatattgactagtggtgttgtagaaatattttttcctactcaatttactatcatcccatgcatgtgtccattataaagctagattgaaatttcagtagtaatcaaaatctgatattgtataacactgtgtttggtttgtcaaacaacacatgacataacaaatcatatactacataattatcaaaccacatatcgaacagaaaacataaaattccaatataagattgttacacaccttttaaacttattaaattatcaaaaagtttcaaaggactcagcctctttctctttctctctgtctctggaaccatttaatggtctcttttagtaacattcatagagtttgatatccatcttgaccctaaaatacttagcaccttcaaaggtatcggtctcaaacgtaacaatccctcgagacatgaaaaaatcacctgtccctccgacaacagacaaatctctactctgcaccatcatgagatctgctcccattatgttcaacgtccctttgtgttgagtcgagttgaacacaagtgtgtacgcgaaccatgcattgtagtcattcttcatgtcgtagaaatagaacccttgagctcttgccacaggttcggactgaaagtttttgtctatggtcataggatcgtcgaagataacgagtttcccgaatttgaaattcccgaggcccggtgggttggtaactgctgcagaagtcgcgttttgcacgtcgtcgacaccgaacattatgtcgtggtagtagaggacaaagtttttgcacggttttggttgcgatttggatggttttctagctgatatgacggtttttgttagaacaaggaaaacgaataagaagagaaacgatttcatttggcctaccatattgaaaatatgtgtgttttaaatgaaaatgtgagagtggataatgagagagtgagattgacaaagaaggagtgatgggtttatatacaacttgggttactagtccgtgttaatattaagtataaacaaagtggactagctcacttcttctctcttgtttcttgtttatatatttatttatattaggttggtgataagttttgttgatgtgtataaagtgagatcatttaccatgaatatctgaaagttttccatgtaggcggctcaatcacctttcaaaactttccacaaaatgttatagtagtggagaaatcgttaaaaataacacgaatgaagtactaaaacaaattagtatatataatacatatttgatttaagactacataagcttaaagcttgtacataccttaagctggagttgcacgaattcatcaataatatctaaaacagcacaaattcaaaagcagaagagatattaaatcggttaaatatgcaattcatggctttaaatcatatatattgaatcaatgaataatctacttgttcgtctaaatttaggacattaataatatatatatgtatagtctttcagaactactaatatatgtaatttggccttttaatgatgggttggtggagcactaataataaaaactaaagagcatgaggagtttttccaataacttataattttacatgaatttatgtcaaactgccactgaccattagcatgatgctaaaaagtatcgttatagattttattttattttattatatataaatcatatcatttttttctataactaaaagtagagtcatctattttattggtaaaagtcacgttgaaaattttaattttagtttgttaagtaccctatggctaatataatttgcataccaaacatgtttttttcttaatgataatctagtccatttgtaaaagtaaccgttttatcatcaatttttttttaattaagctaagctttcgccgacttaatagaacattggcattcggcagccaataaagcaaatcaagttgcagaatttcaaatgtgacataactattcacattttaaaaaataatatcgtgaaacaaaagaaaagcagaacaatagtaaacaaaaagacaaattgttgaatgttgacaaactgtgaagatgataacaaacgaaggaaaagaaaaatactaaaatagtttgtcctaaaaagccttatctgcgaaggcattttaacgaaaacgggcctattgttggcccaatatgatatataggctcgaaactcgtcacgtgtattcaacagttgcttgagtttttcccacacgtgcgctgttactacgtggacgcgcgcgaataactctagttttgtggatttttttcactatcttctcagaacaacacagagccaaaggttttttgctcgcagtaaagaagaatcacactgtgaagaagaagaagaagcgaaatacaaaatcctcaggaaagaaatg

SEQ ID NO: 34497 - DNA, 3000 bp, Unknown; identical to SEQ ID NO: 7443
  misc_feature (1)..( 3000): 2750-1469P.txt file - cDNA_ID_3078948; gDNA_ID_1621146; Annot_ID_173039

SEQ ID NO: 34498 - DNA, 3000 bp, Unknown; identical to SEQ ID NO: 7443
  misc_feature (1)..( 3000): 2750-1469P.txt file - cDNA_ID_3078948; gDNA_ID_1620832; Annot_ID_169725

SEQ ID NO: 34499 - DNA, 3000 bp, Unknown
  misc_feature (1)..( 3000): 2750-1469P.txt file - cDNA_ID_3078963; gDNA_ID_1621146; Annot_ID_173031
tttcaaaacaaaagttgtatttctatgaaacataaaataaggtagagcgaacccgcaatttctcttcatctcttagtagcaatggctcgaactcgaagggagccgggttcgagcaactctccaacgatgcaacggcgatgagaaagcgttttgaggtcgttttcttatcaatagggaatggattggtgtgttattccgtttgggaatctatcaagttagtacaatacgagaaacttccaagttcctagagtaccatgaaatgataccatgtcgcaaacccttcaatgaatgaattcatatgaaaagtttgtgtttagtttgtttaatgctttgaattaacaaagatctatggttgtcatgttaacgtaaacataacgcgaaagatatgtttatggtgttgaagttcctagatcacgttcatattactatactaaattactaattatgcggagttacaccaaaagggatcacatagaaaaaaatgagaaggagcgtaatccgcaaacttatcaaacctttgatctcctctttcctcaggtaggtctctcctatacgtcaatcactcacgagaattgagctgcccacttcattttttagccgtgcgtaaaacttaacgtacatcattctctcaagattatagctaagattctttaaaccatatcatatacaagctctatagctaagattctttaaaccatatcatatacaagctttgtatcatcattttctattgtcgacaattcgtaatttagcttgtggactaatctttcaaataaaaatggtatttactggatttggtggctgggtcagtcaaaacaataaacagcctcgaaaggtcagtttcatttccataaatcagaaaaaatccattaatgtagaaactagattatgattatgtgtgttgttgtaggccaagcccaaaaaaactgaaaatgttgaatctaagtcagagtcagaaatggtggataataataataaccatgataagatgaagaaatattatgacgaagatgagaggaagaaacaagatcaagtttggatagatgcagagaagatgcatccatggaatgatgcccctccaaaggtgaaggtaatgataacaaatcatcaaacatatataatcgcactacttagatttgtttgcctttaaaggaataagaataaatatcttactatttttttaatatatttttgatgtttgtaggtgacaacaaaaaatggtctttgtcatatgaacatagaattgacattgggattttctccagataaagtcttcggattttttactaatccatccaacggaccattttttctctccccacctcttttttcttatcattcattgtattattcagatgtggtattaattgtagcaagacttgagagtgtactctatttttttttatgaaggaaagcaaatcaagaaaggttttaatggaggatggaccgaggcagatcgcgaaggtgaagaaaaccgtggactggaaattccttgggtcgtcttttgctgtccccataagtctaattgtcgatgaaaacagaaaagatcttacagtaagaagtttctctataccccctcacaataatcaaaactttttgttttgtattggtgtgacacttaactccggtttctcttggtgactgtcgacaggcaaaatataagaaaaagaaaatgatcttgatgaaagttttcgaaggtagctatagagtggagccactatatgtagattcagaacgcttgtgcaataacatggagccgaagagtccggcagaatacaaaagatgtagcggtggacaaggaaggattgcatcaaaggtgacaatgaaccaatactttaagccatatcctccttttaatctgccgccactatcttggtacattcgaaaggtcaccatcaagaacaccaaaactgcgctgaaaacacttcaaacttggggtataaaccttcgaaatccaggtgcagtgacttcaacagacaaatatggaaacgtaacaatatcaccaagaaaaaaaagaaaaacaacaaacattgaaaacactaggctaaatgaatatacatagatatagtagcatgttgtaaatttaatatattcttccacatataaatttcctaatttcatatttacaaattatgttctattccctcatttcattttatacacttgctctttattagacttaatctattctatcacgtcatgcgcgccatgcatggtgacattgtgtggctgtgtgcagatccacctaaacattttacacacaaaaattttacttgtacattaaatagtatttctagttataggcctctatctttttcaaaataaacactgtccataatctgctaattggcccattaattacatatcttaagtccatgatacttggatatcaagtcttcgggcaccttttccaattaaagaaaacaataataaaattgttgtattcgtatttgttgtttattcaacaccgacaaaaaaaagttctagttcaacaaagacattagcagattttgactttgcgcatttactttttcataaaaataaactaaaactatacggataatataaactagagaagcttggaagtgggaaaaaataaataaaagatcaattcttggatatgaattgcaaaccagagtcgatatttgattttgtggtagaggagacacaggtcagagtttcacaggttcgattgctacaaatgaaacacaagttgtgtaagcaatgtccggccgattttacgcacatgctttaacgtcgaaagagagaactcacgagaatggaacttgtcccagatttttagttctaggtgcgtaaggtacactcaatctccacctaactgattcttgttattattaccattaagcatcaatttcatttataacctttgattaatcaaacctttctctatgtgtttttccctcaaaccacatcgttgacttggatctctcattgtcatcttgttctgtttttgtgacctaattttacagaaacaaaatg

SEQ ID NO: 34500 - DNA, 3000 bp, Unknown; identical to SEQ ID NO: 34499
  misc_feature (1)..( 3000): 2750-1469P.txt file - cDNA_ID_3078963; gDNA_ID_1620832; Annot_ID_169717

SEQ ID NO: 34501 - DNA, 3003 bp, Unknown
  misc_feature (1)..( 3003): 2750-1469P.txt file - cDNA_ID_3078968; gDNA_ID_1620832; Annot_ID_169711
aatctttgtaattgcagattaatttagcgtatatctttttgtaatttcggttcggttactgaatttcgttgcttcctattgccgatcagtttttcggtttagttcggccaattctgttcggtctggatgccaaggctttgtataaaccggtttcttgtgaagacactgtatcagtgatacttgttgggcaaggagcagaaaaagcattcaatttttgtcttttaagctttgattcaaatgcgaactagggctttgagagagattactttctttatacttttgtattgtaagcttgattcaaagtgtgagagacatgcgaggggctcaagctttatactttcttcgtagaacaacgactttagctcaacatttgtgttctcttacaccgtttattgcgacgcctcgtatggattttagttcgtttcttgaagagaaccctagcgaccttgtttatacccataaccgtagaattgatgaattgattaaatccgggaacttgttatctgcacatgaagcgttcgatgaaatgtctgtacgagatgttgttacttataatcttcttatttctgggaatagtagatatgggtgttctttaagagctatagaactctacgcggagatggtctcttgtggtcttagagaaagtgcttccacgtttccttcggttctgagtgtatgtagtgatgaattgttctgtagagaagggattcaagttcattgtagggtaatttctcttgggtttggatgtaatatgtttgttaggtctgcacttgtgggtctttatgcgtgtttgaggcttgttgatgttgctttgaagttgtttgatgaaatgcttgacagaaatttagctgtttgcaatttgctgttgcgatgtttttgccagactggagagtccaagcgattgtttgaagtgtaccttaggatggaacttgaaggtgtagcaaaaaatgggttaacgtattgttatatgatccgtggttgctctcatgatcggttggtatatgaagggaagcaattgcattccttagtggttaaatctggatggaacatttctaatatatttgtggctaatgtgcttgtggactattactctgcttgtggtgatttatccggttctatgagatcattcaatgctgtcccagaaaaggatgtaatatcgtggaactcgattgtttctgtgtgtgcagattacggatctgtgcttgattctctcgatttgtttagcaagatgcagttctgggggaagagaccttctatacggccattcatgtcatttctgaatttctgtagcagaaacagtgatattcagtccgggaagcagatccattgctatgttctcaaaatgggtttcgatgtttcaagtcttcatgtacagtctgctctcattgacatgtatgggaaatgcaatgggattgagaattctgtctgctttaccagagtttgccttgcctgaatctggagtgttgtaactcgctgatgacttctctgatgcactgtgggatcacgaaagatatcatcgagatgtttggtttgatgattgatgaaggaactggaatcgacgaagttactctttctactgtcctcaaggctttatcactctctttaccagaaagtttacatagctgcacgcttgtacattgctgtgccatcaaatctggttatgcagctgatgttgcagtctcgtgctctcttattgatgcgtatacaaagagtggtcagaatgaagtatctcggaaggtgtttgatgagcttgatacacctaacatcttctgcttgacttcgatcatcaatggctatgctagaaatggcatgggaacagactgtgttaaaatgctgagagagatggatcgaatgaatctcataccagacgaagttacaatattgtctgtactatcagggtgcagtcattctgggcttgttgaagaaggcgagctgatttttgactcattggaatcgaagtacggaatttcgccaggaaggaaactctatgcatgcatggtggatttgctagggcgtgctggtttggtggaaaaagctgaaaggctgcttcttcaggcacgaggagatgcagactgcgttgcatggagctcattactgcagagctgcaggatccatagaaacgaaacaataggaagaagagcagcggaagtcttgatgaatcttgaacctgagaatttcgctgtttacattcaggtttcaaaattttactttgagatcggtgattttgaaatctccagacaaatcagagagatcgctgcttcacgagagctcatgagggagattggttacagttcagtcgttgtgaaaaactaagaaggcaacatttgcaggacagtgtttttgcttcagcttcatgaaaaagaaaagcgaatccaattgcaaagttcacttcttttttctacatatctgaaatgggttctttcgcttgaagccagaccacatgattgacactctacagagacaacacaagaggaatatgagattctttatttgtcaggttggtgcaacaaactcattgacctcttctattttatgtcttttaatatactaatagaatatagaatgtctgttcgtcgttattcaacaccgcatcatgtctaaaattctaaaaatagcatcttgaggtagaaaagctgagagattttctgggacttctttcttttttttttttttttttttttaatttcaaatctcatgggacatcattttgatcatgaacaagttgaccacaaaggttttgtgtagaggttttggagtaaagcaaagaagtgaaaaagcacatgacttgtgctttaagcatagatgtatagaaaaacaaggccttatcttcatgtacttttaagccaagccaataaaccccacaaaccccattaattactctgcatataaattcaacccgaaaccaatcatctctaccaaagaaataaggaatctcattagtaggcactggatttaataatcaacaggaatcttctcttggcgttttgattgaagcatatgatg

SEQ ID NO: 34502 - DNA, 3000 bp, Unknown; identical to SEQ ID NO: 5937
  misc_feature (1)..( 3000): 2750-1469P.txt file - cDNA_ID_3078975; gDNA_ID_1620833; Annot_ID_169766

SEQ ID NO: 34503 - DNA, 3003 bp, Unknown; identical to SEQ ID NO: 21673
  misc_feature (1)..( 3003): 2750-1469P.txt file - cDNA_ID_3078983; gDNA_ID_1620833; Annot_ID_169764

SEQ ID NO: 34504 - DNA, 3003 bp, Unknown; identical to SEQ ID NO: 21643
  misc_feature (1)..( 3003): 2750-1469P.txt file - cDNA_ID_3078992; gDNA_ID_1620833; Annot_ID_169758

SEQ ID NO: 34505 - DNA, 3000 bp, Unknown; identical to SEQ ID NO: 5932
  misc_feature (1)..( 3000): 2750-1469P.txt file - cDNA_ID_3079008; gDNA_ID_1620833; Annot_ID_169745

SEQ ID NO: 34506 - DNA, 3000 bp, Unknown; identical to SEQ ID NO: 5924
  misc_feature (1)..( 3000): 2750-1469P.txt file - cDNA_ID_3079013; gDNA_ID_1620833; Annot_ID_169740

SEQ ID NO: 34507 - DNA, 3003 bp, Unknown; identical to SEQ ID NO: 21651
  misc_feature (1)..( 3003): 2750-1469P.txt file - cDNA_ID_3079064; gDNA_ID_1620834; Annot_ID_169809

SEQ ID NO: 34508 - DNA, 3003 bp, Unknown; identical to SEQ ID NO: 21652
  misc_feature (1)..( 3003): 2750-1469P.txt file - cDNA_ID_3079068; gDNA_ID_1620834; Annot_ID_169808

SEQ ID NO: 34509 - DNA, 3003 bp, Unknown; identical to SEQ ID NO: 21653
  misc_feature (1)..( 3003): 2750-1469P.txt file - cDNA_ID_3079072; gDNA_ID_1620834; Annot_ID_169806

SEQ ID NO: 34510 - DNA, 3000 bp, Unknown; identical to SEQ ID NO: 5949
  misc_feature (1)..( 3000): 2750-1469P.txt file - cDNA_ID_3079076; gDNA_ID_1620834; Annot_ID_57942

SEQ ID NO: 34511 - DNA, 3000 bp, Unknown; identical to SEQ ID NO: 5948
  misc_feature (1)..( 3000): 2750-1469P.txt file - cDNA_ID_3079076; gDNA_ID_1620834; Annot_ID_169805

SEQ ID NO: 34512 - DNA, 3000 bp, Unknown; identical to SEQ ID NO: 5950
  misc_feature (1)..( 3000): 2750-1469P.txt file - cDNA_ID_3079080; gDNA_ID_1620834; Annot_ID_169803

SEQ ID NO: 34513 - DNA, 3000 bp, Unknown; identical to SEQ ID NO: 5952
  misc_feature (1)..( 3000): 2750-1469P.txt file - cDNA_ID_3079084; gDNA_ID_1620834; Annot_ID_169800

SEQ ID NO: 34514 - DNA, 3003 bp, Unknown
  misc_feature (1)..( 3003): 2750-1469P.txt file - cDNA_ID_3079088; gDNA_ID_1620834; Annot_ID_57935
gtcattcgattgggggatgaacctgataacatcgagaagacactaactgtagctctgctggatccaacaaagaatgatacttctaagaaaagcatcacaacatctgatccactggcttcaagcacttgggatgaggtgtgtataactctgctgcgatgtgtttcaacttcagttgattctcgatcttaacagatatgaactcattacttttataggttccatcatcaagaactttgatcacaccggtgcaatgtaaatctatatggagacagttcaagacagaaacagagtatacagtgactcaagccatatccgcacaggcatgattactttcctcataagttagctcttcactctgcttatatgaatacttatataaagtgtttatactaattcaggaggcgaacaggcgtggaaataactggttacctcctccatgggcaattcttgcattgatcgtccttggattcaacgaattcatgactcttttaaggtccatcaaagcttagtattcactgcttcatatccaatgatgatatgtaacattctgatttctttacctttttgatgtaacagaaaccctctctatcttggtgtcatgtttgtcgctttccttctggcaaaagcactgtggacgcaattggatatccctggcgaattccgcaatggtgcagtaagtgtttgccaaccttctcaaatcccattaaagtagtagtagcgtttcaagaatcatggactcgagaaaacttcaagactcaagaattcttgataataatactcatatgatctatactacctgtggtttcttcagcttccagggctcatatcgatatccgcaaagtttgttcccacagtaatgaaccttatcaagaaccttgcagcgcaaggcgaagaccctcctgcagctaatccagagaaccgtcgttcgagcaacaacacttcttcatcagaaaatccaccagatcacaaaagctcctcaaaagaggactaaagaggagagaaacaaagaatcttcttactctccaaaggtttgatctccagttcttgacgtttttttctccttattccctcactcatgagtccaaaacgctgcgtttatagggaccttttgctctgttttattagaacttctcattatacacacgagtgaattagaacttgaaaacgttgtggcatcatttgaatatttttccttcaaataaacaaaaaaaaaaagatgaagatgaaaaccaataataaatatatgtacgttctataataactcgtttcatgaaagtggaagcatgggatgagatgccaatcccatgaaaagtgagcaaaaattaatatttacattaactgctgagtgggtaaagtttaataaccattttctaaaaataacttttattcagaatccaactcatggattggtgtgtgtatttattatcatcatttctatacacatatccacccccaataactctgtcaattatacacctcaaaatcactgtaagttataaaaaaatgaatttctacaattaatcaaagaccgtccaaagccttcgtggctaattggtgttaaactattcacatttttagtcaagtatttttgcatattatatgagattaattttgccacacaagatcgttaataaactcgacatgatgattctgtttatgtggcttctattaactaggaaatgaaacaatgtagttatagttgtgactgatatgaagtcagagaaaatggctacgtaatcttatatgaccagaccaacgtacgtgatgcgatgtgacatttttcattcaacactaaagttaaaaccttgattgtttttgtattacatttggcaactaatccaatatgttttgttagttgttagtactaagtactgactgatgatcacattcacgctcaaccaaataaaacggatgatattgtttttggttaggtgaaagaacaattaaattagttgccaaaaacataacccgtgaagatttatgttagtaaccaacctacagtcataattaataagtttatgactaatagtaattaaatgacttgccaaaaacatggctctgtatagtatagtttttagattttggttaggtgaagatgattaattgatacactatgaatctatgaagacttgatccaacggctaccagatctccgacttcaactgttttcatatcgccattaatgatacagacaagctgtactactatcctttttatctctttattgttttatatgattttacagtaatactattactaagtactaacaaattgtttttctttgcagctggtcccaaaagtcaaaatcatgggacaaaaaaacgagttattattcttattatcatcaccaaggtaaaaaaatgtgaaaggaaatccttttaaggcttagtttcaatataaatacaaagatgttatttgatagtgattgttctttgtaacgaagtacttatcattaatttcaatttgcaacaaacaattctgtaacaataagtctaatgtgaggaaagttactagctggtaaaataaattagtaggtaactattttttatgagtaaatgagggaactattaattgagtaagatgattcatatgtccttttcatttgctatattcgacagaatgggacacacctaaaatcaaatttacgttttagtgtagaccaccccaacatctctttattacacaacttgtgtttttttttactatatgatttttttaccgaatgttgttgtctaaccaaaattcaatgtaccgtataagactataagttatacaactcgtagaaatggttacatatatgtaacaatatatagagacacatgtgggtgtaattaatatagttgctctgttggatcgttagtgttatttataggagaagaaaacacacaaaacaagaccattcatcaaaagccacataagaagttgatgcagaagcaataataacaaaacaaaaaaacattaaaaaaaaaagctcttcagttttggtttctgcagtctccaatg

SEQ ID NO: 34515 - DNA, 3003 bp, Unknown; identical to SEQ ID NO: 34514
  misc_feature (1)..( 3003): 2750-1469P.txt file - cDNA_ID_3079088; gDNA_ID_1620834; Annot_ID_169798

SEQ ID NO: 34516 - DNA, 3003 bp, Unknown; identical to SEQ ID NO: 21680
  misc_feature (1)..( 3003): 2750-1469P.txt file - cDNA_ID_3079094; gDNA_ID_1620834; Annot_ID_169789

SEQ ID NO: 34517 - DNA, 3000 bp, Unknown; identical to SEQ ID NO: 5978
  misc_feature (1)..( 3000): 2750-1469P.txt file - cDNA_ID_3079096; gDNA_ID_1620834; Annot_ID_169784

SEQ ID NO: 34518 - DNA, 3000 bp, Unknown; identical to SEQ ID NO: 5976
  misc_feature (1)..( 3000): 2750-1469P.txt file - cDNA_ID_3079103; gDNA_ID_1620834; Annot_ID_169782

SEQ ID NO: 34519 - DNA, 3003 bp, Unknown; identical to SEQ ID NO: 28009
  misc_feature (1)..( 3003): 2750-1469P.txt file - cDNA_ID_3079122; gDNA_ID_1620835; Annot_ID_169874

SEQ ID NO: 34520 - DNA, 3000 bp, Unknown; identical to SEQ ID NO: 5988
  misc_feature (1)..( 3000): 2750-1469P.txt file - cDNA_ID_3079138; gDNA_ID_1620835; Annot_ID_169869

SEQ ID NO: 34521 - DNA, 3003 bp, Unknown; identical to SEQ ID NO: 21378
  misc_feature (1)..( 3003): 2750-1469P.txt file - cDNA_ID_3079143; gDNA_ID_1620835; Annot_ID_169865

SEQ ID NO: 34522 - DNA, 3000 bp, Unknown; identical to SEQ ID NO: 5994
  misc_feature (1)..( 3000): 2750-1469P.txt file - cDNA_ID_3079158; gDNA_ID_1620835; Annot_ID_169848

SEQ ID NO: 34523 - DNA, 3000 bp, Unknown; identical to SEQ ID NO: 5995
  misc_feature (1)..( 3000): 2750-1469P.txt file - cDNA_ID_3079161; gDNA_ID_1620835; Annot_ID_169843

SEQ ID NO: 34524 - DNA, 3000 bp, Unknown
  misc_feature (1)..( 3000): 2750-1469P.txt file - cDNA_ID_3079164; gDNA_ID_1620835; Annot_ID_57963
ttacaacgtacgtcgtgtatcataattcaaataattaaaagattagataattttatgaacaattcaaataattctacggctgagtcataatgatgggatcggaatcacatgaaacacaactaatcataaaattagtttaatgaataaaattcttaatgtcttcaacagttgctcaaccattccactacaaatagaggctaaagaactaagtagagtattcactcctctctcaaaaccctaactgtttccaagataatggcaaaaactgaagctcctagtttggtggggaagctagagacagaagtggagatcaaagcttcggctggacagtttcatcacatgtttgccgggaagccacaccatgtctccaaagcaagtccaggcaacattcagagctgtgatctgcacgaaggcgactggggcactgtcggctctatcgtcttctggaattacgttcacggtaagtcaaccttatacatattttttttcttttttgcctcaaatgaaagttttttttttatatcttataatatatttttgaacttattttcaaattaaactcaaagtcagacttacaaattataaaataattggtgcagatggggaggcaaaggtggcgaaggagagaatcgaggcggtggagccggagaagaacttgatcacgtttagggttatagaaggtgatctgatgaaagagtacaagagctttttgatcacgatccaggtgacccctaagcatggagggcctggaagtattgtgcattggcaccttgagtatgagaaaatcagcgacgaggtagctcatcccgaaactctcctccaattctgtgttgaggtctcccaagagatcgacgaacatctcttatccgaggaagaagaggtgaagacaacagagacacttgagacagaggtggagatcaaagcttccgctgagaagttccatcacatgttcgccgggaaaccacaccatgtctctaaagcaactccaggaaacattcagagctgtgatctgcacgaaggtgactggggcacagtcggctctatcgtcttctggaactacgttcatggcaagtcaatattttattacacatttttcatgtatatatatatatataactaaccagtttatttttaaaaaagaaaatcaaacaaatgtttattttgaagtgactagatcatatgtgtctaagaaaataatctcaaaatttccattcgtagaccactctagtcacgatatatatgtcaagtctcaaagttaacctataaagatgaaatgttaaataattggtacagatggggaggcaaaggtggcaaaggagaggattgaggcggtggatccagagaaaaacttgatcacgttcagggttatagaaggtgatctgatgaaagagtacaagagcttcgtaatcacaatccaagtgactcctaagcatggaggttcagggagtgtggtgcattggcacttcgagtatgagaaaataaacgaggaggtggctcatcctgagactctcctccagtttgccgtcgaagtctccaaagaaatcgacgaacatctcttggccgaggaatagaggagaatattcctcgtgtgactatctattatcctgtccgtacatgtatgtgtgattgaagcatgccgatttttatcactctttgaatgtggaaaaataaagagttgtgttggatatatgagagtcatgttgtatgtttttaaagtgctatactctaaatttgtatacgtataatgtgttttgtttgtttaataaagtgtaaaatgtttttttaataaaatcttaagcctcgtcttttctttttttttggctaaaaagttttcgtattcaaattgaaaaagaaagaagagatacataagcccttttaaaggcccagtttagaatcaatacattgcaaaaatttgttacaagatcgttaatctaaccaacgttggaatatgagttacatccaaactagagcagaaattggtttgggctgtacaaacctttaattatcttcatcaagaggtttcttcatttttttttaataattaagttgtttaaccttatatgatttaattgctacatttatagatacagttgcatgttacaaaatatttatataccatttttcagttttttttacggattttatacacatataatggaaaagaaaaagagaaataccctaaaatagcatcaaaacaagttttgtggacaatttatacacacactttacacattgccaataataacattaattgttgatacaatgatgaatctagttcataaattgttttaagacatattatttaggaagcttttcaacaattaagtaagacaaccctaaatattttcaacaattaagtaagaatttcctaaggatattttaatcttttaacactaaatttgtgctattttggaacattccaaaatgtgtgttatttgtgaaacaaaacttatttttgtgctatttgtgaaaattgccaaaaaagaaatccatatattgattctaatcatatttatccattaactttttttggttgaagcatgtttatccaataacatagttaatgactgttatatttgttttgcatagaactgtacgtgccttcatgaacgaacgacatgaaccgcgtaacatgcatgttttcttaaagatcaacaacactacatgccaataacaaatatgtcaaaacgagaatttgcagaaggaacgtacaacctaaaccgcgttatactgaatgatctctagatcatttatatgatcaaaacctaattcaaccgttatccattacaaaaattcagtaggtgagacaaaaagatagagtcatgatatcagaagggatacaaaattgcaattaataatgatttgttttcttcttcagccgttacctccctcaatcctctacaaaaagaggctaaagaactcaaaagggactcattttctctcaaaatccttttaattttcaagttaaacaaagagaagaaaaaaatggcgactaaaatg

SEQ ID NO: 34525 - DNA, 3000 bp, Unknown
  misc_feature (1)..( 3000): 2750-1469P.txt file - cDNA_ID_3079164; gDNA_ID_1620835; Annot_ID_169842
ggaaaacgaaagttacaacgtacgtcgtgtatcataattcaaataattaaaagattagataattttatgaacaattcaaataattctacggctgagtcataatgatgggatcggaatcacatgaaacacaactaatcataaaattagtttaatgaataaaattcttaatgtcttcaacagttgctcaaccattccactacaaatagaggctaaagaactaagtagagtattcactcctctctcaaaaccctaactgtttccaagataatggcaaaaactgaagctcctagtttggtggggaagctagagacagaagtggagatcaaagcttcggctggacagtttcatcacatgtttgccgggaagccacaccatgtctccaaagcaagtccaggcaacattcagagctgtgatctgcacgaaggcgactggggcactgtcggctctatcgtcttctggaattacgttcacggtaagtcaaccttatacatattttttttcttttttgcctcaaatgaaagttttttttttatatcttataatatatttttgaacttattttcaaattaaactcaaagtcagacttacaaattataaaataattggtgcagatggggaggcaaaggtggcgaaggagagaatcgaggcggtggagccggagaagaacttgatcacgtttagggttatagaaggtgatctgatgaaagagtacaagagctttttgatcacgatccaggtgacccctaagcatggagggcctggaagtattgtgcattggcaccttgagtatgagaaaatcagcgacgaggtagctcatcccgaaactctcctccaattctgtgttgaggtctcccaagagatcgacgaacatctcttatccgaggaagaagaggtgaagacaacagagacacttgagacagaggtggagatcaaagcttccgctgagaagttccatcacatgttcgccgggaaaccacaccatgtctctaaagcaactccaggaaacattcagagctgtgatctgcacgaaggtgactggggcacagtcggctctatcgtcttctggaactacgttcatggcaagtcaatattttattacacatttttcatgtatatatatatatataactaaccagtttatttttaaaaaagaaaatcaaacaaatgtttattttgaagtgactagatcatatgtgtctaagaaaataatctcaaaatttccattcgtagaccactctagtcacgatatatatgtcaagtctcaaagttaacctataaagatgaaatgttaaataattggtacagatggggaggcaaaggtggcaaaggagaggattgaggcggtggatccagagaaaaacttgatcacgttcagggttatagaaggtgatctgatgaaagagtacaagagcttcgtaatcacaatccaagtgactcctaagcatggaggttcagggagtgtggtgcattggcacttcgagtatgagaaaataaacgaggaggtggctcatcctgagactctcctccagtttgccgtcgaagtctccaaagaaatcgacgaacatctcttggccgaggaatagaggagaatattcctcgtgtgactatctattatcctgtccgtacatgtatgtgtgattgaagcatgccgatttttatcactctttgaatgtggaaaaataaagagttgtgttggatatatgagagtcatgttgtatgtttttaaagtgctatactctaaatttgtatacgtataatgtgttttgtttgtttaataaagtgtaaaatgtttttttaataaaatcttaagcctcgtcttttctttttttttggctaaaaagttttcgtattcaaattgaaaaagaaagaagagatacataagcccttttaaaggcccagtttagaatcaatacattgcaaaaatttgttacaagatcgttaatctaaccaacgttggaatatgagttacatccaaactagagcagaaattggtttgggctgtacaaacctttaattatcttcatcaagaggtttcttcatttttttttaataattaagttgtttaaccttatatgatttaattgctacatttatagatacagttgcatgttacaaaatatttatataccatttttcagttttttttacggattttatacacatataatggaaaagaaaaagagaaataccctaaaatagcatcaaaacaagttttgtggacaatttatacacacactttacacattgccaataataacattaattgttgatacaatgatgaatctagttcataaattgttttaagacatattatttaggaagcttttcaacaattaagtaagacaaccctaaatattttcaacaattaagtaagaatttcctaaggatattttaatcttttaacactaaatttgtgctattttggaacattccaaaatgtgtgttatttgtgaaacaaaacttatttttgtgctatttgtgaaaattgccaaaaaagaaatccatatattgattctaatcatatttatccattaactttttttggttgaagcatgtttatccaataacatagttaatgactgttatatttgttttgcatagaactgtacgtgccttcatgaacgaacgacatgaaccgcgtaacatgcatgttttcttaaagatcaacaacactacatgccaataacaaatatgtcaaaacgagaatttgcagaaggaacgtacaacctaaaccgcgttatactgaatgatctctagatcatttatatgatcaaaacctaattcaaccgttatccattacaaaaattcagtaggtgagacaaaaagatagagtcatgatatcagaagggatacaaaattgcaattaataatgatttgttttcttcttcagccgttacctccctcaatcctctacaaaaagaggctaaagaactcaaaagggactcattttctctcaaaatccttttaattttcaagttaaacaaagagaagaaaaaaatg

SEQ ID NO: 34526 - DNA, 3003 bp, Unknown; identical to SEQ ID NO: 20874
  misc_feature (1)..( 3003): 2750-1469P.txt file - cDNA_ID_3079193; gDNA_ID_1620836; Annot_ID_169901

SEQ ID NO: 34527 - DNA, 3003 bp, Unknown; identical to SEQ ID NO: 20875
  misc_feature (1)..( 3003): 2750-1469P.txt file - cDNA_ID_3079197; gDNA_ID_1620836; Annot_ID_169899

SEQ ID NO: 34528 - DNA, 3000 bp, Unknown; identical to SEQ ID NO: 6010
  misc_feature (1)..( 3000): 2750-1469P.txt file - cDNA_ID_3079201; gDNA_ID_1620836; Annot_ID_169891

SEQ ID NO: 34529 - DNA, 3000 bp, Unknown; identical to SEQ ID NO: 6009
  misc_feature (1)..( 3000): 2750-1469P.txt file - cDNA_ID_3079205; gDNA_ID_1620836; Annot_ID_169890

SEQ ID NO: 34530 - DNA, 3003 bp, Unknown
  misc_feature (1)..( 3003): 2750-1469P.txt file - cDNA_ID_3079216; gDNA_ID_1620837; Annot_ID_169950
tcagcaactttatagagacgacaagggcttcatatgctgcccgaccccatggataagtcttcatggctttgtcgtcgaaaactcttttggcactctcaaatggtatcctagagttagtatgcaagccaaaaagtctaatggatagaagagtcaataacccaaaccatctacgcttttcagtaggccaagctctgcacgttactaagccctgcctaagttcatctagattaggaccttcaccggttggcacatgcaattcactgaagaacgctttgtagtcagctgcaggcacaaacttttctgtaggcagttcatctatatttaaacccgtgatatgatgaaattcgttcaatccaaaccggatgggtttaccagccacgatacaccaaagctccttcttcagtattctcagttgtctgcatagtagataatgtacggtcttaccagaccatagaaaataactatcaacaagcttagcaattaatctaagctctgtctctttcagttctgcccatatttcttttcctattgattctctaattgcagggaactctcccagctttatattatgattaatgcctttaccctccagattagaatccccctcttggtaaagtcttggagggtactcccttgcttggtcttcagacatctgtataaccataaatcagccgtaagcattccataactcagtcataacataaaacaaactcatccacagataccataactcaggcaaaacataaatctaactcagccatagataatataactccgtcataacataaacctatctcagccacacataacataactcagccataagataaatctaactcagccatattttaacagaaactcagacatcgatgtaaggttaaaccataactcagtcacagcataaaacaaactcagacacggatgaattgataaatcataaatcagtcggcaaacaaatagtaactcagccgtcaaatcaaatagatctaagaaatcggccaccatatgtcaatcaacgacgacgttaaaacccagctttaaaaaccatcgttacgcatcggaaaacgatttcagtgacgggaatcacttgagattgaacttagatgtcagagtcttacttaatggaaacatactcactggaacttagatgtcagatgtgacttcgcgcttacagaaatgcgactccggcgtctgaatttcggccggaacagacgagaaaagagcaaaacggcgaaagaaatcgattttgttccgtcgagagagaaagaggaagaaagcgacagtttttttttttttgggagatgatgaacagtaaagccaagaaataaaaaacccaaacgttatgcggtttggagatgattaatgacgtggattatcgtaatgacatggaatgatgacatgtataatcactgttttttaatttaatttttagttaaaaacgaattaaataataataattaattaaaactagttagggttgttaattgtaattacacaagaactgaaaacatctgagtaataaaaaaaaaatgtgttctattctaggaataaacatacaaatgtgttctatcttaggaattatttctatataatatgtatatgttcaattgtgatccaaaaataaatgtttcactacatattatggaaacaaattcgaataagtgttgatgcaaaatcacttaataatcagataactgaataaattttagaacaaaaaaaatggatcttataatgtcattgttttctagcaaaataatatgatctaccggggatcccatcctcggtggtgaactctactgaagtgtggttaactctgttgaagtgtgatgaatagtgggggagtagttaggtgacgactctgcttcaaatgtgatgaagtctggtgacgagtaacatgagctatttcacttatccctacaaacccatctacattaataacatcttgagagaaggtcaatctctactcccccactattcttttcggttaacttagatgccaacgcttaaaataaggtggatagttgagtccaatataactctaatatttttgaaagtgctgttacgagtttttttgaatgcttgtttccgagttcatagattgcatggtataggttattaatagcatacatgttcatcctacagtagtaagaaaataatgacagataaaggaaattacgtcacatattattggttcttatttgacttttcagcattttcccgttgttgttttattttagggtaaattgcaggccacacctgttgaccatgttttatttccatggattgtcaaaatcaaatgtggttttcaccatttatcttttcgcctgcaaaatgacgcttctgcccttgcgcttctctcttagtaactgttgaaatgtacggtttagtttagcaggtttagttacgtacactgttccggttcagttgaagattttttgtttcacgttgacgcgattcggttccgttacaagtgagattatttccattattccgaagtgacatcaacatttaatgcccccaaaaagtttagacgtgactattgtcacaattaatgcaaaatcatcattacatcaaataatattaaaaaaattattgataataattaataaaaaaattgttgagataaagaagatgaacccaggaacaaagaattattgagaacgtacattgctgctgaagaagtgttgatcttgtttttgtaccaagtttggagccaaaacaagcattgttcgtgtaagtaatgaagttcttttaagaagttttttgttatgtcatattaggatcttgattgtgttcgaactccatttttttatcagaaaatttgcaaaatctatatttgtttgtttaaaatagtcaaatgataattggtatttaggtttataaatgtgtagtatcgacattccatttgtttttttatatgtatagtatttttcagttgcatttaatgtgtgtctcctgaatttatgatgcaggtgggttatggatattcccgtatttactatg

SEQ ID NO: 34531 - DNA, 3000 bp, Unknown; identical to SEQ ID NO: 2576
  misc_feature (1)..( 3000): 2750-1469P.txt file - cDNA_ID_3079284; gDNA_ID_1620838; Annot_ID_169984

SEQ ID NO: 34532 - DNA, 3003 bp, Unknown; identical to SEQ ID NO: 33351
  misc_feature (1)..( 3003): 2750-1469P.txt file - cDNA_ID_3079295; gDNA_ID_1620838; Annot_ID_169975

SEQ ID NO: 34533 - DNA, 3000 bp, Unknown; identical to SEQ ID NO: 6048
  misc_feature (1)..( 3000): 2750-1469P.txt file - cDNA_ID_3079329; gDNA_ID_1620839; Annot_ID_170026

SEQ ID NO: 34534 - DNA, 3000 bp, Unknown
  misc_feature (1)..( 3000): 2750-1469P.txt file - cDNA_ID_3079333; gDNA_ID_1620839; Annot_ID_170022
ttaatataggtatggacaaatcaaaatatcttatgagtcaaaatttagaatgaaatcataaaataacatttatatgaaacggatgaagtatgacacaaagagagagaaaatccacacgagtattctagatcacacttaaaagatgaaaaaagttgaagtcatgaatcaaccatggatcaactaattactacgaaactctcgccggtttagtattaactcgcaaaggtcatgttcttcttcttgtccaacatagtatataactttgttttcaaattctaaaattatatgcgtgatgattctaatatcagctagtatgaaaactttttccctagttatagctcctttgtttttcttttctcttacgattcttgcatccaccgagccaccacatctcatattgagacatgacaactacaaccaaaccgacctcatctctgccatgaccgacatgagaaggcaatcttacaacggttttgtcatccttcttcgtttcctcaacgatacaaattacttcaggaacacagatattactttcttgatgcctagcgacaacgatatttctcatgcagacattactccggagagtcttgaaacatttatcctaaaacatacgatccctgcttggcttatgatcaaccacatgcttcattttccaaacagaactcttgttccttgtagcttctctgatagaatgttcaccatcacaaaatctggagggtccgggatatatgtgaacaacgcgaggatcgttactcctaatgtttgtcagaattctcgtatatcttgccatggaatcagcgacgttatctcattcaaccaaaactatgtttcaacgaaaatgttaccatcagttcgtcgaaacatcacttcgtcaaagcattgaagctctttctttgtcccacataagattcggaggatgtgagaatatcttctaatgtttccaaaaataagtgttataggtttctcaaagtcatgtacgagttgaagtgtgccaattttactttagactatgttgttgtaaacttttatttcccaaagataatggtaaaatatttaccctctaagtgatatacgtaaatcatttttagtgttcatttaaaccaattaatgaaaatcgtattagattaacctaaatgatatacaattttcctctttcttattactaagtaggcaaaaaaaactataccaagaaaaacccatacaaattatataattctgtttggttgcaagtttttagaaagtttttttcagttgttaacttaaaaaccataaaacctaagagcatctacatcggtgatcctcatacatgatgtcttaactttaatttattataaaattaatactattttaatctgaagacattcattaactttgtttcagttttctcttcccattggtgagcttaaatgggtgtcttcaactttcatggaagattcagttttcaccattacagaagaatcatcagaccactttttcagtttcaccattaacacaaatccaccacctttctccattcaccagatacattcgccaaaaacaaatcggagaaattggcttaatgtaaaaaccatcggatcgattcgttgtgatagatttaatttagtcttagtaagtatcgaccgattttctgaaatgaagagagaagtttgttagccaaatgaaggaaaaaaaaaatagcaccaaccaatattatggtgacacgttctgtttcttccagtatcagaaaaatgtcttctcacagacatcaaagccacagtgtctctcctgttcagcgcattaattcccatttttctattttttaattttattaaaatttgaagataccctctaaatttgtccgatggggatggtctaatagatttttcgggttttgaattatatttgattaagaagatgtatttatttatttgaagtttcaattcaatcgtctctttatgaagtcatcttttattaaaagatatggacacgccaattttattgtatatagaattttcatttttcttaatttgcgacatcatagtttgcccattctagttgaactaattctcagtaatcatttcaacaacattccctaatattaactcttaattttgcattttattggctctaattagtatattatattagggtaaacaatagaaacaaaagtttttttttgttttgagtccaaaggcgattgcaaattataaaagccgagctaccaacacatagagtagttgaagcttttaacatgaggcccgagattggccgtccgcagcaaagaccgataagccccggatcacatactattcccaagtcatgtgaacacggtttatcggacaattccatgaactatatcactaaatagaatctcacaaaccaaaatatactaaacggtgcaaattcactttattaagaatggctaacactgaaacttagatgccgaagaaatgaagaaactattttctatttttgttttgaagttgaaaaacaaaaaccaaaccgtaaacaagaatgtacacccctctaatagaatattataaaaatgctaaagaatcacaaactgaaaccaaatatagagaataaagccggcgtaactactcctttatcgagatccgtttcaattttggtaacttttgcttgggacaaacaaaacaacaatggcaagtataaaacgtgttcttcatcaaaaccagtaataagattttatttttcagtcaaccaacaataataataagaaaaaaaacagtaataataataataaaatttccatataaaaacagcgatatacccgaatctaataaaataatactaaattaataaaagtcgttaaacacacaattaatttgtgagagccagcgaagattttttctgattggggaaaaacctaagtgaagaagagagacaatacaacaacaacaacaacaacaacaacaacacaaaagcagacctcaatttcttcacaattctgatctgggttttgagaaattcggaatctttctttttctcgtttggttaatg

SEQ ID NO: 34535 - DNA, 3003 bp, Unknown; identical to SEQ ID NO: 20886
  misc_feature (1)..( 3003): 2750-1469P.txt file - cDNA_ID_3079337; gDNA_ID_1620839; Annot_ID_170021

SEQ ID NO: 34536 - DNA, 3003 bp, Unknown; identical to SEQ ID NO: 20887
  misc_feature (1)..( 3003): 2750-1469P.txt file - cDNA_ID_3079341; gDNA_ID_1620839; Annot_ID_170019

SEQ ID NO: 34537 - DNA, 3000 bp, Unknown
  misc_feature (1)..( 3000): 2750-1469P.txt file - cDNA_ID_3079347; gDNA_ID_1620839; Annot_ID_170017
gcctttaaacctaatgagcccatcaggttgttaaggcccatcatatagttaaggcccatgagtcatagtccaaagaaatgttagtggaatcgaaactctcttttaagatgcatcttatatgactatatactttttggagctataaagttataagttgagagagagaatgttcaatgtagcccatataaatgttctgagtttcgttatatgtaagggtatgctattcttttggcattttatttccctaccaatacagtgatgtcttttttgctggagacaaatccattctaagatccgatttggatctgaagccttcaaaaaacatatagttctcatcaaacctgactatgggttgataaagaaattcgaaatcagatttcagcaatccgactctcttaggcgacatgcgttataacgatgcttaccaacactagatttactctcgagactagttatcactgattcttagaaagctttaaaattttcagaagtttttagagtttacttttcaaacaaacttagcacaagttgtaaaaacgtattttttcttttaaatctaatttgatattatattaaaaaaaaaaaaaaaactaactatcgtatcgtgatcttgtttttattatttttaccaaaattataatattttaggtaatgttctccgtaatatctttcactttcattttattatttcaatgatattaacattcataacaaaaaaaagaaaacatatagttggcatcgtaatttgttcttggttttctcatcctaccacggtgtgggatggttcattagttaaaaaagaagaaggtagatattgaaatctaaagagaaagtgtgtacttgattataaatcatgtagatctagcaaacgaaactgtacttgagttgccaaaaaatcattttgattttataaatatgggaggtttcattattcgtgcatgggaatcgaatgggtcaaggagtaaaaaacaaagaacgtaatggtggtgaatggtgtgatacgtgggttttattttatttttaaacgtcaacattattgatatctacaacaaatataatcattgtgtaagtataagaaacggtggtggtacgtgatcatttaaatatagttacgctaaaaaaagacgttcaccgacaggattttgtggagaaacgtacatatattcattacgcaccacggaaaaatacaacgatatgtccttagttaacaccttcatcccaagtttacaattaattccccaaaactttcaactttatgtagcatcctattaatgttccaaacattgcaaggattatatgtatatatatatagaaaatagattgtatataataaacaaacaaaactatcgaaggtagttagctcaattggtaaagatcctacgcgaagcttaaaggtcatcggttcgaataacgtttgagacaaaattaatattacatactgtgattttgggcttgggaagattacgagtttcggttctagaaagattataggtttcgctccaaaacctcttaatattaaaaaaaaaaacaaaaaacaatcaaacaaaactttacattttagataaaatgcgaattgtttttggaaatcacctgttcaatggtaaaatagtagtttactagttttttttttttgaattttaatagtttacttagaagtttaaataaaaacttggatgcatcaaattgaatgaagatgtaaatattaaattattaataaatccagtgattaaaagtacatagtttagtggacgatagatagcaccgtaccggtttgggagtgtttattttgtaagagcgtaacatgtgcatcggatttacaaacagccccaccactctctttcttcttcctctctcagccattagtttcaaaccgataaattatgacaattattttggttagtcaaagagttttggatttattggcctaaacttatcctggacaaggaaacgagaataatcctatattttttcttacaacaattactaattttgaaaagaatgattcaaattaagtaagagatctatattccttgtgcaggatctattggtacagaattccttaaatattttaaattttatttgccactctttgacaaactatatggttgtgtattaatttgacatccttgattactttagactcaatccaaacaatgatagtatgtgttgaaatatcttaaaagaatgttttaaatccaaattacatgattaccacttccgtaattatcgctcatgattttattgcatcctggaaaccattagatagattggtaggtgtcggggataaaaaaatcacagataaataatatatattaatattgtttttgataatgattttttccaatgcgtgatttagaaaatatcataaacatcaataatgaaaaatcataggtagatatcacaatttatatagttacctcttgtgtatgttgatgtgtgtttcaagtatgaaaccaaacaaaaagatggtctccttgttttacgacgaatgctaaattagttataattagtagtttagtagtactactactattttctttaattaaagattagtgtaattgtaacttttaagtataattaattaagacaatcgaggtaatgagattccaaacgtgaatccagccataaaatctcttttttaaaacagtcttcttcacttcacttctctgctctgctcttgcctctgtctctttcttcttcttcttcttcttctcattaaaagctgaacacaaagatctattctttcactaacacattaccagtttctgcatttgtattatatccttttctaaaacttttaaccattctttctccattcccagttcttagaaagagtcaagagcaatgaggaagcttttcttgttagggtttatagttgcaggactggttcttgggaatgaggcaaatgggtatttagagttcaatgtcactgaattagatcgcattgaggatttagagtttggtttctccaaatttagttccaatttcaatccattaatg

SEQ ID NO: 34538 - DNA, 3003 bp, Unknown; identical to SEQ ID NO: 20889
  misc_feature (1)..( 3003): 2750-1469P.txt file - cDNA_ID_3079352; gDNA_ID_1620839; Annot_ID_170015

SEQ ID NO: 34539 - DNA, 3003 bp, Unknown
  misc_feature (1)..( 3003): 2750-1469P.txt file - cDNA_ID_3079376; gDNA_ID_1620839; Annot_ID_170000
tactatgattctagagtggaattaaaaacgagatggatgaacttgaagtttcatcatttcgaggaggagaagtaatgaatctcacatggataataagtgacatatccaaaagattatgttcaatctttgactactaaagatctaaaagttgtataaagcaattcttatacgaatgtgttattagataaaataagttataattagttattactgaaacttcaagacttgaagtctctttgtgaatataactcacattgttaagagaatatctatgatgcagagatggtaaaacagacgcttaaacttttatgcaagtattgttgtcctgtagacacaatattttgaaagaaattttgagaactattataaacttaaatcgagtgtttttcaaaggctaagaaaatatatgacttattgatgataagtaatactcatattctgaagtgaatataagatcttacataactagtcaaattaaatttaatatcgtttatattagaatataaatttcaattattgtctcatttattgctatattaacatatgattgattattaaaatacatggaagtaattttgattataagattccattaagggagtaattcataacgaatgaaaagtaaatcagaagttttcaaaaaaaaaaaaaaaaaaaaaaaaaaaaagctagaagtttcaagagtatatttggcttaaccggattggtcatcctggtttaatgatgatgtgaaagtattgagaattatgtggacattaggtgaaaaaccagaagattctccctaatgatttatcaaatgttacttgctcagaaagcaatatgataatgtgatttttaccagtgtaagtaatttggactttatcttttcgtaagtatatacaaggagatgattatgggttgatcacctactatatgacatttagatacctaatggttataaaagatgcatcgattcaatggacctattgactcgattgttgcatcgacaagaaggtcatatttatccttgttataaacccgcaacatagagtttgcgaggttactttcttgattaaagtataagagtatttcagtgtttatttattataaccattattggatatccgttgggataagtgtttaacattttgaaattcatgttcatacacaaaatggtttagtaatatcgatacgcatcaagccaatgaataattaatagttttccccatcattattggttttgggtcagaaaccaaatagttttcatctaaaatctttgaatgtgaaaagtgctccaccacagcacgctaagatgaaccctcaaaggaggataagaatacatgttggatatgaatgataactaagccatcctagaagtatttatataacgctcgttttgaagactatcatattatatagtcagctattccaacataagggggagaatgtatatagctggtgaaaaaaaaaagataaaaagaaatgaattatcaatgattctcggagtaaagaatgtatattaagagtccaaaagataattcaattacagaatttagcgttgtaattgccagacgcatttgctgacccaaataaagtgatgaagtcacctataccagttgtagattaaatgctccagaatataatgaatgtcttgtaaggaccaatttcaaactgctattgagtcttaagatcgcatgaagcgtaatagactttggttccaaatataaatatcctcgtaaaagtgaaggagcacaaaattaaaaatgaccaaattgaggaaataaatattttgatgatctcttgaagagagtgaatgatctctaaaagagacataaacatgacaaatgaaacattcaagtacttgacaatgaagagatctacctagctatgtcatgtcaaaatataatggaatcaaaagcaaatcgacgtcgtaatatatttgcatgatatgagcagttgatattatggacaaaaaaggaggatcatgaaagaaagtctattgaaaagtgtacacaaagtaatgattaaccaaaaatgaaaaagaagaaatagacatataattataatctctagtagagatatttggactagtagtctatgcacatgatgtgtaaaaccagtggaagataaatgagtctttatgtgaaagaatagtgaaattaatgagattttcacaaagataagaaatgtattatgaagagatatattctcttgtggtggatgtaatatttttaagtatctaaagtctgacaataagacacggaacactggatatgacatttatatgaaattcttgaaagatataatctatgaaggattaattatatgagaattatgttctctagaactctactcgatcgaataaaaagaaatatgtaacatgacatataatcatataaatgtatatttatgttgagtttatcaaaatatattgatcaaactaatatttgttttgaaaatcattaaaactcctacagagttatcataagtaatacgatgacaataatctatgacaaaatatcactagataatgatatttataagtctatatgaaaaccatataattatgatcattaagattatggttattaattccaacgagatattgtatttgattgaaaatcatctcctgaagaagatgtttccgaggggagattgaatgatatgcgtggatgtaccctttttccttatcatagtttttatcccacataatttttctatgacaaggtttttaaagagacattaaagaacacgtaaataatacacttgatgaatattaagaaattctatcaatcatccaaatgaatattatacactaatgatatttagagaaataaataagatggtcaagatgaatcatctaaaatattcatgagcagcagaagaatggcgatgtactttatccaaaaatttgttcaagagaagatttggcggacttattctcaaatactttttaatctttgccacatcttctaatcatgcagagtttttagcaattcatgaagctagtcgcgagtgtgtatg

SEQ ID NO: 34540 - DNA, 3003 bp, Unknown
  misc_feature (1)..( 3003): 2750-1469P.txt file - cDNA_ID_3079402; gDNA_ID_2926131; Annot_ID_196917
atggaggagacgctgcaaaattgctaataagggtttctagtttgcttagtgggggtatatatatatatataggatttgtgaatcatggctcgcaaatttcggagatcgccgctgagtagtggagaaatcgaagaaaggaaagtgaattagggttctaagtctcagaaatgcttatatatgttcgggttagttcggatggggttcgattatcgggtaataaccgattgggtacgggtaaccaaagacatgaaatctataaaccgatcgggttattaatagaatccatacccgtactgaaccccttaattcgggtcgggttcgggttcggggatcgggtatgggtaatgtgcccagtcctattctcaattatagatgtggagaaaccttattggaattatcctcataatatatttttggagtcccagtcaagaatgtcactgaaccagaaatttgaatccggcatgccactttttgatctgtatgccactttatatgtgttattcctattttacccttaatgaataattttttatttaatttcaaaaataaaataaaaataagaaaaacataaatattctatatataaaccctacaaaaacgttggatttaatttagtgactgtatttactcaacatatggaccccactaaaaaatattttatctttttgcggtagaagatactcgtagttataccgttgtaccatcgtattcatagttgaactttccacaattttcataatttacagttgaattagaaggtaaataattaattataagttgaacgcacactttttctctattattttgtatttccaaagttttcataatatgacatcggtgaaaacttggttttttacctattttacttcatataaggtgctcatagactaaatgtttcttatattagaaggggtgttttatatgaaaacaaaattggattttagaaaatattaaattttattgcattgatctaaaattatttatttataatttgggatattcgtatataattttacatgtataataaattatcaattttacaaatttaatcattttaacgttatttagttgaactagttgaactaattatattaaatgttaccacgaaaaccaaagaaagacatttgaactagctcaactaaataaattaaaaagtaccacgaacacaaatacatatatgtttttaatctaatccaataagttgaactagttgaattgttcatacaaatccgagaaatacaaattcaaaatacatgaattaattttttcatgtgcaacaaattgttcaagtgtatcccaggcatagtcttgttcttcctcttacgacgcttttctctggttgatggaaaccagtttttttttttttttaaccattttttggtgtataaattcaattggctctgtcgactcgggaaaaaccatctctggtcggctcatccatttcggcagccgtcgattctcaggtgatgtgtcttcctccatcgatattgttggatcgaaatctagatcgatatctcgatatttactttgtccactctggaaacgttcctcctttagagataccatctccggtcgactcatatatttcatcggtcgctttttcttccgtcgcaacgtcttcttttctttacaagcgctttgtttgttctactctgtctatagatctcgattgaagaaagtgaatgaacgaaacaaaaatggctgtttagatatttgcaatggtagtcagtacaatgtagtaactgaatcgcgttgctccccaaaccaatccattgttgcataataaaatggtataactgaaattggttcaattgatctagttcaaatggttcaactgatctagttcaaatagttcaactgatctagttcatctggttcaatcgaacgagttcaacttatatagttcaaattgttcaattgaataagttccaatcgatttttcgggcgtatgatatgagtaaatttggaaaatgccttttttatgagtttttatttgaaaaatactatatcctactttatatataaaattaataaaataacctcattataatttaatataattaaaactttaaacagaaaaaatccataagttaatatttgatttaactataatttaaaagataattcttatcttaaatattttaaacaaaattttgtccaaaataatatatataaactatatttatttcaaaactatatttatttcaaactatatgtattaagtgataaactttaaaataatatatataaactatatttattaagtgataaactttaaaatatatttagatattaaattgttaaattttaatataaatagataaataaactatatttatttcaaaaataattaaaaatgttatcaacaactaaaacatatttcgaataatacatacatttcgaatttatcaatagagatttttaaaaaaaaatctattacttatatttcaaaatttatttaattttaatttttttcttctaaatatgaatcctgtttttatttattaagaataatgcttttaaatttggataaaactgttactttacatattaaaaatatagtattatttgggccaagttaattattttattgtacttgggtcggattattttagttggatctgtatattttaattttttaaaaagttatttggatatttacatcagttttaattataaaaaaaaataaaattataaagaataagtggcattcgtgattattattttggagaaagtgacattcctgccatttattcaaatttttgtggcaagtgaagcgacaggtaaagtaaaaccgacgccgttttaaaagccagtgcctttacgctatccgttgaaaagggaatacaaagtctcgatttttttttccgatacttgaacggccagattttaaggttcctgtcatgtctgattgcgaaatcgcttttttcttcttcctgagttcctttttttctccgatgaaattttaaccgtgatgatgatgatcataatgaaacagatatg

SEQ ID NO: 34541 - DNA, 3000 bp, Unknown; identical to SEQ ID NO: 6061
  misc_feature (1)..( 3000): 2750-1469P.txt file - cDNA_ID_3079402; gDNA_ID_1620841; Annot_ID_170057

SEQ ID NO: 34542 - DNA, 3003 bp, Unknown
  misc_feature (1)..( 3003): 2750-1469P.txt file - cDNA_ID_3079406; gDNA_ID_1620841; Annot_ID_170055
taaagctgtttaagatcaaatgtgggagtgggagtcaccaattttagtaaattacgcttttaagtaaaagtaaaacttggatttggatggatatgaaatttagtggatcagcgatagtttttgagagtggaaacacatttaagatgttgaaaaatcatttttgaaagaaattaagtattttttgggggtttgaattgaatatttacaagaaactagattttaatccgctgaatatcgcgggactattttggttttttacaaataaaaatttaatttgttaagcctgttaacggctgttaacttatatgtccgattcgaccaataattaaaatacagtgttttatttggcaacaatttattaagtgatgtatttttatttcaatccaaaagtattgagtattaaacttccaaattaaaatttgtttgggattttttaagcatttttgcctttaatgttttgtattttctgaatgtataactcttactatgtttgatttttactgtttaaaaatataggaacaataatgtacagttcattaagttaaaatctagattattattaaataatttaaattttaattatgtttattttattaataatatttattttgttaagtttttaagataatataattatattttgattgttatatctaggatttcacccatggtataacgtctcgtattactatcaactcaaactcgtcctaccatgtaatctcgttcactgaaactaaacatatctaatagatttcactcttggtatatcatctcgtattacaatcgacccaaatctgtcctaccatctaaactcgttcactgaaattaaacattttgtttttgttattttattttaataatactttaatttaaaagatatataattcaaattaatttaaaaatcttctttcaaatggttatttaattgttgtaaaagtcatacattataatattctacatccgtctctccatctaatctagttcggtaaattaaacattatttttttttttttgttctaataatatttttattaaaagatttataattcaattcaatttaaagttttcttttgaaatggttatttaatttaatacatttcatatattatatatattctaaacatttttcggtaaatatcctaaatattttataaattttaaataactatattatttatctttaataaattataatgttaataaaatcctaacatttttcctttttaaaagtaattagaattgatggatatatattagataagtaaatgctaataattaagaatattaattatttgataataataaatgtcaataacatttcttgtaaataagttccaacttgaagatttatttgttaaaatggcagcgaaaatgtatatgtagaagatggagatcatatgttggtggttgctattagatgtaaaacataacgttgtactgtgaactatatgccatgtatttctcctccacaaaatctattctctggaaattaacctaaatttttaaatatctgtattttgcctccttttcattctattttgtttgatacaaacgattgtggtttgtaatgttaaaattaggaatgttattgaatgatatgtatatttcataaaaataataataataaaagtaggatgaatagtaaaattccaaggcatttcataatttacccattacatggtcaaaatttatcaatattttaaaataataataatcatccaatcaagattttgggaatagaatatcttaagaacttagtataattacatatatatatatatattcccttttaaatgtatcaaaaacaaactaagaacatacaaggaatttgatgtagtactatacaatttacatgcaaacagatgtagtactatttgatgacaaaaaaaaaaaaaaagatgtagtactattttatcttttcatcggaataattcggtcatgaagctattaattggttttaatgagaatttattataacagttgttgccacactgtcgaaatactaacgcctaacggctagttaaataattaacacgcggtgagaagtgagtgagttacacgaaccactaagaatctaatataggaagataagataagcatttcacacgtgtggtgtggacaatttaacagtgttaacacgcgcatggcatgtgatctagaaattagaacattaattttagcgttttgactttgacctttgaatcactaggcgtaggtatttacacgtgtaacaatataatttttttcaatatgtgatgatcatgggccaacgtttgtgggtaaaggtgtggtgttcgatcatgatccacttaaatttactgaattttagaattataacagcagaaggatataagtaatataccaaacttaactataatctacctctccttgtctatgtatactaaatgtctaacatgtaacacaaagctgtacaaaatttttaactctcaaattttttgaaataatgcaaagctgtaaaaatagctgtacgagaaaactgtacaataaaactgaaaataaaaaaatttgtaacgtttttgataaaagttttgtaaatgtataaccatcaaaactgtacaacttccagctttgataatgaattaccattcaaagctagagtttcgaattttttcattgtatacaaccatttgaacacaactcttttcaattatgccatacatacatttagttaataaattttaccgattaactagtactgacaaaagaaacaaagagtaattatatttttttgataaattgttttattagaaaaatacttaaaattgataaaaataaataaacccaattgatatatttgatattacaataccagatattgaaacaaataagacatgttttgtctatatacttccaactagaagatatttatttatccatatcctagatattttaatgtgtgaatctaatacattctcttatatacgaccaaatagtaaaacaatatgcctctcctgcaatttttcttcatccaatatttctatg

SEQ ID NO: 34543 - DNA, 3003 bp, Unknown; identical to SEQ ID NO: 20900
  misc_feature (1)..( 3003): 2750-1469P.txt file - cDNA_ID_3079413; gDNA_ID_2926131; Annot_ID_196921

SEQ ID NO: 34544 - DNA, 3000 bp, Unknown; identical to SEQ ID NO: 6055
  misc_feature (1)..( 3000): 2750-1469P.txt file - cDNA_ID_3079413; gDNA_ID_1620841; Annot_ID_170052

SEQ ID NO: 34545 - DNA, 3000 bp, Unknown
  misc_feature (1)..( 3000): 2750-1469P.txt file - cDNA_ID_3079456; gDNA_ID_1620842; Annot_ID_170092
gttaccttaaacatccatcttcgaccatcaatgtcaatttctatcttatgccccctaggattcctgtcatacgtagctcttgggtcattatcattcgcaaacttcgttaccaatgatgatttacaaaccctaacaaaatttagcaaacaattcaattaagatgatatatatgaaaaaattacaatgtctaagaaaagagaatagaaaaaacctacgatgtcaaagaaaaattaatagaaagaggggataaattacccttcatcgccgatgacgaaaaccaatatattcattgtactatattcaggcgtttgaactaggatgagaggatgaagatttatcttgataagatgtttaaggactagaaagatcttaagaaaaactataaactaggaagatcttacaaataaactagaaagaaataaaatctctagatttaaaaagatgaaaaatgtgaggtgacatggggaaccgtgatagagcaaccttcaagacactctattttccttttattattggtgtggtattgtaacactttttcttcttttataattggtgtctcgtgattttcatttcacacagttaataatactttcccacatttatctttaatgtcacacattgtgattaattctctagatgaacaacacaataaatgagctgtagagttatgggcaaaaaaataaataaattttggttggtgagataaacttattttgtaaaaatcacttgtttcctatttattttgaacgtgtgtttgtatatttttctctctctctcttcaacatccatcttcgaccatcaatgtcaatttctctcttatgctccctagaatttctgtcatacgcagcccttgggccattaccatctcgacaaacttcgttatcaatgataatttaccaaccttaacaaaatcaaacaaataattcaattaaggtgacatatattaaaaaactacaatgtctaaaaaaaggagaaaagaaaaaactacgatgtcaaagaaaaaataatagaaagaatggataaattacacttcatcaccgatgacaaaaaccagtaaattgattgtactagaaagatcttacgaaacactataaattaaaaagatcttacaaacaaactagagagaaaaaaaaatctctagatctaaaagcatctccaacagaccctcaaaccctcaaatttgaggggtttttaactctaactccaacaacccttcaaaccctcatggcactattcacaccctcaaaatatttctcttatttcattttagtctttgtactttatattccttacaaataattctattaaagtcaactatttcaaatatattcatataaatttaaataaatgaaaattatttaaatataaaaaacaaatacaacaataatagtacactgagcatttcaacacaaattaaaattaacattacaatgataaataaatacataaacacacaaaataaattaacacttgaaaaaattacattaaaacataactaataaaaaattaaattcgtaatgcaatattaatattcaggtaaatttgatcctgaacctccaagatcaccaaaatattgtccataaacatttgatggaatcggaggttgttgttgttcttgatttcttttttgtatgattcttgcttgttcagatcgtataaattcacatgtattactatcatcaatatcgcttaaacgtgttagcaatattttattttccttccctatttcttttagagctaatttttttgcttgattttgcatacgcaattgagccatctcataatccttgcttctagttgatgcactttctttcaaaaaatcaagagagacatctcataacaagaagcatgccgaaaagatgttgaacgtgcgtttggagtcttacaatcgaagtttgctatcatagcatgatcgtcatgttactggaacaaagaagtattgcatgatataatgacagcttgcattataatgcataacataataattgaggatgaacatgatatcaatgcactgattagagattcaagattgatgccaccgccaacagttgaaacggggttaaatgaacagacaagatttcaacaatttttatcttataatctacagataaaaaataaagagactaatttatcactttgaaatgcattgagtgatcatatatgggagcattttggaaatatttatatagagtaattttgtaattttataaatcattttatgtttttttttatgttttttttttaatttatatataatattatattattatatggagttttttttttaaatcttgtttggcataattgtttctataatatatgtgttatatttatttgtgaaagttttatcactataactgattattgttaaaaattgaggattataatgtaaatacttcaaaaaattaaaataaatttgtgggtataccattggagtaagtgaccctcaaatcttcattttgagggtgtgccccctttaaaatgagggccattgttggagatgttcaaagaagaagaaataaggtgagatggcatggggaaccatgactagagcaaccttcaagacactctattttctttttattattagtgtggtgctttttcttcttttataattggtgtctcgtatttttcatttcacacagttattagggacctcccacacttatctttaattgtcacaaactgtgattaattctttatatgaacaacacaataaatgagcggtgaagttatgaacgaaaaaaataaattttagttggtgaaataaatttattttataaaaatcacttgtttcctttttattttgaacgtgtgtttgtattttttctacttttctctcttattatttgagttacttaatataatataatttatctatttttatataataaattaatatttaatttttcttatattttaagatttatccgttgttttttttaagtaaataattatatataaaataaacgaaatatctaatattaagtaactaaaatg

SEQ ID NO: 34546 - DNA, 3003 bp, Unknown
  misc_feature (1)..( 3003): 2750-1469P.txt file - cDNA_ID_3079456; gDNA_ID_2926194; Annot_ID_201306
ttcgttaccttaaacatccatcttcgaccatcaatgtcaatttctatcttatgccccctaggattcctgtcatacgtagctcttgggtcattatcattcgcaaacttcgttaccaatgatgatttacaaaccctaacaaaatttagcaaacaattcaattaagatgatatatatgaaaaaattacaatgtctaagaaaagagaatagaaaaaacctacgatgtcaaagaaaaattaatagaaagaggggataaattacccttcatcgccgatgacgaaaaccaatatattcattgtactatattcaggcgtttgaactaggatgagaggatgaagatttatcttgataagatgtttaaggactagaaagatcttaagaaaaactataaactaggaagatcttacaaataaactagaaagaaataaaatctctagatttaaaaagatgaaaaatgtgaggtgacatggggaaccgtgatagagcaaccttcaagacactctattttccttttattattggtgtggtattgtaacactttttcttcttttataattggtgtctcgtgattttcatttcacacagttaataatactttcccacatttatctttaatgtcacacattgtgattaattctctagatgaacaacacaataaatgagctgtagagttatgggcaaaaaaataaataaattttggttggtgagataaacttattttgtaaaaatcacttgtttcctatttattttgaacgtgtgtttgtatatttttctctctctctcttcaacatccatcttcgaccatcaatgtcaatttctctcttatgctccctagaatttctgtcatacgcagcccttgggccattaccatctcgacaaacttcgttatcaatgataatttaccaaccttaacaaaatcaaacaaataattcaattaaggtgacatatattaaaaaactacaatgtctaaaaaaaggagaaaagaaaaaactacgatgtcaaagaaaaaataatagaaagaatggataaattacacttcatcaccgatgacaaaaaccagtaaattgattgtactagaaagatcttacgaaacactataaattaaaaagatcttacaaacaaactagagagaaaaaaaaatctctagatctaaaagcatctccaacagaccctcaaaccctcaaatttgaggggtttttaactctaactccaacaacccttcaaaccctcatggcactattcacaccctcaaaatatttctcttatttcattttagtctttgtactttatattccttacaaataattctattaaagtcaactatttcaaatatattcatataaatttaaataaatgaaaattatttaaatataaaaaacaaatacaacaataatagtacactgagcatttcaacacaaattaaaattaacattacaatgataaataaatacataaacacacaaaataaattaacacttgaaaaaattacattaaaacataactaataaaaaattaaattcgtaatgcaatattaatattcaggtaaatttgatcctgaacctccaagatcaccaaaatattgtccataaacatttgatggaatcggaggttgttgttgttcttgatttcttttttgtatgattcttgcttgttcagatcgtataaattcacatgtattactatcatcaatatcgcttaaacgtgttagcaatattttattttccttccctatttcttttagagctaatttttttgcttgattttgcatacgcaattgagccatctcataatccttgcttctagttgatgcactttctttcaaaaaatcaagagagacatctcataacaagaagcatgccgaaaagatgttgaacgtgcgtttggagtcttacaatcgaagtttgctatcatagcatgatcgtcatgttactggaacaaagaagtattgcatgatataatgacagcttgcattataatgcataacataataattgaggatgaacatgatatcaatgcactgattagagattcaagattgatgccaccgccaacagttgaaacggggttaaatgaacagacaagatttcaacaatttttatcttataatctacagataaaaaataaagagactaatttatcactttgaaatgcattgagtgatcatatatgggagcattttggaaatatttatatagagtaattttgtaattttataaatcattttatgtttttttttatgttttttttttaatttatatataatattatattattatatggagttttttttttaaatcttgtttggcataattgtttctataatatatgtgttatatttatttgtgaaagttttatcactataactgattattgttaaaaattgaggattataatgtaaatacttcaaaaaattaaaataaatttgtgggtataccattggagtaagtgaccctcaaatcttcattttgagggtgtgccccctttaaaatgagggccattgttggagatgttcaaagaagaagaaataaggtgagatggcatggggaaccatgactagagcaaccttcaagacactctattttctttttattattagtgtggtgctttttcttcttttataattggtgtctcgtatttttcatttcacacagttattagggacctcccacacttatctttaattgtcacaaactgtgattaattctttatatgaacaacacaataaatgagcggtgaagttatgaacgaaaaaaataaattttagttggtgaaataaatttattttataaaaatcacttgtttcctttttattttgaacgtgtgtttgtattttttctacttttctctcttattatttgagttacttaatataatataatttatctatttttatataataaattaatatttaatttttcttatattttaagatttatccgttgttttttttaagtaaataattatatataaaataaacgaaatatctaatattaagtaactaaaatg

SEQ ID NO: 34547 - DNA, 3000 bp, Unknown; identical to SEQ ID NO: 6077
  misc_feature (1)..( 3000): 2750-1469P.txt file - cDNA_ID_3079460; gDNA_ID_1620842; Annot_ID_170089

SEQ ID NO: 34548 - DNA, 3003 bp, Unknown; identical to SEQ ID NO: 20906
  misc_feature (1)..( 3003): 2750-1469P.txt file - cDNA_ID_3079460; gDNA_ID_2926194; Annot_ID_201308

SEQ ID NO: 34549 - DNA, 3003 bp, Unknown
  misc_feature (1)..( 3003): 2750-1469P.txt file - cDNA_ID_3079472; gDNA_ID_1620842; Annot_ID_170079
ttatatggatttttttggaggtctaagtctttgtgttgtatgaaaatcaatagagtatgtgtgcatgcatgcacatgcacatgtacaataatgtaataaattattgtatttgtatttgtatttgttgatggctccaaataataatagtgtttatggaatattctacacaggttggcgttccacgcaatcaagtgaacccatactttagggtatcaaaataaagaaaatgtacattttataaatttttcaaggctttttatgttttaagaaaaatattatacgcatttttttaataaattcatttttgttgagctttcttttcatgtttcgtgggatttaaacttgatgaaaacttatatttgttgtcaatgaatctaatttggtaacaattgggttttaaaaaatttaaaccttaaattgcttgcaaaatggaagacatcctaagactatattcatcagcgatatctagtacaatatatcaatattaaataaaagaaaaaatagaaaaagaggagagtgggagagagtcgtctctcgtttgagagactacgagaaaaacgtttcttacatgtggttttttataattagtcaagctgaaatacttattaatatgtttacacttaaaatttgtgttcacacataaatgagaaactaaaatcaagagaccatagatggtgatgctctaagatacggtgattttagttgcaaaattataaaaaaaaatctttaattaatcaagtaaatgtgttagctttgctatccattgaaataatttctggttgaaaaactcgattacgtgagtttgataaatgatattgaaggcaaaaatctaaacaatatatttacagaatgtttttttacttacaaactttttatgaaactaaaatatgttctataaaatttagtataaccgatcatatattactacattatttgtgattttataaaaaaaaatattataaggaaaagattttttatttgcgtagcacatttaaatatgccggaccggtcctgattcgaacttacgaaattaaatcggctgcacaactataagtgaattaactttttgtttttcaatttttcataatttatactaataaaaacgttgaaggataacacatacttctttaaataattttttgactagaagtaatctaaactacaaaatacactcattaaacagttattaggtttatgctgtatgacaaacttagagtaagatacttcactaatcatttaatttatatcaacgatacgacgctataagtcaataaaagaattaacttttttttctttttttttggaaatttttttagttgaaagataattcctagaaaataagttatatatttgagttttcatacaacttaaaaacagttaatgattagctatatacctatacttaatgctttctcatatctaattttgacaatctctctttttttttaatttttaatttaattttttcaccaaatactaccgtaccgtgctatatatcttggttgcttaattttgacaacctctctttttatgtatggtaatggaccacacatatccgctttgaaaagtggtccgaaggggaagacgtacggggctctcgacagctagcgaaggaaatgtagtttcttgccgtgattaaccttctttttaaggttttgtcgagaaatcataatcccgttatcgttaataaagttgttaatacccaaagataatttaagattaaaagcatgtctttgacacccaaaaaaaaaaaacacatagaagataaaaagcatgtcccgcaaaaatacaaatagaatattccttctttttaaggttgtcgagaaatcataatcactttatcgttaataaagctggtaatacgattaaaaagcatgtctcacaaaaatacaaatagaatattccttcttcttttttatttttgttgtcgagaaatcataatcactatcgttgtgatcaactaactgttttatatcgatcgacgatcgctcattacaaaaaaaaaaaaaaagtgaatgtttgtaccgaagttgtaacaataaataactaaggagtttggagagaacggagtagcttctttattaatgacgaacagaaaggcagtaattaacataatggaaaaccgtaagtacagaaacttagaaccgaaagtacaggttgaaaaactgatattaatggtcggaaaacctgaaaatacagaacggaaaaccagaaagtaagagataaagagataggcagcaattctctcttaaattctctgagtggtgacttaggttctggatcccccttcttagtagtatctcttcctattggcaaggagctgatctagggttctcttagtctctcttgcgatttctcctttttgcccttctgaatttatcgggctgggccgagccgtgatgggcagagctgtgatgggccgagtagtcattctgatgggccgttgttctgatgggccgttcttctttgttatgagctttcttgacttggtctatttgtgtttaggccgaattgggcatggagggcaaagcccgtatcccacaccgaatctaaataagaggaaacaaagaaaaaggagaaaaagaagaagaagatatgcagccaaatgggcttaaaccattaacataatgggaaagcctaacttaagcccaatacttcagctgtcaaataagaagagaaagcccaatactccaaattcggatcatatcacattatacatctaaatctgtttcacaattcaaaacatacatttggattttgactagtcgaagcctagtaattagtaattaaccatatccatgtctcagccaatcataaactaccacgtgggtgattaaattaattacagagccaaaacaaaattgtcgtttcttcaaatttcaaaaccagattgttctgtctcagaattcagaatcagtctctgatcttctccatgacgattccgtttcattgatcgatcaatcaaaatctcgccggagtttcttcccgccggcctgaatcatg

SEQ ID NO: 34550 - DNA, 3000 bp, Unknown
  misc_feature (1)..( 3000): 2750-1469P.txt file - cDNA_ID_3079472; gDNA_ID_2926194; Annot_ID_201319
tatggatttttttggaggtctaagtctttgtgttgtatgaaaatcaatagagtatgtgtgcatgcatgcacatgcacatgtacaataatgtaataaattattgtatttgtatttgtatttgttgatggctccaaataataatagtgtttatggaatattctacacaggttggcgttccacgcaatcaagtgaacccatactttagggtatcaaaataaagaaaatgtacattttataaatttttcaaggctttttatgttttaagaaaaatattatacgcatttttttaataaattcatttttgttgagctttcttttcatgtttcgtgggatttaaacttgatgaaaacttatatttgttgtcaatgaatctaatttggtaacaattgggttttaaaaaatttaaaccttaaattgcttgcaaaatggaagacatcctaagactatattcatcagcgatatctagtacaatatatcaatattaaataaaagaaaaaatagaaaaagaggagagtgggagagagtcgtctctcgtttgagagactacgagaaaaacgtttcttacatgtggttttttataattagtcaagctgaaatacttattaatatgtttacacttaaaatttgtgttcacacataaatgagaaactaaaatcaagagaccatagatggtgatgctctaagatacggtgattttagttgcaaaattataaaaaaaaatctttaattaatcaagtaaatgtgttagctttgctatccattgaaataatttctggttgaaaaactcgattacgtgagtttgataaatgatattgaaggcaaaaatctaaacaatatatttacagaatgtttttttacttacaaactttttatgaaactaaaatatgttctataaaatttagtataaccgatcatatattactacattatttgtgattttataaaaaaaaatattataaggaaaagattttttatttgcgtagcacatttaaatatgccggaccggtcctgattcgaacttacgaaattaaatcggctgcacaactataagtgaattaactttttgtttttcaatttttcataatttatactaataaaaacgttgaaggataacacatacttctttaaataattttttgactagaagtaatctaaactacaaaatacactcattaaacagttattaggtttatgctgtatgacaaacttagagtaagatacttcactaatcatttaatttatatcaacgatacgacgctataagtcaataaaagaattaacttttttttctttttttttggaaatttttttagttgaaagataattcctagaaaataagttatatatttgagttttcatacaacttaaaaacagttaatgattagctatatacctatacttaatgctttctcatatctaattttgacaatctctctttttttttaatttttaatttaattttttcaccaaatactaccgtaccgtgctatatatcttggttgcttaattttgacaacctctctttttatgtatggtaatggaccacacatatccgctttgaaaagtggtccgaaggggaagacgtacggggctctcgacagctagcgaaggaaatgtagtttcttgccgtgattaaccttctttttaaggttttgtcgagaaatcataatcccgttatcgttaataaagttgttaatacccaaagataatttaagattaaaagcatgtctttgacacccaaaaaaaaaaaacacatagaagataaaaagcatgtcccgcaaaaatacaaatagaatattccttctttttaaggttgtcgagaaatcataatcactttatcgttaataaagctggtaatacgattaaaaagcatgtctcacaaaaatacaaatagaatattccttcttcttttttatttttgttgtcgagaaatcataatcactatcgttgtgatcaactaactgttttatatcgatcgacgatcgctcattacaaaaaaaaaaaaaaagtgaatgtttgtaccgaagttgtaacaataaataactaaggagtttggagagaacggagtagcttctttattaatgacgaacagaaaggcagtaattaacataatggaaaaccgtaagtacagaaacttagaaccgaaagtacaggttgaaaaactgatattaatggtcggaaaacctgaaaatacagaacggaaaaccagaaagtaagagataaagagataggcagcaattctctcttaaattctctgagtggtgacttaggttctggatcccccttcttagtagtatctcttcctattggcaaggagctgatctagggttctcttagtctctcttgcgatttctcctttttgcccttctgaatttatcgggctgggccgagccgtgatgggcagagctgtgatgggccgagtagtcattctgatgggccgttgttctgatgggccgttcttctttgttatgagctttcttgacttggtctatttgtgtttaggccgaattgggcatggagggcaaagcccgtatcccacaccgaatctaaataagaggaaacaaagaaaaaggagaaaaagaagaagaagatatgcagccaaatgggcttaaaccattaacataatgggaaagcctaacttaagcccaatacttcagctgtcaaataagaagagaaagcccaatactccaaattcggatcatatcacattatacatctaaatctgtttcacaattcaaaacatacatttggattttgactagtcgaagcctagtaattagtaattaaccatatccatgtctcagccaatcataaactaccacgtgggtgattaaattaattacagagccaaaacaaaattgtcgtttcttcaaatttcaaaaccagattgttctgtctcagaattcagaatcagtctctgatcttctccatgacgattccgtttcattgatcgatcaatcaaaatctcgccggagtttcttcccgccggcctgaatcatg

SEQ ID NO: 34551 - DNA, 3003 bp, Unknown; identical to SEQ ID NO: 20913
  misc_feature (1)..( 3003): 2750-1469P.txt file - cDNA_ID_3079483; gDNA_ID_1620842; Annot_ID_170073

SEQ ID NO: 34552 - DNA, 3003 bp, Unknown
  misc_feature (1)..( 3003): 2750-1469P.txt file - cDNA_ID_3079496; gDNA_ID_1620843; Annot_ID_170120
ctatcacgagcgtgaattaatttgttgttgaacttgttgtctagggatagcttctgtgaagttttgtcaaccgcctgaatagattaagaagaccacactgttcgattaccctatccttaggaatcatttatccatttgattgcctgttatcatttctgctttgtcattcacttgcctgctattgccatttctgcttttagtttcatttcatttctgttattgcatactaggactgttagaaccaaccaactttctacttggcttgacttagagctttctgatcatatctcatctgtttgcatcacattggattgacatcctaaaatactacaacgacaagatagtgttttaggattaattgagtaaaatcctactatcatatagataaaagcatttttatttggatcaagagcgatctagacgggaatgcgaaacttagattcaaccatgattttgattgctaaaaaaatgttagagatttaggtttgaattagtgttcttatactatatatgtaaatatttttaatgtattttttttgttattattgattctcttttgttagagatttaggtttgaactagcaatgatgatttacaaatatttaccaaattaataatttatgatttctgtgtactgagttgattaagactagaaaatgcaattatgctttcatataatagattaacaattttatccaaaaaaaagctagctagtttttttttttttttttttttggtcgtagctaactagattaactaaaaaaaactatagttcataactttgaaagagaaaaaaattctcttttatgattctaataaattttcaaaaaaaagaagttaaaaagtgcatttaaagtaacatatgaatatgactatataactcaaaagagttcgtgggaaacatctcttcacatgcagttgtattatattaattaattttgtaacaaaagagtggcatatgaccccatggaattgttcgtaacgtatctttacaaaatcaaactatattgtttgtagcgaaaccatgttttttctgtaaaccctaccaacattttatattttaaatttttatgattatgtgttgcttgcttgcatgcttctctctctcgatgttaggtactagactacgagagaacaagaagtataataatatgtatgcaagcaaatgcaacacatacagatagaaaaagacgtatgacgtagaaaagcagctttaggatgattccaaaacttgtttcttcaagttgacatttttgcagataagtgttaagttaaccctatcacgtctggtcgtgctggtgcgtggtcctcacgctccctcaatctcctgtgttttctgaaaatgtaggcccattttgctttgacttgggcccatttaaccctctcctcatctttcaatcttccaataaacaagtttttttaattaaggaagcaatgacttttgatgtctttaattagtattttattctgttttttgaagtttattattataattggtttcgtttctatcatggatgtggatcttctttgtttcttctcttcacgtcgtctttcctttaatagttacatattattttaagttatataagaaatatgaacccctttaaacatggagaccaaatagaaattatttgattattattacctcaacaaataattttgtcaatttttttggttgagaacgacgtttttataacaaaaagacaaaaaaaaaaaattgttcatattacactcttcttatcatctttattcttcgtattttccatacagttttattttattttattacatatatatttttaaaatgaaaaataatttatatgattttcttaaaaattgttttaatatgtgtattgtttgattatgtatgctaaaaaatggtacgtttctatatcatcttaggcgtattagttagtgtttagaagaattttcttacaagaatcgtgatcgtttaacgcttaacgagttcttgaaattactattactaattttgataatatgagtgctatttatcaattaatcttatgtttccttaaactccctttttaacttttttcacgtagttacaaaaagaaataaatatatattagtataaattaaaacatatcattccgcgataactagcaacggtgccgtttcaataacctctctcatgtcctttcgtaactcaacgaaacccaaaatcaacggctcagatcattccgacttctgtttcgcctttgctacgccacttcttcttcttcttctccggttttaaattaaaacctctcacaaaattattcggaatattatttcttcttcttcttcttcttcttcttcatcatcgcatctctctcacttcacgttttcttcggtgaagagatagccgccggaaaaagttatcatctccggaaatttcgctctttctttacggtaattacgagaaaaacaaaatccaaaaatcgtttttttctatttgatgattttgccttcgtattcaatattgtaaagttttgttttttccgttgtttaattacgtaaattcgataaaagtttcttcctttagattgaatttttctgtttctatggcttgagaactagtttcgtgtggttgtttcttctgattcttgaatttgattgagaaagtttatatctttggttaagagtttttttgtttgtgtacgttttaaaatccatggagaagcttgaatcacggagaagactagtcgtattaatggaaactccgtgtaaatcgaatgagcttcttcttttggatggttcttcttctctttagctttcctcttttctctctttttggtttctttaacaatctctgacttatagcttttgaagcctctgtttgtttatggttatatcctctctgttcttctcatttctaaagactgaattttgaatggtaaaagatcgtgtgtgtgtgtctgtatccttaggctttgatgcagttttctgaaaatttgaactttgtttatatgttgcagtgtttgagggtgtgttttatgtatg

SEQ ID NO: 34553 - DNA, 3003 bp, Unknown
  misc_feature (1)..( 3003): 2750-1469P.txt file - cDNA_ID_3079516; gDNA_ID_1620843; Annot_ID_170109
tctaaatatagatttctttataaatagagaagatctttgctccaataattgttgttttgttcctctaaacaaaatgttccaaataaattttattttaatttctaacataatcctcctttatttttaaagtttataaattctatccacttaggttatttttaaacaaaacaaaataaattttcattataacacataaatagacaatcgaatgattaagacattatttttaagcatcatcattagtactatttttatattttaaaatttcaattaatttagtaaatatatctaatacaaatttatatttttaggtattaaatgataacttattaaaattggaagagttttttgtaaataaaaaaattatgctttaaaaatagagaaatgattagtattgctccaaatttggagcaatactatctttatttttggcgcaagatattgagtaccattgatgatgattttatatcaaatatagagcttgtagcaagaagaagggtgacttacattatccttgtggtaaggtttgtagtacgaaactatttttaaccattatccttcaaacaaacaatgttaataattctatgtcaagtttctagatcttaatctccgataacaaactaataattaacaattgttagaacatccaacaataaagcataaagagtgaaaaaaaaaaaaaaatccaattaaaacctgcaatttttctcgttctcaaataaaacttctaactaattaattttcttaaaaaatcttcaagtcgtcaaaattcaaacttttcctatttaaaacttatcttgaaaacctccaaattgaaatattttcccaattaaaacctcaaactttttttcgtttctaaataaaatttctaacataactaattaatttttcctaaagaaacgtttaagtcatcaaattttgagtctgatcaatgatttactaacgataaacggcttttaacaacatattttccatttatttagtttttgaaattcacatgttttagttacagtagaaaatataaaatcaaaattgaggattgaataaatttatacttgaatgattgttaaaatttatactttaatgattatggttaaaattttaaatcaatcgaagtaaataacccaattggtaagtaactaagtattaaaagattccaaaataggaaatatacaataatgttttgcttgtgcatcggtggtcattaagtaaagggcaccattcaattcttagagtggtaggaagcgagaaaccaagccaatatggtatcccatatggctaagcttatgagagagttagagacaagtgtcgcattaggtgtcgtatgaaagatgcatacgatgtatatacagtttttttaacaacgtgtctatttgtaattatcactcattgtcttacttgatagcttttgtttgcttcttcttaataggatgcattttattgcatgtgtatgcatttctccaaatgaaatcttgtgaaacacttgtctctaagagtctaactctcacacaagctaaaaacacgtcagcttgaggtccacttagcttattgatgagtagttttaaagtttgtgtgtttccaactaatcagtaactagtaatcacccaacacataaataaatatattacgagtgagagaattgtttcaaagttagaaatggaaatcataatcatctctctctgcctagcaacaatcctagcctttcttctcctaaaaccacttctgaatcgaaccgttgccaaagacaacctaccaccgtctccgtggcgagttccggtaatcggaaacctccaccagctaagcctccaccctcaccgctcccttcgttccctcagccaccgctacgggccactcatgctccttcattttggccgtgtcccgatcctcgtagtctcttcctctgacgtagctcatgacctcatgaaaacacacgaccttaaggttgcgaaccgcccgcgattaaaagtgattgaaacaatcctcaacggtgggagagaagtggttttttccccttacggagactattggaggcagattaaggtgtttttgctaagtcattaatttatatatacagttaacaattagttgtggttagctctctggatttgctatctgtggcctattatataatttccaaagtctatatttgattaagttttaccagttagattgatagttacatgttgtagtgaatacatgcaccgtgcgtttgattaattttgatcccccttccgttttattttaatttgagtatcgtcttgtaaacaaaaaatgtcgtttaaaaaaaaattcaattttattttatagttttaatttcttgaccaataaaaaatttacataacatattaataaaaggtaaaaatagtattgtttcgttaatttgtgagtaaaaaactaaaagacatataatacgaaatgaattgtatactatttacttcttgaagtacgtttgttttaaaagtcagaaggtatttacttgttgaaatacatatacagttctataatgtttaatcttccaattgaaaaatacaatacatttaaataaaaccattaaatatttttatacaaactttcttattagatatttgattttcgtaagtttagttaataagaataacttgtatatgaaattaacattgtttggcaagaataatagcagaaataaataaataaataaaaaatgagaagaattgtggacttcatacataagaattagtgtttcttttctaatatatagaggatgtaataaaggcatgagttgagctttaaaagaaaaaaaaacatttgctttgtgcgtagagaaagaacagaacacatttttttgcaaaagataaacaacggaagtttgagagaaagtagtatttttgtttgttaaaaactttgatatattaatgctcttgatacttagatatattaattttctcattaagaaactgatgaaagtattacgtctgttttgtgaggaagactgtatgcgtcgtccatctactcaataagaaaatg

SEQ ID NO: 34554 - DNA, 3000 bp, Unknown; identical to SEQ ID NO: 20918
  misc_feature (1)..( 3000): 2750-1469P.txt file - cDNA_ID_3079530; gDNA_ID_1620844; Annot_ID_170159

SEQ ID NO: 34555 - DNA, 3003 bp, Unknown
  misc_feature (1)..( 3003): 2750-1469P.txt file - cDNA_ID_3079534; gDNA_ID_1620844; Annot_ID_170155
tcttaatatacaatacttctttttcatgcattaagccccttacaatgtcgagtaaacaaagcatgtgtccgctaatattgtcttcgagcttggtatttttgtattctgatacggtatttggggacgacatcttttgttgactcgatataagaagggggtttgtggaagaaattgtagtattatatatcaagaatggctctccaaaccatgttgctggccacttagctattatcgaagcgtttgttgcaacatcaatatcatatcttcagctattctgttttagagaggttgagactgaatctatatgatctgaaggacggagatactgctatgcatttggccttgacaggtcgccatgtggagatagctgcatgtctggtaaatgtgaaccaatgtgcttcatttcttgcgagtaaagttggaatatctcccttgtatttggcagtggaagctggcaatgtcccactcgtggtatcaaagttgagaactacaagcaatgaaggaagaaagacgaactttgattttgtacacgtggctttgaaggccaagagtagaagtttgttttgcttcttaccaattagtagctctgtttagtttgtttgactagtttgggacagaagactaaatatttgcatgtgggctaatttatacagatccaagtcttggggatgagtgatgtgaagaagggataaattctctttcaattggagcatccatagggttttataaaggagtatgtaacctgttagtacgattaacgaagagtgtttacgtgtgaaacaatgatggaccctttccactcatttggcagcaacgaatggccatatcagaattgtcaaagagactctaaaacattgtccagattcaaaacacctgcttaacaagcttggttagaacgttctttgcattgcaacaaatagtgggaaatgtaagtgtttgattccgttgttgttatatatgcaattctgtttcattttatttccgcactttgggttgaattgtcctgtttctctatttaaagaaaaaagtgcttcattttgatgctttgtcgatcaaactgaggtttgattcccaagagacacatacagattgtatcataattagctaggtccagtttgatcactgtgattgtagttgacagatagtcaaaatgacctcttgttgttttgctggtgatcattatttcagtacctaagttttttttacccaaccctcacttcaacacatcttttgctgccaccatttcctttcgctttcggccgctggtcacaactcacaacagcaacaatgactaaaagaatctgcactaagtcaatttccagcttcttgttttattaaggaaaatctcgtgccatgtaaattgtcagacttttggtttgtttccagctcatacctggttttgaggtagtctatgttcttggcttgccatttctttttaatcttgagctatgttcttagaggcggctaagcagttcaggacttggttgttggttaacttattgtagcaatacttgttcttatttgggctttgctgggtgatccagaactcggccacaaagcctttcagtttgcctttccatttctgtctttggctctaaactccatgtaggtcgcattctattttggcgtgctcgctacaacaagtgatatactagttattttttttcgttcttcactaaatactagattttaacccgcggtacaccgcggaaacaatttattttttaaagttagtatacataaaagtttgcaaattgtatctatctataaatatttttattttatagtttacaattgttattaagtaacgtcctgccaaacccgtcccgccaacccgtcccataaaaaaaacatttattttattaatgttaatcttatttatgatatgtttatgaattattgtctaaatattttgtaattttgtaataattaaatgctatcaaatatctctgcgatttgacgattataattaaattgttatagtcatggagaaaaacaatatcaaaaatgataattttgtagtaaataaatgatattaaatattttgaaagttttattttagtaactaatcgtgtagttaatgtggagagatttagggaagattgttaaatgtcaaatatttaatttgaagattttttttctaattatcaaaaacaaacattaaaatccagtggcagctattgtaaataagtcccaactataagatttatttcacaaaattgctgcaaaaatgtatatatagatattcagcgcgtattttattttgtgctctattttcttcttgcctattacactgtcccatatattcctggctttggtcgttgtcactgggcaacggatatcctctccgaatgctattatggtttgttgatgaagaagatgctgaaacatatcacacctctggctctggtccgtgtgattgaaacaaaaaagacgaaaggatgtcttcttatctatttgattcagttgttgttttcataactagtaatttattacgttggtttggaaagagtcagtaagcggggatagctcagttgggagagcgtcagactgaagatctcgatccacgctcaccgcattacgttgtcttttcgtttttattttctttctatatatcttttactcattgattgtgttacatgaagcggggatagctcagttgggagagcgtcagactgaagatctgaaggtcgcgtgttcgatccacgctcaccgcaatatttagtcatttaatttttttcccaaagccatgcaaacgacgtcgtttaaaaccaaaacacacagagatagtcatatacggtgtcgctttatgaaaagctcgaattatactaacggtggttttacaatatgaagttcaaaaagcccattaaaaagcccactacatatcccaccgcctttacctctgaaccgactattttttttccaccctttatattcgttgtaacagcagagatttttatagtttggtttctttgaccggagaatctcgattaggttacgatg

SEQ ID NO: 34556 - DNA, 3000 bp, Unknown
  misc_feature (1)..( 3000): 2750-1469P.txt file - cDNA_ID_3079534; gDNA_ID_2926205; Annot_ID_202163
taatatacaatacttctttttcatgcattaagccccttacaatgtcgagtaaacaaagcatgtgtccgctaatattgtcttcgagcttggtatttttgtattctgatacggtatttggggacgacatcttttgttgactcgatataagaagggggtttgtggaagaaattgtagtattatatatcaagaatggctctccaaaccatgttgctggccacttagctattatcgaagcgtttgttgcaacatcaatatcatatcttcagctattctgttttagagaggttgagactgaatctatatgatctgaaggacggagatactgctatgcatttggccttgacaggtcgccatgtggagatagctgcatgtctggtaaatgtgaaccaatgtgcttcatttcttgcgagtaaagttggaatatctcccttgtatttggcagtggaagctggcaatgtcccactcgtggtatcaaagttgagaactacaagcaatgaaggaagaaagacgaactttgattttgtacacgtggctttgaaggccaagagtagaagtttgttttgcttcttaccaattagtagctctgtttagtttgtttgactagtttgggacagaagactaaatatttgcatgtgggctaatttatacagatccaagtcttggggatgagtgatgtgaagaagggataaattctctttcaattggagcatccatagggttttataaaggagtatgtaacctgttagtacgattaacgaagagtgtttacgtgtgaaacaatgatggaccctttccactcatttggcagcaacgaatggccatatcagaattgtcaaagagactctaaaacattgtccagattcaaaacacctgcttaacaagcttggttagaacgttctttgcattgcaacaaatagtgggaaatgtaagtgtttgattccgttgttgttatatatgcaattctgtttcattttatttccgcactttgggttgaattgtcctgtttctctatttaaagaaaaaagtgcttcattttgatgctttgtcgatcaaactgaggtttgattcccaagagacacatacagattgtatcataattagctaggtccagtttgatcactgtgattgtagttgacagatagtcaaaatgacctcttgttgttttgctggtgatcattatttcagtacctaagttttttttacccaaccctcacttcaacacatcttttgctgccaccatttcctttcgctttcggccgctggtcacaactcacaacagcaacaatgactaaaagaatctgcactaagtcaatttccagcttcttgttttattaaggaaaatctcgtgccatgtaaattgtcagacttttggtttgtttccagctcatacctggttttgaggtagtctatgttcttggcttgccatttctttttaatcttgagctatgttcttagaggcggctaagcagttcaggacttggttgttggttaacttattgtagcaatacttgttcttatttgggctttgctgggtgatccagaactcggccacaaagcctttcagtttgcctttccatttctgtctttggctctaaactccatgtaggtcgcattctattttggcgtgctcgctacaacaagtgatatactagttattttttttcgttcttcactaaatactagattttaacccgcggtacaccgcggaaacaatttattttttaaagttagtatacataaaagtttgcaaattgtatctatctataaatatttttattttatagtttacaattgttattaagtaacgtcctgccaaacccgtcccgccaacccgtcccataaaaaaaacatttattttattaatgttaatcttatttatgatatgtttatgaattattgtctaaatattttgtaattttgtaataattaaatgctatcaaatatctctgcgatttgacgattataattaaattgttatagtcatggagaaaaacaatatcaaaaatgataattttgtagtaaataaatgatattaaatattttgaaagttttattttagtaactaatcgtgtagttaatgtggagagatttagggaagattgttaaatgtcaaatatttaatttgaagattttttttctaattatcaaaaacaaacattaaaatccagtggcagctattgtaaataagtcccaactataagatttatttcacaaaattgctgcaaaaatgtatatatagatattcagcgcgtattttattttgtgctctattttcttcttgcctattacactgtcccatatattcctggctttggtcgttgtcactgggcaacggatatcctctccgaatgctattatggtttgttgatgaagaagatgctgaaacatatcacacctctggctctggtccgtgtgattgaaacaaaaaagacgaaaggatgtcttcttatctatttgattcagttgttgttttcataactagtaatttattacgttggtttggaaagagtcagtaagcggggatagctcagttgggagagcgtcagactgaagatctcgatccacgctcaccgcattacgttgtcttttcgtttttattttctttctatatatcttttactcattgattgtgttacatgaagcggggatagctcagttgggagagcgtcagactgaagatctgaaggtcgcgtgttcgatccacgctcaccgcaatatttagtcatttaatttttttcccaaagccatgcaaacgacgtcgtttaaaaccaaaacacacagagatagtcatatacggtgtcgctttatgaaaagctcgaattatactaacggtggttttacaatatgaagttcaaaaagcccattaaaaagcccactacatatcccaccgcctttacctctgaaccgactattttttttccaccctttatattcgttgtaacagcagagatttttatagtttggtttctttgaccggagaatctcgattaggttacgatg

SEQ ID NO: 34557 - DNA, 3000 bp, Unknown; identical to SEQ ID NO: 6089
  misc_feature (1)..( 3000): 2750-1469P.txt file - cDNA_ID_3079550; gDNA_ID_1620844; Annot_ID_170135

SEQ ID NO: 34558 - DNA, 3003 bp, Unknown
  misc_feature (1)..( 3003): 2750-1469P.txt file - cDNA_ID_3079569; gDNA_ID_1620845; Annot_ID_170193
ttcttcctattgaaaccctaaattctcttcttgaaatccaaatcttgtttcaagagtaaaccatgcggagcgagagaattgattcagatgaagcagaaacaaaatcgagaacaaatctctcgcaagaagtcgaagaatatatcaaagatacaattgatcattctttaggtcttccgatctccatggaatctcttcagaagaagctttatacggctgaagaatctcaacgccgtcttcgcgaacagtatcagggtctgatttcgcgattaaaggagaaagatcatgtaatcgatcgtgttagggttagtaatttctttctgggtatctttcgttttctgggatttgattgatttgaatctgaatctttttttttttttttttttttataagtctgaagcgagtatgaatgcgcaagcgttgaagaagtttgttgaagagaatcagaaattggctagtgagtgtgggaatttgttgagtcagtgtaagaaattggagaaagagtgtttgctttatcatcaagatcgtgatgcgttgatggagtttgggaatgaatctgatgagagagctagagaagcagaagctagggttcgtgaattggaggatgaaattggaagaatgtctgaggaaatgcagagatttaagcgtcaaatcggagatggtgaagtaagagtttcttcatattaaccctaaattttctttaattgggttaagttgggtttagaattgcattgccctcgagtaaattagtttgctttttgcacttgctggtttatagtttggttagcttgttcttgatgaaatggttactcaagtgctattgtcttctctctactctttaattagcacatggggtaccatcatttggttttctttgttaagttgacaacttgatttatctaagttctcatgaagtttgacttctcattgagtctctttgcagaaaagtcatagaatggtagatatgatgcacttgagagagagactatgctagtccacattaagtttctcttagtactatgaaatataaaatgtccttccatatcgcttttctcgctgaaggtgataacttgaggtggatatcaaatgggtttgtcatatatcctctattgttagttgttttcaatagcctgaggtggataaaggtagttgataagtttttggttgtctatgtgcttcagagattgcttgttccatccaatgtttaatggtactaatacgaggtgcatatttatcaaacaaatagaaattagaaagatctgttagagtcaacattagtaagaaaatgtatctattagctgctacttataatcatttcaatatagtttctttgtggtctgacagaactctgtattatcatttcataagtatccatgttgtgttcctttgcagaaagtcttacaattgttgatattatccagtagatgcacttaatagagagactctaatggtagtccacattatgtttctggtttttataattgtcagtccatatcgttttgctttctgagggtaataaaactttggattcttctgatatatcaaatgggtttttcatattattcatatatacagtattgttaggcgtttttgatagcttgaggtggataaaggctgttgataagtgtttgattgtctatgatgcttgagagattgcttgttccatccatgatttatctttctgtatccttgagatgtagcatattttatcaaacaaatgaagattagaaagatctgttagtgtcaacattagtcagaagatgtatctattagttgctacttttcatcatttcagctggaaacatagtatctttgtgttctgacagaagtctgtattttcatttctctctaaaggttgaaaactgtactacaccgttagaagaagatttgcttgattcagttttgggatcactcataagcaaagatgaaactataatggggcgtctcttcttggaggcaaacatccacgaccaatcgtgccaagccttgctgagcaagtgggatcacttaaagccttcaacgcaaaaggttctttctttagtttcaaaggcaaagaaattcgaaaaggaaaaagaatgcatcatcatgaatctcgctaaagctgagcaagaggtaataatcataaacgataacactctattgttcttaaatgattccacttgactcacaaactttttacaggtggaacttgtgagcacgctaaaccgaaagctggataaagaaaatcgtaagttgctaaggcaacaacaaagccctctttgctccgcagacaagaaccgaaacagcgcatctgcaaaggtaaaagtaccacaaaaagaaagaagtaaacactgcgaaggaaaaagcagctatgtggactctctctttgattctaacttaggagtgttgttctgtttgcagtcaaacaagagaaagagtccgaagacgatgagtagcccggtcgagaagaggcttgagtttagcagtccagaaattagcaggaagcctctatcacctgtatggaataactcaccagattctaagatgaacaacaattgatgataaacaaaatcaaacaactatctgtatcattcatatgtgaaaccggattatattgttgcttctctgaagctactaacaacatgtatcagtattgctatgaacaaatttgaccagaaaatcatgttttcaaactggtaaataactagcttattatatacaacagcagtgtaaaactgacatagcttactaaacactggtgtttaacatttcttacaaaaacgcaaccgttttcggtaacctacaacgacgtcgttgcgtctacaagaacagtgaaatttatacaaacgttgtcgttttcaagtacattttctaaacgacgtcattgcttctacaacaaacagtgagaatcatgaaacacgtcgttttaaaactaagaacgacgtcgttagtctattccaacacaataaatgtgaaattgcgttgcttttcgatttcttcttcttatccaaaactctctcagtcatg

SEQ ID NO: 34559 - DNA, 3000 bp, Unknown
  misc_feature (1)..( 3000): 2750-1469P.txt file - cDNA_ID_3079631; gDNA_ID_1620848; Annot_ID_170261
tatatataacacgctttcaaagaaatacagacgaacataaataataacataaagaatcaaatcacatgcgtacccaagatgacgtggacagaacagagaaatcacacttctatgtctcaatcaattctcaaaaatatctcaacattataccaaaaaaagaaattctcaaaaatatttcaacctttgactatatttaccaaaccccactttctggaacctcctaacttttaacttatgtattgtaatgatacacctttatacttttgcaagtagactaatctcatggcatctattgcttgctaatggtcggtctaagggaaatgatatatacagcattatacttctgtaattagacaatattaggagttcagaaagaagttgttaccctcgtttacgaaaaaaatgtttatattcaattatgaaaccaactcttctgaaattctgtgatagttttattgttcctcaatggtccacttattccccaccttgatatttttgcaaatgaggcttttgtcttactcataatgaagatccattcgaagacatatttttgtttctttccgttttttcaaaaacaataaaaaagtttttgttcacattttagaagagaagcaattcaccaattaatttcgtaaggtaacatgaaccaaagaagcaaaacaaaacatcattataaatatatttatactgacaccactgaaaggtaacttgaaccaaagaagaaaacacaacataaatatgattctgtgacattatcaaaaggtttaacgaacccaaccaagaagtaaacaaagcataattatgataggataataaaatagttaaataacgaaggccagtgtaattccctactggctattattttccttactagtagtatagatttttcttatctatcactattcagtaataaactttttttggagatccacgtagcaatggaaaaccttgaaatcgcagttcggagctgctatagtgtctaaaatcatcttcgccgtgcgctcttgactcaccctcgcgttattcttttccacaagcaccgcttctacgatcttattgaaccctttccctcggctacgagccacgaaatcaaccagagcagcttgtaccggtcccaaacttgggctatacgccactgattcaatgtaccatccacggtaccacttcccttcgtcatcctgcagcgccactcccgacggagactcagtgtacggagagaacgaattgtttgccgcggctagagccttgcacttcaaatgggaacaatctgatgagcatatctcttcggtagaacccgaaagggtgaggcagttatcgcgcttctcgagaaggagaggggaaccctttgggaggacgtcgtcaggggtgaatctgtacggaaggaggagcttaaggctcgagaatgatccttctgcttcatgctttgatttgagcaggattttgatgtcaagctcgttgctggtctccataagaaactggcggcagtttccgcacggcgcgccgaattcgatgcagtcactagagatggcgactgctaactgacggagacctttctcggagtttagtgcgaggttggtgacgaggaattgctcggggtggatggagtggtgaagaggaagacctgggaattcgacattgacgcctaaatagacccgacccgatgatgcgcgtccaacggctccgactttgtatttggagattggaccccgagccagagacatcgcctttctgatcagctttggaagtctgatgggttcggtgacaccttccgatgctgcttctttggcagtgaaaacgaacttgtacttatcttgtgccgccattgccctgttttgagattctacgacgagattttggaaatgagttaacaagttaggacgttgggccatttaggatcgtgtttcgagtttttttttggttgagagatatgaaatgagatgagaagtggtattgagtctttgcctatttatataggtgtgtcgtgtctgtttgcatattgtgaaaggactttttaaaatcgtgtttaggtcattcgtatactcaaaacaatagttagtgtgtgaacttcaagattaaaaaaaggtgattgtgacgatcaacattcatgaactagcttttaaagcaaagtagtaattagggttaattttctagttagtataaagtaatgtactgtaatgaagagtatttattcgaggaagactaagtagttcttaattaacttttactgagtagtaacatttaatggtttgaatagtactaattaatataggttaagaattacatggacaggcaagaatataaacgagattatgactgtatctccgtcatcaagactcatgctgactcatgaaccatttctcaaaacaaaattgcttttaaaagtaagtaaggttagtttttttttttttttttaaattctatactaaagaatggttaaaaaaataaaattcaatagtcttgattagtcataaattcatggtatgaaaattgggaatcttattcttaaaaagttataattaaattcattgagtttgtgtgagattgtgacaatataaaaatatcaaataatactctaagtccatgctatatatatattttctctttgtgtttaaaattgaatcttgttcagaaatgagcactttgggtagatcattttgaacttaaatgtatgatatatatttgttcgaaaaatatggattccagttaattttttgagtgaatatggattgaaacgttttaagaaggataattgtgttactctaatttttgtaacaataaacgttattatatttttacagttactccccataactttgtaaaaagtaaagaaaagccccaaacagagagaaacgaccacgtaagagtggtttggatcactaaactcgaatcgtcatcttcatcgatcgatatgcgacacatcatcttcatcgtcatgttctgtcttgcaaagttcaaacctttttacaaatcagacaaaacccaacaattaatgaaacaatg

SEQ ID NO: 34560 - DNA, 3000 bp, Unknown
  misc_feature (1)..( 3000): 2750-1469P.txt file - cDNA_ID_3079647; gDNA_ID_2214645; Annot_ID_188486
aaacttttaatttgtactatttggctttccaggacacgatgaatcatacaatccttctttggaatatattccaacagaggaggagaaagcctcatatgagttgatgtttgaggaagatcgtccaaaattcattcctacaaggtatgtaacagtttcgcttattctactctaatgtagtttctttggtatttgtccgctgagcgtttcagtaaatatatctgcgcataggtttacatctttgagaagcatccctgcgtatgagaatgcactgaaggagtcttttgagcgttgtttggatctatacctatgtccaagagttcgaaagaagagagtgagtacttatcatctcagtttttggtttcttctttgtttttcccgtattttttcttacattatgtttcttttctccagataaacatcgaccctgaatctttgaagcctaagctacctagtaggaaggatcttagaccttatcctaactcctgttatcttgaatataaaggccatacaggggctgttacttcaatatccactgatagttctggcgagtggatagcctcaggtatttcattattttttttttttttcaatgaggtctcttttgttttcaagatgctaatcttgtattcttttttccttcaaaggttcaactgatggatctgtccgtatgtgggaagtggagactggtagatgccttaaggtctggcagtttgacgaagctatcatgtgtgtggcttggaatcctctttccaggcttccagttttagccgttgccatgtgagtgaggatcttgtgaatatgcttttgaatttattataattgtctgttgtgaaaccttctcatctcacattgcaggggacgagatttgttttttctgaacactgaacttgggactgatgaggaacaggaaattactaaagagaggcttcactcaggaaacatcccagaaccagacgcatctggtaagtggcttggaataactgccatcatctcgtatgtaattgtgatgaaattccaaatgattaaatctttttggttggtatgttttgcacgacttcatagttgcagcaattgtaacctggctacctgatgagttatatggagggattaagataagacattttaaggtacacttttgcaaaagattctccttttaacagttattacataaggaaaatcttaaactggtttgtttactttcagagcatatcgtctattgactggcatcgtaaaggagactatctctcaacagtgatggcatccggggaaacacggggagtggtattgcaccaactgtcaaaacagaaaacacaaaggctcccatttaagattcgtggacttccagtctgtacactttttcatcccagcctttcttacttcttcgttgcgacaagaaaggacgtgcgtgtttacaatcttttgaagccaggcgaggccaccaaaaagcttgagacaggattgagagaaatctcatcaatggcgattcatcctggtggtgataatctgatagtaggaagcaaagaagggaagatgtgttggtttgacatggatctatcttcgaaaccatacaagactctcaagaatcatcctaaagacattacaaatgtggcagttcatcgatcatatccgttatttgcttcgtgctcggaggattcaacagcttatgttttccatggaatggtgtataatgatctgaaccagaatcctctgattgtgccattggagattctaagaggtcattcttcaaaaggaggtcagtttttacagtgtatttgattcttacaagaatacactatcgcatattaacttgtaagatcgtttatattaatgtgttttgattattttttatgactgcaggagtcttggactgcaagtttcatccgagacaaccatggctattcactgcaggcgctgactctattatcaaactctattgccactagattggtcgcaaaccatattttgacaattttcatctcttttcttctttgttgtattcaccacctttactcaaatattgtatcgtacaattttgttatactggatttattattgagatttctaacttgtagcacttccaaaatggtaaagtccaaaatcttattgtatcgatttatttggcagcgttggttaagttgtggcaagtccttaaacccaaatgttgatttgatagttttttaacgttcactcacaagcgccacgtcatcaccgaaatatctgaaatatctaataaaggcttcttctttcacaaatcccaaacctttttttttctctgctaacgaaaaaagccatcttctttgctactactaatctactattacactgaatcgtttgggttcttcttcttcttcagctgctactttgttcgagtgattgctgacatgccgtcagcgtcggagattgttgacaggtttgtttgtccgttttttttgtttttgttttcccgcttgtgtatgtgtgctaattgttcattgttaaagattttgtttttacaggattgttgttgtttttgagtggtatcaagttccttaaagtaacttcttttgtttgtttagtagttgaaagctagaaggttttcactttagggtttttggggtttttcgtagacagaaatttgttaattttgggcacaatttgtctcttttggattacgttctgtgcgatttgtggcttcgagttcgtgtggggttaagagacttggaaattagaggatctttagctggaataaacgttaaatgtggtacctttcctgagtttgctctgttctaattgtggtcgtgatggggtttctttttattcgctgtgatgctgcagattgtgaaaaattcttgtagctacttcggtgttggtagattctgtgatgcttaaaaattgtttctttgaaggtgctttgatcccaagtatagttgaacatgttgctttaaatcttgttaagagaaaaaatgggacttgcttctgtgcccaatagttcacgagcatgttgctaatcttgcttctatg

SEQ ID NO: 34561 - DNA, 3000 bp, Unknown; identical to SEQ ID NO: 6150
  misc_feature (1)..( 3000): 2750-1469P.txt file - cDNA_ID_3079659; gDNA_ID_2214645; Annot_ID_188481

SEQ ID NO: 34562 - DNA, 3000 bp, Unknown; identical to SEQ ID NO: 6150
  misc_feature (1)..( 3000): 2750-1469P.txt file - cDNA_ID_3079659; gDNA_ID_1620849; Annot_ID_170293

SEQ ID NO: 34563 - DNA, 3000 bp, Unknown; identical to SEQ ID NO: 6143
  misc_feature (1)..( 3000): 2750-1469P.txt file - cDNA_ID_3079662; gDNA_ID_1620849; Annot_ID_170292

SEQ ID NO: 34564 - DNA, 3000 bp, Unknown; identical to SEQ ID NO: 28158
  misc_feature (1)..( 3000): 2750-1469P.txt file - cDNA_ID_3079667; gDNA_ID_1620849; Annot_ID_170289

SEQ ID NO: 34565 - DNA, 3000 bp, Unknown; identical to SEQ ID NO: 6149
  misc_feature (1)..( 3000): 2750-1469P.txt file - cDNA_ID_3079672; gDNA_ID_2214699; Annot_ID_189611

SEQ ID NO: 34566 - DNA, 3000 bp, Unknown; identical to SEQ ID NO: 6149
  misc_feature (1)..( 3000): 2750-1469P.txt file - cDNA_ID_3079672; gDNA_ID_1620849; Annot_ID_170281

SEQ ID NO: 34567 - DNA, 3000 bp, Unknown; identical to SEQ ID NO: 6158
  misc_feature (1)..( 3000): 2750-1469P.txt file - cDNA_ID_3079731; gDNA_ID_1620852; Annot_ID_50999

SEQ ID NO: 34568 - DNA, 3000 bp, Unknown; identical to SEQ ID NO: 6170
  misc_feature (1)..( 3000): 2750-1469P.txt file - cDNA_ID_3079737; gDNA_ID_1620852; Annot_ID_170353

SEQ ID NO: 34569 - DNA, 3003 bp, Unknown
  misc_feature (1)..( 3003): 2750-1469P.txt file - cDNA_ID_3079737; gDNA_ID_1620520; Annot_ID_159442
tactatacattcaaacttatatatcaacacacatatatgatcatttgataacacctaccatttgtgttatacatatattttatagagaagttatagaaaattatactgagtatacatctatgtgtcatcgaaataagctgataataacgaatacacgttttctttttatgtctggagtagaatacagcattcatgcccttacgttgcaggttcccatcattttacaaatattctcttctcttttctactttctcttttttgatgtaatacgatctatttatttattctatatttcactatatatatctcagatgtccaacgtttcagtattgcattgccactcgaattacctaagataaaaacgaattatcactttgatttttcgcacttatagttaaatctattctcaaaatttaaacaaacatgcagaggcaagtggcactcatcaagcagtccctctttgatcaggttttggtcgtttgtttcttcgtattttcgtaatataacttcgtacgtcgtaccacttatatatgaatttcttcatataatttagaaaatgactaatataggaaaatgcatgcagggatatctcgacgaacaattcatggagttagaagagctccaagatgatgcaaaccctaattttgttgaagaagtttccgcattatacttcaaagattcagctcggttaatcaataacattgaccaagctttgtgagtattattttgttttctattatatatatattttttttttttcagttttctaatcatttttacaatgcagggaaagaggatcatttgatttcaatcggctggatagttacatgcatcagtttaagggaagcagcacgaggtaatttccccccttagtttttgactattctaattacgccttcaagaaataattttacttaaagaaatgcgaatacttaaatgtttataagataaaagaatgtaacgcaaaagtacattaaaattacttccattctcattcaggattcaatgacagaatctactttaaccagaaataattagattttatgatcgttagttatactgacaaatgttgcatttcttttttttgtagcattggggcaagtaaagtgaaagctgaatgcactacgtttagggaatactgcagagctggaaatgcggaagggtactttcgtctttatacttatataccttcatgcttctcgtttttaacagaaaactaagtaacggggtcaaaatgaaaataagtatagtttagatggctaaaattgctgcaattaatccgctgaaccttgaacttttactttacttcattttcgaccccctaattagttttcttcgctttttcttacttgcagatgcttgaggactttccagcaactgaagaaagaacactcaacgttgagaaagaagcttgaacattatttccaggcgagccaataatcaattatgcttaataatttacataattagaatgtgattagaagttatcatcaatcacttttgatatagtatttgctgaagtgaaattttttgtaatgaacagttggcaaggcaggcggggcctaaggagacagcacgtaggcccaagtaagagagaaagagagagagacagagataaatgaggaatcgtcgtcgaattttgtagcaaaactatataataaatagttcctctttatttttatatatttcgatgtacgttataaagaaggttttggacttttatattatgtccgttaataaacggtccaaatgtctctatgtttttccccttatatcgccaaattttcccttgggagttttatagctacgattacctcgtaacatatggcttcctctaataacggaatacagaaaagagtggaccaaaaaaatgcattttttcgattctatgatgaatgcattaccttgtttacaaaaggaaaaaaaaaagaaactaagctttacattattcggtttgtttccaggaaccgtgtccaaatcctaaatattcttacctatttttatatcattatgttaatatttgtctctactagtactgattaataaatatttaaaaaagaaaaaaaaaaccaaaatattcttaggtaaaagtctaaaataacattatcattatgttactatttgtctctactaaaactaattattaaaaaaaaaagaatgccatggcttagatgcaaactattcttagctaaaagtctaaaataataacattatcataaacaattaatattacacttttccatctaatttctcttacatgccctatttttcaaacgatgtcgtttaagaatatcacatagaccttctatttcatgaaaaaactaactcaccaatgcaaataaataaatcaaatgtttgtttgtggataaagtaaaacgttttctttcaatggcccagcatttactaaaatttatttcaagttcttccacgtaaagtctacactacatacactcatacaggcagtgtaacgctgattcgtagagctggagagtatcacaacaataaatttctcttccgaaagaaaacagcctaatattagggagatatttacatactctataagatgttctttaatctcttatatatattacatatgaaagaattaattgtttaattattatccaaagcgacgtgaaaccactctcatttattagccctagctatatctcacaacctccatcttccttactttaaaaacacagaccagatcctatttatagcatccatgtgcgccattgaaaggtaaatttatttaataaagtttacctataatatcaaattatgcaaaacacaggctggttcagttttttccacgaatcaaaaatggttggagaaatattgaataagagagagagagagagagagagagatagagtttcagagttgacacaacattgaagtaaactaaactcctaacctctttatctatgtgtatatataaaactcaaaagtacatataatcttcaccattcacacatagtcacataccaaagcaaaaacatg

SEQ ID NO: 34570 - DNA, 3000 bp, Unknown; identical to SEQ ID NO: 6158
  misc_feature (1)..( 3000): 2750-1469P.txt file - cDNA_ID_3079746; gDNA_ID_1620852; Annot_ID_170344

SEQ ID NO: 34571 - DNA, 3003 bp, Unknown
  misc_feature (1)..( 3003): 2750-1469P.txt file - cDNA_ID_3079746; gDNA_ID_1620607; Annot_ID_161812
ccaaaccaaatttgactaccatccgtttgcaattagaattcaattttcctttcatgttactatttcaaacagaaacatgccaaaaatggaacttacctcattatgtccgataactaaccgttatgctactccttaagaaacgtgtgctactatcatatcattaatacacaaattcaactcatttgcttcatattcacaacaatttaatagtttcacgtatcgtggatatatcgcgagattatacaatatcttctattaattaattgctggcatgattgtaaaaaaaaaaaaaaaactgctggcatgtattcaaaaaaatcaatatatacccccatgcagttcttcgtagatggatcactcgactctttctatctatctcttatcaggtcaaatcttattctctcatatctgatagtatttttgtaaatattggttattaaaaaattgtgttcgtaattacaggtaattcgaaagacatcaaaagcaagcaaaagatggctcaaaaggtggaagcacaaggaggtattggaggagatgtatgggatgatggtgctcacgacggcgttagaaaggtgcatgtagggcaaggccttgatggtgtttcgtttatcaatgtcgtgtacgagaatggttcacaggaagttgtaggaggtgaacatggaaagaagtcactaattggaatcgaaacggtacgtaaaaatgttttgcttcgaatccactaatcttgtctttattttgcttaagtttatattatatgttcttaaaactactaaactctcaatactagggatataacgttatgataggataatagctcgcggaccatccaattagccatgtttagaatttaggtcgtatcagttctaatgattaattatagttctaaagccaaacctaaatattaaaaataagaaccaataattaccagaccaattgacgccttatacgtataattatggttctaacaagccaaacctaaaccttaaactattactcaatatatctttctatttttgcagtttgaggttgatgcagacgactacatcgtagcagtgcaggtgacctatgacaaaatatttggctatgactccgacatcatcacatccataaccttctctacattcaagggaaaaacctcgccaccctacggattagataccgaaaataagtttgtactcaaggaaaagaacggtggcaaacttgttgggttccatggacgcgctggcgaaattctatatgctcttggagcgtattttactacaaccacaactcctttgactcctgccaagaaactaccggctgttggtggtgacgaaggaactgcctgggatgatggtgctttcgatggtgttaagaaagtgtatatagggcaagcccaagatggtatatcggccgtgaagtttgtgtacgataagggcgccgaggatattgtaggagatgaacatggaaatgatactctactcggatttgaagaggtataatacttcttgctttcttctcttgtggttgaatgtgaaatgtttttacaaaatgatatgaatatcttacacaaaaatatgcttgggtaagggaatccacataaactttcgtggataaaatcatgcatattttatattagctagtgttgaatatctccatttttgatataaaatattttaactaactcaattgttttatttggtttccatcaattgcagttccaacttgactatccaagtgaatatattactgcagttgaaggcacatatgacaaaatatttggttttgagactgaagtcataaatatgcttaggttcaaaactaataagaaaacgtctcctccctttggaattgaagctggcacagccttcgaactcaaagaagaaggttgcaagatcgtcgggtttcatggaaaagtaagtgcggtgcttcatcagtttggagtccatatccttcctgtcaccaactgatcatcacatatatatatatatatatatgtctcttctataccaccaagtttgtcacgtgtgatatcttcattaagttttaagttttctaatttttcttgttctgtttatctatgttttaagtgtctttaagtatggtgttttgtgaagttgttatgcctgtaatattatatgtgattggctttaataaaagtgggtgattattatacatatcagttgcacattaggagaaaagcttatattcatactcagtatctcggcatctagtgtatgatggaaacaattatctttaagactttagcattatttaaagtgagaaacaagaaaacttcgccataattggagaattggtcattttgatcaaaatccaacaccagactacgcgcagtccgtttcgaaggaggtacactccacttagtatctagatttaatttattatacagtatgtttaattttttttttttttcaaacacatatttttcttcttaagaatatatatggaaatataatatgttaattatgtaatgatcaaataatattaaaacacacatatatatatatatataaaccatatgagcaattggataacgggtaaaatctaaccaggtttcaaaaattgtaactattgttgatttttttttttttttgatcaacaactattgttgagaaaaacatgtattatgtgagcaaaggaaaaaaagggaaaaaaaactacagatcagtaatatcaactactccaattcaacttatttgcttcatattcacaacattctaatattttaatgactcgtggatcacgagattatattaacatttctatagattaattagtggcctacattcaatgatatcaataattacacattttatccagaaataaaaataatcaataaatacgcatgaaggtcattgtaatgcatatcaataactcgttccctctctcctcaggtaaattctcagtctctcgtctgataatagttttgtagagtttggttaataaaactaatcgtgtacgctactaatacgtacaggtaactaattaatattcaaaaagatg

SEQ ID NO: 34572 - DNA, 3003 bp, Unknown
  misc_feature (1)..( 3003): 2750-1469P.txt file - cDNA_ID_3079748; gDNA_ID_1620852; Annot_ID_170343
aatcacacaaacagttaaattccattataaagtcaccctcatggcttaagaaaaagaggtggaacttttaagtgacctacccgagattccagattcatcagaatcgcagattttgttgctgctttggcgcgatcaagatgtttctgattaactgccaaagcatgtacaccagagtaaataatatgtctgtatgagttgataaatggttctaaaaaagaatggatgaaatatatagaaaaccttttccatcagcaacagcgttcatttcactagctactaattcaattccctgtgaagcaaattcaggactctgcaacgccaaaagaatgtaagcaaacccacattgcaaagtgctaaaaaccgttaataagcaacaactagaaatcggtgcaaactcaccgtgcaaccatagattccaaacaatccggtattgttaaagacgctagtgaatgcagtgcatgattgaaactgctgatgttggttcaaaaggcgaagatctgcatccagacaataaagaaaccaatctcatcatcatcatgaccaacaaataactaacttacattaaaacatgagtgttgaaaaaccgcaagtagaaagagaacacattcagagacttacagagccaagagtgcattccttttccagggcctcccgcagaaaatgagccacctcctcccataagcatctgataagaattggattttacacaattaagtctttgcgtttgaaagatcaagtaatgtatttgagtcaggcacctgaagaacagttgcaatgatagcttccttctcgttattccatcctggcacttcaaaagcaagcgcaaaatgtgtagcctgagaatggtgaaacaaaaaaagaaagatattaggaataataaaccttcttttactcaaagaagcccattgaaacgtcatatttgtacctctccacccgtatgttgacggaaatctccaccgacatattgagactttggctccgcaggtcggggtacattagggaggtcagatagtaatggctcaaccacttttagaagttcttcatgatcaactccactagctgctaggaccattcgtgaagcagtgtaattctcctgaaatttcagaacaaaatgagaaaaaagacacatctacgaaataacaaaccaaaagccagtgatactagttccagcgaatgcaataatctcttgtgttaacggtcttacaaaaacaaaattctccaagacctccccagtcaatccagtaattgcagattcaggtgcatacaatggatttgccaatgcgccagagtaaccagcagaatgaactgcctccaaaagaaaacccattggattcgttgcgaattctcctatctctactttcacctttcggagctgccaggagaaaaatgatgaaaacagtgtaaaaaaattgcttagctttaatgtttgtgagatacatgcaacatgacatgaagtacctcttcattcacttcccaatccaaaaaagcagggttcctcacactatcaataagcacttcaaccatttcgggaacataggttttgagagcatcaattgtgtaacccatctgctctcgggatgcagaagctgaagtattacctccaatagcctctatttcccttacaaggcgaaaatggcttctgttcaatgtactcttgaatgccatcctttcaagcaagtgcgtcgctccacggaattgaggagtctcataaatagaaccacagtcaacgtataaaccaatggaagctgctggattctgaacaaaatttcactcaaaatcactttccagtagtttttaacaggaagttgatgttgggattactaaaagaagctctcaccggagacatctcagtggctatagtcagaccatttggaagagtagtggtcttaagtttgctaggctcaacatggtcagagagtggtggtggaagagagacaccagccaagggaatgttcatagaaggaagtgaactagagtagcctccacttagccagctggaggaagaagagctcgttgcaacagcactagaacttgcataacgagaagctcgaaaattgtggtttagaatgccctataaacacacacacacacacacacatcctaagcatcattaatctcttgattcaattaacattgtaaaaataagaactttcgaaacagagacatttcataaacctgcaaaaagcatgaataatggcaccagctactataaagcgataaaattgaatcaagatctataagaatctaagagaccctttaatccaaatccaaaaacaatgaatcatacaaattgttcaatactaagcattctcctaaaaaaaccagaatctcaatggaaacaagtgaagtaggacattgaccttaagggccttggctcgagaagctgccgtacggtacatgatgatgactgcgaaaccctagcttggtcagatgagtaccggtgaatgtggctgacgacgggagagagatagaggccgagtcagagctgaaaagaaacgagagaagggaacgattttttttcctaattaaggttattggatcgggcaattgcttctaattacattgataggcccatatgatataatagtcttggcccaaattataacatatagaaaagatgaatttaaagcccatgtattgtagtggtgtgatcctattatattttctctcaattatattttttttcttttctttttcacgtaccattgtgtaaaaattcaagtaaggtaacgacatttacatgcagtcacaaatgaaacaagaatttttttgaggtgtgtgtaaagtgaaacgaaaaaagtactaagaaagtttatcttctctaagttaatagaattattttgaaacgtagtatccacatatatagaagactcgtgtgtggtgcatatatatactgcataacttcaattgaactgtattatataactatgactatccatccatgggaagataagaatgagagccgaatgctaaaaagcaagggacccgaattaaacaaaaatg

SEQ ID NO: 34573 - DNA, 3000 bp, Unknown; identical to SEQ ID NO: 6189
  misc_feature (1)..( 3000): 2750-1469P.txt file - cDNA_ID_3079760; gDNA_ID_1620863; Annot_ID_170395

SEQ ID NO: 34574 - DNA, 3000 bp, Unknown
  misc_feature (1)..( 3000): 2750-1469P.txt file - cDNA_ID_3079768; gDNA_ID_1620422; Annot_ID_156627
gcagcaggagtgtttttcccggttctgcgggtgcaattaccgccttgggcagccggagcatgtatggcactctcttcggttagtgttgtttgctcttctttgcttcttagaagatacaagaagccaagacttaccactgttttgaaaatcaccacggagtaaaaagtcctttgttttcttacattggagtgactcgactacttttgttctgaaaataatttgtatttacttttcttttgtgctgttgttgttgtaatcatgtaacaacgatattggtcttggagaggtttctttttttctgtaagaaatgtgtcctctcggcctttgttgtaaaaaaatggtttcgatgctttgtgctcgattattaatgtaaaatggtgaaagtagtgaattcctctaatgtgactataaaatgatatttttatctgataatcgaatacagatttaacacgacatattgaatttagaattgttctgaattttgcgacatcaattattattattatgtaagaagtaagcaactatagcttttgccaatctttagcgagatttccggtttaatatacctaaggtttttgcttcacgagtccattgaagtccaagattaattatccattcaccatcttagtgactgtttattgggagttgattttcgtatcagaccgcactgaacagcagttgtagatcatttttgatctttcgtttcttgttcctcacattccatttgtttcttctttttcatcttgtgtaggagtggttagcttacgtgaagtgggataccttctgtcttaattttcaagtcaaagatcttaccaactttttcttcctttgtacttgacgactcatacatattcttcttcgttctttcaatttgagacttcttctccttctttggtcttcttgtcaattggatgattgagtagagaatcaacttccaacagtaatcaaatgcctcaaagtttacaaagttgcattgtgcttccgatgattgttggactgtcaagatagtgtctccttcgaccatgttcatagtagagcacatgcatagatcaaattcgtgaaagctgatttggcatctgcaaagatcaaagtgatacctatacctataagtattaaccaccagtcaccagatttaacattgttagagaaaaacttgtatatattcatgatgtatatctaaatctaatcatcaagaaagtattttgatcaagtcaaaattacagaattgttttgttatttgaatacaccaaaatttataatatactagattaggacttgcatatctattaacatgttgaatattgataagtacctcatttaaaacaaaatttcagttatacgtggttaatttcgcaatacaacattaagaaaaaaaatcacatttcaatatcataaacttaatatcaatcaataaaagccaaaacatttcatatcagaatagtataagtatcatatcaaatttacgtacatacatagttagtattacacaaataataataataataataataataataataataataataaataataataataataataataataaaaataccatgagtacagaaaatacaatttgacatatcgacacgaaaattagaaaacaaacatcatcttaaattaatttttgtcggcacctcataatctcatgactaataagtaataatgataccacgtgtcacatcagtaagaggcttataaatatattaatcttttcatgaaccagtagaaaatttattcccatgatctcattttgtttattttttagtttcctttttgtacaaatcaaaaacactatggtacaatgctaaacattctaattttagatatatataacttaaattgttattttatattgttacactcattgtttttattgcatattcatgtgtaagtgcatggaaatattaaaaatttgaaaaccttattacataaaattgagtactcaatctagtctctcttataagtagacaatgagttcaaaataattaaatcaaatatagtaaaaaataaattcaattccaagatttattaatatagttttcattcgcatgacaatttgtttcgctgtttagcctacgaaaataatcaaactttaaaattagtaatgtaaagtttgcaaatttgcatgcctagtcttatcaactcttcgaaaacatgtttgaatttgtcatctctagtgagaagtgtcaagtatggtgttttgaggcttgcgacattcacatcctttcatatagatttttctagtatttttcgaaattcgaccatacatcgatgagaaacttttctctgacactcatgtcacacttcagaaaaacatattattgtattatttgattgatatttttggttcaaaattttaaaaaattatgaatgtaaaaactaaaactaaataatcatatttgaccaactgaatgtggaaattatatttgaccaactgaatgtgaaaattaaattttatgaatgtaaaaagtgaaacaaaaaatttattaaagtcaaaatctcgtccgagctcagctgaatgtggaaattgaatttaataattagagttgcatcaattgcagttataggtatttcacatttcataaaaagcatattataatatcaattggcttatctttttagttcaaaattacatgtttatgagggtaaaaaataaaatacaagtctcggctaagtttgatatactacaaaatcaactaaaatttcgtcataaaaaaaaaatcattgtggtcgtatctttaggttaactgtgtataagtgaataattaaggataaacgtcagattctaggccttttggaataacggcccaataattattatttgggcctgttaatcacttgtttccccttaaacctttggcgcccaaacaaattagggctttatcttatcttcgcgattctctcatttcctccctctaaaattccccggcgacacagttcaccggaaatcgtagaataaatcagattctttctctttagtatgaaacaatg

SEQ ID NO: 34575 - DNA, 3003 bp, Unknown; identical to SEQ ID NO: 20985
  misc_feature (1)..( 3003): 2750-1469P.txt file - cDNA_ID_3079768; gDNA_ID_1620863; Annot_ID_170391

SEQ ID NO: 34576 - DNA, 3000 bp, Unknown; identical to SEQ ID NO: 6185
  misc_feature (1)..( 3000): 2750-1469P.txt file - cDNA_ID_3079771; gDNA_ID_1620863; Annot_ID_51283

SEQ ID NO: 34577 - DNA, 3000 bp, Unknown; identical to SEQ ID NO: 6192
  misc_feature (1)..( 3000): 2750-1469P.txt file - cDNA_ID_3079771; gDNA_ID_1620863; Annot_ID_170386

SEQ ID NO: 34578 - DNA, 3000 bp, Unknown; identical to SEQ ID NO: 6205
  misc_feature (1)..( 3000): 2750-1469P.txt file - cDNA_ID_3079790; gDNA_ID_1620864; Annot_ID_170432

SEQ ID NO: 34579 - DNA, 3000 bp, Unknown; identical to SEQ ID NO: 6200
  misc_feature (1)..( 3000): 2750-1469P.txt file - cDNA_ID_3079801; gDNA_ID_1620864; Annot_ID_170409

SEQ ID NO: 34580 - DNA, 3000 bp, Unknown
  misc_feature (1)..( 3000): 2750-1469P.txt file - cDNA_ID_3079817; gDNA_ID_2684600; Annot_ID_193191
tccgaactgcaacaccgataaacttagtacgctttatttctatgggattctgtaatataatagttctgctaaaactttggtttctctgtttaatgaacagagatttatcaaataatgatttatcaggagatattccaacattttttgctgagatgaagtcgttgaaactcatgtgagtttcttttcacatactctctcagtctttcactgcacttattgttttgctttgaaagatttagtcttttcattcacagaaacttaagtggaaacccgaaccttaatctcacagcaattccagactctcttcagcaaagggtaaacagcaaatctttaacactaatgtaagatgaccacactcctctgaacagtccttataagttatatgtagtgctacaataactctattctaatctctttttttgttttcttttctgttttccatcatttttaatgattacagtttgggtgaaaacctgactctgactcccaaaaaagagagtaaaaaggttcccatggttgctatcgcagcgtcagtggctggcgtgttcgctctgctcgttatcttagccatattttttgtcattaaaaggaaaaatgtgaaagctcataagtgtatgaatctccaccaggtcttgatattagtgaaaaatgaaaacttttgctctttcatttcacatgtttttatcttattttacagctccaggaccacccccattagtcactcccggtatagttaaaagtgagacaagatcatccaatccatcaatcataacaagggaacgcaagatcacgtatccagaggtactgaagatgactaataacttcgagagagttcttggcaaaggaggctttggaacagtgtatcatggaaacttggatggtgctgaagtggcagtgaaaatgctttctcattcatcagctcaaggttataaagagttcaaagcagaggtacttcaagaaaaaatggttttgttaatccttttttttaaaatattactttctcagttatgaagttgtcatgggacactttgatatctttcgtaggttgaacttcttttaagagttcaccatagacatttggtgggacttgtgggttactgtgatgatggagacaacttggctctgatttatgaatatatggcaaatggagacctgagggagaatatgtcaggtaacatttttaatttagagactgatctgagtttttttgccaaaaaaaagagactctgatatagtcgaatcttccgtggtttaaaaataaaataggaaaacgtggaggcaatgtccttacctgggaaaacaggatgcaaatagctgtagaggctgcacaaggtgaacaaagttttgacttattctctctacctttgtttgactcattaccaaaaaatattgtttcttgatgttcattttatgatgtatgaaagcaaactctacataagcaaacacattttgtgacagggctggagtatctgcacaatggatgtaggcctcctatggtacatagagatgttaaaactactaacattttattgaatgagcggtgtggagcaaaactagccgactttgggctctcgagatctttcccaatcgatggcgaatgtcatgtttcgacagtggttgcgggtacacctggttacctagacccggagtgagtgagctcaatcaaattttaagagttgtgttgttgaagccaaatacttatatgaaatttatattattcatcttatattattttcaggtactacagaacaaactggctaagcgagaagagtgacgtgtacagcttcggtgtagtgctattagagatagtcacaaaccagcctgtgatagataaaacccgggagagacctcacatcaatgactgggttgggttcatgctcactaaaggagacatcaagagcatcgttgacccgaaactgatgggggactatgatacaaacggtgcatggaagattgtggagctagctctggcctgtgtgaacccatcttcgaaccggagaccaacaatggcacacgttgtgatggagctaaacgactgtgtggccttagaaaatgcaaggcggcaaggtagtgaagagatgtactcaatgggttctgttgactatagtctctcttctacttctgactttgctcctggagccagataaatttgagaaattcttttatgtgattttatgggaaagcaatcttgttgttattttgtttctttgtgtatttcccaatgtatgttttgaagaaacaatgtacattctatcttcgtgggtgcaggtgttttgattactctgttttgaaactttttgtgtgttactatataaatatttttcttaaaaggattaattatgtaatactctttattttaatttttacgtattaatgcatcaagctagttaacaactagtgacagctcaattttcggaatcatacacatttagaagtcaagggctgactaaaatcattggaggttgcattggcatgcacaaacattacaggccacgcccacattgatataggagacttctcaaacatgatcgttgacttttgacgttggattcatccaggacgccaaagacacaaacaaagagacaaatcaaccaacgaattgccatacaaaagtcaaagtcaacaaattcatgagaacatttgtggattaatagtaataatacaccgaaattacattatgtggattgataatacaccgttgttttgagtttacttatagtcaacggtgttttttgttctaaagaacataacaataataactcttgtcattgttgacgaaaaacaaatactacttcttatatcattttcactcaacttgctctatcgaatcattttgcatcgtgaaaacatattctcaatcaattaatttattcaatttcaattatgttataagcagttgacttggacttttgagtagtatagctcatatagtcatattctcatatgcataacttgctatcttaaaaaaaagctctcctgtggacagtaaggagaacaatg

SEQ ID NO: 34581 - DNA, 70 bp, Unknown; identical to SEQ ID NO: 56
  misc_feature (1)..( 70): 2750-1469P.txt file - cDNA_ID_3079817; gDNA_ID_1860; Annot_ID_145390

SEQ ID NO: 34582 - DNA, 3003 bp, Unknown
  misc_feature (1)..( 3003): 2750-1469P.txt file - cDNA_ID_3079825; gDNA_ID_2684600; Annot_ID_193189
atagtgacgaagaataaaaaatttacgtatgcggaggttttaaccatgacaaacaatttccaaaaaatccttggaaaaggaggatttggaattgtatattatggttcagtaaacggtacagagcaggttgctgtgaaaatgctttcccattcatcagctcaaggatataagcaatttaaagctgaggtattcataccacaactcataatggaattttgtgtgaaacattccagagtttctttcaaagctaatttggtgtatcattatggtacgttaggttgaacttcttcttagagtacatcacaagaatttggtaggccttgtcgggtattgcgaagaaggagataaattggctctcatctacgaatacatggccaatggagacttagatgagcatatgtcaggtaaacataatatttgtttttactagaaaggcaacatatttggttttcataacaatacatcatggtgaaactataacataccaaatggtaactctttaagaaaaagaaaaacaaataataactcagaataatatatttttttgtcatttacaattcactcattagttatttttttgaatataattttgaatatttgtctattgaatgtaagaatctaacacacattagttatttttttaacaatacataggaaaacgaggtggttctatattaaattggggaacaaggctaaagatagctctcgaggctgcacaaggttcgtattgatttctcaaatacctaacctcatcatattctttctttgtttcttttgctttgactgactgaaactttgtgaaaataatatttttcataggattagagtacttgcataatggatgcaaacccttaatggttcatagagatgttaaaaccacaaatatattgttgaatgaacatttcgataccaaacttgctgattttgggctttcgagatcattcccgatagaaggggaaactcatgtatcaactgttgttgctggaactattggttacctcgatcccgagtaagtattacttcttcaataagaaaatatattttgtagatattttgtctccaatgattacgtaatattcttgcactttgaactattttatagatattaccgaacaaattggttgacggagaaaagtgatgtgtatagttttggagttgtattattggtgatgattacaaaccaacccgtgatagaccaaaaccgcgaaaagagacatatagcagaatgggtgggaggaatgcttacgaaaggagacatcaaaagtattactgatccaaatctccttggagattataattctggttctgtttggaaagctgttgaactagcaatgtcatgtatgaatccttcttcgatgacaagaccgacaatgtctcaagttgtttttgaactgaaagagtgtttggcctctgaaagctccagggaagtgagcatgaccttcggaactgaagtggcccctatggctcggtagaggtcctgattatatttcctattgtatcgcgtggatcattattttaccctatatatcctttacaactatcctaaattttgtgcatcaattttattttttgtaagcaatgaacttctaattacaatagaagttcaaagtcttttttcccccatgtttcagtttattccaactaaccatgaattaaataatgggtggtggtgcatgtttcttttaccaaaaataaccatgaattaataactatagcatttgcttatgacccttcaacttctaacatgcagagtgacctttgtatataagcagcgtcacctaagagatccagtcaccagtacggaaacagaagaaattcctgacaataaaagaagcaaactcacctcctagcttttcaaattacaaaattgatgaaatttggtttatagattctcttcattggggcaaatcatagaaatagtttggtcgacattggggcaaaacatggaatagaacgggacaattttggaaataacagattgagagcatcagcaacggcaacttctcaacttccgattctcaatatatgtgtgaacataaatataagtgtgaacacaaatattattaatatttaattggaaagtattttaattaaaccaatgattgaatgacaactgtgagaaacgttgtcgatgagtttttcttggtttctctaaagaaaactttcccttacctctctcctccttttgacatttttttcttattttattggtgagagattttatgagaaactcccgttggagttggtctgagtgtccttcaaacatttttaaaataaatatcacacattcacactataactgcttattctacttttaaaaccataaaatgattgctccaagccattgggaatataatcaaatatatatacttaatccaaaaggtacataaaatttggtgacaaaaatttactttttgttggaaaaagaaagtatctgagcagaatattggacggagcaaagaaacaagagaaggatatcaagtagcacaacttgacaaattgacaaaggatcaaacaagattcatatgttgtaataatctatagtcaactaaggcaacacattgcttacaaactacaaagtgaagtcattgtcattaatggttatcagatgattacttatgtccacataatatagaaaaaagcatatccttgacaatattgaagataagaaaattcaaggagaatctaaagactgattgttctttcgagttgacttagtcaacggttttgtggttccaacttgtaagctgtaattacggctgggcaaggtaacggaccactcttgtcattttctctcaaccaaatcattttacaccatcgaaataatatcctcattaaatgtgttccctcaattatttgattcattaatgtgacacttataagaatttgacttaggactttgagaaatacctcatatacataatcataaacttatatgcatagctttgctaactcaaaaaaaaaaacagatcccttctttgcatagtaaggaagatattaatg

SEQ ID NO: 34583 - DNA, 3003 bp, Unknown
  misc_feature (1)..( 3003): 2750-1469P.txt file - cDNA_ID_3079838; gDNA_ID_2684600; Annot_ID_193184
tttaataaaattaatattttttcaaatttcttaaatatacaagcgataaaattgagaaaaagtaaacttgtaatttttccaccaaaaaacataaacccgtgattttcccgccaaaacgtaaacccgtgattttcccgccaaaaatgtaaacccgtgattttcccgccaaaaacgtaaacccgtgattttcccaccaaaaacgtaaatccgtgatttttctgccaaaaacgtaaacccgtgattttcccgccaaaaacgtaaactcgtgattttcccgccaaaaacgtaaagccgtgattttcccggcaaaaacgtaaacccgtggttttcccgccaaaaacgtaaatctgtaattttcccgccaaaaacgtaaacccgtaattttcccgccaaaaacgtaaacctataattttcccgccaaaaacgtaaacccgtgattttcccgcaaaaaccgtaaacccataaaaagtggaatccgtaaatatcttaagtttgatgataatgaattaataataataattatttattattgttttttatttataattaattaaattattacttaaatgggttaactcatttaataactcaacccatcaaatgagttgggtcaacccataactcatttaaccctaaactcatttgattatgagttgagttgagttgggttacccattttgacatctctagtcattggtgatcagaattaatacttgactttctttgattcaatgtaaattaaaatgttacaatataacaacttgaaaaaaatattaacacatgaatacatatcattgtataagctccacgctcattataggctctataccacgtcatccatgtcatttctatcgaactgtagtcttggtttagtctggttagtgtctacttgcttcaatataaaataagtaagtcattaaacatatgaagcataataagcaaaaaatgacgtaaaatcatcctaatgtcaattatgaacacttgccttgggtttagaagacaaattactttatctaaattcatcagttgaattacttttggtcttttttgtgagatctaagaaaaaaagagaatacttttgaagactaacatgcatgcatattagcaacttaactaagaacttcatcaaacatcgctcaagatctaaacaacatctacaaactttaaaaacattaaaaagaagcagaaactgaaaggaaagaatagaataatataccttgtgtcttatgttttagatcttctcaatcaatcataattacctttcacatgtccacctatagcactcaccaagttttttattatttttggtcacatttttcagttggcatgagttaaatatagaacatagtaaaaatatatattttaaatagaaggaagagaaaagtaaatatttaccttttggaggacaactacaacataaatgttttgatgaaggctagaaaaataatagcggctcctgcacttcagcttgttattaccttaacagcttgttattaccttaagatgatctgataactaaactctaaacatgaatgatatattacctttgcgattgttaatgtttgtgtgaagtcgtgatggccttggtagcttgttattaccttgagataaattgtctttcattgatatttattcttgcttccatcatattgtgtgtcattagctagaaaaaacgtcactatttataacctatgtgaattaagtagtagggtttaaaaggatcatgaattttccaattaatccatacgttgtaatttatttattgaaactatacgttagcttagcaaaactatacgttacaaaagttgtgtatttattgtttttgactatattaaatatttctatttgtatgtttgatagtagtattatgttttgtagcagttgagaattgagatttttgtaaccttgaatatttctgtgtcatttttgtgttatcaatttaattttccctaatcccaacgtctatttgttgtgacataaatgttaataattgtagaagaacatttgcaacataaacgttacatgcatggtgttgtgtttatttctgacataaatgtttatttgagtttagtcatttggatcttttatactaaaatattataaatactattttttctgttttcactaaaaatataaagatgttatgatatttaataaatatttaaaaattaaaaataataattaaaagacaatcccaaagtaggtatgataatatttatttaaaaattcaaaaaataattaaaagacaatcccaaagtaagataggtatattaaatcatatttttagtatatatttttctaagaatattatactaaatcatatttttctaacaatgattaatatttttttttgttttaaagtaaacattatatactatagagattacaaatataatagagtgaaatagaaaaaatttagaatatcaaattaaaacttaatgaagaggacacatgtcactaaaatagagcgccaaatgtcgcattgttaggcaaagatagaaaaaaaccttgtcatattatataagatttcttacacaatatttcgtattctaataaaatttctttgggtcgtcaagaatgtttaaaaaaaaaaaatttttttttttttttttactttatgtgaataataaaagttttgatcctataaactgccaaaacagaaagagaaacattgtatttatgttttcatttataaatttccaatgaacagaaagctactacaaaactattggcttacagtaaaacatattttttctctcttgaaaaataccaaaatttacatgtcaatagtttttgcttttgaaacgatagccatatgtcagattagtaatgcgatctaatacaaaaattatgacagttttttttataaacgattgtgtcaggttcccggatgatgtgtatgaccgaaaatggtacccgatcttccagaactcatggacgcaagtaactacgaatctcaatgtaaatattagcactatttatgaactaccacaaagcgtaatg

SEQ ID NO: 34584 - DNA, 3003 bp, Unknown
  misc_feature (1)..( 3003): 2750-1469P.txt file - cDNA_ID_3079841; gDNA_ID_2684600; Annot_ID_193183
  misc_feature (1371)..(1420): n is a, c, g, or t
tttggattaatcatgtgaaaacacatgcttgcatcccaagagaaccctaacgacgtcgtttagtttgaaacccttggtcaaaacttttaattgatgccaaatagagtttatagtcatcactgagaaatcattatctgcgcacacaaaaatttacaaaaatatcaaggagatattggtttgaaacacaagataatttggttgaattaaaaataagaatatgatgatacgatctgaatgtggtttattgggcctatgctgggccaagattacttactacgttaagccttttatgcttttagattttgtattatataagctaaaaccagagttagtatgggaatcgaaaaagattacaacagtgaccttctatctctaagtcttcatagattctcagaccttcacactttctcttacaaagtattgattatgtccaaaaattatatggttctgtgtcatgcatcatcatcaatctattgtaatttgtaagattataaagtgatgttttgtttgtaagattgcaacatatcttaagcatataaactcatacatctcttcatttgattctccaaaagaataatcatatagagatttgtctctgtaactatctacttagttagactgcgaacgatcttttggtttagacaaactaagcttcttctaggcaatggcgacattcataaattgaaaataaagaaagggttctaagtttttattgtttttatcttccttggactagaccactaaagacttggctgtttccagcaagagtggcttcccattcaatggaagacaggagtatctgcgagagcgatataaccacttgcttcatgtttggtcttagaatcggatcatcatccacacattgctttgccaacgtagcaatctgtccacaaaattcatttacaatgaaataaatcatatggttactacatttttccaactactaattaagcatttgtttcttagtttaccttgaacaaacagtcatgcgggtataaatccatcatgttggggtcaacaaactccttcaaactcgacatgttcatagagtctggtgagttctttagcactgctaacatctgcaagaacaacaaaaaagggctttgcgaatgaatgttgcatcaaagaaagaagtgtaatggttcaatctttataaacaaactccaagaacttacaatagatgccaatggacgtctttctggattcttagttccaatcgcctccgttcttataacagcttctcttccggatataatttcgaaaagaacaacaccaaaggcgtaaatatcacttttcgaggtggcaagaccgtcgcttagatatctgcaaaagaaaagacagaaaagtcacagattgagcacagcattacgnnnnnnnnnnnnnnnnnnnnnnnnnnnnnnnnnnnnnnnnnnnnnnnnnnctatattatcagtgatcacaatgatatataataattataattaaaatttacaatttatcaattaaaactaataagtattgcattgaaaacctaaaaaattaatctttttaaaacaattttattttctaaaaaatcaaacaacaaaaaacagaggaagtatataaaaggtcacaagctatttaaagtctcaaacaatccatagtttgagattatgtcattttgatgaatgttaagttctcagatttattgatgggaaggtgtaattaagctgcaattatctaaattttttataaattgtattcatcaagcacaactagtgaaggctacagtttcgatctggtcaacggccgacttaaaccagttgcgaaatttcatgtatctaatagactagtacatataaggttgcctagacgttttgtccacttaatttttaatttgaaattaattcattttccagtctgatcattttaaacttgtattttcagtgactatctactgttttaaatagtaaacatctacattacatttttaaaaaccaagcgaacttttatactcttaatcaacgttaaatgtttttcttttatattgaatatatatagtatactgcttttcttttgacttataaaatgttatttattattctattgtttataaatcatgttatttaatgtagtttacttgctattatatatacaatatactaatttatgttaaaacacctaaaatattctaaaatgctcaaattctagctgctaggtggaggtgataccctgataggtctcctatttgaaaacgatatattttgtctaaaaacgttgaatgtaatatatgaactacttgtatgaagtattaaattcatcaagcacacaactagtgaaggctcactttttggtcatacaaattagaaacaaatacgaattttgactaaaataaaataatatcagcgaatatgtcggctacaccaaaatttcagcgtgtaatttttgagttgaaacaaaaatttatgtggaaggttggatcgtcaacggacggttctaaatatacgacaatttcgtgatggacaagctttcatcgtaacactcaagaccactaccaatgattttgcatgcggcattctgaatctttggttagttttgcacttcaagaatttgtgttttctaggagttgaaccccaaacctagagtaacaatattaatccttgaatcttgatcaactactggaccatggggatttccatgtttcctctgatatcttatacaacttcttattattattcttggttttagtcttttagatattcatttttaccttaccatcatattatcatatgtaatattatgaagacaagtactctcttcattgttgttaacagataagattttgttttttaaaacacttgttaatttctcgcaactctctctatcaaatgattttgtaccggtaaggaaatattctcaattatttctttattcaattctttaatcttataatgagttgactatgaattttgatcatatagttgtatgcatagtttggtatcgtaaaaacaaaaagctctcatgtggacagtcaggagaaccatg

SEQ ID NO: 34585 - DNA, 3000 bp, Unknown
  misc_feature (1)..( 3000): 2750-1469P.txt file - cDNA_ID_3079857; gDNA_ID_2684600; Annot_ID_193177
  misc_feature (1304)..(1353): n is a, c, g, or t
taataattttttaataaaaatgaaataatataataatatattgtgtgaatatttatttattacaataaaaaatagattaaagaaaatatatatacttttactcaaaacttaaatctagaatgagatgttatttctggtaatacatgaattttcatcataaaaattatttagtaatattacaattaatatagtaatatttttttattatatagttgttatcatattttgaaaattttaaaaagtttctttactccatgtttataggaaagaacaatgtcgatatatgtggtaaacattaaaataaaaccaataatatttaaacagaaatgaaaactgacaaccatctataattttctttatgagaatataagttatttagtagaaaataatctaaaaatacgtggaattagataataaaccaaaacctatatatgtgaactaaacactgtattaaacttttttttttatgataaaacatttttaaaaattgtattcaatgaaactaaaatccttagcaaaaattatccctgaaagaagaagaaaagatgtgaaaatttagaatacatttggaatacaaaattaccaaatatgaaatttagctagataaaaataaactcaattgaaaaaaaaagactgaaaataatttcttaaagactgaaaaataataataataataataattaagtgaaagacatttttttgttaaagatgagaaaacatatacacatatacctatacttgtagcactcacaaaaatgcaatgctaattttccaacgaatcccccaacaaaaattacattggctctgatttaccaatttgtttatcaactcatcaactttaatttcttttatttttagttagtgtcattccttcataatccatctaaaaaggagaaattcattatagttgttaaacgtatacaaccatccttggctaaaaatattaaagatatcctcctctactaaaaacttgttttatcacatagtatggaaagcatatgatgagaaagaaaaaaagagattataaagtataagaaaaaaaaactaacatgtgaaacacattgaatcatgacaaattatggttttctcggttgcaattgtatcaacgtcacccgcaaacacaacaacctcaagaatatctaaaacatagttcccgtatatttagctatgaaacattctaaataaaaataattcatatgtttctattgcaataatatcaatcccaccaacaaacttcgacaacttcaaaaaatatagaacatagctcaagaaaccctatttgagtcggtaatcagccccgtctnnnnnnnnnnnnnnnnnnnnnnnnnnnnnnnnnnnnnnnnnnnnnnnnnncgggtttggtgatcactcttaattaagggattttagtttttccttcaattacaaagcaacccacataaaatttgttttctatattattttccagatactacagaacaaattggttgactgaaaagagtgatgtttatagtttcggagtcgtattgttagagatcatcacaaaccaacccgtgatagacccaagacgtgaaaagccacatatagcagaatgggttggggaagtgcttacaaaaggagacataaaaaatataatggatccaagtctaaatggagattatgattccacttctgtttggaaagctgttgagctagcgatgtgttgtcttaatccttcatcagctagaagaccgaacatgtctcaagttgttattgaattaaacgagtgtttgacatctgaaaattcaaggggaggagcgattcgagacatggactcagaaggttctatagaagtaagcttgacctttggtaccgaagtgaccccattggctcggtagtttacatgaagaattcagcttctttttgaatttttgaatggtttcttctaaacaccatgtgagaataagtcatccacatataaccatacaatgtttttctaagttttcttactctcaaaattttgtgttcagcttgaggttaatcgaggtatcctagtggttaatcgaagtatacttcttcagtgattttttcaattaaaactaataattttacatagttaatgcaaactccttttcaatccgaacggtatcatgttttgagattgccgttttttttttttccattttcgtccgtcttgctcttgtaaatgagtaaatccatttttggctcccactttttccttttcttatggtttttcgggtgaacacgcataattttaattgatcatcctgacttattcatccatagcaagtatccacattcttcttccatatcataaggaattttttcaaccaaaaatccaacaaattatacatataaaatcattggagattgaattgagatgcaaaaacactatatatttttattttttttgttcaaagcaaaaacactatatatgatgtataaattcgaaagaattcgagtttcacatatacaagccttttgaccaaaaacacacactacaagctggatgatggttgacttctgacggtggagattcaattacgaaaacgccatatccatctagaacgaaagacacagaaagacagatcaaacaatgacgtgccatataaaagtcaaattcaacaaatctgtaagattattaactagaacttagaaggttatggtttaatgcacgtttcctttctagatattattcctagtttttcgacgtcgacaacatcaaaataaagcgtgttattttgcgttgacggtttagtggtctaaaattagtaaagtacatgagagtgttttcgacctcttgtcatggttgaccaaaaaactaaagagtttgtcattttctcacaacttgttctatcgaaatcgaattattttccatcctgaaaaaaaaggtctcaattatctatttatgtagctgacttgagacttttaaaagtggctcataaaaatcatatatccttatatgcatagcttgatatctaaagaaaaggctctttcttttggacagtaagaagaataatg

SEQ ID NO: 34586 - DNA, 3000 bp, Unknown
  misc_feature (1)..( 3000): 2750-1469P.txt file - cDNA_ID_3079869; gDNA_ID_2684600; Annot_ID_193174
  misc_feature (1541)..(1590): n is a, c, g, or t
atcaaacgctttcacatggaaagttttgaaacagcttcaatctcgccttatgctactcaagtcccagaagtacgcaaaatctagacacctacgtgctgatattgttgacttcatccgaagcaacgactccaagagtgcactcttccgaaccgaacagctcttgctcgtcgaaaacgcgattacaatctacggttttttgctcaagttcactgatttcatcctcctccgcttctcccccagtaaaaaacacagttgtttattggttaatgatgatacttccgaagcagtttcgagtctgatttttgcatcggtcaagtgtagagaaatacctgaactgctaattattagcgagctggttggtcaacgttatggtcaacgttatgtaacaactgctattcaggtccctcccgggaatcttgtaaacactgagatcaaagagaaattgaagtcaacttcagtagtatccgaaactgataagtgtagagtaatggaggagatagccaaggagtcgggttaccgtttagaaattctagggctgggatataaatctgagattgacaacgaggtgattgttttgttattataaatcaagatcagtacatatatatttttgtttttcttggtttcatatgtaatattttggacttttggtgtttaggtttttgacttggaagaaaagaacgtaatggatgagtcactacacgaggtgtataaattttgcctcaccgatgttgatgagagaagcaagaaagagacatcaatgaaagatgattacatagaacataagaagtctactagattgttggctgaaaatgcgaagaagtccggtcacagtttagaaatattaaggccggaatctaaacctgagactgaaaaagaggtgattttattttcttgttatataaagattcgtagacatatatttggtttttctttggtttcataatattttggacttatgtgtgtttaggtcaatgaagaggaagagaagagagtaatggatccggatgtggatattagttgttatgaagagtcaccacacgaggtgtataaatttagcctcaccgatttcgaagaagagataatggaagatgattacagagaagatatgaagtgtagaatgttggatgatatagtgaagaattccggtcaccgtgtagaaatatcaaggccggaatattataaacctgagattgaaaaacaggttttatttttttggttattttgtgattaagatcagttttttttttttttttttttggtttaataatatttgatcttgtgtgtgtttaggtatatgaaaaggaagagaagaaagtaatggatccggatatctatattagatcttatgaagagtcaccaaacgaggtgtataaatttagcctcactgatttggaagaagagataatggaaaatgactccatagaaggtgtgaagtgtagaatgttggatgaaataatgaagaagtccggtcaccatttaaaaatatcaaggccggaatataaacctgagattgaaaaacaggtgtgactcatgagtcnnnnnnnnnnnnnnnnnnnnnnnnnnnnnnnnnnnnnnnnnnnnnnnnnnaactaacaatccatacaacacaagataaattataaaacatcacttagcatcaatttgacactaaaataatttatgcaaagcagacataaagtgtaacatactattttattttttgttgtaactttggagtatataagcaaaaataaaaataaaatcactatcaaaagttccaaaatgtgatctgagaggtgtggtgggacagaaccaaactgtcttttgtcagtaacagctcattgtaactcagtaacaactataaaactcatcacatgctaaatcataattaatcaacctaaactgtcgttttctcaaatctttttgggtattattattactttgaaacgataaagcacaaaatcttctaaacttttgcttaattaatccatttctaaatgttgaccatatttcctaatccatatcttcttttttttttgttttgtttgtggagatatgtcattttcttctactttgtagccttttccagtttccccccatgttctgtttttttcaacacaacaatagatttcttcttagctctagattttactgtgtgcagttaatgctattcaatgcagtatctaatatatatcgattattatattaaaaagccagtaaaaaaataattctccctttcatttacacaaaaacttaatttaaatataagaatgaaattaataatttttttgtgaatctttaaaatatttagcttccaatacaattttaattaaacaaaaaacaagttcctaaattaaaaacgaagttcttaaactttcaaccaaaaaaaaaactacattctataacattactatttaacagataaaagagtaaattctcactaataaacaatttattagatttactaaaccaaccactgaacaccagtttttagaaagtagaaacacaaatatatttattcttctttgaccttgaaggcttgagaacagagatactgatcaacctcaagtctagacaatataatagtcacacataagtattaggtattaaaccaaacacataacctaattgactcctaaatgtctaattaattcacaaaaattccttcatataataatattaattttggattattatgattttcaatttttgacaaagaacatggtcttttggatattaaaaatatatattttggacatttcctcttatcaattaagattttattttagattttttcagtccgacaagagagtgtgcgcttcactccttcctcccatggctgatttcatctcttctctacttcttcctcttctccattaaccaaatcaaccaatacccatttctcaattcaccatatcttcatcaaatcaagattctttcttccttaatccctaaaaaaaaccttctttcaattctgattttcacttaggtttttctcaatttctacttcacacaatg

SEQ ID NO: 34587 - DNA, 3000 bp, Unknown
  misc_feature (1)..( 3000): 2750-1469P.txt file - cDNA_ID_3079882; gDNA_ID_2684602; Annot_ID_193201
gttacagttgacctcactgggtgtggatttaatatgactgacacaaatactgtctctaccttggaggaatattcaaaaccgttgatcgatctcctcgaaaatctccccgaagaagagaaggttagagcctgctctctttgtttattcagaaccatttgattggaggaatgaggcaatgagatacaagtttgttgtttaatgtaggttattctagtgggtcacagtactggaggtgcttccatttcatatgcgttagagaggtttccagagaaaatctctaaagctatattcgtatgtgcaacaatggtttctgatggccaaagaccttttgatgttttctctgaagaggtaattaattaacactctttgagttcatatctgtaatgtagtctttgtttctgtttcttcttgttgtgctaacatttgtgccaaactgtctacactgctgcagcttggttccgcagagcggttcatgaaagagtcgcagttcttgatttatgggaacggtaaagacaagcctcctacggggttcatgtttgagaagccacatatgaaaggcttgtatttcaatcaatcacccaacaaggtacactccaacatgctaattcttaactctgcatttgcacttggtaatcacttactgtaacttttttaaacgatatggtttatggttttgcaggatatagcattggcgatgatctcaatgagacctgtaccactcggaccaatgatggagaaagtatctctaaccgcagaaagatatgggaaagggagaagattctacgtccagacgctagatgaccgtgcactttcaccagatgttcaagagaagttagtgagagagaacagccctgaaggagtcttcaagatcaaaggaagtgatcattgccctttcttctcaaagcctcaatctctccacaaaatccttctggagattgcacagattccttaacaaagctctgagattattatacttttgaaaacgagaatacactttccatttaatcctcaaaacatcttttgtatgcaattctagaatcaatgatacaagatcgtatttataccatttgaagataaaagtgattgaatacacaaatggccctgtattatatagatacatatacaggaagaagaagaagaaacaacaagaagaggaatcgaagagaagagagaaaaggatctgtctatatataacaacaacactcttattattccaagtctagaatgccgaaatttgagagaaggatcttaacttgatcaacaaggtctgatcctgttgcatactctgtgagcataccaactgcgaaaccaaacatagcccacctacaaacaaaacacacagagttatctcttgtctaggcagtaccaactgacaagtgtgaaactttaggctatatatgtctgaatttgaagaaacatcaatgactagtaacttgtttattcaataccagagctacctcaaatgcaattcaaacaaatctctctatatctattaactttttgagttattagcatccatcaatcaaatacaagaattgagatcatagcttaagtaccttccattggagatctcatttttgggttggaaaccaaaaaagggaccttgaccagcagcttcaagctttttctgtttaaagtactcttgaagctctttagccttttgtctctgaaactccactgtagttacactcttcccatcaacagctacagctttctgcggcggcggagaaggaggaggagaggaagatggctgtgatggaggaacaggtttttgaggctcccggagagtaggaggagccgatggtcttcttaaaggaccttctgtctgagagcatctgatgatgaagacacatggcttagtcgttgttgagaatctaaaagacgacgaagctgtcgaagaagaagatgaagatgatggatttagaatcctgatacattgaatcggtgaagctactgacatttttttgttagttgaattgtctgattttcgaagctttggttctgtcttttggtaatgtctttgtggatgtgatatggccaagtctcatggttatgtgcaaatggtactttcgtaatcatcccacgcgcgttgaaagcgcgtgtaatagttttaactgttgtttgacttgaaagctaaaaccaagtaatgatgattgggtagatttttttttaagagctgaaactttggttaaccaaaccggaaagagccggtttatttggttgtcggttaaccaaagtatttgtaaagtgttgttgaaaagaaattcggtttggttcttgggtaaattcgatttgttttttgtttttttctttaaaatttgattaaaattggctattttgtataaaccggtcttatttttgtattaaccgatgtaaattagagtattggtgataactgatctaattttggaataaaccggtctcattttagtatagtccagttattaagaaaaacaattacatgggaactggactgaaattcttaagtaaccaaacacaaattgtaataatgccgattgttgttaccaaaataaccgaaaccgaaccaaaaacaaaatctcggttcagttcaaaattccagcatttttttaattggattttcttttccaaaagttgtggtgtggattttatcattacaggacagagtagcatagagatgtaatacaaagaataatctaaaatacagcacaaaattgacaaatcaagtggctacaaaagtacacatccaaaagttcctcttcttcttatccaatcttttgcaaatccttctccctctctctttctatatataataacaaaggtgcacatgataagagagcagctacatcaactatatgaaaagccctttgtctgcaaacaatttttaacttccaatgggtcacatgattgtgcacatacagctttttccacttccatgatgaaactcatcttctgattcatcaacttcactgcaaaatttcaatcagagcacactgttttcaacatttgttccccaaaatg

SEQ ID NO: 34588 - DNA, 3003 bp, Unknown
  misc_feature (1)..( 3003): 2750-1469P.txt file - cDNA_ID_3079917; gDNA_ID_2684602; Annot_ID_193226
gaagaaacgcgttttgaacatctaattgatgtaccgacgagtcgcgttccaccgcaaagtttagaaccgcacggattgttgcaggctttacaaccggactgaacgtctcataaaaatctactccgtgttcttgtgattttccattagcaacgagtctcgatttgtatcttgacaaagaaccatcagcattgtacttgtgtttataaagccaaatcgaattgataatgtttgtacctgcaggtttaggcactaaactccaagtcttagtcttaatcaaagcatcatactcttctgtcattgaaggattctaatttggatccattaacgcttgcttataactttttggaagttgggaaagtgtttaagcattaagtgaaagaatttgctttggtttatgtatgccttgttgtgatctaattaccatctgttgtggaggttgtagtatcgaagcaggtgctgcaggttgaacaggaggcgttgccgtcactgttggaattgatggagtgagaaggagacatttttgaatttgtgtaagctgtgtttctgcttcgagaaattcataagcagaatcgattttagtgtgagttgcttgtaaaggcaagatatcctcttgaaatgtgacatgtcttgaaatcataatttttcgtgttttcatatcaaaacacctatagccagggtgaagaagaggatagcctaagaaagctgatggtgcagacctcggctctaacttattttgggtgtttgtgtgaggataacatagtgagccaaagacacgaagatgattatatgatggtgttttgttgaacaagactgagaacggaatccgattgttgattaaggtggatggatgaagattgaggatgtggacaacattatttagagcttctacccaaaatgtgtttggaagatgagcttgaaggagcatagtgcgaaccgcattgtttatggttcgtatcatgcgttctgatctgccattttgctgagaagtgtatgggcaagaaaaacaaaaacgaatcccgtgtttagcaaagaagtcatgaaactgagagttgttatactctacaacattatcacattgcagtgattgaatgtgtttcccgaattgtgtatttacataagtatgacattgaagaaattttgagaacacatcaattttattgcgcagaggataaacccataagaaatgagaaaactgatcaaggaatagaacataatatcgtattccagataaacttgagacaggagaagtccacaaatcagaatgtattatttcaaaaggagaattgactttggaagtggaagaataaaacagatgtttaacatgttttccaatttgacaagcattacaagaaacatggagattcttttaattcgaatttaaatatgaaagtgaaagaagcgtcttcaagacatcgttgctagggttgttggtcggtaattgagttttcagataacggttgcaagtttgtgctgtttcacttaagagacacaagtagaaagagacagaagtatgaagagacacaactaattgggttgttgtgtctatttgttttctatataaaccccttgtatcgtcatgtaaatatcaacaagtttcagttcaataaagagttctttttgttcttgtcttctttacaagagaagagacaaatgtctcttactctgtttttcttctttctctcgataatccaacatggtatcagagccaatggttgtctttggttgtctctacaaaaataagatgagttccgctgcgaaaagaaaaagagagatttagacaacaaatctatggtgagaagaagaggaagaagaagaagaactaagaggtggtgacaagagagagtaccatcaactttcacaaacatattcacaagaagaaggctccaacaacgatgaagaagataggaaatcttctctagaggcaatggagaaaacggatgtggatttggagctgtggaaggagaattctgaaactttgttcaacaacgtcttggtgaagcgtaagacgggaaagcggcctgttgtaacaaacagagcaaggcttattatcaaaacgttgagttgagttgtgaagaagactacaacacaaaggcgtggagaaaagtttgtttcaaaaggaagaaacaaagggggcaacaaaagtcaaaagaaggccgagaaatggtgtgacttttgtacgtgtgacgattactttgagagtgattgttggaaaaagcaacacagggatgttagcttgcctacgggtgtaaggtgctttgtgcgtaacaagccatggcacgtggtgaagaactacaaggttaggaaggccgagagagcgaacctaagcctagaagaaacaaacgaagagagtgacaatgaaggtcacgttgaagaaagatcatcatcaaacgtgaatgatgagactgttagagtttaattgagtttggtcgttgttttatacaattaactatatgtgtttagtttatacattaagagatgtgtcttgccttaaaggtagttatgttgataggcataagtgaagagttacaacacttatagatgtgtcatttcagtcaaggtctatctcacgtctataaaaggacgatgtctttgtttgtaacacacaattcagattttcaataataacaagtttcagttccattaaacgttttctgttttgttcttgtcttctttataagagaagagacaaatgtctcttactctgtttttcttctttctcttgataatccaacatggtatcagagcttatttggttttggagcctatccaagcaaaacaaaaataagaagaagtccgctgcaagaaaaagagagatggcgacaacaaatatatggagagaagaagagaaagaagaacaagacatagaaaaggaagaaaagagatggtgacaagagagagcatcatcaaccttcacaaacattcataaacagaatcttcaagatgaagacttcaaagggatgaaggagataggaaatcttctcaaaaagcaatatggagacaatg

SEQ ID NO: 34589 - DNA, 3000 bp, Unknown
  misc_feature (1)..( 3000): 2750-1469P.txt file - cDNA_ID_3079930; gDNA_ID_2684602; Annot_ID_193222
  misc_feature (1182)..(1231): n is a, c, g, or t
ataatattttcattttccatatggttatattaattaaataaatataaagtaacatatataaaatcaaaaatattaattttcaataaattatttagtttttttttttttgtcaacctgtaatatggatatttgattaagagtaatatagaactatgactattttaatactcaatacaaatttattttttcttagtatataaggactttcaactcaaaaccaattgacaataaataaagaaacctatgtattttatatattgctccacaaatatctcatctctagatgtaagataccatatattttagcatatttcattataaaatttagtgttcctatatgtatacgtactacctccattttattggaatcaacaacatttaataaaatctttcatatgcataaaattcagtctaatgatatttaatcttactgtaaatctttctaacttcagatagctaataacgatatatccatggaatgagagtgatctctcaaagtcacaaatgaggttaactagagctgcgatattcaaaaatataattaaatggttttgaatacttataaaaaacatcatagttttttttttcgttaacttagaatatagtttatctaacaatatgccaaacatgacttcttgtgatgcattactatatatatatatatatatatatatatatatgtgtgtgtgtgtgtgtgtgtacttgtaaattatggtgtaatggtattttttctattgtaacaaagctggaaataaaacattaacgttcgcaatttgtagtttatgttcacttggtgatccattattgtattttttttctattaacgtttatatgaactaggttttttttttctacattggttgagtaatcgttcatgaactctattttaattttgaagggtagagtactacaaaacctagtctccattatttagcacgacgaaatgataacaaaagatcccaattatcttggttattaataaattaagagtatgaataaagaacacacacaagtgattagaggcagcatggcctaggagacggtgaaagttaaaaacttaaaagtaattttggagggaagcaccctcttttgttcgtgtcgtgaatttcttctttgattaatctaaactaataagatggcttatttttttatataaatgtcgtaaaatgagtttagttgatnnnnnnnnnnnnnnnnnnnnnnnnnnnnnnnnnnnnnnnnnnnnnnnnnngcccgctgtttggcgactcattagagaatgatataatttgcaaaacttttatctataaaaaaataattcttaaattttaaaacttactactttaaaaagaaaatcacaggacgggtaaagaaattatagaacgggttttattttggaattgagttatatggtggatgtatttgaatcaatatttataaaattttaaaatattattaatatactgttttaataggggttacaacttcagttttttaacaattgtctcatagattcgtggtatagtcttacttaataacaattataaactgtaaaatataaatattttataaaaataaaatttgcaaattttaatatatattacttttaaaaaataaatcgtcccgcgatatactgcgggttaaaatctagtttggattatataagactcaagtatatttgaagatggacctcatcttaggtatttttcacacttagaaaactattagctaactcattgtacttattatatactcatattttgagttaagacttcaaaaaattagcaaagaaaactcaaacaaatttttttaaaaaaaaccaaaaaattaattgaaataaggagtatataataataaagtaaaattagcattggaaaaattaaatatagataataataaatataccattaatattagaatattaatgatacttataatataagatataaaatttacattaattatgaatgcgagtagtagatattcatatagagaaagttgaccaactttagtaaatatgtcatatatatgattatttttcggctccttgattaatgaattaaatatttttaaaaacaataatataaaaacaattttgggactgcagataataagtttaaatacaataaattttgtaactaaaatgttatagtcatttactaattttatttaattatattatatactcatttacttaataatcatctcatgcacatggtgcagatagatgacatagtttcgttcgtagatgactagagtactaaagtgataagtatacatgaattctatcaaacatgtatatttcatttcaaaattttggatttttgaaccaattttaatttttacatatcatcctaaactttctttacgattttggctcgcattatatacgatctcacgactaaaattatcttttaatatttacaaatttatcttttaaaaaactgtatattggaaatatgaaaattgagaaataaaaaacttaaaatagtaacaattaacgattttgctttaaacatacactctcttgtcactccacgagccctacgcttcccaaccgcctgcctttttcagattacctccggtttctaccactctcgccgtcgccgtcaccggtactccgatcacctccgcacgattcatttcctatttgcatttttcacctctctaggtaataactccacgccgtctcatcaatttgcttcctctcctcagatttgatttcaatcagtgaattgctctgtcgaaattattgatctacgatcttagatcttacggaaatttcgttccgatttcaatctccggtgactgatccgatctgatcgaatcgtgttacattcaaatttactgttgcttagcgatcgcgatcgaattcatatgtttttcgattctgtgatatcttcatgactcttgattcgtgactcgattctttagcggaaagtgagtcttctcgagaatgggagattgaagaagtaagagattcactgattgaggaagagagaaagttagttcagaaaaatg

SEQ ID NO: 34590 - DNA, 3003 bp, Unknown
  misc_feature (1)..( 3003): 2750-1469P.txt file - cDNA_ID_3079934; gDNA_ID_2684602; Annot_ID_193221
cgaccctgcaatgagtagcttgttatgtatcatctttactttacctacaaaaacactttaagattgtaacttagtggcaaaaaaatggagggttcattgatagctgaattattgtacgactattgaaaaagttgacatgtgacaatgaggggagaacaagaaattagtttaaaaccactacgtatttgaataagattacatgtttgtatcaatagcacttacctaatttcttaaacaactacatattatttgtttttttatgcatatttctgatgagatttggtctactccgaaagacaaaaaaaaaaaaatgttctcattcttttgttgcttgaaaatttaatctcacgttgaccatgtagtatgtaatttagggcgtgggcattcgggtacccgttcgggttcggttcttttttttcgggtatcgggtctattcgagtaggaggttgagaaccattcgggtattctaaaaattcggttcggtttcggttcggattcgggtcgattcggttattttagtaaaaatgtaaaaataaccaaaaatacccaaaatatttttgggttcgggttggattcgggtattttactcatatatactcaaatctacccgaaatacccaattacccgtaaatatattgtttactttttatacaaatataaccaaatgtaaccaaaatacttaaattacctaaaagaaaactataacatttgttacttttatcccaaatatatccaaatttatatgaattactaaaaaaatctagtataatcggatttataattttaattttgggtgtttgaggtattacaaatatatatataactaatatatttaggttacatttgtattcgggtacccacgggtattagattcggttcggattcggttcgggtagtgaggtcaaggacccattagggtaattctaaaaatcggattcgtgttcggttcggttatttttcgagttttttggttcggatattcggttccgggtattatgcccaggactatgtatgaacctctacgtatgtatggaccgttttattccaacaaatatactctaaaatattccggataacaataagataagcggtacactagttatttaaattatcaattgtccacactatgggtattaaaccaatctagattactaagagcacctccattattttttttacaaaatgtctaatataataaaaatatagttgataagtttaaaatataaaaagatgtaaaatttaatataattttttatattaaactattaatattatgtggatgagatactcataggttaatcagaaggttgtttgaacttaaaaaatcaatgttgggtggcttaccaagaagtactttagagcatttctagtggatcgagcctttcaatggattctttcggttttttaagtataaatttctgaaaaatgttggatgagagtttcaggttttttttttttaatttttcataatccaagggtagtctcttttagtaagaatttcagaaaaaacttattcttttaaaattattttatttcataaaacttaacaaatattgcaaattataaaataaaacacataagttattttcaaacattttataatagatgtgcaaaaaaaaactgaaataacgaagttctaaaaatatggttgcgaatttttttcatgctcaaccaaatggtttttaattataaatgcatatctcgatcacgaactcgattttaaatgctcatcaaaaactaagataacacacgaaaacggcaacgactccaaagagagccagcttttttctttttagttagttttgatttatttttttcaatttaatcaagagaacttcataaaaaagtttccatttatcaccaccgaaaatgctcttatatgataaagtacaaaacacggaaaatgatctcgtgatgatatgtagggttagtaatcaatttttttaaatctctcggagcaatatatcacctgttgggcaagggtgggatccatcgcggaaagcggacgaggtagcttgctagcgatgatgatggcggaacgttacgagtggctcacaacgtcaagtgtgatggttcatggtttgcaaaagaacattacattttgtgagtgagatactgaaggtgattgttaaatagtggtatttgaagagttttttaattaaagtaactactttttttggctacttatgtaacgtaaccaaacattaatatattttctataactctcctgacaaatttcatcgttaagcttacgtgagtaacgtgatgtaatagtttcattatgcattacctactaaaaagtaactttcagatatgtatgagtgaagactacttatagagaaagatctcgtgatgctttgcatgatgatataagtaaacaagtatttccagcttcctaaaattatataacaaaaccgtcagacagaactaaataccatgcgtcgagatgggaagtgaagaccacaaacggttgcagtggacgcgttattctatactgtatagtgtataacatatgtaagaatccaaaccctcctttgcgtcatatgtgctccaaatctagttcaaagatcgatgaatcacttgatagtagtataactcatttgattgaacaaatatatcttgattcactcttttgttttgttacctgaaacacgcttacgaagaggattcatgtcatcgttttatctatcattgatttgaagcgtctttattagaccatacattttatctttctagattgttaatcaaatgtcctgtgtccatgttcaagtgataatgtgatatccctaagtgtatcggtttaattggacaagaatgggcttaaaccaaataagggtataatagtcttttcagaaaatcagtaatttcgatagccaaaatgagctatataagccgaacaaaaaaaaaccctagctcacgctgttgaatcactgaagagagaaagcttgaagacggcgagagctccatcttttctcaggcatctcttatcttcaaatcacaatg

SEQ ID NO: 34591 - DNA, 3000 bp, Unknown
  misc_feature (1)..( 3000): 2750-1469P.txt file - cDNA_ID_3079950; gDNA_ID_2684602; Annot_ID_193216
  misc_feature (571)..(620): n is a, c, g, or t
acttttatggttaacggttaaggttttttaaccgcttgatacgtttacaaactagttattatttaaagacagttcggttacaaaccgaaatacggttataatcatgcctaagcaaactcttgtaatcgtgaatttgtggaatttctgtgattatgaagttgtaaagtgtatttttgcaattttcttgtacttttgtatttccttttacgtgatcgtgaatttgtggagtttctattatcgtgattttgtggaacttatgtgatcatgaagttgtggaatttatttttgcatttttctcgtattttttgtgtttacttgttgtgtgtgttttaaagataatgtatttttgtttgtttatgattaatttctgtgatcgtgaagatgtggagtttattttagtattttattgtatttttgcctgtgtttaaattaatatttttttgtttatgatttaatttacttgtttgtgaatttgtggaatttatgtttattttttattgtatttttgtatttacttgttgcgtgtgttttaaaaataatgtttttttgtttgtttatgatttatttatgnnnnnnnnnnnnnnnnnnnnnnnnnnnnnnnnnnnnnnnnnnnnnnnnnngatgctttagcattcaagagtatcaatgatcctatcaagaaccagatcaatagttgtgctgcaatctgtgttaagcaagatgatccatgccatttcttgcgtgtcctttatggtatggttgcaaacagattttcatgtgcttttgttattgaaagatccgatctttgtttttaaagttcattagatgttgttttgcagagtctctgataacaggagggttagctggtgttgtggtggaagctgctttgtatccaattgatacaatcaaaactcgaatacaggtagtttctcctcaaaccaatttgtgtgttatcatccaacataagctcttttttattattattgtaatgagagtcagactatgaccaatgcttgacttacaatggctaactatagtggtttgacatggttaggtagctcgggatggtggaaagataatatggaaggattatactctggtcttggtggaaatcttgtcggtgtcttaccgtaagtatgtagtcagaatgaaagaaggaaaaatatatgcaatcaacttgaaaacctgtgactctttgcttcaaatgaacaatgtttttcttcatgtgtagtgcttcggctctattttttggtgtatatgaaccaaccaaacagaagctgctaaaggttttaccagataatcttagtgcggttgcacatttggtatgtattatcttaaaactatcctgaatctaatttaagtgttagtttatctgctggagaaagatgaatgtcttcttgacctgcttgacctgtatatattagtcttgctaccattttgttttaagacttactcatttgagacagaggcccttagaatctagttatgctctgttagaaagtatatatgtcttagcgagttatataagctcaattaggctgcaggtgcgttaggaggtgctgtttcatctattgttcgggtaccaacagaagtaagtctcttccttcttgtttctttgtttattcttgtgtgttggctataaacttgtgtaggctaatggaaacttcaacaggttgtgaaacagcggatgcagactggtcaatttgtttcggcccctgacgctgttcgccttattatagccaaggagggctttggaggcatgtatgcggtatacctgttacttcttgatttatggttttagtgttttactattttatttgtagcaggcacaccttgaggttaagatgaacagacaacaaaagctccatgtaatgtaatatgttcctaaacatgcagggttatggatccttcttattgcgagatttgccttttgacgcgctccagttttgtgtttatgagcaattacgaattggatacaagttggctgtaagtttttgttgctacaatgataagtaacagaacatccgattttgcaggcaaatgacagtgtgatatccatttgtttagaacaggcaagaagagatctaaatgatccagagaatgcgatgattggtgcttttgctggtgctgtcactggagttttgaccactcctcttgatgttatcaaaaccagattaatggttcaggtatgtcaaaacgataaatacacaaaatactgaaagagaattgttattcttggattcatttcataggagaatagaagctccagtaatatattaccgacttttcattttgaaatttggcagggctcaggaactcagtataaaggagtttcggattgcattaagacgataataagagaagaaggttcatcagctttgtggaaggtgaaccaaatttctgctcttacaattctcttttaggaatacacagtttctcatgtttgtgcaaagttgttgacaaacttgagacactgtattacagggaatgggtccaagggtattgtggataggtattggaggttcaattttctttggtgttttggaaaagacaaagcagattctttcagagagaagccaaaagagtcacaatgcttaaacagttagattctatcttaaacagttagattctatctgtgttgtctacatcattcttgtctcttgatgttttgttgaagatgaagtatttagattctttacgtatcttttgcttgattctctttctttttctcctagaaaaaatgtcattctcttttgttaatcaacttctacatttaaattgttttttaagttgaatctatcactggatagttactgaaacttaaactttatgtggacgttataaggttgcgtaataaactatgtcatcgtcactatcaaagtcttaatctctcaatttcttgaatatatatatttgaatcatttaacaattgttttgattcctttgtaattgatccccaccttttatacaaacaaaaagttgaagctgaattttttttgcaggttttaagtaaagatgatg

SEQ ID NO: 34592 - DNA, 3003 bp, Unknown
  misc_feature (1)..( 3003): 2750-1469P.txt file - cDNA_ID_3079971; gDNA_ID_2684602; Annot_ID_193210
attttttgtagtttttccatcacttaagttgaaacctatttgcattggttttttcgtctacttttaaaacaagttctgtaatttaatcttggtttgatcaagctcaaagtaaacatgaatgttgaaaagtagagacacaagaaacataaaccgtattcaaaccaacgagaatatcgtaaatgaaaacctaacatgacttaacttaataaaagaagactatcaatccaaccagttcgcttttggaagcataatgttaattcctaaaagctactaaaatctacggtatgggttccatagatttggttgcagtagtggctgtggcaaactaccgtagaggccgacaagcggagcaggtggatatagtgttggacgaaatggttgtggcaccatgaaattagggatagagattggagggcaactgtttggcattcttgatccgcacatagaatatggttggaagttgtatcctcttaatggagtttgttgagataacattgttgccggagcgaccacttgactgaagataggttgttggtgaggacttggtggtgggttattaaattgagtttgtaaatgaagcttatgttgctctttgcattgtgccaaagaaacatagataggtttatttcccaccattttcccattcatcttgagcatctgtgtaaggataaaaaattaattagtgtgagttccttgattaagaaggcaacactaaaagaccattacttggtttacaaacttaccgctttcgaagcttcttcgctcgttgagaactcaacaaacccaacacctttgctaataccattggaatggaccatgaccttcaaaattcattagttaaatttattattcgtcgtagtcacaaatcaatcttttgctattgcatgcgtacttgcaagaagtgatggtcccaaactctgagaataattcttcaagctttgtgttatcaacagaatcatcaagattcttcacataaagattcatccctttacgtgttttcatatcccgtattatcttttctagttcaaatttagctttcaaatcctcagttctattagttttcctctgagctcttccaacatgcaactccttttcatcaactactaccccgttcatcttctctatcgcagtaaccgcggcctcagccttctcgaagttcacaaacccgaaccttctagacttaccttctccatctttcatcaccaccgcgctagttatctccccaaactccccaaagagcctcttcaaatcagcatccgtcgcagtctccaccaagtttttaacataaacattagtgaaaacccgagatttatcccattgaccacggctaacgaatggacaaacatgaatatgttgattgcggatgagcgtgccattgtgaaaattgcatgcggtgtagactgaaaggtctgagtaaaactggacgaacccatatcctttggaaactccagaagcatcacgagccactttgcaagagagaactttgccaaatgcagagaacatatcgcaaagttgcttgttgtcgatagattcgtctagattcttgacaaacacgttacctcgtccactcattctgttgctaggatcacgttctgaaaacattatcctcataggttttccctttaacttacaataattcagcacctccattgcagtcttcgctgtttttccccacgaaaaaataaataaatcaaaccaattaacattcaaattcgttaaagaaaaatcgacataatttaaatcgaaacaaatacacgtgtgcctaaataatactaacaaaaaaaaactaaaaagtgttttagattagggaacaatcattgaaagtaaactatttcctcaacgtaacgactaaaccctagaaacaagcaacatgatgaaacaattaatatagacgaacatatagaatattacgacttaccttgagaactatggttgaaattaacatatccataaccaagagacaagccagtgtttcggtcgcaacaaactttcactgaagaaatatcatgagtgaactcactgaatttggtgtataagtcaccctcttcgacactcgaatcaagatctcctatatataatgtatgcttctcaaatttgttctctgaggttcttatagttgaaacacgtctttgttctctgataattttttttaagtatatatctggttctaaagtcatatatattaaaaaaaagaaaaaaaaaaagtcaattccttactaggattagctttttatttttctactaagataatattaataatttctaatatcaaataaaaaaattaaagataagctttaactatttcgataagcttaaagaaataagaaaagttaacctcctctcacagtgagtgccggtttaagtacaacgatgaataatgcgatcattctatatatgagaaattgttttttttctgtataaaaagagcacaaattgttttctttttgtatatataaaagagacacacaaaaaaaattatacatacaaaaagagaataaaatattttcttttcaaaatttgtcttagggcacatgaaatatatgagctggtactgctcacacttggcaacagattcgtaccgttagatcataaatataaatttgaaacatatgtagatcgtcaacttatttggttaaacattaattttaactacaaagtataatcgtaaacttgttttgtattttattcaattcagaaattaataaatagatcgtcaaaaacattattatctttaagaaaaaaaaaacaataacataagagggttttcagagaaatatgaataactatagtgactaatatgtaaatagagaaacatatgtagactcttgactaatcccaacacagtttctcttcgacgccgcgttttgtccccgtcgttgaactcttttcaaccggcgtcgaatctcgtttcgtcgccgtctcgttggctcttttcaccggcgtcgaatctcgtttcgtcgccgtcattcgtgtatccatcttaaaattcgaggctgattcatg

SEQ ID NO: 34593 - DNA, 3003 bp, Unknown
  misc_feature (1)..( 3003): 2750-1469P.txt file - cDNA_ID_3079979; gDNA_ID_2684602; Annot_ID_193208
  misc_feature (326)..(375): n is a, c, g, or t
aaagatctccttggcgcatggctgcaagcatttcatcaatacatttcatccatcaccaagaaattctagggatatatactgcatagagcttcaaagacttggtgcagtgtcactcacgagttttgctgtgtttaatgtggcaccggggtttgcttgtaaatctatacctccagctttaatagcagaggtagtgactatggctggtaaactttggcattatgtgacttctttctccgatgtgacatcttcaggtgtccaaacaaaaatctctgctcataagacaatataagttcatcgacaatactagctactgttttgttgaattnnnnnnnnnnnnnnnnnnnnnnnnnnnnnnnnnnnnnnnnnnnnnnnnnnatttccgaatgccttagcttaaaacgcaattttcaaccttccgagttccgtgatttatccccaaccctccgctctcttgatttccctggttaacctggccacaaccatgtgtgcctttgattgtatatggttcctccaatatgggagttgcccggtctcgggtttaattggagccagattctcttggtgcttaagttaggtcccataccctagtaggtccctggattgttcttttgtggtatactagaacatttgcagttacaggtaatgctgtaacaagagttccttcatctgacttggatattgagggatggctagacactcttgaacctgctgacattaaggttctagaaaatgatatccatccttctgaatcttttgtaactacctcgaagaatgagttctgtattcagtgtttatgattcatttcgtttcagtcttcaggaaatcgttcccttaaatgctggaaacatttttggtatggaggatgaccagcctgctttggaatgggagaacttgatacgtgatgccttaaaccgagttcaacctagaaagctgaagattaaaagtcacagtgatcccccttctccatcaaagtttaagcaacccgaagaggttccttatagtgtagaagatatgtttgttgaaaccagtcatgatgcttgcgatggaattagttcaatggataacaaactcaactctgttgaaagcacggacgtaccaatcgtaagcgaagattcacttactaatatagacgttttgggttctaccaatgacaatgcgtcttgcttaccaatacaagaatatctacagagacaattttcaacaccaaatacgccagaccgctctctgtcgatgcagattaatagtgattccaaaagggaagaaagatttagttacactgaaagggtaggtttgagctggccagagcctccattaaggctcctaaatcaatatgtttccgaaagacgtggttccttcaagtcagtgaatctgactatcacgaatctgagaaaaccatcgtatgttcggattgtgagcaaacagatggttggagtgtttctcaccatttgggttcggaggaacttgcgcaagcacataagcaacctttgtgtgtctactgttggtgttggtattatgggctacattggtaacaaggtcttgatttctcttactagttgctttaaatagttatttgtagcctagcttataacttacggtttcttgcggtcttacaggggtctgtatctgtgagcatgtcaatctatcaaacaccattttgtttcttgtgcacgcatctgtcatctggagaaaaggatacagatcaagagaaaagaaacgatgatgtacgtgaaatccacagaagaacgcagtttcttcctcattctttaaatgccaatgagcttccaagaagcatctgtaatcatgagtacgttttatttctcagttgatccattcaactacatctcttaatttttttaacataacaagataaccttgtgtagaagaataatctggctgggagatctgaactatcggattaacttgtcgtatgagaagacacatgaacttattgcaagaaaggaatggcaaaggttggtagagtacgaccaggtacctttactgcagcattgttttggtttaatactaaattgtgaagttctaatgtttatgttttttaagttacatatgaatctatcaagattgaaattagatgtttattctctgatagctttcaagagaaatgacaaaagggaacctattcgagggatggtcagagggaactttagattttgcaccaacatataaatacgaaatcgattcagaaaattacatcggagatgacccggaatccgggaaacgtagaccggcctggtattgtcttcatacactgtgatacaacatttttacttgatatgataaaaaggcaaaaacgatgagtttggagtgactatgattgatcaggtgtgaccgcatcatttggaacggaaagggaatgaagctcttcaattacagaagaaacgagattaaactatcggatcaccggcctgtcacagccacgttcttggccgaggttgaggttttgtctccacggaaacttcaacatgcgcttacacttacatatgctgagattcaaggccttgacgcctaaacaaccacttccgtcagatcccatttgtgtatagtaatttaacgatttgtatgcccttcatgtataatagtgttcacgtacacagaaatattgtagatagaaatactgactgaaaacaaagaccgtatctttgatgatataaacattggcaattgagttgagatgtaaactatagtgttagtgtatgcacaaatataagaattagctcagacttacataaaagttaattaatgggctttgttatactccaataatgggctcaataaagcccaaacaacctgccactcacttcacttcccagttcccactgactttgatcactgatttttttttcctgtctcattttccattttcccccaaaataaaaaaatatcacaaatcccatgaaaaatcacagagcttagaactctccacactctcaaactccgacgacttgactttaagatcatccctgaggagatcggtacttagcaatg

SEQ ID NO: 34594 - DNA, 3003 bp, Unknown
  misc_feature (1)..( 3003): 2750-1469P.txt file - cDNA_ID_3079983; gDNA_ID_2684602; Annot_ID_193207
taattctgctagagagttcttgccaaacggtcagcaatacaacaggccctcaagttttgactcattagagaccgctgaggtcacctcagctcctctggtgtttgagaaggaagatttcattgaaatggatgatcttcttctgatccctgaattcggagcttcttcaactgagaaagccgcacagttctcgaaccatggtgaattcgacgattttaatgagtttgaccaattgttccatgacgtttccatgtctttggatatggaacctattgatcagggaacttctgcaaatctgtcttctctgagtgattctgctaactacacatcagaccaaaaacagcaactcctttatcaacagttccaggaccagactcccgagaaccagctgaacaacatcatggatcctagtacaactctcaatcaaatcactagcgatatttggttcgaggatgatcaggccattctatttgatcaacaacaatccttttctggagcatttgcttcaccctcatcaggtacttagactcatgcttgtcttggagcattcaccttttgatgtctgctaagctatttccactatgcacgattttcttttctgcgtttgtctttgacttaaaccaagacatgtatatatatgatactggggctgttgttattcctcgattatcaaacccccttgttaatctcttaaaacgtaagaatttaagcctaagcctttccactgatacattgtgaataatcctcatttgcttaggtgtgatgcctgattccaccaatcctactatgagtgtgaatgcccaaggccatgaaatccaaaatggtggtggaacaacaagccagttctcatcggctttgtgggcattaatggactcaataccttcaacgccagcctctgcgtgtgagggtccccttaaccgaacctttgtacgtatgtctagcttcagccgtatgaggttcaatggaaaggctaatggaacgccagtgagtactaccatagcaaagaagggtattagaaacagaggttttcttctattatcaatcgtgggtgctttgtgtgccatcttctgggtgttggtagccacagttcgagtctcaggtagaagtcttctcttgaaagactagtggtggttctcttgaactcttaactactggtaagttagaagaagaaaccatgatccacattagtgttcatgggattattgacctatctataatatatgaaactttgaatatgtacagagtttgaaagagtaaagtacaataattcgtgataaaggagtttcttttccttctcgattgtccttgtttttttttctgcatatcttctgggtttcaatattcacaaagtagactgtctggttttggtttcatcaaagcatgatcttgaagaggtactgtgaatcgtgaagcaaactcgtgtattcatctctgttgaagttgtagatactttaggctgagctccggtgatctgtgtcgtgttgacggtgattgttatcccgatttgtggaactgttgccactgaggaaagagagtatgatccgtaggaatctgcaagcttgagaaactagagagcagataccgacgacgcaaccaaccgaagtttcctctgttctactcatggcagcttccaagagaaagcttaaacctttatctatcacccgtcctctgttattgatcgctgaggcggttgcgccgccattctttaatgaagttactagttgccgactacaatataagtcgtatggctgggcaaaatattagtttgattcgatcggatccgttatttggttcgattcaattcgaaaaatcgggatatctatagttttacaaagcaaattaaaaaataaaaaatttgttaaaagtgaaacaaataactaatactaaaatttaaataagtggatatctgtttcgatctattatacacaaaacatatatatatatatatatatagataattacatacatatatattaataatttaacactttttatgtaagttttatcagttttttttttgttttttttaacttcaaactttaggctttattatagtgatgaagtgtaatcctcatggatgaattatacaataaaaaatggaaccaaagagaaaagagaaaaagaagtattatttgggaatggagtcttcactaaacaatcagcaactttattacacgttctaggcacccatgtgacttcggcttcgaaaaatttcttctgccagtattgaatctcccttatcaagttgtgtaactcaaaacttcgggctttgccattgacacactctgccacacttctattgtcaccttcgaatatatcacactcagtttatgttcattaaattaattatttaaatatttttttagtgaatcattatttatttgggattaaatttttgatttttataatttttattaatttttataattattttttaatatatacataacaaattgaatatttgacaaatagttcagattttaaagaatatccaaaaattcggttactttcgaaacaaatataaatcagaacactaattattcggataaaacaaatcggataacaaataatattacaattttgaatattccgttggtgtcgacccctaaaattaaattatgtgaaatttttagcatcggataatgtttagcgagttaaaaaaatgaattattaggtgtttgttacggatctgattgttttctattttatataagtaaggaaaaaaatctgttttttcttcttttttacattaatataaattgaaacaacttgttattgcgctctctttgaaaattccaagaacactaaatgtggtcaataatggcagatttagtaacaaacatatttcaacaattaactatacaaattattcccaaaacagaaggcttaatatcaacatcttaaaatttactaaaaattgaaaacactaaagaggaaattaagtgaccaagtcttcttcttctttactctctcctttctgttaccgtcgaaaaaatcgagctaatg

SEQ ID NO: 34595 - DNA, 623 bp, Unknown; identical to SEQ ID NO: 189
  misc_feature (1)..( 623): 2750-1469P.txt file - cDNA_ID_3079983; gDNA_ID_26053; Annot_ID_146542

SEQ ID NO: 34596 - DNA, 3003 bp, Unknown
  misc_feature (1)..( 3003): 2750-1469P.txt file - cDNA_ID_3079987; gDNA_ID_2684602; Annot_ID_193206
  misc_feature (396)..(445): n is a, c, g, or t
  misc_feature (810)..(810): n is a, c, g, or t
ttctgtggttaggtttgattcttctggctctgttttgttctgtttttggtgtttaattcttcttagcaagcaagtaatattcgatcgtcactgtttttgctttgattttgtgatttctctatcaaagattagaactttacgtgaccctttaagcgatcaacaattatctcactgttttttcagataagggtatatgagtttgttggacatgggtggagatatgatggaagatgattgggaatttgcgtcatcatcaaaccctaaaagaaccctagttcttgtgggccgtactggaaacggaaagagtgcgacaggtaacagtatccttgggaggaaagcttttaggtcaagagctagaactgtaggagtgacaagcacgtgcgagtcacagagagnnnnnnnnnnnnnnnnnnnnnnnnnnnnnnnnnnnnnnnnnnnnnnnnnnggcagactgtttgctgactcaggtgaatgtaacaggtctatcgatgttgaagacgggagatagacagtggttctttttcactccaaggaataggaagtatcctaacgcagctaggtcaagtagaggtactgcaactggttattggaaggcgacaggaaaggatcgagtcattgagtacaattcaagatctgttggactcaagaagactcttgttttctatagaggtcgtgctcctaatggtgagagaactgactgggtgatgcatgagtacactatggatgaagaagagctagggagatgtaagaacgctaaggttagtattatagccaaaactcatctgtttctctttttgatttatttgtagnttaactaatctgtcttaccttcaggagtattatgctctttataagctttataagaagagtggggctggtcctaagaatggtgaacagtatggtgctccgttccaagaagaagaatgggttgatagtgatagtgaagatgcagatagtgtcgctgtaccggattatcccgtggtccgttatgagaatggtccttgtgtggatgatactaaattttgcaatcctgtcaaacttcagttagaggatattgagaagcttctcaatgaaatcccagatgcacccggggttaaccaaagacagtttgatgagtttgttggtgttccacaggttagtttcttctctaataacatattggcttatgctttctttcttttttgggtcctttggttattctgttgtgcttccttcactaaatagatacttgtatttgcagggtaatagtgcagaagtgatacagagcacattgctgaataattcttctggagagtatattgaccctcggacgaatggaatgttcttgccaaatggccagctatacaacagggactcgagttttcagtcccatttgaattcatttgaggctacctctggtatggcacctcttctagataatgagaaggaggagtacattgaaatgaatgatcttctgatccctgagctcggtgcttcttcaacagagaaatccacagagttcttgaaccatggtgaatttggtgatgttaatgaatacgaccaattgttcaatgacatatctgtttttcagggaacttctacagatctgtcttgtctgagtaattttactaataacacatcaggccaaagacagcaattactttatgaacagttccagtaccagacacctgagaaccagcttaataactacatgcatcctagtaccactcttaatcagttcactgacaatatgtggtttaaagatgatcaggctgctctctatgttcaaccaccacaatcttcttctggagcattcacttcacagtcaacaggtacttaaaaagtctttaaactcaccctcatctcagagcattcccttatgttgtctgccaagttatatttcccacgaagcattagtttttgaatttaaccaagacatgtatatattatactctgttttctttttgttgatatcaaaccctcttgttaagatcttgaaacataataacctagggccttttttactgatactttgtgaataccaacttacttaggtgtgatgcctgagtctatgaatcccactatgagtgtaaatccccaatacaaggaaggacaaaatggtggtggaacaaggagccagttctcatcagctctgtgggaattattggaatcaataccatcaacaccagcctctgcctgtgagggtcctcttaaccagacctttgtgcgtatgtctagcttcagccgcatcaggttcaatggaacgtcagtgactagtagaaaagtcactgtagcaaagaagcgtatcagtaacagaggttttcttctgttatcaattatgggtgctttgtgtgctatcttctgggtgttcaaagccaccgttggagttatgggaagacctctcttgtcgtgacctagactcttgaatcttgattcagcataagttagcctgatccacatctttgattatgtatagagtttgaaagagtttaattcttaacaaaagatttcttttttcctggattctctgatggctttgaaattttgcttgcacttatcatattaagcagaatttttgaacctctgtcgtgtcagacaagaatgttggaaaaaaataacaataatgggcctgtcgaattaatgggcctgagctagtatatttcgagcccagtaggttctcacaaactaagtagcagaaaaagctgagaccatcaaatagccaaccaaaaaatcacctcaatctacacaaagtctcatttctcgttaatttccattttcgttatctctctctctcgccgatcaaaccctaggtgtatcaattcgttcagattcccggcggttggtctcactgtcatgtaggtttgattcatcttctcttctggatcttgagtgacgaagagagaagagatctgagtttttctgagagagagatttttctccctcgatgacccgatcagttttttttcgtcgctggggattttcaaattttttttgagggatcggttttgatttgttacgtagatg

SEQ ID NO: 34597 - DNA, 3003 bp, Unknown
  misc_feature (1)..( 3003): 2750-1469P.txt file - cDNA_ID_3079991; gDNA_ID_2684602; Annot_ID_193205
tggaggagaaacacaaccatgaaaatgaaactaattatttattggtcaacaacagaaacagaacctgctgaagatagtggttgatcctcactaccatcacgacgaggagcccacataacacgatcaggtctatccttgtttcttgtacgcctctcttgcttctcactgatggtaccagaagtatgataatctttccctgcacatggaccatctattttgaattatcagcccaacttgggaagcaaacattttcacttaaattgtattcctttataacctgctcgagtgttggctggtcgagaaggtcgtttgtagttttctgcttctgagggttccactctttgctcagactgcacaaaagtggaagactggctcggtcgagagtcatttctcagaagtattcccttgatcaacctcccaccaacatcactcttctggttttgtcttgaatccgtggagtttctagaaagattagtgtctatatgctgttccggttgtggtggagggttctaaaaataccattaacaaataagaaatttacatggcttataattctgtttacaatcaaacagcctgcacaactttcataaagaacaaaaaagcttacatcaggattgtctcggtcttttgatctcaggagcaaaatctttttcttcccagaatccatagtcaatgctatcccagggggagagctatcaatgatagcggctgcaattgagtagcaaaaagacaaagagttaaacgtggccttttaaaaatatgtaattagctagttaggaataacaacagctgttgattttttaccagtttcatttcctggtagttcctttccacttgaatttgactgacgataatctggcttagagctgctgacgtctgctgtagtcttccggggcacattctttgaactttctttttccacatactagaatgaaaaatataatggcaacagatgagtataatggcagacgacactgactattgactcctaaaaagtgagagacaaacctttttcttttcagagttacgtttcgagggccttggactcggcttgtttgcagagactactctggttcttctacctcctcttcgaatatcagataaaccctgttgcttgaacagaaaccagagatcaacaatagaagttccattttgaaataaataaaatagagagacatccgtcccaggaaagttctgatattcaactaggtagaataagtgaaaaccccgtaaaactgtgagcataatgtacctggggtcccatcacagtggcacgtttttgacgtatgaattccataagaggtgtaacaatgggagccgcttttgaagcacctaagaaaaataattgttgtgttagtaatttcgattaattcactagagaataaccaacctcttcagacaaaagaagcatcaaaatgattgcaaatacgaaacacgaaccagactgctcagcttctcttctttccaactggatttcagcactaggaagattctcaacaggttgtgcaatcaccttaagaaactcaagataatcaggatctttactaatagacccttcacgaggatctttcttatcactcggtttcggaacacgctgagaaggtgcatattcaactatagccttaaactgagcacctaaaccaaaagaaaccacaaaaatcacatcttcaaatacacacactactaaaaccacatgcaaccatcagacaaagacagattaaaaagtcaaatacccttttcattaacaaacacatgcccgttgaaaaatgcagcgaactcataaacatcttctggtgccttgaaacttacataggcccgtgaatacttctgatttttatagctgaagacaccacaaaaacacaaacacacacacacatcactaaaaaaaacccaatactactaagtataatttctctacaatcaactaagtaacaaaaatctatacaataatcttcaatttccaacataatcaaatacaatcttctttaatttccatcatcttcttaaattacaaaaattcgtaaccctaaaattcatagaaaccaaaattccaaattcaagacccaacgagaaaataaaaccctaacctggacttcccaggacgaaacgaaacccaattgtaacgatcagcgaaacgaggatcaatttgagataagagatcggactgtgaaagagaaggcggcaagtgacgaacaaccaccttcttcttctgcaaaggttccttcatcgaaaaccctaaattttccttggagaaagtcgcaaatcaaacacgaacacgatgaagaagaagaagaagaaaagtgaaacacatcaatacgctaattttgccctaatttttgtttcctctcttccctttcctctgggaaaagaaaaaattaaaatacccgtagacaaatcaatcttcggtctacgtggactttttaacctatatgggcctctaatgggccttaattatatgtttcaaccgtcggattaagttttaaggcatcggacggcagataattactctgatagtttgtgaaatgggcttgttattgggcttaccgtaggatgaagattataataatacatcgtacggtgtataatcaatctaataggtgatccgcgtcgcaggtgataaagtacgagtttgtttcgcagagacttctggtcttgtcaggttttactgattctgtataaagtccaaaaaagatatttttctctaagattgtcgctttagcttctccggtttttaagcaagtaatcttctttcgtctctatcttctttacttgattgcttattcatctgttgattctgtggttaggtttgattcttctggctctgttttgttctgtttttggtgtttaattcttcttagcaagcaagtaatattcgatcgtcactgtttttgctttgattttgtgatttctctatcaaagattagaactttacgtgaccctttaagcgatcaacaattatctcactgttttttcagataagggtatatgagtttgttggacatg

SEQ ID NO: 34598 - DNA, 3000 bp, Unknown
  misc_feature (1)..( 3000): 2750-1469P.txt file - cDNA_ID_3079995; gDNA_ID_2684602; Annot_ID_193204
  misc_feature (1623)..(1623): n is a, c, g, or t
  misc_feature (1988)..(2037): n is a, c, g, or t
tcaggctaacttatgctgaatcaagattcaagagtctaggtcacgacaagagaggtcttcccataactccaacggtggctttgaacacccagaagatagcacacaaagcacccataattgataacagaagaaaacctctgttactgatacgcttctttgctacagtgacttttctactagtcactgacgttccattgaacctgatgcggctgaagctagacatacgcacaaaggtctggttaagaggaccctcacaggcagaggctggtgttgatggtattgattccaataattcccacagagctgatgagaactggctccttgttccaccaccattttgtccttccttgtattggggatttacactcatagtgggattcatagactcaggcatcacacctaagtaagttggtattcacaaagtatcagtaaaaaaggccctaggttattatgtttcaagatcttaacaagagggtttgatatcaacaaaaagaaaacagagtataatatatacatgtcttggttaaattcaaaaactaatgcttcgtgggaaatataacttggcagacaacataagggaatgctctgagatgagggtgagtttaaagactttttaagtacctgttgactgtgaagtgaatgctccagaagaagattgtggtggttgaacatagagagcagcctgatcatctttaaaccacatattgtcagtgaactgattaagagtggtactaggatgcatgtagttattaagctggttctcaggtgtctggtactggaactgttcataaagtaattgctgtctttggcctgatgtgttattagtaaaattactcagacaagacagatctgtagaagttccctgaaaaacagatatgtcattgaacaattggtcgtattcattaacatcaccaaattcaccatggttcaagaactctgtggatttctctgttgaagaagcaccgagctcagggatcagaagatcattcatttcaatgtactcctccttctcattatctagaagaggtgccataccagaggtagcctcaaatgaattcaaatgggactgaaaactcgagtccctgttgtatagctggccatttggcaagaacattccattcgtccgagggtcaatatactctccagaagaattattcagcaatgtgctctgtatcacttctgcactattaccctgcaaatacaagtatctatttagtgaaggaagcacaacagaataaccaaaggacccaaaaaagaaagaaagcataagccaatatgttattagagaagaaactaacctgtggaacaccaacaaactcatcaaactgtctttggttaaccccgggtgcatctgggatttcattgagaagcttctcaatatcctctaactgaagtttgacaggattgcaaaatttagtatcatccacacaaggaccattctcataacggaccacgggataatccggtacagcgacactatctgcatcttcactatcactatcaacccattcttcttcttggaacggagcaccatactgttcaccattcttaggaccagccccactcttcttataaagcttataaagagcataatactcctgaaggtaagacagattagttaanctacaaataaatcaaaaagagaaacagatgagttttggctataatactaaccttagcgttcttacatctccctagctcttcttcatccatagtgtactcatgcatcacccagtcagttctctcaccattaggagcacgacctctatagaaaacaagagtcttcttgagtccaacagatcttgaattgtactcaatgactcgatcctttcctgtcgccttccaataaccagttgcagtacctctacttgacctagctgcgttaggatacttcctattccttggagtgaaaaagaaccactgtctatctcccgtcttcaacatcgatagacctgttacattcacctgagtcagcaaacagtctgccnnnnnnnnnnnnnnnnnnnnnnnnnnnnnnnnnnnnnnnnnnnnnnnnnnctctctgtgactcgcacgtgcttgtcactcctacagttctagctcttgacctaaaagctttcctcccaaggatactgttacctgtcgcactctttccgtttccagtacggcccacaagaactagggttcttttagggtttgatgatgacgcaaattcccaatcatcttccatcatatctccacccatgtccaacaaactcatatacccttatctgaaaaaacagtgagataattgttgatcgcttaaagggtcacgtaaagttctaatctttgatagagaaatcacaaaatcaaagcaaaaacagtgacgatcgaatattacttgcttgctaagaagaattaaacaccaaaaacagaacaaaacagagccagaagaatcaaacctaaccacagaatcaacagatgaataagcaatcaagtaaagaagatagagacgaaagaagattacttgcttaaaaaccggagaagctaaagcgacaatcttagagaaaaatatcttttttggactttatacagaatcagtaaaacctgacaagaccagaagtctctgcgaaacaaactcgtactttatcacctgcgacgcggatcacctattagattgattatacaccgtacgatgtattattataatcttcatcctacggtaagcccaataacaagcccatttcacaaactatcagagtaattatctgccgtccgatgccttaaaacttaatccgacggttgaaacatataattaaggcccattagaggcccatataggttaaaaagtccacgtagaccgaagattgatttgtctacgggtattttaattttttcttttcccagaggaaagggaagagaggaaacaaaaattagggcaaaattagcgtattgatgtgtttcacttttcttcttcttcttcttcatcgtgttcgtgtttgatttgcgactttctccaaggaaaatttagggttttcgatg

SEQ ID NO: 34599 - DNA, 3000 bp, Unknown
  misc_feature (1)..( 3000): 2750-1469P.txt file - cDNA_ID_3079999; gDNA_ID_2684602; Annot_ID_193203
cgaaacgtaactctgaaaagaaaaaggtttgtctctcactttttaggagtcaatagtcagtgtcgtctgccattatactcatctgttgccattatatttttcattctagtatgtggaaaaagaaagttcaaagaatgtgccccggaagactacagcagacgtcagcagctctaagccagattatcgtcagtcaaattcaagtggaaaggaactaccaggaaatgaaactggtaaaaaatcaacagctgttgttattcctaactagctaattacatatttttaaaaggccacgtttaactctttgtctttttgctactcaattgcagccgctatcattgatagctctccccctgggatagcattgactatggattctgggaagaaaaagattttgctcctgagatcaaaagaccgagacaatcctgatgtaagcttttttgttctttatgaaagttgtgcaggctgtttgattgtaaacagaattataagccatgtaaatttcttatttgttaatggtatttttagaaccctccaccacaaccggaacagcatatagacactaatctttctagaaactccacggattcaagacaaaaccagaagagtgatgttggtgggaggttgatcaagggaatacttctgagaaatgactctcgaccgagccagtcttccacttttgtgcagtctgagcaaagagtggaaccctcagaagcagaaaactacaaacgaccttctcgaccagccaacactcgagcaggttataaaggaatacaatttaagtgaaaatgtttgcttcccaagttgggctgataattcaaaatagatggtccatgtgcagggaaagattatcatacttctggtaccatcagtgagaagcaagagaggcgtacaagaaacaaggatagacctgatcgtgttatgtgggctcctcgtcgtgatggtagtgaggatcaaccactatcttcagcaggttctgtttctgttgttgaccaataaataattagtttcattttcatggttgtgtttctcctccatgacatttgataggttcttacaggaaacaatggagaagtgaaagacaggatgttctctcaaagatcgggagaagtggtgaactcctctggtggtcacactcttgagaatggttagttcatctgaagttggagaatgcataatgtgtcttgtgtcattattatatgaataaataaaagtgacgttggttctgccaaaaacttttgactctatccaggttctgccagacattctagtcgccgtgttggaggtcgcaatagaaaagaagaggtggtgattggcgagggtaaaacctcccggagaggaagtggtggtggtcccagttcacatgaggcaagccaaaccaaagtcttttcttactacttttcctctgtcctcttttaaccatgtatagaagattcatttttactgtgttgcagaagcaaatgtggatccaaaaaccatcatccggtacttgatatattctcttaacatatggtaagcttcagtcgcactactaccctctcttacttgaaatttgtcaacacagttttatgattgttgtgacctttcaggctaaatatatgagccattccactggattttgtccttcaatgggaatctatagatctcaatcgaaatggggaagtaacattatcaacatcacttgggttttggagacttttggtccaacgttgtaagtcgtagtattgcacataaaagaggccgttctcaaagttaggaatcagctcaagatttatgagaagtgagataagaaaaactcgtttgctactgccttttgaaggccctagcggttcacggtacctgcatccccccttttggcttgtgcggtgtcacagacaagtgagtgagaagtgagaacttactctcgagtctgagtaatgaaaataaagtcaaaagtgtatagggagcgggaagcacagtgtgtcgggttttattttgggttcctgagaggccttagaacttgattgcacgcttttaaccatataagagtttgattactttgaagttaatttcttgctaagtaatattttcttgtggaagttagtttattttttatatgattagtctatttgtacttatttttgatttcaccaacataaaagttatgctgaaagtgatttcacgtttagaaagaccatattcttgcgattaggattaaagagggttacataaattaatcaaatggtcaaaaattaggaaatgagaactcacttgtggaagagaagtcataaggataagagaccaatatatatttccccttggggtcgagttttttgggcctggcttgttagttgttacaatcgagtgtgatgcgtcccatttcggcggagactttgaatgtgtattattgacctttgattcctttgtccatcatttgttttgtgtttgcttaaaattaatttttggtcttccccagtcgactatatactctcttggtcacttgtaacgaagtaacaaaatgaaatacatgtcacatgtgatatatttatacacagactacaatgaaatcaagtatgttgactaagaagagaagaaaatgaagtttgttgactaaagaaaggtcaaaatttttagaaattatcatcaaatcataaagatagtaaaataatgttaacagtatgaagtgtgaactcatatcttcgaagagattgagacagagtttagaaaatctcttacaaatctagtttctacaacctcaactaacattgtccaaatctgtctctatcctctgttttatttttttcttccggtggtacaaaaattcacaatgaactgtatttatcacaattaatgaccgattgcttcttcacctactctctctctctctctctctctctttggaagtaaccaaacaagcctatatgctgctgatcccatctaggggccaagcctctcttctttaaaaacttttgacttccattttcttgagaattcccctttctgggttcttgatttggaaagatg

SEQ ID NO: 34600 - DNA, 3003 bp, Unknown
  misc_feature (1)..( 3003): 2750-1469P.txt file - cDNA_ID_3080011; gDNA_ID_2684602; Annot_ID_193198
  misc_feature (818)..(867): n is a, c, g, or t
agactgttgttggaatgtgcaaatgagacaatattggaaatgttatttgcagcagaaggaggaggattcttctcttcatcagcttctggttatagcaatggtttagctcttcttctattaggtcaaaagactgaacaaaaaccaatcaaagtttcatcacaatggaaccattatcatttagttcttgaagattctgataccgggtttcggttagattcgtctaagaattggctctcttctgcttgcacttctctcatatgttttggtcgaaaatccgaaagactggaaagcgaggggaagaaagatgaggcaccgagtgtggaggactataataactgtgaagtcactaataggtttgcacttaaaagcagcttgaagaaaagatcgtttagtgatgttgtgattggtgatgatgatgtgagtagagatggtgtggtggatcatatagatagaaggaaagtgcagtggcctgatacatgtggtattgagattgctgaggtcagagaatttgagcctaggtatggatgctttctcttatgaagttagattctgtttgattattctttatatgtgtagccactagatgtaagttctggtctatgttagagtagggaataacctgttttcataggaaagaactgacttattccctctctgtctgcttaaaatggtttagggcacatcttttatcatgatcttaccggattcttccatgtaaacttaagcttatagtccgagattttatagtagtaactctcaagatcatgaataagcaacagtgtaatagatccagcaagatctctatatccctttcatgnnnnnnnnnnnnnnnnnnnnnnnnnnnnnnnnnnnnnnnnnnnnnnnnnnataatcattctctcatcattttgcactatattcatgtatatatatcttatgttgttatatgggtaaaacacaataaatttaaaagatagaagttgtccttggggtttaaaaaaaaaaacttttatattaaaattcatatgattttataagaaaacaaattagtttgtcacttacaaaataaaatgaattggaactattatgtatgagtttatatcaacaaattattttgtaatttactttatcatacatttattttgtaaaaataagatatgatatgtttattaatatatacatgcataaataacatagaaaaagaaaaactgttaaaatatgagcaaaagtaagatatcaaattttaacatatttttaattttttaatcatataatattgatacaaaattattttaattaattaaggttttaaaaaaaaaaaactaaagatggaaaattttcttataaaattggaggataatttatagtagtgaactattaatgtgcagtcttattggttcctaatttacaaggaattttgatgacttcaattaaatccttgaaaataaagaaatgaaagattttaaacgattgttagagagttttttataatcttgttgattagtttttcataatcttgtaaagtttctcaaacaatctctttattttgataatactttccatgacttttcatgacttcattttgtgaagaaaaatgtaggaaatcataaccaataacacaataatttaaatcattaacaatcattaacaatcaaagatttttttgttttaattgaataacacaaaacttttaatgactttataaaagtatgaatctaataacccaaaatttatgaagaggttagattactttttacaaatcttaaatgaataacacaaaaatttaacatacttttaaaaaatcttgattgaataacaacagattttacatgacaatttaaatcactaaaactcttttgaaatcatacacgaataacaccccctaaaacataatatcatgtcaaaattttaaagatttgattttgtaattagttaagggagttgcaattatgctagaagaaaattcatttcaaaattgtagtttaatatgaagtaatttcaaagtttaatgactatttttctaaatatttaatatatctattaataaattattttagtcaaactacaattaatgataagtacatgtgtcatcaaagtatagtgccaaatgtcgcattagtaggcaaagttaggaaaaaccttctcttattatataagattttgaattacaggaagtgatgaggatgtctagtaaccgaaaggttgtgatcgataacaagactcatgatgaaggcaaaaaagcagagcaagtccataagcttctctccctagtagatgatatcagaaggagcaagtgtggagaagcatataccgatgatacatatcatatgataaaggtgaaaaaatctcttgcatatattctcctcagatatttttgaaactttaaaatgatcaaatctcgtggtatcttaggaagagtcagagaaactaaggaagcatcatgaggagctggaatcaaagaactattcagaagaatgtgcagctgaaatgaagaatcagtcacttatattgtataaggagaatttgaaacaaatgtcagagcaggtaaaagatatgatcataaatcttatatgactacttccggttttccaatattaacaagctctgagtatattttgttaagttggagaagaagctcaaagatgctgcggaggcgcaagaaaaagcgctaagcaagatgacacaagaaaacaacgagctgaacctggcgcttaagattcacatcccgttgccgccaattactccatgcaacattctttgaaaaatgtcttctttctaacaaaggggtttctcaagaaatatcagtaactattatcgtccaaagggattttgggttgccataagaagatacaatcaaggaggttttgtttgtcaaaatttcaaatgttttaccaaacctttctgttttttttcccattttgtatttcagattacatgttctgtccaaaactatattgtggtttcttttgttgtgtgtggacttttgtataactatgttttcttccatgtttgaataagtgtatg

SEQ ID NO: 34601 - DNA, 3000 bp, Unknown; identical to SEQ ID NO: 7243
  misc_feature (1)..( 3000): 2750-1469P.txt file - cDNA_ID_3080035; gDNA_ID_2684605; Annot_ID_193256

SEQ ID NO: 34602 - DNA, 3000 bp, Unknown
  misc_feature (1)..( 3000): 2750-1469P.txt file - cDNA_ID_3080037; gDNA_ID_2684605; Annot_ID_193255
ttcacaataagagtgaaattacaaaagaagatacaacgcctatagctgttgttattccagggttaactagtgattcttcatctgcagtaagtttagttttaaatcacttatctgttctttaatggctaattgactttatattggtgattttttgttgtagtatttaaagcatcttgcttacgacactgcaaaaacaggttggaatgttgttattagcaaccatagaggattgggaggagtttctgttactgtgagttcgctagttttatgaatctacgaaaagttgtgattacttatatacatatattcttttatgtaagtgttgttttgtggcaaatgtatgtagtcagattgcttctataatgctggatggacagatgatataagggtagttcttgattatcttcaacacaaatacccgagggctcctctctttgctattggcactagcattggagcaaatgttctggtactaaatcaggaaccgcagtgttttacttagctttgaatgatgtttaagtgtgaagatttgctttgtttttcatggactttttgttacatattgctcagttggctgcaccatatgctacattcaaaaaaacgatttcaagctaaaagagtagattgattatatatgtttttcaaataccattgatatgcgtgaggaggttcctgaatttatcttatgcttcaggtaaaataccttggggaagagggtgaaaagactcctctgagaggtgctgttgctatctgctctccatgggacctcttggtgagctatttttcataactgtcttgttctttgtatattgattcgtgtctgaagttgtctctaataacttgacgagaaattatgacttccttaattttcttcattgggttctgatttcagacctttgaacttgtaaatagtactaagggttttgtttgatacaagtggatgcttgatacgttatgctttttcttttccttttctcctcccaacaagattggtgacaggtttatctgtcggactttgaaacaaaagctctatgacaaagctctcaccatcggactccaaggttatgcccaattgtatgtccaccaagaactgcctagattttgagtttgtaagatgggctgagaggagatatttccgttttactgctttgagaagatcaggtttcagttataacttttggtttcattgcaggcatgaacctcagtttttacggcttgctaattgggaaggcatcaaaaaggttagtaggttaattaaccacaggcccataagttatacagtctacttggtagatgcattgaaacaagcagagttcttaagcaaataacttacatatttctttccctatcgacgttgtctgttgttgtccgttgtttttacttcatcagtcacgttccatccgagattttgacaaccatgctacctgtctagttggaaaattcgaggtattagttctcctccatattatcttaacttctgatgttagttttccaccgcaattggctttgtaattcatatattcatctttgcaatgctcttcataatcaccattaagttctctgttgatttaatataagtacaacgggttgcacctttatgcagactgtggatacgtattaccgaaaatcgagcagcactcaatacgtaggaaatgtggcggtgccactactctgtataagtgctctagatgatccattatgcacaaaggaagctattccctgggacgaatgcaggtaagacgctatctatctctttttaaatcttaaatcctgttacagcgattaacatgaagtttctattgaaaagggccaacaaaaacattgtcttggctacaacaaatcacgggggacatctagcgttcttcgaaggattaactggatctagcttatggttggtatatttcagattgtaactaagtaataatagtacttcctattttgactgcctatatatgttgttgtgtataggtgggttcgagccaccaacgagtttcttggcgtccttagctgcagtccttatatgcatatacagaaagtaagtttccgtttattagaattgcagtttagataatttaactcttctctctatttctttcttcctaagattatcaatttttttgcagattgtagataaaagaagctcagggtcagggaaacaagagccatcgataaaccaaggcccgtacctaaacattgcagaagacgggttggtggcagcagtcaaatatgagcaagacaccaataagaccacactgaagcagagagggcgaaagcctgaggaagatgtaacaaagaaaagctttaaagagctgtgtaggcagacaaaacagtcggtatggtggcttggttacataggcatggttacaagtttccctttacttgggatgctcctaaactacatcttccgtaagaagcaacgacccacaacaacatccacatcctgaagttgctttctttctcaacatctccattcactcattcttctatctgttaacctattatcgattattgagaatgttaataatcatctaatttttttttatcataagcatagtaattatgtagagttttcatgaaggaaaggagtggaatcgctcaaactcattttttgtcttattatttcggagaatcctttcattaaaactgacttcgatcgaagatcaaatcatttggtttgagtataagtttagatgttcctggaaaatcatattactctgaataatccaaaatattagtatgttatctcagtggcattaccgttaaaatatgaaactataagggtattctgggaagttggtgattacatttttttcttttcctggcaacttcgagagcttttaagcgcagaagaaactcgttaaaaatcttggcgagaaaagttgagaactggaatcgaagaagcgatagggttttggttacttggagtgtgagtattttagttaccaccgcttgcaatttcaaattggtttcttttttccggtgacatttagtaagacaatg

SEQ ID NO: 34603 - DNA, 3000 bp, Unknown
  misc_feature (1)..( 3000): 2750-1469P.txt file - cDNA_ID_3080041; gDNA_ID_2684605; Annot_ID_193254
actaagtaataatagtacttcctattttgactgcctatatatgttgttgtgtataggtgggttcgagccaccaacgagtttcttggcgtccttagctgcagtccttatatgcatatacagaaagtaagtttccgtttattagaattgcagtttagataatttaactcttctctctatttctttcttcctaagattatcaatttttttgcagattgtagataaaagaagctcagggtcagggaaacaagagccatcgataaaccaaggcccgtacctaaacattgcagaagacgggttggtggcagcagtcaaatatgagcaagacaccaataagaccacactgaagcagagagggcgaaagcctgaggaagatgtaacaaagaaaagctttaaagagctgtgtaggcagacaaaacagtcggtatggtggcttggttacataggcatggttacaagtttccctttacttgggatgctcctaaactacatcttccgtaagaagcaacgacccacaacaacatccacatcctgaagttgctttctttctcaacatctccattcactcattcttctatctgttaacctattatcgattattgagaatgttaataatcatctaatttttttttatcataagcatagtaattatgtagagttttcatgaaggaaaggagtggaatcgctcaaactcattttttgtcttattatttcggagaatcctttcattaaaactgacttcgatcgaagatcaaatcatttggtttgagtataagtttagatgttcctggaaaatcatattactctgaataatccaaaatattagtatgttatctcagtggcattaccgttaaaatatgaaactataagggtattctgggaagttggtgattacatttttttcttttcctggcaacttcgagagcttttaagcgcagaagaaactcgttaaaaatcttggcgagaaaagttgagaactggaatcgaagaagcgatagggttttggttacttggagtgtgagtattttagttaccaccgcttgcaatttcaaattggtttcttttttccggtgacatttagtaagacaatggaagaaataagatcggcgatggagaagcaagtggatctcgtagcggatctggttgagaaactctccggagagctccgaacggggtttcaacctgcttacgataatttcttggggtttttccacgccattgattggaaggtaatgagaatctttcttcgtattgcatcatttggtcttgaggaatttagaatcacaagtctagataaattctcggtatttgtagaatttcatttgaattctgtgagaatttgagattccataaactatactcatatacattggttttttctcatctggcattttttggttacaggaaccttggattatgggtttaatggcgtttcatgctttgttgttactagtgactcttctttctagaaggcatctcaacttccatatgttcctcttcttattggcttgtaagttccctttgaaactgtctatatatatattgtacaagaaatctcttcgatctaatgatctcactagtctaggttgtggcattcatagtggatcaagtgtttgagaagctagtactgacatgttttacttcactctagcttatgattgaatgcactaggctttgttttctttgtttagtacaataggattatcggatcatcgatgtttggtaaaacgaaaatatgatattcatttgtctactcaatagctgtgttagtttagattatgaacttagtgattggcatatttctttgcgatattttgtgagtcgtcactgcatcaattagagttttttcttttcttagtacacgttattgagactgatgatgtgacaaaaaatttgcagtggctggggtatactttgcagagaatctcaaccgggagttgaggaaaaactggaagagcttctcaactcaaaactactttgactcgaacggagtcttcctatcgactctctggtctggaccacttttggtcattgcaatgataatcctggtaatgtgttcagcaatctttccctttcttctctgcattaatatattagaatctacttgctagctcttaataaattgttcccaagtaaaacatactttgattgagcagtcatattaactgagaaatcgaggatatgtttcgtgtttgatttggttttaactcttaagagtatttgtagtccttaactcaaaccatagtaccatactgatccatgtcttgtttaggattttaacgaactatgtgtagtgaatgtggaaaatctgatggaggtgttgtgtttttgacagataaacacactcttttcgctttgctacttaatcgtaaagtggaaaagagctgagctcaggcatcgcgcaaggcttgctcataccaaggaggaatgatcccactttttttaatctcacatttatgtatactctcacacaatgcatcaaaactgttttgagttttttagtagaagctgctcttttatgtatttcgttttcaattgaatcgaattgtatcaaaccgaaccaaaccaaattattctacttcggtctgttatggttaaagttttgaaaccccgaattgaatgatttggcatcaatttctaggcatgaaaaaattgtagaaaagcacatacataaataatcgatgaccatgtccataccaaacaaaaaatgaaatgaaaaattcatgtgtttagtgtttaaccgacctaaatttgaattaattaagggtttaatttggttattaaaatttgaaattgtcgtaataagagatgatgccacaattagccgttacgagtaaatagagagagagaggtcgtcggattcaacaacggactctttttcaaaatcagaaggagatagagagagaaagagagaaacactctctaaatcttcttcttcttcatctctttcgttttccattttcgaaaatctctcaatcgttcgttcttacagacttattcatg

SEQ ID NO: 34604 - DNA, 890 bp, Unknown
  misc_feature (1)..( 890): 2750-1469P.txt file - cDNA_ID_3080041; gDNA_ID_1563689; Annot_ID_148128
  misc_feature (108)..(109): n is a, c, g, or t
cttaataaattgttcccaagtaaaacatactttgattgagcagtcatattaactgagaaatcgaggatatgtttcgtgtttgatttggttttaactcttaagagtatnngtagtccttaactcaaaccatagtaccatactgatccatgtcttgtttaggattttaacgaactatgtgtagtgaatgtggaaaatctgatggaggtgttgtgtttttgacagataaacacactcttttcgctttgctacttaatcgtaaagtggaaaagagctgagctcaggcatcgcgcaaggcttgctcataccaaggaggaatgatcccactttttttaatctcacatttatgtatactctcacacaatgcatcaaaactgttttgagttttttagtagaagctgctcttttatgtatttcgttttcaattgaatcgaattgtatcaaaccgaaccaaaccaaattattctacttcggtctgttatggttaaagttttgaaaccccgaattgaatgatttggcatcaatttctaggcatgaaaaaattgtagaaaagcacatacataaataatcgatgaccatgtccataccaaacaaaaaatgaaatgaaaaattcatgtgtttagtgtttaaccgacctaaatttgaattaattaagggtttaatttggttattaaaatttgaaattgtcgtaataagagatgatgccacaattagccgttacgagtaaatagagagagagaggtcgtcggattcaacaacggactctttttcaaaatcagaaggagatagagagagaaagagagaaacactctctaaatcttcttcttcttcatctctttcgttttccattttcgaaaatctctcaatcgttcgttcttacagacttattcatg

SEQ ID NO: 34605 - DNA, 3003 bp, Unknown
  misc_feature (1)..( 3003): 2750-1469P.txt file - cDNA_ID_3080064; gDNA_ID_2684605; Annot_ID_193248
aacatagtgaaagaaggtaaggaatcttagacttcgagtctaaggattctaggatgcgatatagtattcaggatccttgaaaggatcgactagtgggctgggtagaatcgggtcatgtgcaacctacacaagactcggtccgggcaaggatcggcttaggcggggacgcggctcggcggaggaccggcgggtcttaattgacctactgggaattggccggactgatgcgtgatcttcccctctccgaatcctgtccacggatccgagtagtgtatggactatagagcattacatggacttgcatatgactaagtaaacgagattacttatggctctatgactttcaggaactaatggagatcgtgggaagaacttggcttaggcgcgagagactcaaggccggtatgatggatggttatagttcggatagcctagggatcgattatatgacttgcaatagcttatatgcaaactcataagttttattgaatcctttgcttaattaataaagatcagattgtttgtttactctattcgttccatacattgaatcatagaatcgtatgaaatagatttcactagggaatgaacctcataatcggttagggtcaagtcacttagtgatttgggtcgggagatctcgcccggacttaggcaggacggatcggggcctttcaaggtctctacaaactgaaagaaaactcaacaaacaattttttggtgtccataataacaagttcatttagatatatccatccggaaacctttttactgatctatatccattctatatatcatttccataataacaagagattcgattaaccagaatctcgatgctacgtagatgaaatgagttttacccatgagagagagagcaaacctcaaatcaaaccgccattgttgaagaagaagaattttcttagagaactgaatctcaaatttattttaaaacaaaaatttaaattgcaaaataaatcttaatcttaaagaaaccaatggctcatactctccaattaagataaatttttatttggcttgagattgaaattgaaaaccaaaaattatattactagagacaaaaagagcttccttgttcactttgttcatagttttacaaaagctttgaaaatatcttctcatttcaagttcaagttcgattcttctatagagtaacctcgatccctcaacatctgaagcaccgtgcgacgcaccttgaaaagcctcgtgatttcatcatccatgtccgccattccttccaaagttttgattttttgttcttttgccggcgaggaagaatgagattagtgaggttttagggtttatggcactcataaataatggtgatatagcatgttattatatttaatggtttggatcttcagttatatgagatgaatttcttaaatacgatacgatgaatttctttaggtaatatagactgagactgagatacttgtccatgatcatatatatctcagaccttgagccataaaattgccttaaaaatcaaaagagacgagaaataaagtgtaaataatctcactaaaaaaacatgggaaagggtttttcgctatttatcacaaaaggaacaaaactgagaggaaaagagataacaaacaatgtctactactgtctatagcctatcttttcctcatttgttactattactttacgccatatacaacaacatgtggattacatatatgtataagattatagtccttattcatatcttgtagattgtctttgcttcagttatgcgttgtgtccatttctttcttgtctctttttgccgccattgttgaagaaaaagaagtttcttagagaactgaatctcaaagtttatgtcaaaacaaagatttaaattgcaaaacaaatcacaatcttaaagaaaccaagggctcgtactctccaattaagataatttcttctttggcttgagtttgaaactaaaaaccaaaaatcaaattacttgagccacctgtgagacccagtcccggacgtctcggcgtccggcgaccgtgtactcaagttcgcgcctcttctcggccgaacctcttaatttttcgcgattcaacatagaattgcctttacgaggtttaattctataatcgctctcttattacacaacgaaagtctttctaaccttggtttagttctaaccaactcttgtaccggtttcatcgtctttgtcccttagacttagatcgatcctttactcggtcaagacatgcatatgttcgctaaccattctaagccaaacaatcgcatattcctttatcctactttcacggtcaattaccaaacgtctatcttaactaataagctagatcgttacataccttggccaatatgcggatttgattccttagcccgtttgtcgccttactccattcgttcaacgactcgtatccgatcgtgaattgatgaaccaatccctatcgttacttagccatacaaccaaccaaccccactggtctaagtacaacgatagagattggggatcgtacgattcccttggttcacgatggccgaatcaagctcttggcttattggtccattcgttcaccaaacgtacgcccctccggctacatggtggacgattgagccctcggcttataaaaccatccatgtttccgtttcggtcgtttaacactacgaccgcccacggtttactaaccgtttacccgtccggtccatggtggtcgataaagctttcggcttaatgatccatccatgcggtccgaacgatatccttatcacacccaagggtccgtggattcaaccaccggatcatcgtaggctagcccatgaaatctttcctccgtcggccttaggtttgctcgtgggtccaacatccgttttgtccatcggttcccaccgtggactttcccgttggttatccgtcgagtcaccctttggtcttaccgatcttcgatcggtttcatcatggctgaggagatagatacatgaaggcagccgcgatattgatcccatatg

SEQ ID NO: 34606 - DNA, 3003 bp, Unknown
  misc_feature (1)..( 3003): 2750-1469P.txt file - cDNA_ID_3080084; gDNA_ID_2936562; Annot_ID_194493
accggaatctcgatgctacatagatgaaacgagtttgacacatgagagagagagcaaaaatcaaatcaagccgccattgttgaagaagaagaagtttcttagataactgaatctcaaatttaagtcaaaacaaatatttaaatttcaaaataaatcacaatcttataagaaaccaagacctcgtattctccaattagtctagagagaagagaaagccatcgcgtagtgtggatttggagattaattgcagatttggaattgaagatattctggaaaaggtttttttcttcgataaagtgagaaaaaagaaaaaaaaagagaagagatgggaaaaggagagagaagagatggccgatggaaaaaatgtagttaaagggtaaataagtaaaataatttatctaaattaccttctccatttaaagtgcctaattaggaactaactttaaaaaaagtctctaattacgtaatattctcaataataattgaaatcataatttagatataaaaataaaattagcaatacttacccatataagattgggttcttgaaaatcattgctcaagagatctgttcaaacaaaaaaaatcatagattggaatttcaatcgaaacatttggaaaaactaaagtctaaatctgaatcaataataaccttacctctttgtaaaattccagcttagctgctagaaacaggaatatcactctcatcctcaagctaatttttccagcctcattgtacttcatttggcgggagaggaaccaacgtcttcactccgctacttcacgtcctactacttctatcattaaggaaatcaagatgatagttaggacaaggcttgatcctctttctagggctcagagatccacccctcctgccttgaccctcctcgccacttggttctccttatcccaatgacattttcagttgttgtttcttttgtaggcttggtttcattgggttcactttgtgtttggaccttcctcttgctgcgggggctgcgtcctcttgtttcgggcctcggccttgtttgtttctgtttcaggtttgcgtaccccttctcggcatttatcatatatgttatgtttttctagtaaaaatttaaaaaaaaaaaaaaaaaaaatttcagattagcgattaacagatgataaacggtgtcatagtgtattgattatcaaaacaaattgcaagtgattcatactacgaacaaccgtttgattttattttggtgtgtgtttgtttagagaagaagaaaagacaaggtttcttctagaattatctattcaggtaaataaacatttatcttttcaataaaatacaaaaatcaatcaatatgtgaaatgatctgaagaaagttttgtgggtttcggcccaaaacaaaattgtcatgttattcattaatggactcctaaattattcgttgaagcaaacaatttttggcattttattagatattcgataaataatcataaataatagacttatttgtctaaaaaaccacaaaaacaaataaaaattgtatgacttttttgtgttgtcgtcgtcgtcgttatcaaccctcatcatcatcatcaccaacgtaaccaccgacgccatcatcatcgccattaacaactggatctgtctccgtttccatcaaatctctttctctctctgcagatcaattgattttttacaacgtgattgaagcggggctagctccggtgacgatagttgattggttttgtcccttaagatgagctccttcaatggtaacgaacggcgtcggcggccgtgaatcatgagagagatggctcagtttctttttcttttctctgatcttcctctttatcatcagattctatctcagaaacttatcaatgtgcgtttgattttttttgcttgggttccctttacaataatcattagggtttagtttttgaatggaattctcttccaataaacaaaatatcattaatggtgaatagtgaggacgcaaatgattattgaaaagctttgatttcgaatactcgattgcagatctgccacaaatctgaaactctgtttttactattcaccttcttcttcatttgcaagatgatttcatttcgttcgtttaattttttgctttggtttcataaatactatcatctttagggtttaattattgtgaatcaatgaatgtttttagttagaatagattttaagaatatgagatttggaaaaaaaattggatttaaaagaagaggagcgtgcaagaagatgatgagagaagatgatgagattattcaggggtaaaatgatcaaatcgccctatcaaaactactctttttcaaagatcatacacaaaagcctcaaaatcaaaatttttatcaaaaaacatcctcttttgacaataacccctaaataatattataagtattatacactaatattctgcaactgtccagattatttatcatttaccaaagaaatatattaaaaattatatttatctttaaattcaatatttataatggatcaaacatcaaacaaatttgtataccgaaatttttttaaaacacaaaatataagtttctccttaattttcttttatgaaattttcttctaaaaatagaataacatataaaataatacataagagagaaatcatgctttattttacagagaaaaatagagatttacattggagataatcttatatgaaaactgtaaaaaactataaaatcagggcgaaaaatgtgtatggtaaaaaaacttaacatgtggttaaaggttttaaaaagattacagaatagttctctattgggccttcgaaaaaagcccaatacccaacaacaaaaacgcgcgtgtatcacaccttcaatacactagtaagagtcacacagtgatcgtcaccggtaaattagttggcaaactccgcctgctcttcgataattccgaggagcttcttcactcttcttatatctcatttctctctatctctctctctctctcgcattgcgattaacgaaattcgaaaaatg

SEQ ID NO: 34607 - DNA, 3003 bp, Unknown; identical to SEQ ID NO: 34606
  misc_feature (1)..( 3003): 2750-1469P.txt file - cDNA_ID_3080084; gDNA_ID_2684605; Annot_ID_193243

SEQ ID NO: 34608 - DNA, 3000 bp, Unknown
  misc_feature (1)..( 3000): 2750-1469P.txt file - cDNA_ID_3080090; gDNA_ID_2684605; Annot_ID_193241
ataaagcgcctcaaacggaaaaacattcttttaaaagtgcctaatagtggaacattcccattattattatcaacaaatcccaaatcgtgagaggttattttaagattggttagttttaaaaccaatctcttattagaaatctacagtgaaccgagttaatacataggaaaaaatataatcagctacaccaagtatagtggaatacatagctacaccaagtatagtggaatacatagccacacatgccaagtttagaaatgtacaatcaactacacgaactagatgtatttcatccccacatataccaactacatgacggcatgtgatcaatgaacatctttttccggtatacaaattgttgaaatccagtattgaccaatgttgatcagcattgaccaacaaaaatattcgaaaaatgattttttttttattttaatattcttaagaagttattctattgaatagtttatggtattatagaataaataaacacaatctatatttaacagaaaatatattttgtatgattcttattattacttattttttcaatttcaacactaaattaaaagggaaatgaaaataaatattattaatttattaatttcattagaaattattgaagtagatgactctttaatctaaaatttacatggtaaaaaaatagaaagtttttttgcgaaaattaaatcagaattcatagtgaaaaagtatagaaaattttacatactctttagtctaaacaaaaaaatgtcctaatgtttttttaatatatagaaaattgacgataacgattttagcaaaagcacttgtacaataatacgttagttttttattgacaatgtaaaaagaatcaatttgcttaattatttttattcactttattttactattgaaattaaaaaaaaactatctaagtataataatcaatgtattaaatagatatataaaatatattatgttaaatatagaatatgttttcttttaaattataaaacactataaacttttgattcaacacatctttactttgtttctcatcttatttagttcgtgggctttgttttaaacataacttgggcttaagtactttttattttttatttatctttttagaccatccccatcggacaaatttagagggtatcttcaaattttaacagaataaaaaaatagaaaaatgagaattaatgcgcttaacaggagagacaaggtggctttgatgtctgtgggaagatattttttgatactggaagacacgaatatgtcatcatgttattggttggtgctattgttttttatttttttcttttatttggccaacaaatttatttctcttcattttgccaacaaatttctctctcttcatttggccaataaattatagttaagacatgtaaatgctcttagggtttattccttcttgtaattccttgtttaaacacttcttgtagtagttcttaggaacacagtttattattgagtaaaaaacagagttttttttttgtctcaagtgaaatttactaaaccacaaaagggtaaataagcagggtaacagtgatacccaacaatggcccattacattaacatctatggcaaaagactgtttgatattggactctatctaaagacaagtgttgacctaatattacaacagcaacacgttctgatgagtcaacagaagtttaccgacatcagcctctgccatcgagaagcaccgaatccggtgagtaaaacatcgtcgaaacttcgcacgaaatttccttgtttaccaccgaaatatatctgaacggagctctaaaagagacacaacatgagagaatcatcatatgcatcagaatattctgcaatcctttaaaccaagatgaaattgcttgaatgatttcctgcaaattgaggtttctaaagacaagccggagacattagttttaagtaataagtacttaaaaactaattatcaactcaaatctatagaaattattgaaagaaaacatgaaaaaacttgaaaagtaatcggttataaaaccgatcgacggcagaaaagatagaagccggccaaaaccactcatagaagctggatttgccggacgataaccggctatctccactaacagaactggaagatatcgggcaacagtccaaaacacttgggacagcgattcaccggaaaatttccggtctgtaaacatcaaaaactttctctctctgaaagttatgtgagagagaacagagttttatttgaaattgcggtttacaaaaacaaatcggaaaccacactacacaacacggtattgagaaatcatatattagcccatgtgattcgaaatgtatttttgaattttgtggagtgttttaagtttaacggacacaaaatatccagatcagggggaaaattctcattttcaattttgaatccaaattgtttaacggaataaacaagggcatttcgtaattacatataccaagctttttccttttctctccgcaaactattcatttcatttctctccaagattttaattttgtttttgattcatcgatcatttcattcacttcaaaattctcttccgattattccagaacagaagcgtgtgattgaatctgggtctgttgcttcgatcgttgaacacaaacgcacaaatctctcaggtataaaccctattcttagcgatctagaagaatcagtgtgatgatgatcttcgtatcatctctgttaatcttgtttattgctagtttttgaaagattaaatagatatatgatcaacgttttatggttttgaataacatcagttacatgtgttttgatttgatcgttgtttctttgattatgaaaatcacaactatttgagatgatttgtctctgtttgtttcaactatcatcatgtgccacagccgatgcaattataaacgtttcgtggttcagttttgtctctctatctcataatcacttttgctaattcaaaactttgaaaactgttttgtgcgttttgagcgatcatg

SEQ ID NO: 34609 - DNA, 3003 bp, Unknown
  misc_feature (1)..( 3003): 2750-1469P.txt file - cDNA_ID_3080123; gDNA_ID_2685553; Annot_ID_193289
ctgaaccttttttttttctttcttgtttgcagtaaagtctttagactcttagttatcctattataaaagaaattaagaaagaaaaatttaattttacattcaaaaaggagaaacaaattcaaatattaaagaggctagattttcttctataagatgtacctgtaaataagctaacatagcgtcacccacataaggattctcaaatctaatgaaaacttttaaaaaacgttcaacaggaagtataaggaaagtagggtctattggcatcgttctatctataagtagcgaagtcttaagacaccgtacctcatctcttatccttcgatagagatggaaaacatcacgaataactccgagcgatccctcgaccgtccaaagaggcaaagacctgtctccatggagaatgttggaggaacggcgagtggaagtgaggtggcacgatcagcaacactgttggagcttgatcttctggactgtcccatctgctaccacaaacttggggctcctatctatcaggtctctctcttcctttcctggtttataactttcttttgatggaaattaaaaacaattagtggcactgacgagtccttaaaagatgatttttgttgatatgagacttttagaataacatcatcaatttgcttgaaattcatgtatttcaaatgttactttgatgaatttacgaatttctcgatttctcaaatgtaatcttgactgccacattgagttgataagatgttattctttttcatttttttgattagatatttttataagttacactagactagttcataaaactttgataattaactaagtctgagttttgaatttcagtgtgacaatggacatatagcatgttcttcttgctgtaaaaaggtgaagtacaaatgcccttactgtagtttgcggattggtttttttcgatctagaatactggaaaaaattgtagaagcagtcgttgtctcatgcccaaacgccaaatatggctgcaccgagaagattccatatgacaatgaatcagaatcagcccatgagagggtatgcgagttcactctttgctactgccctgaaccagagtgcaagtacaccggcgtgtacacagatctctaccgtcattaccatgctgaacacaagactgatcactcatggttcaagtgtggcgagtacaataacgcgtggttacacgtcaccggtgaaaaattaagctttttagtccttcaagaatatgaagatggtccattggttgttgttcaatgttcgatggagtctcatggaatatgtgtgactgtgaactgtatagcaccttgtgctccaggagttggagaattctcttgccatctcatctaccggaacggaagtgaaaagattacgtttgaatccaagaagatgaataagattcaaaaagtgagccctgaaaatcatgtggcgaattacaagccgattccttactatttacgtggtgaagcctctaatttcatgtcgattccttactatttacttgatgaagcctctatattgaagatgcaaatttgcattcgccgatcaggagaagaagtataagaagctgatgatgatgatgaagaggatcataattatcatatcatatctcttgtagtaggttattaggttcatacatcagtggcctagctagtaatgtattaaatgatgtttgtcttttgttgttgttgttgttgtagctgctttcatctatgaaagctaaactcatattttaaatattgcttatcgtttacttaatgttgtttctttctctctttttcttttttttccgatgacaatgttgtttctttctctaaccattgattacacttatacgtctttgaatttagtcctccaaaatgtaattttaatttctatatattgttgatagaactaccatgtatagtcggattctttggctaaattagaacttctttcctttgtttggctatgtccttaacggttttaggaataaattataatttgttgaccaacaacaaaaaaaaagtaattgttttttataagagcaaagaattcttgtatttttgcaaactatgcacagattagtggtagatgttgttatctcttgtttgttttttttcgtcaactagtttcttggtttattaaactttatgatttgaaattgtcaaaataattacccgaaatgccttcaattcactcactcccgaattaataaatacatccattatgtacataacgaagcaaatgtaaaagacttgacacttccaaatgacaaaaattaacagagggatcaactagaaaattaggaaatatcttctatagcacaatatatcaatctagctaggattcgatattggaagctacctaaacatggttgggagaaatgtaattatgactagagcttcatcaaggattcaatagcaccaacaataggattggatttggcaagatttcatcaagagtcttcctaagtgctagggtttattgttgggtttgtgtgtttcctagttctaatttttaatttttgcgcaaaacttgtttgattaaatatctcacactaatcaaaaaaaattatatcttttaacaaaaaaaaaaacaatattctaactaatttcatagttttctatgtttattttaacaaaagcaaactttatttgtttattcttagtatgatttttatttatttatttattaaagtaataaacattttactataattttataatttttgaatacatgtttggaactttattcatagttcttaattatcaatcatgtttttgactaatttttgatagattttatcataataatataattatggtgttttaataccattatataataatatattatatttattttagttatttttatttaattgctatgacacccacagagattctgaaacctttctgaaaaaccattccggcgggaaaatagaaaaaggcgattagggtatatactcatctattgacattgtagcgaagctaatcccatcgaaatccgatagccatg

SEQ ID NO: 34610 - DNA, 3003 bp, Unknown
  misc_feature (1)..( 3003): 2750-1469P.txt file - cDNA_ID_3080151; gDNA_ID_2685553; Annot_ID_193321
taagtcaccttcaaagaaacatcaaaatcacaaatccatgcttagagatggaacaaaactacatcaaaagagacaatcaaacgattcaatcaacaacgaagtaacaattcaccacacgaatcacctgaatcagagatcgaatctagcaaaaccagagattagaccaaatccaaagcgtatcaaagaatcagactcaaatattttctgaatctgaagctgatcgcagacgaaatcggaaaaaatgagatccgttatggttttaacaacgatcaagagagatttaaaagaagaagatgagattgagactaaccatctccatctttgtcgaagaggctaaaagcttccttaaactcagagatctgttcatcagttagctgatccgccatagcttcttcttctcgtttctttggtttttcgtttcagagaagaaatgatttttttttttcctgaagtctccgaagctgtgaaaatatcttagcgaccgacaaaaacaattatacgacaatgaggaaaaagttaaaacgaaattaaatgtttacggaagataataataataatttactagttgggtttttagctaatcatgtgattagtggatgtgggacttgagaggaagcccaaagggcccttggatacacattaaggcttaaaaatgttttaataaaacaatttacatatttaaaaagtaatgatttttcaattttgaatgataaataagacaatcctcaataatacaatagtacttaagttttaagctgtaagttttccaaaattaccattgttttattattcagatcatcattttatttgacatccctgaaaagcaaatatttacttttgagtttaaaataaaattgtgtttacttaaaaacagttttatcctaaagagtaaagacctaatcttatagtaaaagttgacattacttactgtataataaaaaaaggattgaactagtagtttctaaagataggaacaaaacaactgttcaattttcttcagatgaagattaaaatctgttattattttaaatctcggggactacaaaatttacctccaaatctatgatttactaaaaacaaaattagttaagccaacattttaactaacctaatactatcatttgaacacttataggtatgttaactgatttcaaaattatctatatacatcttttgtaatggcatgttttccatcaatgtgtgtgaacattgaaaacataaactgttgaatatctaaggtcatctccattggtaagaaaccttcaaagtttctcaaaaaaaaaaattactaatattttattatgacttaattttgtaattaatatattcttttctttttttcagttgtctaattacttcaaaatttctctgcacagaaacgtttctgtaattatgttattctctctcctcctttatgaattgtttatattatattagtgaaaagcaactctcaaaattgtaaccgatggagatgatctaacctatttaccaaaaacaattcagacaaaatttattttcggtttagtcgttttttttcgttttcttaatttcaaaataatttactgggaaaagaaaaaatcatcattacgctcatgtgaaaaaagatcgttcattgtatgggttttggaagttagaaaagtaagcaagcaacttataccctattggccattatatctaccgagaaacaacaagctctttaatttataaattcgtgtagttgccttaaacaaaccccaagctttcattacacaccacaaccaaaatcgtagtttgaagattctgatatgtcaaagaagcatctcaagccgttggagacatgttttgaagatgaagaagatgatgttatttatcttcctccaggtcttgtgaccggtgcaacttccaagaagaatgaggagttttgtggcggctccggcaaggtacaaccgtctgagatgaagcgtcggagtgaagggacctcaacggacatgacttcgaagagagccaagaaggtttcagcagaagatgagaagaaagttggagaatggacaaaaaacccatattttcaaagactgtggagtgaggaagatgagattgttatgctacaaggaattattaaatttgaagatgttacagggaaaagtccgtttgaggatagacacgggtttatagaattcgtcaagaactccattagcttcgaggctagtgtgcaacaatacattggcaagattagccaattgaagaggaaatatacgaggaaaaggaagmacggtttttctgaaggtcatgaacagaaatgtttcaaactggccatgtctatttggggaactaaagaaacgtctaagaagacggacttgtgctcttcacctaaaggtaaaaaagttaaagaagaagatggagatgtgacaaactctgattggtttgagaattcgtttctacttccatcaattgagagtcttggtgtggattcggttaaacgtaaatggaatgttgtgcctatggagtttaagaagaaaattgaagagaggttggagttgttggaggctgatgaaagtgaatgcaagaaaatggaagagatgttgaaggttaaaaatagcgaatgcgtgaaacaaaagactaaccttttgaatgaggtgatcgatgtgatgacttgagattttagatatgaagtttaatgttttctagtggtttatcttatgactcttttatgttggattatttctttatatatcttagcataaaaaaagttcattttggtagaaaacagagaaaaaaggattaattagtaattacgcaatctaatcaaattttaaaacttgtgattatgttaatagcgctataattaaaaactctgatccgtttaaaatgaaaatgacttttcagatttcctttggttgctccgctacttctcactgtcgctctctcagcttcctctctcacaatcataaaataaaaaacaaaaagtagcttctccaagacgcggttcccaatatctgcgtttcccgtttgcgttttccggcmatg

SEQ ID NO: 34611 - DNA, 3003 bp, Unknown
  misc_feature (1)..( 3003): 2750-1469P.txt file - cDNA_ID_3080176; gDNA_ID_2685553; Annot_ID_193312
tggatgtatgtattattaatggaaatgtaaagtgttatatcactagattcacttctatatgttcaataaaatgatcattcacttttaagatgtctctatatcgatgattaatggagaactttgcctctaatcggttaatctcttacttcatggggttcttatttggcaaaactatctcacgtggcttcaaagacagtatcacggaagcacctcaaccttgaacaaccgccacatcccaggcataacatctatttaaaataattgatcgcggaataaacacacttatcttgccacttgcgaggcggcaaattctacgattcacggttgcgttatggttcagcgaaactcgtagcttacagcatcgtcacgccatctaagatcattgtccagattccagagcacacaagtcttaatgtctcattatttacgcagacttttacaacaattttagtctttcggggatctgaatacaatacatagaaactaaaatctaacaaacattcaacactaacacataactagatgcatatcctctctgtgcacataacattgaaaagtccattcatgatcttgaaagctgatagctaggttcaatggcctttgtcaaagagtatattgatatcgacaacattatcttggtaatatggaccggccgtagtgttttgttgtcgaaagcgaaaaaaaataaatctctaatcttacaattaaacccaaaaacaaaacaaaatcaatctcactaacaaaaacatattaaataaacaattaatgttttaaaaggattggaacccagcacttaaatttataaacgcttgtctcatcagttttagcctttaggtcaggttagggcctgttggtaatgttaccactacaatcatcaaatttaaactgagctcatcgtccattcatatgaaaaagtaaaagtaatttgacccagtcaatttagtatttacatatacagagaggagacgtgtgtctcggaaatttttatagtaggctcggcccaacccaaaatttttaaattcattacaacattaaaaaaaattgttttgtgctaaaaaaaattgttctaatcgtctattttacaactttataacgcccaatcctaaacattaaatcccatattcatgttcaatttgtaactacagagtgtatattttctttttaatttaaatattattaaattctaaaaaccaaatttacttattagtaaaaaattaaccggattagaaaaaaaaagacccatattcaaaaatacaaaacaaaacaagatctacagtacaccagaaaacacgatcttcgtcttctagatccaatgctaatatgattcctctgcacacaagacctcgatattaagatttttcccggagatattaaattccattgcaacctagcaccgaaaaacgaactgaacccaaaactttctttttggaaaaaaaaaattcacaaccaagacccatgacctcttctacttgacctaaaaagaagagagatatcaaacctttaataatatcaacaacatgcattatcttatgttggatttgaatccaagtggtgagaagacaaaataatactagcacaaactaatagctaggctacatgtccaaataatatgttaaagtcttttaaaaccatttttgtttttaatttataaacaaaaagtttaagtttatatatatatatatatatatatatatatatatagtttttttatataaaaaattaaaatttatataacgtaaaattacaactataaatcatggtcatgcaatatttagagagtggaaggaaagaagacgaagcatcctttatagtttatatagtcagatgcatttgattacgagagtgacatgtatatatatatatatatatgattgtcagattataatatgtgtcaacatttaaaaaaaatcctaaactgttttgaattagttgaataaccaaaaatgatctgtcagattacagttgactagacgattaattaagacaaaaagattgcgatctttttaaaataaatatattaagacctcgcggcatgcatggttctttttttcgtttttttttctactaaaattattgacgtactgtatagtatttaacgcatggcaacaaactaatactatcctgaaaaatctttagatgtgaatcacatcatgtgatccgtatatcctggaattttttgaatatagggatattgatctactctgtttacaaaaaaacmcaraaaaaaaacacaaaagatttctgaggaaagaaactctatttaatatcacagtgagaaaataaaagtaataaaaatttattacataatattatgtatatatgtaacctacggatggaagcggacatctagcttttctaaaatttgtatttgtgaattgttttgtttttgaaaaatacatgttctaaatcattatagatactcgaattattttgaataaaatcaaagcggataatttgtttctaccgatggcatggttcgtagtcaatcaagccatggatcatagttatagtagaagcttaatgtgctcattccaaaaatgtcaaagtgattttttaatccaaaaccagtcaaacgtattggcatctttgcaagaagtgtattttcttctatgttacattggtgtttctactcgctataccttagaaacttgcagaaaaattttctagataaaacaattcttctaactacgtcttcgataacacatgagtaaaatttgtttattaaatatttcataatttctctatttctccaatttattcatataaaagattacacacagtccacaactatgtccaagttgagagtattatactgaagtacaacaattccacgttgaaaaagtgttaatcaccattaattttcgttagccagccaacataattttttaaacaccgttaccatttatttttttaccatttaaatttttgtataaaactgagggtatagtcgttgctcaatatcattacttaagccaacctaccaataataataaaagagaaatg

SEQ ID NO: 34612 - DNA, 3000 bp, Unknown
  misc_feature (1)..( 3000): 2750-1469P.txt file - cDNA_ID_3080192; gDNA_ID_2685553; Annot_ID_193307
  misc_feature (830)..(879): n is a, c, g, or t
aaaacaccacaatgtttccgcaattgacagttgtattccttttctctctcgttgtaatccaccctcttcatgtctcggccaaaacatggtgtgtggcaaatgtatcggcggcaagtacacaattacaagctaatattgattgggcatgtagtgaaggaaaagttgattgtgcaacaatcaatcctggtggatcttgctttgatccggatactcttgttagtcatgcatcatttgtgatgaatgatttctaccagaatcacggaagcactgaagaggcgtgtaattttactggtactggtcaagtcgttactgctgatccaagttatggtagttgtgtgtatacatagattacatagtttaatgaatggttttgctattacaaagtttgtttacgaataatacaattatgtggaatcaaaaatatttataaaaattatgtaaggtttataaaaagtaatgttatcattcattcatctttattcctattaagtgtttttatcttgattaatttgacattatattcaccattttatgtgattctctcatacaactaataagtcatttmtattttattgcaaacaccatcatttagtgatttgtttttataaaattatcctaaaggaamtttggtaagaaaaatcaatactaacgtaagcttttaatttcttaaggttttgtcaaacaatctcaatttctaattccaaaaattataatttaagatatcagaaattacactttctatggaacaataactaaatttccaagatcaagaaatatttatatgttgtaaattctaggtaatacaaatatgaaaataaaatattattgannnnnnnnnnnnnnnnnnnnnnnnnnnnnnnnnnnnnnnnnnnnnnnnnntaaactattatttatcaaaaaaaagtaattaactatttacccatttaaagttttaaatatgtactaaatgaccaacatttcagaagtaatttgctaaacaacaaaagtaattaagggaaagggaaaaacaaaaacaattggagtaatgtggctgcaagttgcagagtttggacataatcccataaccatatatttaacaatcatagtttaaatccgtataatgtatattgtaaaagaaaaagaaaaaagaagcaagtaaccatgtatttaacgaatagagcgtatataaatattaatcagcagaatattatccatgatatacttttcaacattttctccacatatttttcttttactgtaacagaaaatcagatatatacattataaaatgatattcaatttttatgtacttcaaatatctaataattaatagtggctaaaatatttcaaatatgtaataagaaaattattatactattcctatgaaatagaataagtgaagaacacagttgatgataaggaattagtaagggcttttttttgtgtagaaatagagaaagaaacgtgcatggtcatcgtccacgaacaattttccaaatgagacacaatctcataaaagcggtaagagtcgagtcatcttcatatacaagttcattttttcacactttggattcatcccaagaaggtaatcatacacaatcattgtttattctttcaaaatgatagaaatcatatcttttgtattctttcaaaatgatagaacttgattatactttaatggacttttcccgacatttctatgatatatctagagagatttcaaaacagaacattataatgccagcaatgttttttagagccagaataattaatttttatgaagtaagcatcaacttttgtttgagttggaagtttattgttgtagggtttgcttgaagaattctaaactgcaaatttgacattaaaagattagtaggatagcaaaaatattaaaatattattagctattaattgatcattaaaagattttctaaattacttataattttaaaatatgctagatacataagaaaggtacgtgttatctttaacgtttcattagtccatgcaaatgtaaccataaagttattataaataatatatatatatatatatatatatatatatatatatatattcggctaaattaagttttgaaatgtggaataaaacatgaaaaactgcatattaatttaagcccatattcacatcaataatcttgtcttgaaaaaatgacttaatgaatgtgcatttgttattctttagtggtaaagtaaagatttgtatatatatttgggaagactgaaaatatatctactgtattttcttaagatatacatgcgaaatatgactggcaggttcgttatagctcttaaacttgaatggtagattagtgtgcgtggaccgttgtcctcttctcttcgagttaaaactgttttaggtacttaattcattaatcaaacttagttaattgccatttacgtatgagtcttgctacttatggttttaagaagaagaaattgtagtgattactaaaccaagaagggtaaattctttgcggaataaatcatccactttaaatcaaagatacaatcttttttttctttcaaaggcatatatatttatttatttttacgtttttacaatttacatatacgacattgaacatgttggaattggtagattcaatcgtaacacgtctacgtgtctaacctttcaataccaagtcctttcatgttctcgggttggcccatattagcaaaattcatgacgtctgccggtacacacgtatacgaaattgtattattgtacacgaacatacttacaaaactctaatcaaatttctaataattttaattaaataataaaatttcaacggttacggttaaaacaacttggcaagtcgagccaaaaagatgtagacgtttccgtaagctatttctatattgcttcattgatacacgaatacacgtatgctacggagttaaattgatacatgacaacattgagggtccaaaacttacaataaggacaagattcttttaagaggagcgatgaacatagaatatagatacaaaaatg

SEQ ID NO: 34613 - DNA, 3003 bp, Unknown
  misc_feature (1)..( 3003): 2750-1469P.txt file - cDNA_ID_3080195; gDNA_ID_2685553; Annot_ID_193306
cgatataagacagctaagtgctcatctcttacacaagataaagtcacatgttctgaaaacaaaccgcaagagtgaaacggcagaggaaggcgcggtccaaatctctcagcagtaaaatcaaaacacactaaaaaatctttgacatttggagcttttgctatttctttagcaaaaaagtaagtttttcctttcaaagacacgccacattttatatcacaatcgggattgacatcaagaaccttccatgcactagagttaagatcgtagatatcataaaatccaaaaaagtctgagtactcaaaagcatcgaagaaacctcaagattttgtagttacggttcttgttctcgtatccgaaagcaaacttgtctgatacttgatatttgtggaaatcgcttatgggttgaatccaccctgttccccccagataagggttccacactacaggccatcggttacctctgaagacgcataacaacaagccttcgcaatgaaagactttaaatatatcgagttggtcaagtatacttactcgctttatagatggttcaacgaagtcgctttcgtaattgagtccttggagatcgaactttattgaataaagcccaaaatctatcatcatgaaccctagaaactgctgcctcgttttgccaaaaatctgagtttttgataaagcgttccacgttttacaagtagatcgcacggcactcagagatgttaatggaaccctagagagtatctcttctaccaaagccaccggaagatcagagattgtcctcatgtttatagattgtgaatgtgttatctcattagaatgataatgtccatacatatatatagatacacaaaggaattagggaaaaagctaattgcacattcatgggacgattaggtttcaaggtttccttatttcggtttagtggtatagagagtctggtttatgtaaacaggtaatcaagtgtgatttccctggttaaaccgaaacactctactttaaatagagtgtttcattgtatttgtcatttgagactttatgtgaaataacagaattatcattgttcttcgtttgtttttcgatttctcatcaactattagggttgaaaaaggattttgaaaagctttataacgtttattagcaaaacaagtttgtgagaattactctgtcttcttctcgaagtaagaaaccctaaggagaatcaaaagaagacgagcttcacgtttgtctctgttattaagtgtaaactaaagcatttcgttaatcttttctgattaatatagttacaacttttttgatgatttttcaacactaaacgacgattaaaacagagatatagaagcatgaatattcattaaatgacacataagagtaaagaggcgataagagtaaaataggagattcaattgatagaactgtatttgtgttacaacttgttcaagtaaagtacattacttaaaaaaacgaatgactaaaacagagatcttaaaaatctcaatcagcaggctatagctttcgcaaccgatggaactgtaacagacattaccctcgaaggctctctcaaatccttagcaggtcggggttcaggcatacacttaacatgaactatacgaccattcttggttaagtagactgcatctttatacatccaatcatcatcttcatggctaaagaactcttcaaacggctctacgcataatgcgcaattcttctgatcttcatccgcaggcaccatgagttgttttggttcttcgtcctttcctttcttcttctgcatttctcctccaaaagatgctacttctaccgtctctcctcccgtcgctgcacaaagccataaagatgcacttgctaaccatcccctcgatttcttcggttgctgacccagtcttgtagtggttttcaccgacctgttcttccttacatgccaatccatgtgtttactatgctcttcttgacacttgaatctcaacccacacgatgaacattgtctcggcatatcagaatacagagacttaatcacagattcatgtcgaacattaagtgacgatggattatcaaagcttaatccaacaggcaaagaatcactattacttgcttctaaagttttcttctctttctcattgttaagaagactaagcaaatcagtcaattctttgctcaaaacaattggttgatgcatagattgagacacaactgaaaccatgttcgaatgattcatcggattttgaacattcgtaaaaacaggagtgtttggtacaaaattcgatgacctaacaggataattcggagttagggttcttgaattcggaacccaatcaggtaacgaatctaaagagagattgtcatcaagcttacgataaggtaatggaagaggaacaatttggggattagggtttccataaccagcaacaaagggtttctgataattgttggtgttagaatcattgttacgtaatgcaaaacttgaattagaagcaatcacatcaacaccgcaattgttatatgattgagaagaaaccctagacacgttattattattactaccatgatgatgatacagaggattatgaccagatcggaattgctgttgcgcttgtgatctgaaacgtttttgcggcggcgcgtaacggttcgtctcctcttgataacctccgattccgccaccgtaaccgcgattgtcgcttcttctcttcatcgttgttctagcgtttgcgtttctctgagcagagaaagatccgtttgatgccatcttcacgattaaacaacagttatgagttttcagagatcgatcgcagaaagagaaaagaaaccctaaatttggatttggtgattgcgttgagagaggagaattttagaaattgaaacgattgaaaaataaaacgaatctgaagagacgcgaagataggtttctctataaataaacgtttatgtcggttgataaagtaaaccgcgtgaatcgcgcgttgtcacgtgttttgggccacggtttataggcccagtttgttaatg

SEQ ID NO: 34614 - DNA, 3000 bp, Unknown
  misc_feature (1)..( 3000): 2750-1469P.txt file - cDNA_ID_3080221; gDNA_ID_2685553; Annot_ID_193298
  misc_feature (1879)..(1928): n is a, c, g, or t
gcaaaatcatcgccgtatcttccgctaatctacacgtctttttgattcccatatatatgatcgattctaatatatatcaattctttcgatgattcattttcattgtttattttgtttcgatgattcatttttcctaagaacctgcttcttactttcatttctttagccgacacgtcgacttataagtaatatactccataatatagttgttttaggctaacttgttttatttattttatcttcgttaatatctttgtatataatcttttttttttgttgaagttttggacattcggcccattctttgggtttagagaccaaaacatgctaaaacctttttttttttggtagaaataaaattcaaactagttcgatactaatttatgttttgtacaatccgtctttattgaaataacgttcttttttattccttttttaaatcattttgaggatttttttcgacaaaaaaaagttaggattttttttgctttcaaataaaacattcacaccttatcaaaccagttaacatttactcatttttgatgggccgagcgagtaaagtgggagcaaagcccacgcccaacattattgtgaaataaattattgatgaaactgtgaaaataatataatcatataagttagtaagataaaaatctagaatttagagaatcgaaatcatttaatgaaattatctaacaaaaaatattatatattgtattatccatcatcgaaattgttagtaacagataatattgtttacaaacacactaactttaaatatggaccaagaccatgatccaagtaaatagccatacgattatatatgttaaccatctagagagaatgatccctcattactttataagaaacacatccgacagctaatttaaccagtttgtgaacgacgacacatatatactaagaaacattaccgggaaaaaaacaaagagatataatacttggacactctagtcaacacaatgtgtagataactaaagcagctggtctttctaatccatttttagataaattattctttacttcaaaaagtaaaatatcttaactctacttatataagccttttggtatatctttcactatcgattcctctaaatatctatagatattactatggtgtataatagctatgaaaatcatttacttctcacataaatagagaaatatagaaccatcagatggaaacatacatcaacatctccaatttctttcacacaaaataaacttattttgtggtcatgggctttggtcttgtccctctttgagcatttaacaacaactttaccaactaatcttcttatattaaatatgaattaatcgctctaacaatatttcaaataattaattataattatatcctccaactgttatcctaacaataattcaaaaataattaattaattcacaattatttcccccctcctctgttttctttttcttgctcaacaatacattgacggttttagttcatgttctttgagttttaaaatacacttttccaaaattgaaagagaattgttgttgtcactttccctcttacctttctttttctttagatatcttcagagaagaaagaatggggttatatgttcatcaacgaaacccaaatacaaatcctcaggacaacaatctagaaataaaaactcatttgaaaaaaatgattcttgatttgggttttccttgttttgttcctcctcgaaccagctctcgtgaggacaacaaagcttggcttctggctgaaacagagccgaagcttattgactcagaacaacattcgctgcagccttcgtttaggttcagtccttgctcacagttggagctggagaagattaaaaaggagaaaccttcgccgccttatcgnnnnnnnnnnnnnnnnnnnnnnnnnnnnnnnnnnnnnnnnnnnnnnnnnngtatgtggctcattccaaatgtgccacacagagtaatgtttgggatggtgaagatcttgagggaaaaccagaagctattgatgaaataggagttaatccatttgtgaggataagtcttggaatcatacaacatttcagccatcaacaacattatctgagacttgatgataacacgggcagagactacgacgagagtaagctgtgtcaagcatgcatcacgccaatctattttggtaaattctactcttgtatggaatgcaatttcattctccacgaagaatgtgcaaatttttctcgcaaaatacaacacccgatacatccacatctgctcactttagtgacttccgcgaccgataaagccaacactcatgatttatgttcagcttgcccatggttgttcaccaccggtttcttctatgagtgccacagagaaggatgtcgttttaatctacatgtgcggtgcgggacaatttctgaaccattagttcatggaagtcataggcatcctttattcctaacatctaaaccaggagattggagaacatgtagtgtttgcaaagagtcaagccgttatgtcacacatgaaacatttaattgcgttcaatgtgtctttgctttgtgtttcaagtgtgctgctatacctcagaaggtgaggtataagcatgataatcatgtgctcattctttcttatgggaaggagatcgagacaagtaccatggcgtattggtgtgaagcttgcgagagaaaaataaatmcgaaagggcagttttataattgtgatgagtatggttgtgtcaccctacacattgaatgtttgattgggaaggacttatatatgaagcccggttcatcttggttattcaaaggtagaaaggtacgtgttcttcgcaacaaccatcgtatgactagacctatttgtagggaatgtaaagatcgttgtccacacaaaatagtgttccgacgttctacattaaacttttgttccaccggttgtatgaggtcgaaggtttttagtctggagctttatcgttagctcttattgaatttgtatgttcaagaatcaccgatgatg

SEQ ID NO: 34615 - DNA, 3000 bp, Unknown
  misc_feature (1)..( 3000): 2750-1469P.txt file - cDNA_ID_3080231; gDNA_ID_2685553; Annot_ID_193295
gataatgtccataatcgttgatgcatacaaagaattctattgcaataaggaagcgtcacgtgaacgtaacaacggggttaataaagtacccggtctattacatcggtttaactacgccaagacacatatttttttacttttaagtcactgaaagggacaaatctcttataggaatagcctaccttatagagtattaattatttataagctataagagactagagactttgaaatcagaaatttcaaacttcttatgagatacatatgtaagaacattcttaaaaaatgattcttttgagttctagttattatcggttgttaaaaaaaaatactttttatgtgttaaactctcaaaatgagaaactttcagactttcagtcttttcaatttttaaatatttcaaaactatcacaataattacatttttttactatagagactttctaaaatagatatatgttttctacctaaatcatctagtttgactgttaaactgcgactcagacacttcctcggtttgggtttatgctaatatttgataatttcaaaaccagaaaactcgacaaaaacccaccatgaacctacgacccgatgattttaacataaaatttaggatttcaaacttttagtgtattcaatattcagttaatttagaaaaatatttggttattcatatcactattctattatggttttagttagatttaagtttttaatctttctattattattgttattttgttaaacatagtacaattatttttatttttatatttataaatttgtataaatatcaaatatattaaacaaattttaatctattgacttatggtcaaacccggttaacctgatgatctgatctgatggcctaaaaaatatttaggttcactgtccaaatatataacattcatgatctggaatgatcgagcaaacaagaaagaaagaaaatatatatattaaacacaacatcaacatcaacttccctcccaacactatatataatatctattttaaagttgaataacgatggctttatatgttgccattcacatcaatcgcatgtatatgagtaacaagtggttctgcttttttgtattaacaaaataataatctgaaccattaaagtatatatgggatgatttgtacggtagaaacgtttatgaattcatcccattatatgtgttccacctatagttaatgtttttttccttttatattaaaacatctttttttacatttttaagttatgattaaaaatgccttctaattctgaaaatattgcatacacttataaaagtttttacataaatacaaaataacatattttgtaaatacagaattttttttgtagttattaaccttttatattctaatatattaatgggtgattgacacaaatagcacaaaaaaactttattattccaaaaatatcaccattttttgaaacttccaaaaatagcatttaaagtttttaatcctcgataattaaataaataataaagtgtttttattaccatttctatcaatcctccaaataaaaatgagagcaaacactaatctaatattaaattgaatcaaaaaacttttaaatagtgaaaatatatatcctaaattggaaataaaaaacccaaatataatactaaaaactaattttaaaataaaaaatctcttttaaatggtgaaaatatatattctaaattggaaataggaaacccaaatataataccataaattaatattaaaatgaatcaaaatttcttttaaatagttgaaatatatactctaaattgaaatagaaaacccaaatataatattttaaatttatttctaatttattttggttgaatagattttagataaaattatggtattattattgtccataaaacttgttttagtgttactaatttctcaaataatgaattgagtgctatttatgtctaaaaaactttttaatgctatttttgtccaaaaaacttaatagtgtgctatttatgggaatttatctattctttaagatattttatttaaattatatattttctatttgattcacattatttgatcgacttttactattcaaacatatatttagaccgtcaaaaaattattttgatctacacttgttacgcttgatccattgaatacatttgatccgctatgcttgatccactttctctattcaatcaatagtttcaaaaagagtatgttaataacaatatttctttttgcatttaacactgttaactcacaaaagtagttttcagacatgaaatagtaaactttagttaataaaaactttgaaaaatactagaaacgtattattcaccgaataaatagttaactaattatatataattttttagttggactatttcaaacaatcggccttcgccgaatctctcgccatcacaaacacatcagcgcttctcaatttgaagttgtgaactatttcatctcgcctgttacattgacatatctccaagattctaattcttaaaacctttttccggttctaaattaattttcgagtatatatcactaaattaataattctataaattaataaaaatatcatagtttagtttattaatttattaaaaatttactgaaacatttcatacttcaccttatacttcagtttcatacttaatcttatacttcattttccaaactatatttaatgttttaactttaaagatctatgtggtcatataattattttaaattacacctgtcgcaatgccgtcacttataatttgtcatataagcaacgtttgttgaccgcattcagcttcatatagtaagaagctgcctttttttaattggacgacgttccatatatttaatttattctcattacagtaaattgttttttaagaacacggaatattactatatataagcatcgagaggtccatggattatcactactctcatcataaaccaaagtatcaaacaataaaagatttttgagaaaaaagagagagagatatcatg

SEQ ID NO: 34616 - DNA, 3000 bp, Unknown
  misc_feature (1)..( 3000): 2750-1469P.txt file - cDNA_ID_3080235; gDNA_ID_2685553; Annot_ID_193294
aagggtgtcaccgagcaagagaaggtggacactttcagaacctcaatttactttgcagaacaaggtgagataaggcaaatcattgaggagaatgggaagttcacaatcgaggcttttgaagatatcattcacgctaaaaacgagtttccttttgaccccaagacattggccatctctttcaaggccttctatggtgctttcatttccgcacattttggagtcgaagtcatgaggaaagcctttgagcttgttgaggtcaaggcacgcgaacagatttctcgcctccataactccaaacccggaatgcagtacctcatcgtgcttcgcaagaactaaaccgtgatccaaatatattgttatatgtgatttcctccattgttgcttctcttctttcgtctatcttatggtgctttgtcgtctcttcttcttgttgttttgtcttaacgtctttgtattctcccctatcctacaaatgaataaaacttcactttacgcttatatgtataacgagtattgttgttgaatcatatgtatatggtttgataacaaacaagcttccatagtatcatcaataatactatatatagaaacacttctgttttcttgcgaaacatattttctttgacaaacattgattttctttgagcatatcagatcagagtccacaatctacactaaaagtctaaaagcataagacatacaatttggatacttcatttattgggtaattggaaagaataataacttttactagtatagtttttaatgatttatctagtacagttttcattatacaattctatatttgaatatagttatccagattataaaatacaattactaataatttgtcagatatccattggaatccattgaaaagagcctgattgcatatgagatatatatatatatattgatgttggttaaaattccattgtttagttagaaaataacaaataattacatcaaaaaattgagagcatgatttttgttkgttttacgattagttctttgkgttagtatattttagtaatataaaattgacttttaaaaatactagtcatctgtttaaatgttcttttagactagaaattttcttttattctagcgtcattttgtgtattttcttatagtatttagattagatttatagctctttctctattattgtaagagttaattgtgtataagccaccgaaaattaaaaaacttctacaaaaaacaaactttttctatgtatacacataactcaccgttgctattgatagaaattcgatccgtacataggtgtccaaactctgtttttttcttgagattgtcaaacacaaaaccaaatatataatatttatttaaatttgaatagctataattccaaaaatatttgttagttaagtttatcgtccaactttcaaattagaagcaaatgtttattatagtattataattgttgtgtatagtaactgacaaaaacagttttcagatgggatactaaacttataataattattcaactaactatatactccattattaattaaaaaaaagggctatcttcatgtataacacaaattatatatgcatatatagtaccttacatcgcaaccaccgatcgaatttctcatcttgttcaaacaatataaaattatccaatgttgaacattcttctttgacggctaagattttgctagttacttggacaaatctactaatacagtgtaacttgcataaattaatatttgataaattaataatctctgtaaatttataaatttttccgatccgagttggggctagtgtaaataatgacagaaatcgataaattaataagataataacttttttgaaagttctatgtaaatatatggtcccatcaatatcataaattaataactacataaatgtatcaattatatatatatatatatatatatatatatatattatataagaaattgttttgaaatatatttataatttttttttgcttaaatttgtatttattcttatttgaaatttagttataatatgtaacggtctcaaaaaaatttagtgttgttttctagacacattattttttatttgtaattgattctagaaagacattttgtatagtgaaaaaagtcttatggaattttttaaaaattaccaaattaggagaatctctctataaattaataaatattaatttatcgataaattaaaacctctttaaattaaaaaattttgcagtcccaacattattaatttatagaggttttactgtacttcactttctatgtagatcataacccgtgttacatcacgtgtaatctttgtttttattcaataaaattgtaaattttgttttttgaagtaaacaaatattttggtgtgtacttatatgggtactggactactggtccttattaataatacaactttgagaaaaaaaaaagaagtaaacaaatattataaaaatttggactctttcttctcaaacaattggccatccatggcttctttgaaggctatgatctacattgacaaatctgctagaagtacatgattacagataattttacaaactaatgttatttaattgcgataaatcaaaacatttcttttggttctaaattaagttttcgacaatttatatatcactaaaataccataatcctgaatttattaaattgttaaaattctactgaaacatttcttacttcaatttctaaaccttatttgtgtttcaatttccatataactatttaacacatatcatagtctaattgattatgtcatatatggaacgttatgttgaacgcattcaagttcctataataaataagctgttgttttcttttgacgagtttcccatgcacatgtttaattagttctcagtatattgcctttcaagcactatatatataagcatagagagaggtctatggactcactactctcatcataaactaaagttaaacaagaaaagaagtttgagataaaacagagagatatataatg

SEQ ID NO: 34617 - DNA, 3000 bp, Unknown
  misc_feature (1)..( 3000): 2750-1469P.txt file - cDNA_ID_3080239; gDNA_ID_2685553; Annot_ID_193292
ttctgctacaatgggggagaattgtatagagttatggattagattgagaaattggggatcttagggttttatgttgatgttctaaaatacgttaggcgcttgttaaagtcgaatctatcgagtaattgatgaattggattggtgtgtatagttctgataaggaagagccagatgctgatggaggaggtcaatcaatgcttggtcttcaaagctattgggatgcagcgtattccgatgagcttactaatttcagagagcatggtcatgctggtgaagtttggtaactttcttcagatctcactatggaacttaagagagaagatcctagctattgatttatttttttcttttcgcaattttaggtttggagatgatgtgatggagattgttacttcttggactaaagacttatgcgttgagatttctcaaagaaacatgtctgtttctgaaaacgatgttacgacagaggtgaatgatcaggctgataagtatttgtctagttggaatgtgcttgatcttggtactggaaatggcttactccttcatcaacttgctaaggaagggtgagttttctaaacattttctcatgctctggctttaaatgcttaactttgttgtttcaatcgaagaagctctatggactatggataatgctatttgttaattttcactagcctgattaccactcggttagtatgagaagtttagaatcatgtagcatttatagtaaacaagctatcataatgtactggtttttgtctgcttcctagaacttctattgaatttcttgtttatagaggatccctagatggtggccgtgtatcactagccttttgggaatataacggccacagtgaactttgatgattataggttctgaaccattgtttgtcacgataaagaaaaattccatagaaaataatgtagaaattcagaagtcagcctctctctgaggcgtaagtcccctatgcagtgatacaaaaatgttactatatctttatacctaaggcatttcgtgcttgtttcgtcagtgttatgaaagccaaactgtcctgaatgtggtattgctattaaactttatcactgataattgttagttatgtagaacaattacacaccaacacatttctaaccagaatcttatgtttagactctactcttgttttgacattactaatctcatcatccttgcacttttctggcttaggttctctgatttaaccggaactgattacagtgacggggctgtagaactcgctcaacatctttcccaacgtgatggctttccaaatatccgtttcatggtatgaatttgttagcttcaatataaaaaagagttacagaacccaactacaaaaagtctgcctccacaaaagtctaaatgctgtctcttctttcttgaaaatggttacttaccttgatcaagcaatgggatacgtacgttacatgaaattaacatctagtagtacaggacacagaaatcttctctatgaactagtaatccttactgtaatgagcatcagtagcaaattgttttttgggaaatatagatctaaggtgctctacgttgtggaactaacggttggctctcataggttgatgatatccttgacacaaaattggaacagcagttcaagctggtaatggacaaaggaactttagatgctattggtttgcatcctgatggccctgtcaaaaggtacctcctccttagattgctatcctttatagtaaattaccgcactttctttctgttacctagcacacaattaggtttggttaccaataacaatcccatttgtctgtttcagagtcatgtactgggattcagtgtccaagctggttgctcctggtggaatattggtaagagcatctcgactcctgaataagatttaggttataagcagctaaagcacataagtttaagctgttagaaagaaaccaaaggctcttgtttcccgttttgcttgctatagaacaccttaaacaactgcatctatgtctaatctcaatttctttctgcttctgttaaaggtgatcacatcgtgtaaccacacaaaggacgaactggtggaagaagtagagaatttcaacatcagaaaatccaacttatgtagaggagatggaaatgacgcaaacaatgtactttcctctggctctgaagctgcaagcagaattgatcaacctccgtttgagtatctcagccatgttaggacatacccgacgttcatgttcagtgggtctgtaggatcgcgtgtggcaacggttgcttttctgcggaagtgagaacaaacctgttggatttgttttaacataatgcccagaccttttctcttctttttatgttggtgtcaagcaagactgttgatgtgcttttgggagttcttaataacctctaaagttcttttaagagaaaactgatttggtcatatgtcagtgttttttttctttcttttttgatgttaaagtatgtgtcatagactaattcaaaaatcaaagaaattagtaatttgaaaacaaaatgagtggattcacttgttccttgaaaaaagaataaaaccgacaaaaagaaagattactattagaaccgaaccacatttaatctgcagtctactccatattagattagattattcgattttgtttcggataaactcggatttttttggattgaaacactcttacattttcttagttattagataacgaattaaacaagttgaagcataaaatccaaaattgttagaattggaagttagtacttgagtttgatgtttaagattgaaacttgtaatgtgtaaatcttataaaagagtagaaaaatcatacacgttagacacaaaattgtacatttccatggacgaaaaaacgacagcgttttgaatctaaggaaaaaaaaacatccagaaacagtcccatcagttgcttttcttcatcctctttagcaaaaaatctcagaactcaaaaaaaaaacatccaacaccaaagacaatggagatg

SEQ ID NO: 34618 - DNA, 3000 bp, Unknown
  misc_feature (1)..( 3000): 2750-1469P.txt file - cDNA_ID_3080243; gDNA_ID_2685553; Annot_ID_193291
  misc_feature (1299)..(1348): n is a, c, g, or t
aaatgtaacgttcagtaatattattactactcttccaatcctatgtggctatgtcacgtgtgtgcaaatgtaacgttcagtaatattttactacgttgagattgttagcctattttacaacacgcaattattgaattgatagacgaaactatgaggtggacagcgaaatattttgtgagaatttcttcaaattttgtcaacagcggaattctgactatgaggtgttatgatttgggattgtatcaacaacgtttaccatttgtcaatttcttgtacatcaatgctaccattggtcaaaatggattaagaccaaagaaatctacgatcgaaaagagactatccgctatcgagagcaattcaggaaccggatatttttagtatccctatcataatgttaattcataattattatttaatatatgtagttgcatctctagatccttttcaatggtgtctttattttttactctaaatttagagttttttataaaatataaatagaacatagctttcctccattaatagttgattcaattttttttgctttaaaatatatattcctaatatattctgttttaatattttattttaatttatcacatagttatttacttaaattttccaaattctatcaacttagtttaacttatgcaagaattctacatttttatttatatatttaataggtaatgaattttaaaacattattttgcatagttataacttttatataggtgatgaattctaacacagttttatatattttaggtgatgaattcgattttattaagaaagaagataaataaacataatttgttaagtaaagctctttcttgtttgatttgatcattgtaaattatgttttgtttaagtcattttaaactaaaaatgtgactttttcaaataaacattccttacattgtattgcatagagggtttgagggatagtaagccaatgagaagatttaaactaacttaaaataaaactttaattgaatacataaaaaacaagttttgtacatgaaaaaagttatactgtggatattttgtggaagcccctatttagacatggttatttttgtttttaatatttcattcaatcggtcgtaagtaagtgtattatatctcatgcaaatagtaagctctatgatgaagcttgtttctcatgaaacaaccttaataaagtgagatctcaaacggtgagagggacaatcttggtaaaaaattgcatcaaattcttttgtcgctaactacacttatattcttacaaaagcatatgttatgaattcgagctcggtnnnnnnnnnnnnnnnnnnnnnnnnnnnnnnnnnnnnnnnnnnnnnnnnnnaatatgttatcaatttgttctcttataaacaatgatgaatgatcttttgtaaactctgtgtgactgtgtaacaatagtaacaaggacattcatatctaaaactgaaaaccatcttcagagtccacatttggctaagcaatcacacataagttaaaaaccattttgaaacaaaaacaaaagccaacataagctccattctatcaacaatggagcttatgtcttgcttccatcttggacattatttagtcgagaataaaaactttcagaaacttagtacaagcgagcttgcaagcttcagttttcttatttgatttgtattaaaagagaaatggaatctgtatttgacttagatggatattcaccatcattctttgttggtctgcaaaatatcaagcaaaaaactataagmaccacrttcaaaaatcagatcatggcctccaaattttgaagtttaggggacagatcataatccttattagacaatacaagatcacatatgcacgagactaaaagaatgggatcagawcaagcaaaaatcacaattgtctcaaatgattcaaaacagatatactcaaaatggttttaaacacacaatctcctgtcaaatataacctttcataattgactgatgatcataagttgattataattagttagtttcctttgtttaggcccatataagaaaatatacgctgcccattttggactaatttgtcgtgatagcatcatcatcactgtatatggatttaaataatatttttttggatttaataaatataatattatttacaaactgaattaaagtttttatttaataaaacgaatacgatattcatttaaaaacataaaacacttgttagtgctacaaaattttagtgtaaaagtatttacttatctttatattatagtcatgttaatttttgtcattagatattcttttctttagtgcaaagagcaaaacaattgtgaaaaaatagagagagaaagaaagttcacaggcttctttacgtgatgtacaatacaaatgtggaaattttgataacgtacagccaagacatttgattttgctatatttgggatatagccggtagcttttgtaatactgtctaaagcaacactggatgagtcttaatgttgtagacatattttgggctgtggaaagactttacagcaacaaccaatcatcccttttggttttttagatctcctgttattcaactaataatttctaattaaatatctttctatatcctatgttattaaacatgaaatacatataaaatcattcaaaaccatttataatctcttgttattcagttaatcatttataaaagtcatactacagaaacaagaaattgaaaaatctgtcacaatctcaaaataaatgatataaagataagatgataaactgattacggttttattaacgttagtcttgtcattattacaacaatcctataaggatatatgcgttatagcattactataaaagatttacttttccaaactattgaaacacagaatcaaaaaatctatagaaatataagtctcatttctcttctccaccttgtctttaagagacaagcccactttctttcatctcctcagcgccaacaacaaacacaacctctaagacaagggtgaagaagatg

SEQ ID NO: 34619 - DNA, 3003 bp, Unknown
  misc_feature (1)..( 3003): 2750-1469P.txt file - cDNA_ID_3080247; gDNA_ID_2685553; Annot_ID_193290
  misc_feature (1856)..(1905): n is a, c, g, or t
  misc_feature (1958)..(1958): n is a, c, g, or t
  misc_feature (1961)..(1961): n is a, c, g, or t
  misc_feature (1963)..(1963): n is a, c, g, or t
  misc_feature (1969)..(1969): n is a, c, g, or t
  misc_feature (1974)..(1975): n is a, c, g, or t
  misc_feature (1977)..(1977): n is a, c, g, or t
  misc_feature (1983)..(1983): n is a, c, g, or t
taatctgaataactgagtattgtgagtttttgtgtgtatcagtgtgacaatggacatatagcttgttcttcttgttgtactaaactgaggaacaaatgcccttcttgcgctttgccgattggtaactttcgatctaggataatggagagagttgttgaagcagtcatggtcacatgcccaaatgtgaaacatggttgcactgagaagttttcttatgggaaagagttgatccatgagaaggattgcaggttcgctttgtgctactgtcctgcaccaaactgcaactattcgggggtgtataaggatctctacagtcacttctacgttaaccactatgacacatggaatcaaatcgggtgtggcaatttcgctggtgcatggctacgtatcagtgagaagattttggtccttcaatatggacagggtcccttgattgcggttcagtgtttcaaggagacacaaggaatgtatgtgactgtgaactgtatagcaccttgtgctccaggagttggggagttatcctttgagctctcgtacaagatgccgatgggaggtaacagcactatgatgtttaagtcagaggagatgaataggattcagaaagtgagtttccaaactccggagaaggacttcatgttagttccttattatttcttgggtgatttctctacattgaagatggaaatttgcatacgcaagttaaaaaaagatgaagaagaagctgatgaagatgaagaatctgaagaagaagaagatgatgatgatgatgatgatgatgatgatgaagaagaagatgctgatgaagaagagtaataatcatcatatcatatccattgtaggtcgttctgttcataacttcatctaccctttaaatacatttctgatgtttttctgcagctactttagtttgtcatctatgcactctaaacgaataagtttcattgctctgagaattttacagggctttatttgattctgcaagaataatttctcagcttttaaaaccttaactctgtttttggagtttcattagataatttagatgctatactttgcacaatgtgtttttctgatgatccatgattttgaggatctctgcattgataatagagatttggttacattactcattgctaataaagttaggaaccaactattgtcctctgctaatgaggttatcaatatgttccaagatatctattttttttctacttgtatatttttagtgtataagacagtctagcattttcatgcatattcaagttctttcagctatgtttatttttacatagtgacaatgagctaaacttgaagcagaataggtaacgtataagaatctaaattacaaacatggacctgaaaagaaggagcataaaaagctttatagatcaaaagtacttgctgtcaaaaagcatcgttcatatcaaattcttcgttcatgttaaggtctgtgttgtttgtcctccatggtaagtgcttgttggtcaattgttgcgacttgcgagatgaggcataaacgattcagacacagtttggtctaattgaatcatttttggaaccgtttgtgtcatcaattcatcaccaactgcaaaagctgcaggtttacatgtatgtattagatggcctgaagtaacgtataaaaagatatcgtgctacttcacacttgatttttgagttagaaactcatgaactttgtttattacatatggaacgagtcaatgagagtttagctttttgctagtaactcacttctttgatgatctcaggacctggcatgttttgacaagaaggctcatggttttttggaggactaggagaattaacaaaagatagagcaagtgagaacgaatcagcannnnnnnnnnnnnnnnnnnnnnnnnnnnnnnnnnnnnnnnnnnnnnnnnntttgtttcccttcatcttttatttagacttgaatccataaactaatcaacacnttngntgatantgganngnaggganccataactcatttaattctaaactcatttgattatgagttgagttgagttgggttacccattttaacactcctaactgtactactgcaaatattcttactgaacctatttatattttatcataataatatttagattcttctttatttgaacaatcaattttccattttgtttcgggattttccctaaacaagaatgttaatttgttaccttaaattgcagaatttactttggattcgacaggatataagaaaacaaagtttgagattttgtgaattttatatgaatagaatataatatggttaatgggtaagaggaagagtttgaagacgtgtgatcatatacaatattaacgtaaaacaggtgatatagaaatgtaaaagtacatttttgaaagagacatagatagtttagttgacatcacatcctttatatccaatttcatggggatttcaatattccaactcattagggaaaaaacaaaagaagaatattaaatttaattaatgaacccaccaaaccttgaagttaagtatattatatacacagtaaaccagttatgaaccaaaacaagttaaataagatatcaaatacacagtaagcatgttcactcatatcgtcgatcataattgtcaaaaatgattgccaccacagcatctatataatacatacttaatatacaaatatatcttagattttaggctgctttctttttcttgattattttagaaaaccttagtcttactaatcaaaatacatccaaaatcaaatccaactgttaacactttctaagaaattttttcttctttctttcgtctaagataaaaaatgataataatgtaaaaaacgagaaatacattagtttaaatatttatcttattaaatacggaagtttcttcagtcaaaagaatatatatagtgcctataaaaaggccttcaaattattcaccgtctctcattctttcaaagccttcaatatctcttattaatcaaactaaccaacttcaaacacaaaaaaatg

SEQ ID NO: 34620 - DNA, 3003 bp, Unknown
  misc_feature (1)..( 3003): 2750-1469P.txt file - cDNA_ID_3080287; gDNA_ID_2685553; Annot_ID_193276
  misc_feature (688)..(737): n is a, c, g, or t
  misc_feature (2876)..(2925): n is a, c, g, or t
gacatcttcgtcgttttcatttccaccgtcggaggcaccgtcttctccttcagtgatcaccatcttcataatcttttcttgattacaaaaactataatgcggaagctttaattatgatccacaaagatcgactgctctgataccatgtaaaataaggtattgaactgacttgattctattgattcacaaactatggtatttatatacaatgatttctatcaagaaataaacataaatccctaaaatataggttaaaaactctatcatcaaagatattgtactaatcctaatcggataacatatatccccggttcaaaatgtttttgataggttagttttgattggttgaaaaatcaaaagaattttgaacaaaactttaatgttgacaaaagaaatagattagttagttcatgcatgcgtcgttcactagtttcgaaattttggtcgtcggtcaaaagaggaaattgatagtattatcattatataatactaataattggattctcgaacatggtgtagtagaatcttatgcaaatgaaactgtagttttggtggctttaaattcactgagaaattttgagcgaaccaattaactttcgaagggtatatggaattaaacaacagatgatcgatgggattggaactttcataatgtggaatgtgacacaaagataattgagacgttctnnnnnnnnnnnnnnnnnnnnnnnnnnnnnnnnnnnnnnnnnnnnnnnnnnaagacaattgtttcaacatgtgtttcttacttttaaaattccatcatccagtttctcctttagattcactgcttatttctcagtaagtatctcgaatcggactctttaattggactttgagtttggcttcggccacagtattttggaaaggaaagttggtcaaacgtgaataatgaatgtttcggacttccctatctcttaaatttcatcgaaacatacacaatccaaacaaaatcaaaaaagaaaaatctccggacctaatcctattcctaattcagtccgtctttatcattttgcaaagatcatcggatcactctttgttataaccgtggatcaattgtcaaccacaaaactgtttttccttcacgtttcccaattagttagcaactctctaagtttaattaagagagatttggcctcattaaccatagatattagaatggatccagtaagtacatgaaactcgaaggtatgggccattatgggcctgaaccaaacatgaaagagctgggataactgacctttctttttgacatttgagcatcgagcctcacagtgcaagagttctattatagaactcctatactaacaccgatcaagaggcaaatctcccaactcttccaacttccaaggctcgatatgagtacaggtgcgttttcttctcttctcattatgatttcttttcttttttttctattccgatttctctggaattgaagatgtgatgatgattgaaattggattgaaatcaccttaaataccagatttatgagatagcttttggaactaatcactgctaattgatcatcatcatctgcaattgtgtatgtactgattagtcctggaattaatctttagagccagtaaattctctctgttgttggagacaagataactgtgcttgagtttggtttattagtaaaacccaaaaccctagatcaacaaaggttcatactttatagatttcccactaatgttgtatcttgttttgtatttaatcaaatacactacaacctatattgatttagttagaagagaggaaaaacaggttttaatgatgatcactataaagttcgatctgaatcgttactcgtgttcatggggggcaggtggagcatttggaggaaacagaggattaagaccaataccaccagagaagggcattttccctttggatcacttgcacgagtgtgatgcggtattcttcaacaaacgatttttcttatgacctttgtttggttatatttcagtttattcacttttagctttcattttttgttttcaggagaagaaagaatatcttggttgtcttaagtcttcagctcacaaatctgaacaatgtagacatctctctaagaaatatctccagtgtcgaatggctaagtacgtcttttttcttacttttgtcaccatcatagtttctctctagttcatgtttacttgggtcgtactcgtatcgaggaatgttggatgggtttagatcatgatagtgatattattatgcaggaacttgatggcaaagcaggatatggctgaacttggattcagtggtgttaaagaacttgattccactgaagataagaatacagagagtatcgaacattgaaaggttgacaaaagaaaactttgagcctcattttgtaaaattttggattaacattgggatagcatttgagattttaggtcctaaaacccaactactatgaaagtatatgcttcagattcaccaatttttatacgtatgtattcctgtgtgaaataaagcattatacaaagcctgaaacagaagcaaagtattgtcttcggtccatattcgtttgtagactttttgggctaaagaatatttgtttgtggatattagtccatattgatttctcttatctagtttagtcgtagtgaaacttaacaaacaaaatattagtataattatgttttagttttggttaataacagtatgaaaatattccactttataattactctattagacccatttctttatatatcattttctccagacaaaggtcttagatttaaacaaacaagataaagtaaaaccattgcaagtgttgaatgttattatgtaaagtatgtgtcatattaatcgaccgttttttcacaagttttgaaaattagccnnnnnnnnnnnnnnnnnnnnnnnnnnnnnnnnnnnnnnnnnnnnnnnnnnattgctgctaggcttgagtttttccaaagattggttgatgagaaacgtgtggcaaaggagaagaaggagaacacgatg

SEQ ID NO: 34621 - DNA, 3003 bp, Unknown
  misc_feature (1)..( 3003): 2750-1469P.txt file - cDNA_ID_3080291; gDNA_ID_2685553; Annot_ID_193275
  misc_feature (1897)..(1946): n is a, c, g, or t
ttttgagagaataaattattttagaatgtaaaaaacgaggaaattgttgctcaattaaaataaatttcaatgaaaacgagatttagtagttaatgtaaagaaaaaacaaacaaaaatttcataaaaattaatgatatgagttttgttacaaaaaaaagaggtcctaaaacactgtataaacatattattttttgcctaatttagcaaatattgtggccttttatttgtatattttttggtggctaggcaaatgactttttcttcttctatatgaagcacggcagtgactaacaattagcgaccaaatcttatttgtttcataatcgttgattcatcgacaaaataaaaacaattagttctttgtcgttggcaactgcaaacagaaaataaaacgtagtactagttaacaatgttaatcattatgattatatatccactgcgagacgaactcatgaacatgtcaacatcaatatatttcaaggttcaaacttctttggtttgcaacatgcacggtgtagaataaggtattgaactgaattgattttattgattcacaaactatggtatttatatacaatgatctctatcaggataaacataaatccctaaaatataggttagaaactctatcatcaaagatattgtactaatcctaatcggataacatatatccccaatactcccccgcacgacaaacgtgttacgcaaaacgcaaactttgcaatcacaaagcggaacacgtatgtcgtggacaatawgtcgaggacggmcaaatcatgtaaataaacatcttagggtataaacttcattcttggggtggaacttcatcatgtcttcggtcttggtaaaagagaatacatcccatgtacgcaaattatgctgctccacaaacaatcatctttatcttggacggtgtataactcgggactaaacatgacctaaaaacatgaatgttccacaaactctactaatggctaaaccataaccaaactcccccgtaatggtaaaactattaccaaactctcttactaagaacacaaaaactctgaaaatttcttaactcaagaataattccagtaacataaaaagaaaaagaaaaaccaaaaccaatcctattaaaaacatagaaaaccaacgacttaaagttttggaaaaataatacccatgtgattaagaaacaatcacgtaacctccatcccttaacatgccgacatcttcgtcgttttcatttccaccgtcggaggcaccgtcttctccttcagtgatcaccatcttcataatcttttcttgattacaaaaactataatgcggaagctttaattatgatccacaaagatcgactgctctgataccatgtaaaataaggtattgaactgacttgattctattgattcacaaactatggtatttatatacaatgatttctatcaagaaataaacataaatccctaaaatataggttaaaaactctatcatcaaagatattgtactaatcctaatcggataacatatatccccggttcaaaatgtttttgataggttagttttgattggttgaaaaatcaaaagaattttgaacaaaactttaatgttgacaaaagaaatagattagttagttcatgcatgcgtcgttcactagtttcgaaattttggtcgtcggtcaaaagaggaaattgatagtattatcattatataatactaataattggattctcgaacatggtgtagtagaatcttatgcaaatgaaactgtagttttggtggctttaaattcactgagaaattttgagcgaaccaattaactttcgaagggtatatggaattaaacaacagatgatcgatgggattggaactttcataatgtggaatgtgacacaaagataattgagacgttctnnnnnnnnnnnnnnnnnnnnnnnnnnnnnnnnnnnnnnnnnnnnnnnnnnaagacaattgtttcaacatgtgtttcttacttttaaaattccatcatccagtttctcctttagattcactgcttatttctcagtaagtatctcgaatcggactctttaattggactttgagtttggcttcggccacagtattttggaaaggaaagttggtcaaacgtgaataatgaatgtttcggacttccctatctcttaaatttcatcgaaacatacacaatccaaacaaaatcaaaaaagaaaaatctccggacctaatcctattcctaattcagtccgtctttatcattttgcaaagatcatcggatcactctttgttataaccgtggatcaattgtcaaccacaaaactgtttttccttcacgtttcccaattagttagcaactctctaagtttaattaagagagatttggcctcattaaccatagatattagaatggatccagtaagtacatgaaactcgaaggtatgggccattatgggcctgaaccaaacatgaaagagctgggataactgacctttctttttgacatttgagcatcgagcctcacagtgcaagagttctattatagaactcctatactaacaccgatcaagaggcaaatctcccaactcttccaacttccaaggctcgatatgagtacaggtgcgttttcttctcttctcattatgatttcttttcttttttttctattccgatttctctggaattgaagatgtgatgatgattgaaattggattgaaatcaccttaaataccagatttatgagatagcttttggaactaatcactgctaattgatcatcatcatctgcaattgtgtatgtactgattagtcctggaattaatctttagagccagtaaattctctctgttgttggagacaagataactgtgcttgagtttggtttattagtaaaacccaaaaccctagatcaacaaaggttcatactttatagatttcccactaatgttgtatcttgttttgtatttaatcaaatacactacaacctatattgatttagttagaagagaggaaaaacaggttttaatg

SEQ ID NO: 34622 - DNA, 3000 bp, Unknown
  misc_feature (1)..( 3000): 2750-1469P.txt file - cDNA_ID_3080310; gDNA_ID_2685553; Annot_ID_193268
aagtatttaactcaattataagtgaagatttctaaattagtgattatggcctaaataaatatacatatcctagttgtacaaattatcctaaattggtaatttagcctaattacaaatgaagtattctaaattagtgattaaggcctaaccttatcctatactaatgatgattatggcctaactttttatcctaaattaatgattaaggactaaatttatcctaaattaatgattaagtccctaaatttatatcctaaattagtaattaagctcacttacgagtgaagcgtttggagaccgagagagacgagcgataagtcgccggatctcgtcgcggcggatagtgtaaaagctattaagccgatgattggagaaaatctcgacggcgccaatacgtcggagattcctccaatgctcactatacggagctgataccatagatgcgtaattgtacgagatatgttaagaagcaattgactttggacggttcgcgagaacgacgtcgtttttcgtgaagcattcttcgacgattgagtgtgaagagactacgaaaacgagtttgtttcctagacgaagggagaagatcggagaatcgtttagtgatttagagatggtgaggaaaagacggtggagcggtggtttgagaaggcggaggtggccgatgattggaagtgagaacggtggagatggtgggaggtttggttttggtttgagttttttgatgaggaatgtgagagtgatgagggttaggattaggattgtgatgagaattagggtttgagtttcgtcttccattgttgttgatttgattttcttcttcactttgaattttgggatttttatagatgtggttcagaatttgcttgcactattttgtaaacgtggattttgaaaacatcacaaaaatttgaaaacttaattatagaaagagtttagctcaagtcatcaaacaaagtcacatactcacatgggaataaattacaagcgttagatgaatagactaccacattggttgtcttgacaataaaagatcgaaactattaaatgactcaatcaataacatcgaactctcaagccttctagagccagacgaatgaccaaactttccgacatcaagaggtatgacacatagctgaaaccttcaattattatagcttttgatatgtttaaaaattagttcaaaagtaactacggtttattcataaaatcatgttttgtttgttttgacatatgtacaaaattacaatggagttttctaacagcgtttacaaaggtattcaatattataaagcaaaagttcaattttgtttttaatgcattctattataattttctgtgattgcaataaattaaaataattgaatacaattatcgtaataaactaataatatgtagacaaaattataaaaaaaaaaaaaaaaactaccctgtatggaactcaaaacacctaggcagctttcctagcatcaattaccaaataagtcaatactaaaattaacttaattgtacccatatattcatatttaattttctataaattataactatagggtacgtacaatgttgacgtagattataaagatgaaaaaatatcattgtcataaacattatttagttttattccaaaaatgttggaacactggtggtggattttgatttcttgtaaggtaaattccagcttttctggcaatccactgacgtgaagcaccacatcgacgaacattggccattctgtatccaataaattctgaataatatcgcatgtataagtcgtgtttcaaaacacaagtccatcttgtcctttttcctatcttatctgcgaaacgaattttttttatttcattgaactgtaaatttttgacatttaaattgttgtctcttgagtgacaatgctattgtagaaccaaaccgggaccaagctcgttcgtaattagaatatagtttgacggacatggaaacatttcaaattctacattcaatccgaaatacgtcgcaactacaaacatgaaaattatattcatttttcgagtaatttgaaactgatggacatcaatagtacaatatatatagttttttgtgtggttagtattttcttatggccataactaaaattagttaaattgaaacacagacatgaattaataatagatagtgtcgaaaagtatcgttgaccaataaaattaaactaaatgaattcaaccttacaaattataggtgatccacaaacacctaacaaaaactaaaaagtttaagctataacaaaaatcttgcaagtgttatgaataatcatatatgttaaatcgatgcccattgggtgcaaacaaaaaaaatttaaaatattgtttgatatgaaattgttattacttatggtgaagtgtataaaattaaaatcaagtttattatgatgaaataaatagttaaactgtattgcagaattgaatgtataagatagaaatttgttttttttcttttcttctaaatactaaattaaatatagaaaaagtgtttgagttactatttagaaattcaaatatcatcaataagattgagtgtgtataattaaaatgtagaatagatataaaatagaatgcataaatttgtttaaaacaaaattatttaattaaatattaaaaatgtatagattacttatttactattcaaaattcaaaaaatatcaataaaattttatatttatatcttacatgggccttatatagttcaaaaataaaacatagatttagattcaacaaaactgattttagaaacaaacatcgagatattgaataaattaaggactgctacacataaattttgaaactagtcatgtgttttgtgacaaatgaataatgggcctctcgttaaagcccgattaaaataaaagtgaattggaaatttgacttttgtcaaacacggtaaaaaattgtccaaccctaaacaattattcgtcggatccgttttggcttcctctgctctcaccagtcttctgcttcaatttcgatg

SEQ ID NO: 34623 - DNA, 3000 bp, Unknown; identical to SEQ ID NO: 15053
  misc_feature (1)..( 3000): 2750-1469P.txt file - cDNA_ID_3080347; gDNA_ID_2685554; Annot_ID_193353

SEQ ID NO: 34624 - DNA, 3003 bp, Unknown; identical to SEQ ID NO: 27359
  misc_feature (1)..( 3003): 2750-1469P.txt file - cDNA_ID_3080351; gDNA_ID_2685554; Annot_ID_193351

SEQ ID NO: 34625 - DNA, 3003 bp, Unknown
  misc_feature (1)..( 3003): 2750-1469P.txt file - cDNA_ID_3080419; gDNA_ID_2685558; Annot_ID_193405
aaatctagtatttataaaagtgggatggagagtagagaggattcattcatatcaaaagagaagaaatcaactatgaaaaaagaaaaacaagcgattgcatcacaaagaaatagaagaagagtaattaaaaatagaggaaacgggaagcgattgattgcatcattatcacaacgaaagagaagaagaatacctagaggaagaggaaacgagaaggcagtgtttgcaccatcatcactaccaaacgatgttgtagaggaaatcttcttacgacttccggtgaaagcaataatccaactaaagtctctctcaaaacaatggagatcgacgatcgagtctcgcagttttgaagagagacacttgaagatcgtcgagcgatcacgcgtggattttccacaggtcatggtcatgtctgaagaatattccttgaaaggaagtaaaggtaatcagcctcgtccagatacagacattggttttagtacaatctgtttggaatcggcttctattctgtcctccactcttatcactttccctcaaggatttcaacaccggatctatgcttctgaaagctgtgacggacttttctgcatccattccctaaaaacacaagccatatatgtagttaacccggccactcggtggtttcgacaacttcctccggctaggtttcagattttgatgcaaaagttataccccactcaagacacttggattgacataaaaccagtagtctgttatacagcattcgtgaaggccaatgattacaaattagtgtggttgtataattctgatgcctcgaatccaaacctgggagttacaaagtgcgaggtttttgattttagggcaaacgcttggaggtacttgacttgcactccaagctatcggatattccctgaccaagtaccagcagctacaaacgggtctatttattggttcacggaaccatataatggcgaaataaaagtggtagctctcgatattcacactgaaacgtttcgtgtgctacctaagattaatccggccattgctagttcagatcctgaccatatcgacatgtgcactttggataatggtttgtgcatgtcgaaaagagaatcggatacgttggtccaagagatatggaggttaaaatcatcagaagactcatgggagaaggtttataccatagatttgctttcttgttcttcttcttctttatctgagttccgcgatggatttaattggacacgaaaagatttggttgagccatccacaccagtggcgatatgcaaggacaagaagattctgctctcacatcgctatgcccgcaatatgatcaaatacgatccccaaataaaatctatcagtttaatttaccaacctcctttgtgtagaagatatgcttcttattttcagagtttgatctctcatatataaaatgctttgatgtatttggaagcatgtaatgtaagaaacaaagcattaattgtttggattgttatattatccgatagcatgctgttattcataaatcataataaaccatacttatttcgccaaatgacactatacttaccaaaaatcatactactttatgaaatgatacagatttttcaaaaaaatgaggacgagtattttcgttaatccacacaaaaatcagtttcattctgtgtgtggatgtaaaaggaagatgaaatatagattttatcttaaagggaccattgcctcgttgttaaaaaaaagggaccattgcatccgacatcttttatccgtattaatcttgaaatgtttattcaatatactttgttgcaagatttttttttattcaatatacttttgttattcatgtcaaaaaaaatttgattaatagccaatctatgtaacaatctaaacacaagtttgccgctacaattaatatgagtctatgacacacatcacaaagttttgagagattaaaattctttagtcccaaatacttcaaatatagaaaaaaactacaatttttcttttcaaaatttgtttattttacggtgacaatttttatgattgccaaccaaatcccacattattaagtttttcaaccaaactgaactgtatacttattttgattattaacggtcggatttagctttaactaaatcatcttcctaagctctatcactgaaataattctgcagacaaaaaaaaatgagagagaggtggcaaagatgaagtggaggtgagagacggaaagcaaaaacaatagtcacgagaatcaacaccaactcttaaaccaagatagaccaagaaaccaaacagagtaaataaatggtggccttgacaacattgaaatccccaaaaatctcaactttttagggttttcgagctctgaaatctctctatctttcttcttcagatttctcacttttttcttcttcataagatcctcgtgattccactttataacgtacgcctcctttcaagaaaaatctctctctatattatctacgtttctctcgccttgtctccttttgaggttccatttctacttctctccaaaattcgaaacttttcccactctctctctctctctactagtttgacatgaacagcgacggtgtttggcttgacggctccggtgaatctccggaagttaataacggtgaagctgcgtcttgggtcagaaacccagatgaagactggttcaataacccaccaccaccacaacacactaatcaaaacgacttcagattcaatggtggctttcctttaaacccctcagagaatctgcttcttcttcttcagcaatcgattgattcttcttcttcttcttctccgttattacatcctttcacactcgacgctgcttcacagcaacaacaacaacaacaacaacaacaggaacagtctttcttagctacgaaagcttgtatagtttctcttctcaacgtcccaaccatcaataacaacactttcgatgacttcggctttgactctggtttcttaggacaacaattccatggaaatcatcaatctccgaactcgatg

SEQ ID NO: 34626 - DNA, 3003 bp, Unknown
  misc_feature (1)..( 3003): 2750-1469P.txt file - cDNA_ID_3080438; gDNA_ID_2685558; Annot_ID_193415
tctccatttacatgatcccacaaatctttgcctacgctatcaacttcccaacggcgaagtttttgcaatcacaaagcaagatcatggtcatggctggaatatccggtgtggttcttgtgatccatagtttcttcacgtggctagtcatgtctaggttacactggggacttcctggtttagctttagtgcttaacacgtcgtggtgggtcatcgttgttgcacaacttgtgtatatctttaattgtacgtgtggagaggcttggtctggatttacgtgggaggcttttcacaatttgtgggggtttgttaaattgtctttggcttctgctgccatgctctggtgagtgcaaaccttttttctcttccaattattttggtccgatttgatccaaccccattaatgaattcatattttaaatacaatttatttacttttgtagtttggagatttggtattttatggcactcgtattatttgctggatatttgaagaatgctgaagtctccgtagctgcactctccatatggtaaaatttgttatatctcttaaactaattaacatctttacaacatttaaggtttacatgatttgttatttgattcatttatttattatcagagagattctctgaataaagactagacccaacgtgcgtagtagtctcttgttttgtttaataatcaatgtccttaatgtattaagaattcaaaattttgaatacttccactgcaaagaaatttctaatgatttgttttccttaattaatggtgtgtggaatatgaagcatgaacattttgggatgggcagctatggttgcgtttgggacaaacgcagcagtaaggtaaattctagcgtgtgaaataaaactaactctttacaaattctacacatctaacaagtgccaagctaataatacatttttgttggcagtgtgagagtgtcaaatgagctaggagctagccacccaagaacggccaagttttctctagttgtggctgtgatattgtcgacagcaattgggatgtttatagcagccggcctactcttcttccgcaatgagtacccggttttgtttgtggaagatgaagaagttagaaatgtggttagagaactcacgccaatgcttgccttttgcattgtcatcaacaatgttcaacctgtattgtctggtaatatttgtttagtggactccaatagtccaatataatatggttgtacataacgtaaaccgaatgtatatgagattatgataaatttgataacgcaggagtggctgtgggagcgggatggcaagcagttgtagcgtatgtgaacatagcatgctactacttgttcggagtcccatttggtctattattgggatttaagcttgaatatggagtaatggtaatgaaattcacatccttttatctaaaagtaaaacctttatcaaggaaagacgaaagaccggggtttttgatgttttggaaacctattttgatcagggaatttggtgggggatggtgacgggaacttttgttcaatcgatagtcctgacttggatgatctgcaaaaccaattgggagaaagaggtaagaaaccaaaacactttaagaccgaatagtcacgacctcgctcaccgagtttattgttctaatcttttgaatgatatatatatttgtaggcttcaatggcagaggaaaggataaaagaatggggaggagtacctgcagagaaagagactcttttgaactagaaagagttattacttcaagacatattgatgagtctttcagatcacatttttgtatacgaaccttaaaagcaaaatttggttctctctttctaaaaaatctgtaacttgttatgtcatcaaacgctgacaagatatgttataacgctgataattatctataaacaatttgacttttgagaattggggtcttaatgaaaagttaccaaatcatttagaataatactactcgcttgtcagaagttgcttagtatagtagaaacgtgaggacaacagcactaccagcttccttaatcttcttttcatctgtattcgacacaagcttagccttgacaacaacaggtttattctccggcaagaaacctttccctaaaaccttaaaatatccaaattgagtaacatcaatcatagacacatagtgtttcgttgcttagtccataacgtcctgaggaaccatcgaccaaagcttgtcaagattgacgatctggcagtaaaacttgttcctgagcttgtggaaatacctcataccaactttaacaaaatatccaggatgatacttgtcgaagaggatacggtgtgatgcataccaccggcgttaccacgacttccgggaagcttacggtgctttccaaaacgaccatgtccaacagatacgtgttctctaagatttcttgtcttcttcctgctagtcgtcatttctcaccgattgaaattagggtttcacaagaaaaaatgggtattaaggtttatatgtttttacgcggcaagtaataatgggcttatcattgggccttaagagcgagaagagccagaagaatccggttccgattttttagtcaaaccaaataaagccgaaattaaattctgctggatttggtttgaaaattcgttattttaacaggaaataaaaacggtctaataagaataaaaatctattcgaaaaataagaacaatttttataaaataaaataaaaaaatatatttagaaagtgttatcttaggaaaactattcgaaaaaaatatttaatcaatcattatctctgcctgattttatatgattttcacttttctataaatatttgacatttcattgtaattatccaattgttcatcacattaattgtttacaaaatatttcttaccctttttatagataatgagaatgatctagttttgttgtaatttcgtttctttccttcttcactcgttaaattttcgtttaatcagacatcgatctcaaaagctctcatcttcaatctcattgagaatg

SEQ ID NO: 34627 - DNA, 3003 bp, Unknown
  misc_feature (1)..( 3003): 2750-1469P.txt file - cDNA_ID_3080443; gDNA_ID_2685558; Annot_ID_193413
actttcgtctcgactcagttctggatgagctccatgttctctggacccgtcgtgggttcggctaacggaatcgccgccgggtggggtaacctcggaggaggcgcgacgcagctgatcatgcccatcgtgttctcgttgattcgtaatatgggagccaccaagttcaccgcgtggaggatcgcttttttcatccccggtctctttcagactctctctgctttcgccgttctcttgttcggtcaggtaacaaaccaatcacactcaccggttcagttattttggttttttcaactaatccggttttgagaatttatcaccaagttattttttgttttggttaaatttactttctttgtatagtcagtttatcctgttctatataaatgattaaaccgattcgtttaggtgcaaacccggtttattgataccggtttgggtcgtctagtagagtctttagtcggttaatcatggtcgagtttcagtggatatggacaataactgtttaatcatctaagttgtgtctattacaaggaatagtaaaaggatacatttgttttgtcttatgtttgctatatgtttttggaaatgagtaggatcttcctgatggagattattgggcgatgcataaatctggagagagggagaaagatgatgtggggaaagtgatatctaatggaatcaaaaactataggggatggataacagcattagcatatggctattgttttggagtagagcttaccattgacaacatcatcgcagaatatttcttcgatagattccatttaaagctccagacagcagggattatagcagcgagttttggactagccaattttttcgctagacctggaggaggaattttctctgattttatgtcgagacggtttgggatgagaggaaggttgtgggcttggtggattgtgcaaacatcaggaggtgtattatgcgcatgtcttggccagatttcttccttgacagtgtctataattgttatgcttgtcttctctgtattcgtccaagccgcttgtggacttacctttggcgttgttccctttatttctagaaggtaacatacattttggtattgagttgcttgattggttattcaacatttttgcttacaaaagtttgtttatgcagatctcttggggtggtatcgggaatgactggtgcgggaggcaatgtaggcgcggtcttaacacagttgatattcttcaaaggatcgacatacacgagagagacgggtataactctaatgggggtaatgtcaatcgcatgttcattaccaatatgcttgatttactttccgcaatggggaggtatgttttgtggaccctcttccaaaaaagtaactgaagaagactattatctcgccgaatggaacgatgaagagaaagaaaagaacttacatatcggaagccaaaaatttgcggaaaccagcattagcgaaagaggtcgagccacaacgactcatccccaaacttgataaattcatggtgttttttttgtttatatgtatcgactgttgactatgtttttgtcttcttctcttttgtttttcttaagagttttcaagaactcaatttcttgattttatttataattgtgtgataagttgtgtatgttatgtaaaacctactactggttactgctttctttgtaatggaaggcttttgtaaatgtttgttcatcatggaatgaacaaacgtattttcatttagtatacatattttgttttttagttatcttttgttgatcgtgataataatgatttgaccacaagaatacaaaccagtagattcataatttattatacactgttagtctgttaaccttgtaaaccaaaaacgtttcgatattcatatgctcttttacatcaaacactcggttatttgttttatccaaataactatgacaattacatagttactaattggtactttatttcattatcagatattaactgagttgaaaacaaaattagatagcagttgaattaaactttctattagtattacatcattaagtgtttttaggtgaccaaaaaaaacaacaattacattcttcccactttacaaatacttttaaaacaaaacagcttgtcttttatgtcaaagttcattgaaagatgaacttactttggtatattacagataccatgaaaccttaaaatcttcaatagatcacatctttttagcccaacatctttattttatttacttttgggcatatttagcccaacatctttggcagggaagaaaaactttgtaatcttctcgctatgccattgggctagaaaggccattatgggcctattcttatttcattatgtctctagtgggcctactactgtctttactatcttggccaattagaataaaatctttattgtatgtttcccaatctaccacattgtcacaaacactcacaataattgctccgcacgtagcaagaagtaggccatatggagtccacgacacaaagatttgaatggtcaaagatatataacaaaacaaaagaaataaaagagttgtcgcatgttcttatataaacgatttatatattataactgcattttacattattgtattgtttagccgagtcgtgcgaatggaatatcaaatcgtcatccttttgattttgaatgacaattatacagtaatggagacacacacacaaacatataaactattaaattctactgtgaaacgctaagtcaataagattaactggtgtaaagctgtctgattaacaaaaacttaagtgtgaaagctgtcttttaccactcttccaaacactcgtaagtcgtaccaaatctagttctttatttattttttaatcgttctctatattatataaaagagaaaataaaactattaacttctatataattcataaaccattgattcctaaagattacaaaatcattgatctccttcttcttctttaactttaagcactctctttctctctttctctttctcttgtcgtcggagaatg

SEQ ID NO: 34628 - DNA, 3000 bp, Unknown; identical to SEQ ID NO: 15073
  misc_feature (1)..( 3000): 2750-1469P.txt file - cDNA_ID_3080459; gDNA_ID_2685558; Annot_ID_193408

SEQ ID NO: 34629 - DNA, 3000 bp, Unknown
  misc_feature (1)..( 3000): 2750-1469P.txt file - cDNA_ID_3080475; gDNA_ID_2685558; Annot_ID_193403
gaaatctgaagaagaaagatagagagatttcagagctcgaaaaccctaaaaagttgagatttttggggatttcaatgttgtcaaggccaccatttatttactctgtttggtttcttggtctatcttggtttaagagttggtgttgattctcgtgactattgtttttgctttccgtctctcacctccacttcatctttgccacctctctctcatttttttttgtctgcagaattatttcagtgatagagcttaggaagatgatttagttaaagctaaatccgaccgttaataatcaaaataagtatacagttcagtttggttgaaaaacttaataatgtgggatttggttggcaatcataaaaattgtcaccgtaaaataaacaaattttgaaaagaaaaattgtagtttttttctatatttgaagtatttgggactaaagaattttaatctctcaaaactttgtgatgtgtgtcatagactcatattaattgtagcggcaaacttgtgtttagattgttacatagattggctattaatcaaattttttttgacatgaataacaaaagtatattgaataaaaaaaaatcttgcaacaaagtatattgaataaacatttcaagattaatacggataaaagatgtcggatgcaatggtcccttttttttaacaacgaggcaatggtccctttaagataaaatctatatttcatcttccttttacatccacacacagaatgaaactgatttttgtgtggattaacgaaaatactcgtcctcatttttttgaaaaatctgtatcatttcataaagtagtatgatttttggtaagtatagtgtcatttggcgaaataagtatggtttattatgatttatgaataacagcatgctatcggataatataacaatccaaacaattaatgctttgtttcttacattacatgcttccaaatacatcaaagcattttatatatgagagatcaaactctgaaaataagaagcatatcttctacacaaaggaggttggtaaattaaactgatagattttatttggggatcgtatttgatcatattgcgggcatagcgatgtgagagcagaatcttcttgtccttgcatatcgccactggtgtggatggctcaaccaaatcttttcgtgtccaattaaatccatcgcggaactcagataaagaagaagaagaacaagaaagcaaatctatggtataaaccttctcccatgagtcttctgatgattttaacctccatatctcttggaccaacgtatccgattctcttttcgacatgcacaaaccattatccaaagtgcacatgtcgatatggtcaggatctgaactagcaatggccggattaatcttaggtagcacacgaaacgtttcagtgtgaatatcgagagctaccacttttatttcgccattatatggttccgtgaaccaataaatagacccgtttgtagctgctggtacttggtcagggaatatccgatagcttggagtgcaagtcaagtacctccaagcgtttgccctaaaatcaaaaacctcgcactttgtaactcccaggtttggattcgaggcatcagaattatacaaccacactaatttgtaatcattggccttcacgaatgctgtataacagactactggttttatgtcaatccaagtgtcttgagtggggtataacttttgcatcaaaatctgaaacctagccggaggaagttgtcgaaaccaccgagtggccgggttaactacatatatggcttgtgtttttagggaatggatgcagaaaagtccgtcacagctttcagaagcatagatccggtgttgaaatccttgagggaaagtgataagagtggaggacagaatagaagccgattccaaacagattgtactaaaaccaatgtctgtatctggacgaggctgattacctttacttcctttcaaggaatattcttcagacatgaccatgacctgtggaaaatccacgcgtgatcgctcgacgatcttcaagtgtctctcttcaaaactgcgagactcgatcgtcgatctccattgttttgagagagactttagttggattattgctttcaccggaagtcgtaagaagatttcctctacaacatcgtttggtagtgatgatggtgcaaacactgccttctcgtttcctcttcctctaggtattcttcttctctttcgttgtgataatgatgcaatcaatcgcttcccgtttcctctatttttaattactcttcttctatttctttgtgatgcaatcgcttgtttttcttttttcatagttgatttcttctcttttgatatgaatgaatcctctctactctccatcccacttttataaatactagatttttttattaggagatttaggggattacgagatcgacttgaaagtaaaattcatattgtaaaatatattcttgttattaaataggtagatttagtattatcataaatctaaagaacttgcttgctatgcaagtaacattcttgtataaataagcttattggctaattaatataattgagagaaactatttcacatatctgcactatgtgtgaaataaaaaaatattaagtaatttttatatataatcaatattgaaggtattcaattttatattattaattagataatcagtttgtattaatgactatcaagattagtaaatatatatttatgtttatcgtgatttatgatatatatattttgtatattaatagatacaaaatattagatacttcattttgaatagatttgtatttcttagttgcatacattttaattgaattttcgttttaataattaagtagtaaaaaacataaattatggtttgggccgggtcgttaagattctgaaccctctaactgacctggaggtttcacacccatcatcagatctgaaaaatttctaactaagtctttcgcgttaagctccgacactgcattttccgagtactcaagagaaaggcgatg

SEQ ID NO: 34630 - DNA, 3003 bp, Unknown
  misc_feature (1)..( 3003): 2750-1469P.txt file - cDNA_ID_3080482; gDNA_ID_2685558; Annot_ID_193401
ctaattattggtcaagtacttactatcacatactatcaactaataatctttcataatcctctaaacatttccctaattgctactcgtatgtagaaacaagtttaagtcctttgttgtatcttcatactctctggaaaatcaacacttgtcttggtaaaagtaaattattttttaatccaaaaaagttatatagtgatgatttcacctctctcttgacccatcatatgctacaatggctgccatgtgaatgccaccttttagtaatcatctccattttcaccatcgatagccccaaatatttcaccattatcttggtttcagttgactcggataatgcctgaattattggattttactgtgcaaccaacccccatctctcaccttagttaaattatctggtaaagtaagtccaagatttgattatttacttaaaaatacatattcaagcatttctctcctttccaaataaaaattttgggttaccttttaagacaaagtgagaaacctaacagtaagaaaataaaatattcaggggtatcaaagcttagaatatcgaaaatgataatcatctggtctctatcatcggtaaaagtttttgtaattttcttctagaactcttatcttcttctattttctttttccagcttttggttggttcatgagattctttttccttttatcctatgaatccaaaggcccaaaaagcagagagagagagactcataatgacgcatgtctctcttattcaataatctcccacatacaaacaccagtagttacacaataccaaccacacacatccatatcatatcaataacatcatatacacatatcgatctgtcgacatacattacacattttaagtatgtatgtatttgtatctcccaatatgagattcggaaaggaaccctttttcagttctcattgtcactccctggtggtccagtttttttttcattaagaacataagagttatgatgatattctcctgacaaaattctgtaactcctataattgaactatacgaatctatgtgtagaatataaaatggtgctatatactactacaggttatacgataaaaaccatgtggggagattcacttcaacatacactgctgagacaagaagatctaaatgttttcagcaacccctttagataaaaggggtcactactcacaatactctcacaagccacatagaatcactcaaagaacgagctcattaaacataacaatcgaacgactatgctaccagcatttcatcctaagagttgtatttctctcctaactaccagttgaagacagaacattgaggatgagaactaaaagtttcgacctttactcatccgcagcatgaaaagcaaagaacatagcgagtagattctagtgtactcatacaatctctttaactggtttaggttaacccaagcccatctcattaaccttcaaggacttgccaaaggaacacaagaacatgaactagtttttccaaagacttactataagctgcatcattatctctaaagctcacacagaatgaccaatccactaccagttttttctaaatgtaaagtcacaagcaacgatctttaaagctcacacagaatggaagttacgcatcaagcgactaaagatcagaaagcataagaggcacaatggattgaattgcaagaacatcatagatatatataaagcccactttggtccaagcgtttgaaacatcaatagatataactaataatcactgaacagtgacaaactctcttttagaatcaaaggaactaattctcagttatcttaatcactaacctcttacaagctaaggtctttaagcatcactatcactgctttcatcatcctcgtcgttgacatggcggttactgaattcattggggatgaaaactccaggctggctcgatcttctcctagtcctcgacggaaggatattatccaaatcaacctcagccaaaggatcatcggagaaatcgctttcgtcgtcttcatcaaaaccttcgtcatcttcatcatcatcactgtcgtcttcatcatcactttcttccacttcgatcatttttccctttcccttatcctctcgcgaaatccctttacctttcctatcaacaacttcttcttcttcttcttcttcctcgtcgtcttcctcttcatcttcttcatcctcttgctcctcttcagctccaacatcgccgattacgccactctcaacctcttcagctgctttctccgataaaaccgatgattctgctccaatcgtttcctcggtggaagaattcagattctcgatttggccacttccattagtttctccgtctttggactcagaatcagcagaattcaatgaaggattaagcttctgagccttgtttgtcacattatcctggtcttgacaaaacagatccgattttcgcttcacaggaaacgaagaatcctgttgattctcaacatccgccatagatgaatcaatcttcttacttcagagactcgcgattttggtttgaggacgacgattcagagttagggctttgaagctgaatcaaaacactcgagccaatttagtttgtaaccctagaagtttttgtagggttttaccgtctctgttttttattatttggatctctgaacacatttggcccagtattagcccatttacctatcttctcaaaatatttggttcttaacaaattcaagcctaaccattagtacaattttaattttgatctgtacattttcaaaaaccggactcgaaccaagatcaaattcaacaattgtggcaattttaatggtcgagtctccagtgtgtatgtggcagtaggagaacgtgccgggggatattaaaccggctcaatgctacagtcgtaccggtttgtttttttactcgttggtatataattaaaaccggttatccaatttgacaggcagagagaagaagatttgattgaagtacagatccatcggagaagaagacagagagattgaagatcaatg

SEQ ID NO: 34631 - DNA, 3000 bp, Unknown; identical to SEQ ID NO: 15068
  misc_feature (1)..( 3000): 2750-1469P.txt file - cDNA_ID_3080487; gDNA_ID_2685558; Annot_ID_193399

SEQ ID NO: 34632 - DNA, 3003 bp, Unknown
  misc_feature (1)..( 3003): 2750-1469P.txt file - cDNA_ID_3080491; gDNA_ID_2685558; Annot_ID_193398
aatatgttccaccttcctgttctccttcctccatagttaaatcatcagaaagaggcttgtcttcctcttctgcaactacgctcactggttccggttttctcaacaatgtcatatcactaaacctctcattttccctctcatttctcattttcaatgtcagattcggtttcaaccgcaacttagactcctcatcatcaccattactagtataaaacgaactcggctttctcaatataacattaggcaatctctgcacctttggagcagcaacagcctccaccaatggcttcttcaaaacagggcttggcttcttcatcactggcctttcgaacttgactccatctttcagaacaggctttaccaatttcaatccatccagtgaactagtagatttcttcttgttatcctttgaccaatccaatggaatctcttcaacttcaggaattttacctttgttcttgtagaaagatttctcaatgtcaataaaagaagcttctggatccacttttctagctactatctgtataaatttcaccattaacatcatcagcacaacagagagaaatcgaaatacataaaattcaaagaaccgttttttacgaaatctctcaccttagccaaagtcaatttcgggtcttcgccgagtaaacggccaaagttgagctccatttgatcccattcgttgagcttaggctcttctcttttcgaagcagaaactaaaaacttcttctgtttagctaacaaattctctcggtttcttctcactctaaccctagaaggaaacgacaggaattttccggcgagagaagcggagggtgcggcggcggaagcggaagaggataaggcgagaacgtccattttccgattaagccgaaagatgataatttatacgaatgagaatcatgggtccaatcaaaatcacgactttattttatctcgagtgagactgttgcttgagctctgtctcttactctccccctatgtgaactacagagaggaagaaatggctatggcggaggaaggagctttatcagtttagctcaatatttcgcttcctggttgaaccagtaaggtgaagacacgtggttgatgaaggagcaactacaaaaaaaagattgcattttaacgtcttgccgttgtttcgttttagagatgaactacacgtcgttttttgaaatttgctttaacgtcaaatcttttcatacacgcgtaagattgggctatcatgggcctaaaattggcccaatagaaggatgggaaagaaactcaaagaagaaaactctaccaaataatccatgtttttttatgtatgcagaagtttattatatctgtatatatagataaacactgatatatctaaatatctaatgcactgaggctatttcattgtttcagtttacttaacattgttatttattttgatatcgattagggtttggattttgtgggttcgtcataaaagggactagagtttttttttattgaaaaaggaaacggactagctagagttatagttttgcatatcggctctacctaaagttttaaataagttgaattcacgcatgcatcaaataactcgtgcactttaacgaacattaattggttaatccactgattgtcaaatatcgactatgaattagtccattttattcttctcgttccatacaataaatcgatgttagtacagtggcaaaagtgtagtttagcaaggacgaacacatgtgagacgagaaaagggacaaagagctgaaagtataaataggcgttacgttctatagcggttttcatgctgagaacatcatacaattgtcgttcgatataatctgtggcttgcatagtttacggctcctcgtttggatttttgaggaatttatataattataaataatgactatttgtattttcacatacttcagtagatagattctcgaatctcgagattaccaatatcatgcacatcatcatatgatgcatacacgtgatgtaataaagttattttaatatgtattcagccaaaagttgcaccaaaaagagaatccatcgaatccacgaaaactaggttctactaattagttatctattaaattatttcacaaaactaataaccatatagcattcaacacgagtacacatctataacggggggaaaaaaacttttatggaaaacatttaaaataaatatgtataagttagttaatatatgtgccaaaacatggaacctaacgcccacagtttttccccatctataaaatatatgtactttcagcctttcacttcaattccctagctcaacaaacaacaaactatgaatcaaaacatatatctctttatttcataatcatttccataaattacaccctcaaaggttttccacttcttaaatccctttttatcaaatggatgtctttatatcggaagagtatatcaaccgccggagattggagaaaaaagctgccaccgttgccggaaaaagcatgaggtttggctcagcttcaagcaagacaccagagaagagaaatagttaccctcggatatcggaatctccgccagataatgagttccgggtcactggcgggggtgtttatgatagctttgcctttgtgttccactgcttctcgccgtaaaaaaaacaaagcgtttgtgtttagcgatcaaaatgcatgcgcaatagtatatgcatgggaactttattagttgtagctctcgtttttctaacatttacttgaaaaaataattcttcttaacactgtttttctgaatgatggatagaatttcatgtttaccaaataagtggataggcccaatagcaaacaaacgaataaataaaaattattatcggcccaaatccaataagaacgtgagcaacatgattttagtgacacgtgaatttacttaaatgaaaagaaaagcctggcacttaaaatatatttatattttccaataatctcaaaaaaaaactctctgattcgaaaagtgaaatttgattttgacaaaaaaaaaatg

SEQ ID NO: 34633 - DNA, 3000 bp, Unknown; identical to SEQ ID NO: 15069
  misc_feature (1)..( 3000): 2750-1469P.txt file - cDNA_ID_3080498; gDNA_ID_2685558; Annot_ID_193396

SEQ ID NO: 34634 - DNA, 16 bp, Unknown
  misc_feature (1)..( 16): 2750-1469P.txt file - cDNA_ID_3080506; gDNA_ID_2685558; Annot_ID_193393
gaattcagctgagatg

SEQ ID NO: 34635 - DNA, 3000 bp, Unknown; identical to SEQ ID NO: 31554
  misc_feature (1)..( 3000): 2750-1469P.txt file - cDNA_ID_3080530; gDNA_ID_2685559; Annot_ID_193429

SEQ ID NO: 34636 - DNA, 3003 bp, Unknown; identical to SEQ ID NO: 27373
  misc_feature (1)..( 3003): 2750-1469P.txt file - cDNA_ID_3080566; gDNA_ID_2685560; Annot_ID_193474

SEQ ID NO: 34637 - DNA, 3003 bp, Unknown; identical to SEQ ID NO: 27366
  misc_feature (1)..( 3003): 2750-1469P.txt file - cDNA_ID_3080583; gDNA_ID_2685560; Annot_ID_193461

SEQ ID NO: 34638 - DNA, 3003 bp, Unknown
  misc_feature (1)..( 3003): 2750-1469P.txt file - cDNA_ID_3080607; gDNA_ID_2910749; Annot_ID_193791
tacatcacatgattattataaaaatataatagcgcattttattctatatataggctgttcacgacatattcaaattgcatgacaggaaaatatcacctttaaattctaagaatacattatcttgtatttaagtattgaaagttgacattcttttcctatttttattttgtataacatatcccatacgaagacatatatattgatcaccatatatcttatcctataacgtacatattttctttgtttccgtataatctatatacttcccactatacaagaacccttttaacaatatttgtgtgcaactaatgattttggtccctctaaacttaattcatcaatggccagtataaaccaaaattttaggacttcattggacaatagttttcttaaaataattttatgtaatagtactacaacgcgatatataaattaaatcacatcatttttgttatatctatgtgtgatatactgatatatattttgtaaagtttgacgaaaataaaaaagatctatattatatttagcaaactaagaataacatattgtaggcatttccaccatgcatgcatgaaccaaattttggccattggtcttctagcaggccaaactttgaggtccaagagtcgtacatgcaaccatcatcgaatctgtagttatcgttttatgatatatgtaagcaagtctataaaggagcatctgcagtttggaaaaagaaaggttcttttatgtattggataaatgttcttttcgcgtgcttgtagccatcaacacatcccaaccaaggattcggtggaattattaactaaaaggccaattactttgaagaggttataaataaatcctactaaatcaaggatgacaattgttctatattataaatatataatcgtcagaatgtcaatgaaataatagcatcacgtttgcttcttgaaacaagctttgcagtcacatataccctatttataaacagatttagttatttggaaaattatcacataccagttatatatgtcttcttctgttataaagctgttgagtcgaaccattaattaatatttatatgtacatgtgattaatctcaaaatgtttggcatgttgcaatggaccgtacgtctaggtcacgcatcttatccgacatcatgggaccagatcacgacatggtctagtgagaatatatatgcatatctaaaatgatcttggtctgattgctgatgcattgttttcccacatcttaaagatcatgcatgggccgggtctaacccatcgtcggctaccaattgatcttggggtgattttgaaggggaggggtaatgaccatttcttgggttcgagttctaccaacagataattaacattagtaatttctggtccaaagagactataactcctcggttgccgaaaagaacaaaaaatcatgggcacaatgcatgcttttgatgtttgtgtgcatttaaaaacaaaatacacattgtttaagctaaccaataaaacatgattagcgaaatggaattttaaatagatctcgtgtttgcctgaaaaagttatttaaaggggacctcaagggcatatatacatacaagtctgtatgtgtttttactttcatacgtattctcgattcgttgtccttaaaattcgttagtcaccatgaaagcaaatgaaatgcttagctcatacgtagaatctttctctcttcctctcacttataattattacttctttttttttgatgagttacaaaatgtggaagtggcgagtcgagaatagaatcctcacgttggagaaggggacgtggcctaaagaaaaaaagagccctcgttttggataactatttctccaactcataagatgccttctgataggctttacatattccgtttttagagagaaagaaagagagagactcaaatctaacaaaatgcatatgcaagaaatccaacttaattagctctaaaccttatagttagtaattatggtaggaaacattcggaaacttataatgtttttcgttggtcgtgaaacttaaaaacgattagaggatcctaattagatattaacttaattcgaatttaaagtgcagaatcaaatctcatgaacactttttgatgctaatcctcaaaggactaggtgggagctaggtatcctaattgtacataaaaataattatcgacattagattgagtagaatgctagatttacaggattactattttaaaaaaactcaactgtcgaaaattacttataaatgcgcatgcatgatccagtgacttatcaacgggatgtctatctagttactttttcaaaaaaatccgtgattttatctgatttttcaatatattgtagctacgaaatctagtaaatttttgttgagtcacaatgagttatagccgagaacaatataaaccttattaacaatacaaaccttattaaaaacaatataaaccaacccttctcctttattaatcaatcatttaggtatttatttaatattacttgagattgactattgtctattgatcgactatagatcgctttatggaaccgtacaaaggacattctcaccttttagagatgactatatacataggtctaattctaaatgccaaatggacaataaaaatgaaaagtaaagataagttcgaaaatcattagattctcaatcacttacattttgtgatccaaaataaaattgaacttgttgtcgctttcggacacgatatccttagaaacaaaatcccaacatatttccccatctaatccaataatatcatcgtcttctctgcctctatataaactaacacttactcacctatttcatatatccacacaacatttacacaatacccttattctccacgtagaatcaagagtacttcttttccttaaatctctacaaaaaaaaaatcgatctatatactaagagatcataaatatagattcatagacctatttaagaaacgacttaagaagctgttggatcatataccatataaaatagcaatg

SEQ ID NO: 34639 - DNA, 3003 bp, Unknown
  misc_feature (1)..( 3003): 2750-1469P.txt file - cDNA_ID_3080615; gDNA_ID_2910749; Annot_ID_193789
gtaagttgtttcagagggattgatagttacctgctgcaagtaggatcttcaccagtgttgtcacaaactttctccaaaccaaaaagaacaaaattcgaaaaactgaaatctttcacccacacctgcatcccggaacacaccattactgctttcttcgttttttcagaaagttaataaaccaagcggagaaatttgtctgatcactactgagtattccagatttttgcaaaattaaaactgctattctgataaacatccagtgcactgagaaagtgatgttacctctgttgggaagtggtggtatgttttttgagggaaatggtaatagtaaggaggcagatgaggaaccatatcacggtcatgcgtgatccggaaggtattgggcacaagcaaactgtaataagatgcaaaagcggcattcccaacacgaggttgcccaaatgtcataacctgtacgttttcttcaccttcatttacctgcgatttgtatccaatataagccattaacaactcaaaggacaaaacaataagataaaaaaaaaattcaatgcaaggatgattacaactaggtctagaccacaaaaggaagccatggctcctcccattgaatgaccggtcactatgatgttgatgttcgccccgtagacttttttcactcgtgttattgcatccaaaaccgcaggccgtaaagttgtattgtgataagcactgtaaaagccatggtgcacctgccaatgtggataactattacaaattccaccgtactacaagaccaactcaatgacaaatacttgttgttaaagtgtaccattgcatctggcatgtcagggtaattcagatcgagctgtttccagaacaagtctgagacccaattttgtatgctgcacaagttttggattgattaagcattaaccaagtttatgcgaaggagtagcttttagattacaatgactagaataaaacctgtgttcttgagttccccgaaatgcaataatgatagcattcaaatccttagccaccccaacatacgcctgttgttacaagttacatgtactgatattaataattgttcaatgaagaaacatcatgagttcatgaccagctgtagcttatgatatcagagcagacctgtaagcagtgttcaacgtcaaatatgacctctattacttcgaaatcctgcaccatcctaacaaacgttagagctcaactcaataattgcggcttcaaagttcaaacagtgatctgcttcaacatgtgttttttacctttgtcaaaccattgcatctttcgcacgtccaagtgaagagttttgtcaaatcagactcatagacctgcatacatcttacaaacttgattcactcatcttatgtacgttatcagcatcatctcttttctctagtagtgcaaataatgataaatgaaaatatgaagaggacaagtgtaatttcttctcacttgcagaacactagatataaatgacattcgttctacagggtattacgttttgaagctaaatcattatcaaaggtcttttactacttcactaatctgccattaacttaccgcagaggcatactccacaagcgtgacggcaagcgtatggttgtaaacaggtcgatcatcatcgctcttcaacttgagaactgcagttagaagaaagaagctaacataaatccacttgcttcagtcttaactccttcgtagcctcacaactcataccaagaacatgaaattgtcgaaaacataaagctttgaaatcaatattttgaccttcatggttccttatgtatatgatgatgctacaaggattatgaattgatttgttccaaacatgatagaacatgtaattaggccttaatgaaaaatcactgtagccagattaaatttccaatttcccaagcacttcacattacacagaaagtttaaaatcttaattaagctcagagagactcaggagaataaaaaaactggaagtcccaataaaggaaacagacatagaatcattatagaagttgcattaccacctctaccatatgaagatgaaacaagaaaagtaaaaactgccagcaagaacaacaatctcttttgtcccatgttctgcaagaagacaataaacacatccacatcatcctctgttcatcaaccaatgttaagggcaaaattgagctaaaacaaagcagaattcggaagcaaattagccaaaaatataccttataaaacgagactcacgaaacccaaactaatgaggattaggacaaaacccgaaagagatttcagcaaccaaaagtcccagataaattaaactgaggatccaaagcctaaattggacttcttttacaacaattcggaaatttccgacgatgatcggagattattcccggcaagaaaattatacggcgagcttatatattattatatagaagtcgtgatcttgcgaaacagaagctaatagaagaaaagaaacggcgattaaaatacgaatattcggttttttttttcttaacttccactttcatcctctatacgcaaaggtgcatgagacaagcgtgtaggctctttcaaagggtattattggaattttaggtgtgtagcgtgtcgcaacttcaagtgctgaggtgtcagatacgtgattcgggcggataaatggataaggccgttccgttataagaacgagaagttgacctttttgactttcgctttcttctaagtttaacttcgagcccatgggcctttaaagcccgaattccaaggcgggaatttccgaaactcttacttctcaagtggcgggagaatctttataagtcaagccaacgtggcacatctcagccgtagatttgatttctcgaaatcaacggggtaaaatagaagctacggtcgtttcaaacgtcgggtttgttgcttttaatttcacttttgtttatttactaaccaaagcaaaaaaaactcaggaaccctcgattcgatctctcagacgaaatcaggattcgtagaggcgcgtcgatg

SEQ ID NO: 34640 - DNA, 3000 bp, Unknown; identical to SEQ ID NO: 15111
  misc_feature (1)..( 3000): 2750-1469P.txt file - cDNA_ID_3080619; gDNA_ID_2910749; Annot_ID_193788

SEQ ID NO: 34641 - DNA, 3000 bp, Unknown; identical to SEQ ID NO: 15108
  misc_feature (1)..( 3000): 2750-1469P.txt file - cDNA_ID_3080627; gDNA_ID_2910749; Annot_ID_193786

SEQ ID NO: 34642 - DNA, 3000 bp, Unknown; identical to SEQ ID NO: 15112
  misc_feature (1)..( 3000): 2750-1469P.txt file - cDNA_ID_3080634; gDNA_ID_2910749; Annot_ID_193784

SEQ ID NO: 34643 - DNA, 3003 bp, Unknown
  misc_feature (1)..( 3003): 2750-1469P.txt file - cDNA_ID_3080654; gDNA_ID_2910750; Annot_ID_193803
aaagttacaggtcttacatcttaaaccaaagaacaaactttttgacaaaatgcaccaaaagctaacaataaggaatccatctctacccttccctcactttcctccctttgctcaatggtcttaatacctgacgtttctcatcttaatctaaaccaccataagtacctctcttaaccagaaaaaaaaacaaaaaaaagggaactaatcttcctctcccttaccgttgatccactgtctttgtttcagcttcagagtcatagaatcaagttcactggtaatgcctcaatattaggttcatagacttcttgcaaagctccatgtatctcttttgttactttcgaagttggaacttgatgcgagaatctgagtagttcggatttcgggattgtgaatcttacatccttgccatcaatccagtgctcagtagcagctaaatacaccgaaccaaaacctgcacgatctgctaatttaaagccaccatcaggtgccaacaacagaaccttgtagtcctgtttatcatccagaatttccacaagatcataagtttgggattgaagatcaaccacatcaatgtcattactccagtttctgtaaatagcccaaatattaccagtctttggcatgatactgtaattatttccatcctctgagctaatctgacgtgaaaatacatcaagatcagtgaatatttcaagagctttagttgcccggaaactcccacagccagtgggcattctcttgtcaatccactggatgacgcctttgattactgtagcctttagccgacctacatgcaatttaactactggatcctgctcaaatgcctgaacaaatgtgattttctgaatcttgccatagtaccggggcaagtaatcgtcaccactgcaaaatgaccagacttggcctgtttcataagtccttcccttgcaagcaaagtgcacgcattgcgaatacgtattattctcggagtttgactctttaggctctgctagtagatgcaaagggacgtctatctctttgatatttgttggtaatgcagtaggatccagctcataagcacctcgaggcacaccttctgcttctttccagtcgtcttaaatgatggaacacaatgagagaattgataaacatcggaattacgaacataagatgtaacaatttcctcattaaagcgacaaaacaagcttaagaagccttttgctttatgcaagaaaccagcagataaagggtcacttgatccagcatcttctgacacgatttcgacaaatgcgtactgatatttccagggagaaccgggatcagctaaccagttgatgtcaaagctcgtcatgagagatttgtagcgacccttgaagatagcccatgtctctcctattcttgggtatatacagaatttacccgcgctacttcctttattgcaatgaaccaagtgagaaaaccttgtgtgatctttaatagtctcatcttttccaagtttaaacctaccaacagaaacaggcaagtctttttcatacctctgtattggttcctcgtcatatggatcaggctcaagccacgtgacagtaacattaaaaccagaaacaaaaacttctttgatctgagcatacaatctaggcatcccatccactgtatcataaagagcccaggtctggccaacttcaaagtgtacttcttccctcagcttatcaaagtcattgaaagctaaaacctactttgctctttctggttcttctcctgcttcttccttgcccaaagacccttcaccatttctgttgctctgtgcaacgaaagcttgccgcttgctatacacagacttctgagactgctctcctccatcaaaacataaatcttctatagctttagtgtcaccaacaataataacttcttcattctcgctgctgtttccagcttctctttctcttctcaccaatccttctctctttctcttctcaccagatttctgattgagatgaagtggagcctgttcgagaccagatgaaggaagctcttgagcaccatcagggttagtcttttccatcacagctttagccttgagcggctcctccaatatgatctcaacttgatcagggttagtcctattcattaacaacaatgaacaaataaagtaatcaaaacccaagctaacgtcaaaacagtatgcacgagattaagtaatctaagcatttattcctcagtaaaactttgaaaaaggcaagacaagatgaagtaaacaaccgaaaattctaaaattccaaagtgtcctactaaaagaacccacatttgagaaaaccctacaacatcaaaaccctagctatgaattgtgatagagagaacactacccgaacagtaagagaatcaaacacagcaggagaatccagaaatgcaaagtagaccgacaaaacgattcaatcaaggatttatgcaacaccggaaaataaatttaaaaatatcggcagcgagtttcgccggataacgaaaaaaaaaaaaaaaaagacgaagaataaagcagattaagaagtttactctgtctaagcggccgacgtcggagataaatgtggtccggcgaatgttacgtcgtcgctgaaggagaaggaaaatctaagctctttcactttttctctgccaagtttacccctcttctcatttcacggcggtaaaaaaaccctgttggcagtatagttatggcgggaaaaacgtttcacccgagaagaggataaatgggccaacgatcattatgagcccaagaagcccatctaactatttttaatttcataagtatatgactgcatatcttatctccttcaaaacaaaatggattcaaaatataataattattctaaattagtccagttttgaattttgaaattgttcatttccttctctctaccattccccctctctctttccaaatcccaaactcattcaacaacggccattgattctctctagagctgacaaatccagaatcggatctcaggagacttgaagctcgctcccacgatg

SEQ ID NO: 34644 - DNA, 3000 bp, Unknown
  misc_feature (1)..( 3000): 2750-1469P.txt file - cDNA_ID_3080797; gDNA_ID_2910716; Annot_ID_193495
gtgtctttactagcagctcttctactgtagaaaagggttgtttcgtggtttacacggcggataaaatccgctttgcttttccaataagttatctgagcaactctgttgtccaggagctattgaaaatatctgaagaagatttcggtctcccaacggaaggaccaatcacattaccattcgattcggcctttttagagtatctcgtcaaactgatccaaagacgaatggatgaagatacagaaaaggctttgttattgtcaatctcaagtgctagatgctcttttcaaccacaagaacaacaatgtagtactacgcaacagttgcttgtattttagagtttagcaaatttctgtaaagtttatagtggattagatagacagatcatttcagaaatacaaactattcttattttgtctctcatttaagttgtttcacaaaaattcaaaattcactaacttcatatattccattattgagagtaattgaaaactcttatatatatcttgaactttatacatttactatttactacatgtatggtttcagcatgtaagaaatagaaagaagaaaaatttgttactgattctttccaaaattgaagaatctggtaagcagcttccggctgtggatgaataactggagtcttaacaaaagtcatgcttaagaaaaaattgaacaatctgatcaacatctctagtgaacagcttgacttgaaatccaaagaaatgggaaaagtccaaaacctgattgatgaacagaggaaagtactttgtgacatgtataagcagcagacagctaatgcatgtatcaacgatacttctagcatctttgtaacatgtaagttgtaagtcgttacaaaatttaatgacactgaacccttacgttacgtacgcaccaaaattatttgatcaacaaaatattaactagtggactatagagataacttcaacatcagttaatgtgacggtttcttccaactgtttttctctgaaaccaaaaaatttcattcaccgcatttcataaattttccctataaaacagaagtatggttaaatcgatgatttttcttctggccagaaaatctaaggacctacatgctcttcatcttggcttcaccagctcatgtctttccttgtctgatgcaaattgtatccatctatatcagtgaccattaattctaaccactttttttggtccttgacttcacaaaaaagatttgatgtcccctgaatatatatttgatctattatttttgtgactcacatttgatttagatgtccaggactactaaccaagtatcaacagcctcttgcattcttcaataatgtctcagtacctaaatcttgtcatataaatgtccatataggaaatttatacccacatgatcatgtcttctaaccacaagttatctatagtccactagttgaatgcagacataattgattaccaacttgggaccatagattagaaacataatcatgtgttgtgtctggttggattgctcaggagcttgtcttaacctaatagtttctccttctatataatgaaacaaagcttattggtattcctcatcaaccagaacttttattcaaagagatctatacaaacagaactcaccaatcttatctctttccttctccaccttgctttccaatctcaagctttaactctccctgaaaatgatgataaacgcaaagaagctcatgaagttggccaagaaatggcaacaaagagcagccctcaagagaaaaagaatttcatttcagagatcaagtattactactagcagccaaacagctgtagaaaagggttgtttcgtggtttacacggctgataagatccgtttttcatttcccttaagttacctaagcaacactattgtccaagagctcttgaaaatatctgaagaagagttcggtctcccgacggaaggaccaatcacattgccattcgattcggcctttttagagtatctcatcaatctgatccaaagacgaatggatgaagatacagaaaaggctctgttattgtcaatctcaagtgctagaagctcttttcaaccacaacaacattgtagtgctactcaacagttgcttgtgttttagagtttcgcaaatttctgtattttgtagagtttatagattagacagcttaattgtttcagaatacaaactattcttatttggtctctcatttaagttgtctcataaaaattcaaaaatgaccttccatataaatggaaactttatcccaacttcaaaaatcacttgttctgacagtttcatataaatctctgaatactcaagccatattaatgaaatatactgtacttcactatgaatcatcgtatgtccatatgaatctctgttaaggcacagaagattgcacaagaacaagagatgttcttataatttgaacttacttaatctgtcacagtgagaagagaaaagagaacacttgcttgtatgttcaaagaaggttccaattattctacaaaatattaacttgatgaaactttttcactcatctagagagctattaacaaccattgaattttctgtaagtttagggttctaacttctctgtaaacgtcaaagggtctacaagttctgcatctttcattcacttgcacatgtctgtgtctaaatttaatagtaatactattgtataagtgactcatacctaaatccacatggtcaagtattttcaggagaggtttctaatccacatgttgtgagtagacaagattggttacaacttagggaccccttatgatcatcacatataaaacaaagacaaagacagacgcatgtcttatgtctggtgtggtttctcttaagtgaatctaaactctaatagtttctccttatatatatcatgcaacaagcctattggattcttcatcaaccacaacttgcattcaaagagttacgttatacaacacaatttgcacatctcttcctctttccaatcttaaacagcttttccctaaatataatg

SEQ ID NO: 34645 - DNA, 3000 bp, Unknown
  misc_feature (1)..( 3000): 2750-1469P.txt file - cDNA_ID_3080801; gDNA_ID_2910716; Annot_ID_193494
tagaaagtagaaactgtagattaattactttaaaaaaaaaaaaaaaaaaaagtctatgatcttaatccaagtgagcctatgatgttaacaccttaattttttctttttgtattgtgtactatattatagctctaacgtgaagaaataaaactagcaataaagaataaataaaataattagagggtccagttatatgatgaagtgtggtatttcttaacttctttgcaaattttaattatctattgtttacttctataataaactactcatgctgactcggtctagtcattatttcattgtttcgtacagaaattcactagtaattttgtatgttatatttttaattttataaacgaatatagaatgttttatttctctttaacatttctaaaagtcatggatcattcaaatccgtatatattagtattaagcaactaattcgttttaatttatagatcctcaagtatagatacatataaggctgcattattttccttgtgtggacgatgacttgacatctcaattaattgttatgggaagataggtatttttgaatatgaaacattatccaggacacttttgataaatcttttcttcgacttttccgacctcccggcaaataatttgtcatgtatgtacgctcgatactatgaaataaaagatgaatttatttcaatcattgatatgagatagatggggggaaaataataaactaaatacatacaatagagtatttttgaaataaattcatattaccaactaacatcttaaagatgttgcattattctttggtcaaatattggtctacttgatgattccgtatggcgtaagatcagtgccgcgtaatttgattaactaagattgttttaaatttctgtaagagattacaattaaactaaactttttatatggggttgagtcgttgactatatgtgcctgaccatccattattcgacaacaacgtattcacttcatttggatgatactcagtcaattaagcaacatattggctccgtttttatccaatttgattaagtaaaaaaaaaaaatgtttcagatagtgtaagaagctacgaagaatttatgggtwtgactgaaagttgaaactttctaaagccatcacaattgtatactttacaaaatattaagatacattgctgtcaaattttatagttttttctcgtttggaaaatatcaaaatatatacctaaaaccataaactatatgctgtctttgttagtcaacattattaatttgaaagatattaaaatatctcattcataaatacaaatatataattttaaatatcttttcatattatttattaaataaatttgattttctttttatttaatatattttttcgtaaaccaaatttttttcttacatcattttttcataaaaatttgcttttgacgtaacatattttctgctcgcatagcgcagaaaattacccaattatttttaaaatatctcattcataaatacaatagtattttaactatcgacattattatgctaacaataacaaacagaagacattactaaaaatcaactctatattaccaatagtgtgcctaacgatattaccatgtgtttgctcaaaacaaaaagctcacggttttccttactctctttttccaattatttcctaatcttatggataaactcttttgaaaattcatctaaattcatttttctttttaaaatatgtaaaatgcgaacaaagattacaattccgtatggatacattgtacctctcaaaagaatctgaatatttttagttggtatatccactatcccatgcattagatgacactagctgataataaatgtgtatgtcaaaaaatgcatagtaattagtaaagatactcttgactcaaataaacttttgatttcataaaatcttaacatattaatgggatagttacaactgtagatgatgatataacagagataaacacggaagtgtcaaaatcataggtttaaaaaaataaaataaaaagtgtcgaaatcgtcggactcaaaaatgtatttaaatacagttaagaaaaaacctctttagccacatcaatcattctcatcctttcttgtcttctctgatatttttttttctccaccattattgtttcttctctctctctattaaaccctcaaaattaaaaaataaagagacaagttcaatttttcttccttcttctcttttttttttcttctcaattttaattttattttggttggtagagattctctcttttgctcttcgtgctttgtatcgtgatcatcgtcggtgttggtaactgcacatttcaggtatttactcttacctcctcactttcgcaacaaattttgatttctgggtttttcatgtttttcttcttcaattgattgggttttctactgaaaattttcaactttttttctgggtttttgtctaaagtctaaaaccccttcttaaagggtttcttctcttttgttatgtcggcgatttcgatcaatagtgtctctgaaagttttcagctttttgatgatcggagattataagaagtaaattgggttagtttctttttacctagtaacctagttctgtgttggtttgatcttcttaatgagtttaatcatgttatttgttcaacgatcttcttaattttgatgttaattgagttaaagcttcatcatttgactattgtgttagtcaaatgctcaacttttagactttcgaaaaaaaaagattactttcacgacttttgtttgatcaaaacttgtggttttgtattgatcaagcttttttgttggttttaggttatggtttcttgcttgcatgttaatttttcagcacatgacttgagatttcaaatgtgttgtctactcttgtatctcgattctcaaagtttatctgacctgtgaagattttacatgtgattattataaatgtgagctaatgcgtttattctcttttaattttgcaaagcagatcaaaagaaagaagttgctagaatg

SEQ ID NO: 34646 - DNA, 3000 bp, Unknown
  misc_feature (1)..( 3000): 2750-1469P.txt file - cDNA_ID_3080805; gDNA_ID_2910716; Annot_ID_193493
aacatccatattaagttctgttttcctcatgaaaaacagataagagaaacaccacataagaggcatcacaaattcgtcgagttttatgatgtccgcggtgctgaagcagcattgaaggcattaaacaggtgtgagattgcaggaaaacgtataaaggttgaacctagtcgccctggaggagctcgtcgaaggtttctttctttcttagatctgctacatgaataatgaatgccattacatttcttacatctgaccatttatttgatctgctagcctgatgttgcaacttaaccaagatcttgagaacgatgatttgcactacctaccgatgattggttcacccatggcaaactctcccccaagtgagtctatttcttgatgctcttcttcaaacaaatttgtttataatatcctcaaagactgaaactgtttgatttagtgcaaggtaactggccgctgaacagtcccgtggaaggtagtccgcttcaaagtgtacttagcaggtcacctgtttttggcttaagtcctacaaggaacggccacttgtctggtttggcttctgctctaaattcacaaggaccaagctcgaagcttgcacccattggcaggggtcaaattggtagcaacggcttccaacagtcatcacatttattccaagagcctaagatggataataagtacacaggaaatctctctccttcaggtcctttgatctcaaatggaggtggaattgagacgttgtcgggttcagagtttctctggggaagtcctaacgcacgctctgaaccttcaagttcctcggtttggtcaacatcatccactgggaatccactcttctcaactcgagtagaccgatctgttccatttccacatcagcatcaaaatcaaagtcgtagccatcatcacttccatgttgggtctgcaccatctggtgttcctctagaaaagcattttggattcgtcccagagtcttcaaaggacgctttgttcatgaacactgttggtcttcaaggaatgagtggaatgggtctcaacggtggaagtttctcttccaaaatggcaaataatgggatcattaactctggaagcatggccgaaaacggtttttcaagttacagaatgatgtcttcaccgagattcagccccatgttcttaagcagcggtctaaacccagggcggttcgcctctggctttgacagtttgtatgaaaatggtaggcctcgtagagttgagaacaattcgaaccaggttgagagcaggaaacagtttcaacttgatttggagaaaattcttaatggagaggattctcggactaccttgatgattaaaaacattccaaacaagtaagcttttcctttctttatctttacttctcttgaaatatacttggaatatgatgcagccagattactgaatgagtttcttttatatcaacagatacacctcgaagatgttgttagctgcaatcgatgaaaagaaccaaggaacttacaactttctctatttgcccattgatttcaaggtaaaaattgattagagattcaaagttccaaaatcactaactgatacaacgagcggttaataaatctttggttttgcagaacaaatgcaatgtgggctatgcattcatcaacatgctcaatccagaactcatcattccattttatgaggtttccttccctctccgctttctttcttatacttttagctaagatcactcgaaaggtgaactaacaaacatccaatatttgcaggcttttaatgggaagaagtgggagaagttcaacagtgagaaagtagcttcattggcatatgctcggatacaaggaaaatctgcccttatagcccattttcagaactcaagcttgatgaatgaagatatgcgttgtcgtccaattatcttcgacactcccaacaatccagagtctgttgaacaggtaaagttactctttggtctgaaagttaatgctaaaccttatggaagttaatactgcataatatagttagcgatgatctttagacttattactcggattaagtagctatggtattcttgttcttcataggttgttgatgaggaatctaagaatatggacctcctcgactctcagctcagtgatgatgatggcagagagagaagctgacacaggagttgagagacgactcaatgttgtgataatggctgttttttttctttctaagtactaatttttaaccgtacatattggtgaaaggcagagttaactgatgcatgcaggaccctgcggaagtgtgttttcgaattgcaggttttaaatgctgcatgcagaagctgtgcgagtatttactctgttttttttttttttttttctttcttcatgttttttggttccatggagtatatgtaaaaaaaaaaaccatgaatactcggttttatgtgggtattatgttgtaactctcacaactcttgttaaagcttttggcaatttgtacagtaagaaaaaaagaattgtctctcaagtcttttttgtcttattttttggacagaagtctgtcttgcaaaaaaaaaaaaaaaacagaggcacaacatttgaaaagatgaagatatacatctgaaactgaaattagttatgtcggtaccaatgaaattttgcgttaagctttacaattattttatgataagacttgcaatatatataaataaaaaaactagtgaaattatctatgatcgacatgaaattttgtcatgttccaatgaattagatatggtaaagctgacgtggtatcctaagtggggtggatttgaattggagttgattccaacggtggagattcaaagattctttgattgatagtgagcgactctcgttttccaatcacgtgtaactcggctccactctaaagcacgaaatcaacacgtccacgtaacgatcatatattcatgcagtgatatagtcgtttaacagaaagatcactccgtcaatctttccaccactgtgactaaatctaaacaatttcatg

SEQ ID NO: 34647 - DNA, 3000 bp, Unknown
  misc_feature (1)..( 3000): 2750-1469P.txt file - cDNA_ID_3080808; gDNA_ID_2910716; Annot_ID_193492
ttttatgaggtttccttccctctccgctttctttcttatacttttagctaagatcactcgaaaggtgaactaacaaacatccaatatttgcaggcttttaatgggaagaagtgggagaagttcaacagtgagaaagtagcttcattggcatatgctcggatacaaggaaaatctgcccttatagcccattttcagaactcaagcttgatgaatgaagatatgcgttgtcgtccaattatcttcgacactcccaacaatccagagtctgttgaacaggtaaagttactctttggtctgaaagttaatgctaaaccttatggaagttaatactgcataatatagttagcgatgatctttagacttattactcggattaagtagctatggtattcttgttcttcataggttgttgatgaggaatctaagaatatggacctcctcgactctcagctcagtgatgatgatggcagagagagaagctgacacaggagttgagagacgactcaatgttgtgataatggctgttttttttctttctaagtactaatttttaaccgtacatattggtgaaaggcagagttaactgatgcatgcaggaccctgcggaagtgtgttttcgaattgcaggttttaaatgctgcatgcagaagctgtgcgagtatttactctgttttttttttttttttttctttcttcatgttttttggttccatggagtatatgtaaaaaaaaaaaccatgaatactcggttttatgtgggtattatgttgtaactctcacaactcttgttaaagcttttggcaatttgtacagtaagaaaaaaagaattgtctctcaagtcttttttgtcttattttttggacagaagtctgtcttgcaaaaaaaaaaaaaaaacagaggcacaacatttgaaaagatgaagatatacatctgaaactgaaattagttatgtcggtaccaatgaaattttgcgttaagctttacaattattttatgataagacttgcaatatatataaataaaaaaactagtgaaattatctatgatcgacatgaaattttgtcatgttccaatgaattagatatggtaaagctgacgtggtatcctaagtggggtggatttgaattggagttgattccaacggtggagattcaaagattctttgattgatagtgagcgactctcgttttccaatcacgtgtaactcggctccactctaaagcacgaaatcaacacgtccacgtaacgatcatatattcatgcagtgatatagtcgtttaacagaaagatcactccgtcaatctttccaccactgtgactaaatctaaacaatttcatggcgagtctctgtctctcatcgtcccggatcgtttctcttcaccaccagaaaccattcctctctcttaaactccggtctcgtccttcagatctctccggtctaggtcgccacacgagtcctgtttgcttcaatccgcttaggtaccgtatagtgaaaacaatggatttgggattctttcgagtcatgcattttgtgtaactctttttgtttgtaatgtttctaggttatcgggtgatcgtcagcgaaccgctacggtatcaacgagggtggagaagcggcgaaagagaggatcgagtgtggtctgttatgctgctccgatttctgccaatagtctacaatggatctccaccatttcttgcctgtatgatctctctcatttactgtgattttcttaacacataatgctggtgaaattatgctaatgatgattgtgtaatttcctctgttttcatcataacgtcaataacataagttaattgctatactgaatggtgtttcatttctagtgcattgatgcttgcaaggggtactggtatacataagtcagttgttgttccactattcgctctccacgcaccatcgagcatcgtcgcctggattaagtaagcttttaacatggagatatattcattaacatggtgatatatatgggtctctcttcttctttttgcatgcttgagcagcctattgaagtcattaaacttaaacttgtgtatctttatttttgtaggggagagtatggtgtatgggcagcattcttggcgcttattgctcgacttttcttcacttttccaggttcgtaatcatcttcaatatgtaggttgattacaagttattaattaattaaagttatacattaataggtgaacttgagcttccattcatcgcattactcttggtgattgtggcgccatatcaagtcatgaacataaggttagaatcttaaagaatgtaatgttttaatatatatcaaggttttcttttctttagtcgccgagactcattgacttcattataaacttgcagagggaagcaagaaggggcaatcatagcaatagcaatatctggttttctggctttccaacatttctcacgagcagggagcttggagaaagcatatgagaagggttcagttcttgccactgtagccattattggtgtcacagttgtatcgctccttttgttgctataactatatgctcctgaccaaaaatgttaatcagtgtaagaatgtgtgtgaaggaaaaaaaagaaagatgtgcttgcatttatccgctctttaagaaatgctggtacatttttggcaactattcgctggcaataaaaatgatctttcatgtacaaacgtaaaaacaatacacatttaaaatctttggtcgacatgggattgggatatttaaaagctgacgtggaatcctacgtggttagatttgcagtcgtattgatgccaacaacggtggagattcaagattctttgattgattgtgaactaaacgactgtcgttttccaaacacgtatttatgggccccactttaaaagcattcccgctaaatctacaccgtccacgtagcgatcatgatattgatgcaaatgattcaattttaacggaaagatgacggagtgatctttccaccaccgtaactaatcttaacaattcatg

SEQ ID NO: 34648 - DNA, 3000 bp, Unknown
  misc_feature (1)..( 3000): 2750-1469P.txt file - cDNA_ID_3080815; gDNA_ID_2910716; Annot_ID_193490
tttctgktatatctttctaatagttaataatgtctgacattgcttttgtatttcttaaccgttccctaagtattttattttctaaaactgtaaagagatacattatgcttaatgtgtctacaagaatgtatatatcctaagccctttgattttgtagtatctcctactaaataaatatactttcagtgataaactatagcaatagaacagatggtgagaattaggtcatggattaaaatcttcttgcaaatcacagctgctttcttgagctccatagatcgcatcatagttatggaaaacgcgcttcataatttgcagagaatgattgaaaccctgaaactattgtctgtttaaagataattttccctgagcagtggcattagtatcccaactgctgtaaatattgagagaaggctatgtgatacagaggttgctgaattcggaagccctgttggctctgctacgccgaagggtggtccagagccagttatgcctgtagttggagttgttattggcggtgggtatgtagatgatggtggggaactaaaatctggtggactcatttgacttggggggcttgtgctgcaattggcagatattaatcacaattatttttctcacttttttgacaggttaagaagttgatttgtggaaaaagaaacacatacctgactgttcctgatgatgatgagaagtgacagcttcctttacctggagcagtataagagcagatttgaataccagtctcagatttatctttagcgttgaaaggtataaactctagttattatcagattctttgacccactggaatcatatggtgggctagtattactaggttcaggaactatttctagacactcaacatctatcagttgtggaggtctcaagtagcttatgccgctcatggagacagcaaagataaaagctggaaatatggaagctagtatgcgggtaacttaattctactttcccggttcttatggtcaaatctgtgtggactagtacataaaaagttaagatgtcttacttggatctgtgctagtaagttgtgctgcccctccaaaattgcagctgtctgaaccaggatgcttctggtaataactattgaaagcaaaggaagcatggtcacgaattgtgttaggctcgtaacatgctgcaccttgttgtatctggccacaatcagctcctccatacccacaagcgtaatctaaagccacctgtaatgatgttggcgaagcatttgctttcgctatacaccactggccactaccaacacctccacctgcaccagtgtcaccaccaccaccataacccccacctccagcacctgcaccagtgtcaccacctccacctccacctccaccaggtgtaccaccaccatatccgcctcctccaccacctacatcacctccacctggcggtgtagtaccataaagtggtgggtaaccaccggttggcgtggtaccgtcaagaggtggataaccaccagttggtgtagttggacctgggaatgtcaaggaaggcggtgacggttgtgttatggttggtgttgtggtactaccacctggagctgtaggattaacaactggtatatcaccttgtcctccctgaccctgagctataacatctagagctgaaatcaatcatcacaaaaatcaagttagtttgttgcatccttaaattttcagaatgcgaagaaaaaaaacaaagcttattcatatgtatcagacgcagagagattacgtgaagtatatagaagacatagaagcatgatggtggagaaacatcgaggagctatacggtgagtcatttcgttccgtaagcttttgagagagaatagtcttcaggtagttgttggggtttggtagaggaaataaagaatgtttgcgaagaagttccctatcaggtatagatatatgttgttataaagatgaagagaaaagagaagaatcatagaatcaaagatttcttgggatgggagagagaagggatgcgaagacatgtaggagagaatataagaaaacttgagaaaggagaaactagctaagaagctagaagaatcggcaagcaaagagaaaacgccataaagaggaaaaggtatttacagataaactttatagtacatgaagaatatataagaagctcgttccttgtttcttggtgggaaagttcaaatctcttctcctatgtagtattaagagatttattgaactagttatgtttctactttataatgacatatggagatcatattatatatcacaagatacttatttaatcaaggctaatatttggagcattcgaagattgtttttgttttaaagattggagatgtacaacttttgtaaactgttgtcgtactaaatcgaacaagacaaagttgaaagacttgtaggtaactgaaaacaacggaaacatgaggaatctgcgtattaagcccagttgcgattctctctttatttgtttcttctcttctcttgtaaataagtgtatcttattggttcattcgtctctaaccttttttgtaatacattcttcttttacctagaaagttcatgtgcttaactctgtccaaagttgtaatccaaactagtagtaatctttcatcggaagcgatataaacccaaatcaatcgtcctttattatcatgtgtgtatgtcttctttttttaaccttgggcaatgtggttttggttcggtttaatttagcactgctggtttaaacgagagaaccggttcagtaattttacaaatttaaaaaggcaaagaggaaaaaaaaaggaaaagaaaagttgttttttttctataaggtgaagaaaaaatctggagagggtttcgttttctacagagagagatatatcttcccttgagcttccttggtgttcttcgtattgtcgtcgcgactgagagaaggccacaaaagcttcgtttatttccttcagatccgatatagtgagagagagagagagagagaggcagcttacggcggataaatatg

SEQ ID NO: 34649 - DNA, 3000 bp, Unknown
  misc_feature (1)..( 3000): 2750-1469P.txt file - cDNA_ID_3080821; gDNA_ID_2910716; Annot_ID_193488
gtctcattgagacgatggtcaaaagtaccagagacaaaaaaatctttgactaggcgaaaagatcatctccgacaatatcccagaatctctgataaaaagcggctgttaaaccatctggtccaggtgttttatcaggatttagagagaaaagagctcttcggatttcttcgaaagaaacatccttaacaatcatctccttcatcccttctgtaattatctcaggaatttctcggagcgccgatgaaaaatcaatcgggtttgttgtagagaaaagattttgaaaataatccactactaatgcttcaatgcctgattctttgtctatccaagtcccattttgatctagcagaccaatttattctataccgcgcacgacgttgcattgtcgtagcatggaaaaacttggtgttcaaatctccttctttgtaccacaatactctgcttttctgtttccagaatatatcttcttctctataagccccacatagttgcaatttaagattcaaaagttcatcaattgatacattctcattattttgagcttcgtcaatttttgattgtaggctcaaaatcagcttctcagagtttgttattgtagattttttccaacaagagatgatttgaccacaattttgaccacaagtggaaaacttcaccacttggaccgtttgctgaacgtcttgactgcctcatgttaggtgagaaacccccatgaaggttaaacaattttttagacgccgcaccttgaatacaagtctgtccagattgggctttaggagttaaggccttttactttttttcctttttgcctagagtggcccaagcccaaatctggaaaaggagaaacacgattcttcttcctctcgtcgctctctttcacgttattctgcttaaggtcttcaagttcttcacctaagagatcatcattctccaagttctctcctgcgtctagaagggaattttcgatttcacgataatctcttcatcttctatcgctcagtcaagatcaagatgatcctcctcaggattattctcctcccaatccatgtcgccatcatccgtcactccttgctatgtgtcgttgacatcttcctgcataaactcctcttcctcctcccaggtttcttcactcttaatctccatttctgatgcgttaatttctgtattttcaggattagcactcggtaattctccaatatgaattgcattggagaatcttgcttctaaaggagcttcttgagcatgattttcctcttcttccacagtttgatcataccaactcttctccttgtccagctgcttcgatataaccaagaggtcagatttattacgaggaccaaacgcttcatcatcttgtgtcatagtatcaaagtttaggcttttctttgcagagcttccccaatagtaagtttctcagaggcgatcacgtgcttcaattgaatgtagtcgcctctctttttcagattcaagcgaaaaggtctttctctgttaagagcttgagaagaaactccttgttttactcgtagtgaagagatcaaaggatcagagaccgtcaattgcgagtccgagacatgggataaaccagcagattttgatgctgcagctggagatttgttctggttcatcctgcgggtcacagctctttcttttgatgaggatggcttgtgattatggttctccagagtgtcatcataacgtcttttgcgacctgaatccttaaagggagggatctcgcggactgaagaagggttcttaatctctgaaggtctcataagtttctcccgtgttcggggaattgaagctgtgctccattcaattcgtcgatcatagccctgagagtcatccctagtcgtatgatgatttgagtagcgagcatttgcaggtgggttccagttctgagatcgagaattgtcaatacgacgccaagcatgtttagaattagcatttacaacttgtttgccttctgtttttctcctgcggtagtcagaggttgttgggtcttctttagcttgtgttggcttgaccaagtcaggtctccaccacgaagggtgaatccttccatttgtgctgagctggagagttgcagtaggagtagaaagagttaacttcttccctgaagtcagctttcccaagcttttgtcattatctttttcaaacggtaacgtctccttctgagccacaaggtttaaaggacaagattcttgttcgttgtagatcctatgacaaagcttacaccacctaaagagtctcttggagccgagagatacccaaacaagctcacccgaagggatttaagtctttttgcggaatctcaagggttcatctgccttactagtgactgtgttattttaaagattggagatgtacaacttttgtaaactgttgtcgtactaaatcgaacaagacaaagttgaaagacttgtaggtaactgaaaacaacggaaacatgaggaatctgcttattaagcccagttgcgattctctctttatttgtttcttctcttctcttgtaaacaagtgtatctttttggttcatttgtctctaaccttttttgtaatacattcttcttttacttagaaagttcatgtgcttaactctgtccaaagttgcaatccaaactagtagtaatctttcatcggaagcgatataaacccaaatcaatcgttctttattatccttgggcaatgtggttttggttcggtttaatttagcactgctggtttaaacgagagaaccggttcagtaatttttcaaatttaaaaaggcaaagaggaaaaaaaaaggaaaagaaaagttgtttttttttctataaggtgaagaaaaaatctggagagggtttcgttttctacagagagagatatatcttcccttgagcttccttggtgttcttcgtattgtcgtcgcgactgagagaaggccacaaaagcttcgtttatttccttcagatccgatatagtgagagagagagagagagaggcagcttacggcggataaatatg

SEQ ID NO: 34650 - DNA, 3000 bp, Unknown
  misc_feature (1)..( 3000): 2750-1469P.txt file - cDNA_ID_3080829; gDNA_ID_2910716; Annot_ID_193486
tattatttgtatgtataattcattgccccttatttaggtttgtttgaccaaccggtgattcacttactatttaggtcggcaaaacgttacatgaaataaaaacagcatttaattctgtttttttttgggtataattctcttattagagtcgttaattaatattgcgacaaaagaaaattcgtgagttgattaatagtagaaagtgtagaaaacgagtcaaggatttaaaggtcaatggcctcagccatttgattggtttagagcttggctatctctgaatttgaactatatcttacccacatataataaaattaggccggccacatagacaaacataaatactaacaaaacaagttcaaaaatctcaagatcaccaacgatttatgtagtttgacaagtattcacgaaatatttttgctactaacgtctcgatcaccactggttgtggattttaaatcttctctcagtctctatgttcgttattatgggaggctttaaagatttacaaaatacaagaattcactttccaatagatcactcatttataaattgcttcaaatcaaacacatttaattataaaattgtttaaaaagtttgacctaaaaaaaaagtgtattttagtgacatgatcaaatcaattattttaaacttttcttatccaccaccacatttctagattttggaatgattaaaaaatgcatacatgatgtttttataagatttttacggtgttggttctattttgtttttcttattgccattttttcgattattagtgttttgtatgttaaacttgccgattgttccaattactataatataacaaaaacaagttttagctatcgatttttccaaagttttacaacgaagtttttataagttaacatgaagtaataatagtatatgttttaaaattatacgtttttttgtatgaaattaaatgttacattacactattaaagattccaataattaaaacacatgttacaatgagtaaattttattatcagacaataaacatctctttgctctaagaagaaacctatgctagtgaagcgttgactctggaaagatgcaagtgcaacgtgtcgctgaaacattgaaggcgcgtgtagaaaaatgttaagctaaagggaagttcactttctttaaccaagttttgcgttttgcaaattacaactaaagaatccactaaagctaacccaactaaattcaaacatttttctatgtgatcagtttaccatcaaactatttcatatttttgcaatgtgtagtaaaaactttctttgttacattatatgcttcttttataagcaaaaataccatattacattacatgttcatttcatttttgtttggtatttgcgcttacaatttacaaaatgattttgtttgatactatttacatttacatgtgaaattattgtgttcatcgtaaaacgttcaaaatttctaaaaattgtaagaaattattgtaaatgtaaacaaagtcggtttcctataaaaccacacgtctgaaccaccttaatcatcatcacaacatgaaattacaaaagcagcgactttgtcgattgccgtagtttcattgtagcatagataatcccgtcacgtgatgttatctatttttaactgtttcaatgtagtcagaaaagctatttgtttgatttcagaactgtttgattagtggccattgaaaaattctataatctatagtcaatagtctatacacaattgaaaatggtatagttgattttttaaaatacgccattaaataaaattatatatagaacttctctataatcgataaagtcgaacactccaggcaacaagcggaccgaccacggagtctaacgtaagagtattattagtgatactgtaggttttctttgactaacgataaagaaaaaacaaacatgtttaatttctcgtgtcctctatattcatgagtcatgacgttcatacaatttattcttgttttaaatgacgttcatacatcattttcatggttgtctattagttcactagaaaaacgaagtcttgaacgttgaagcgaagcattgaatatcattttataattttatggactaaactatacatttcaatcatctttgcaaaaaagaaaaaaaaaaatgagttagatcataaggagtcaggacaacagctagcacaaaaatctcaaaatcctatactgtttaacccaaaacaaccgtagaacaaatattattatacacccaaaaaaaaaaacatatttgcaatcacattagtttgtaaacacttctatttcgttccataaccaaaaaaaaaaaaaaaaaaaaatcaacattcaattttttattttaaaacatgtttgcatatgttcatggtatgacattgggtattaatctatcacagagagctaaagcccatataaataataacagaaggcccatatctattaataaccaactcttaaccggtccattctaactgtttttctcaaatacaaaacacgtggataacacgaggaattaaaattgaagttaaacaccacaccatgtcgcgtacgaagctgccacatcactgttctattaacacgtggcttaatatgatgcaatatagacccaccgatagctggcgctttctagtttaccaaggtgcgacgtaccagataacaccacctctccacttttgaaaattaaaacgctctcttttggtaattatttagggaaacttcgataattaatcgaataatgaaggactaatttgcagttttaaggaaataagtaagcacacacgttagagaagaaagaccgttccagattgccacgtcatcgtctcctctcaacgagtttctgcaaaacctgaaacgtgctgcaccttgcctctctttctctctcttccttcgtttctctctcgatttgaagagagaaaattcgttcgatttcgttttctcttcttcttttggattttcccggaaaattttggaatcggtgagtctctatcgattactggtcaaccatg

SEQ ID NO: 34651 - DNA, 3000 bp, Unknown
  misc_feature (1)..( 3000): 2750-1469P.txt file - cDNA_ID_3080845; gDNA_ID_2910716; Annot_ID_193521
aaaaagaaggttttactaattaaaaaggggttgcactaaccaaagaaacaaggaaaagatcagtttgtagagtaaattttactataagtccattatagtattgcctttatttacatttctttaaattaatcgcttaaggagaagacgctttcacaatgttttttttttggtgaatacgctttcacaatttttttttttttttggtgaatacgctttcacaatgttattaagaaactagaatggaaacattccaaaccataaataagttacaaatctaaccaaatccacacttgaaagtaacgttttcaaaaatagaagagcgataattaaaaacaataatatataaaaccaaaaaaaatgatactatatcaaccgcaatttttcaaagggaatattatcattgcaattctgaaaaggtcactaattattcgttaatcatgaaagaaatacagcctaacatgcaacttaaaagttaaaacctgaactgattagatatcgtattttcttaatttttctaaaattagtttttggaaagagggattcttgtctctgaagtttcgattatatgcttcatttcttcaatttccctgattcactgcccgaacttgtttttatgctagcagggatggttcgggttgaattcagaagaagcaaagccgtcagattcaggttgtctaagatgaaacaaaccattttttgcctggcgcagtgataacttgtgatacaagtctaactcaatttgctctatcgtattgaagagtagatttgctgaaaatattgatcccaaagtaattctcgaaaagtattcaatagaacccaaccaatatgtgaacttgagattcatgtctttggtttcttcccccaatgccttgaagatcgaaccttccatgtaatcaagctccacggtatcattcttttggatgaaatccctgttttttttcaaacacctctaaggcctcgatgtatggagcatgtagaattaaaatgcagtttatcattatcaaataaatagttaaagtgtatagcaatatttgaaacaaaattactaaattaaatattaagaaaaatatagaatactatttagaatataaagattatcgatacaaaattatatttatttctcacaccctccgaattgggccggccttatctagtttataacgtaaaatatgttgttttaaaatcagtttgtgccttttatcataaacaattttttaaattgagcatttggaccttaggcaaatgcatatgctgccattggtcatagacaagcctgttccaaatacgcaccatccaacattttattagttttgacaaagtttgaattttgttctgttatctataatgctttcatgtaatccgatttgtcgaaccaacaatcatttgcatcttttaaacaagaagaatactctatattcagagatcgctgtttttcgtggcctatacaatactgggttttggatgttgggcgaaacgatgatgagtctatttattcattttaagtaagtagagaataagtaacaaataatgtcaaaaaaaaatcttcttgttcaaaaaaagaagaaagtctaagaaacaaatttcagaaatcaaattcaatatgtcatgttaagtctggtcatggtaaacttttttttaagtcattcaaaaaagaaatttaattctttttttacggcatgtttaaatttatttcatgaaaaaggttattatacatgaaacttttaaaaagtatgagcagaaatcaaacaagaaaaaataaatcatgttaagtctagttatatttaaaaaaaaaaaaaaaatctatagaatgaaaaaagttactgtacataaaactttataaaagtatgaaattaaacaagaaaaattaagtcaagttatagtcatgtttaaaataaatttaaaataatctataaaatataaatcgtcaaaaccaacaaaaactgatcagttttatattaaaagttgaaaaacatcctctaatttgaagcatatgtttctcctaaacatcaactattaaaatatggtgggagtatacttttaatattctaatactttttttttatcaaataaaacattctgaaattcattaagataaaagtattatttgtttattgagtatacgtagatattagtaattttgtactcaaatttatccaatcccataaataaatttactatacatctatttaatataaagattatactttattttgagatttaattttacttttaaatattatatatttatagtattatacactgttaccaattggaaccatttactctagttctatggtagagaaacacacactatttactctagttctatggcagagagcaaactaaacttcaacacaacttttttcaataaagaagatgcataacacacaacatgtataatgtggtaagattatagaaaaaatgagtaacaaagtgttttggaaacactaaagaaaaaaagtagtctaaaatatggtcgaaaaaaggactacaagtctacaacatacgaaaatatacacatacgtttgtataagaaatatttgaaatcatgatagaaactgttgtatattccttaaaaaaagaaagcatatgctcaaattcaagaacaaagacatgatgatattggcaaccctagaaaaaagggaaattaaaaacacaaagtcaaactatttgtctgtctggaaatgaagaaaggatctatgtaattagtaaccaaaagaaaataaagaccagtcaacctaagaatcttcttgatatcactcagaaagaaaaaaaacaataaaaacaataaaatctcaaacgcggtttctacgatttttgtagagtcaaaaccagcaatggtgttggtgagagtctaaaaaaaatcgatcgaaagctcaaaaactccatcttctttcccccaggaactcacaaaccctagatgaattgttaatcatcaatcatcgatttcaagatttagtctcgaaaggttttattttttttgtgcttgcgtcttaaatg

SEQ ID NO: 34652 - DNA, 3003 bp, Unknown
  misc_feature (1)..( 3003): 2750-1469P.txt file - cDNA_ID_3080853; gDNA_ID_2910716; Annot_ID_193519
aagtttttctgtttaattcgatggaaaactatggggtaatttgggagtcctctgttttttttgtatccttgattctcattttgggatgatctattttatgatatgatctttagcagtaattttaagtttattttcaattgaacgttacttatttcacaatctttcttattttgcgtgtgtatgaaggcactgtacaactatggagctagaaagtttgcattggtaggaattggagccattggatgtagtccgaatgcgctcgcacagggcagccaagacggaacaacttgtgtggagcgtatcaactcggccaaccgaatcttcaacaacaggctcatatctatggtccaacaactaaacaacgctcattccgatgctagtttcacttacatcaatgcttatggcgcttttcaggatataatcgccaatccctctgcttatggtataatagagatatcttcatgaaacttaagcctatgattaaataaatattctcttctactttatggtaaaaagaatctaatctatatattgggttctctgaatgaatgtttttagggtttacgaatacgaacactgcgtgttgcggaattggaaggaacggaggtcagctaacatgtttaccgggagaacccccgtgcttgaaccgagatgagtacgtgttttgggatgcatttcatccttcggctgctgcaaacacggccattgcaaaaagatcttacaatgcacaaagatcttccgacgtttatccgattgatatctcgcaattagcacagctttgaaaggacagagaataggagagttttacaacaattgtatgcttttcaggttataaattgaattattggaaatgattctgatgttatgtgtgtacccaaagtgttcaactttataaaaaaaaatagggattgcattatctgagttacttccacaatgttttttttttttttttttttttcttttctgtaatcgtgtattttcattcagtttcaaaatgtgtagtctaggatttattgtctaaaacttttgtttggttgaacacggcttcgctgaaactggatctagtatatagataggaattgtgttaaattgttttgatcatttgatttttattaaccgtcattaatcaactatgagtacaacaaatgtaagaaagaagacagaaacattaaataatttgaacgcatctctattcattacttccattatgcactttgaaaaatctcttgatcctctcaggaaagcacgtaacgtaattctttcatacgtaatattacattctccaccgggctaaataaaccaagcccaaaagttatcaatgaagcccaatagttgtcaatcattttttcatatcgaactaaaaatgtgtttttttttttttttgttttggtttttaaaaataacatagagtgcaccagccgggaacatgtagttaatacaattaactaaaaaaacatgtagttaaatataatttttttttttttttttcttgtcgtctactcaaaatttaattcaccttgttttgtttcgttaattaatttaggttgttgttctaatatatgcttttatgattgatacaatgactaggactggacacaggacacaggtcatctattttcaattttagaattgccattagatttttaagagtattctactggaaaagagtttttttgttagttagcgatatttaaatctaagtttaaattgtatgataacttgaaacatacaatttgttagttagcgatatttaaatctaagttcatatatatatggataattcctactaaaaactttttttttgtaatgattcttttatgaccaaagcctaacatcagcaagtattcaaaacatattaacgacgaaattatctgtcaatcgatgactagaatgatttagtgaccaattggctttacttattttttctttcttcagagaacatgcaatagtttaacaataaatgtagcattaccctaagttaagagttttgacctacgatcttaaatggaaagagttgggagggaacatggaagcagcaccggccttgttcaattatgatacaaacaagtcgttgatttattcacaaaatatccactatacctttcatttattgcccaaacctaattcttcacctgttttcttttcacccaattttcttccatttcaaataattggtatctttcaattttagatatatatacacaacaagtgacaccgataatacacaatctatcacgattttcttttcatttcgtatttatttataaaatgatttttaattggctcatttatccaattatgacaaaagttaggattttgtacgcggaaaaaactctacagctggtcaacgttcagagagaaggacaagtggctttgtcaaacctacgactttgtcttctctcatactattataatgcaaaatatctttttcttactttaaccagctgcaaatgacctttctaaatgctttaaacaatatatatatcgaaacaatgatcagaaattagggtttagtgagggtatatgtacattactaactgtaaataatattttattggtataagtcatgactaaaaataagcccttgtcgataagtcataaatcctactctccgcgcgatatgtttaattttggtaattacctatccatttactgtagttctttttttgttcaatgttccttctccaactcctctttaagttccttatataagttaatgttaatttagttgtcggcacatataccttttaaattatcgaatataaagccattgataaatcttgattctgatgttgaatgagaaaaaactggtcacattatattggacccaccaatcttaaagtgactaggcctacaaaaattaaatctatcaaaaacacaaatgtctctctatatatagttacacaacttctttggacttcttcacattcactcatatcactacactttccattaattaccaatatatttttactacttaaaaaagatattggtcttgaaatg

SEQ ID NO: 34653 - DNA, 3003 bp, Unknown
  misc_feature (1)..( 3003): 2750-1469P.txt file - cDNA_ID_3080856; gDNA_ID_2910716; Annot_ID_193518
tgtaaacacaaaataaacaatagcactaatgaagaaccaattaatgtaagtgtttttttctttctttttggtatccatgttaagtgaccaattactataattttcttggttaaggttaacgtacaaaggatatttaagttatagattttactggttgatataaaaaaaagaagttatagaattgacttttctagactgaataaatgacgaataagtttcgtttggaatcaagtttgtggatcaatcaaaaccccttactaggtgcatcatgcttgtccacacaaaaatgtttatcgatcttgtttcaacgattaattacaaatctctgtgaaggctgaactatttcatcaatgcaaagttcataaattgataaacgtaattttatcttcgtgacgactaagtgatgagacacctctcacacgtattatgcttttgtctaccatagctagccaaatcttttcatcactttttaatcgtttttcattataagttatttctttacagtttaccatttttttttaaaaaatagctgtagatattccaagcaatgagcgaaatgttttgggatatcataatattgaatattattatactgttttcgcatacttaacatataagcattttaaaacacgttatcattatacattaagttataaaccaacttatttttcttttgaatataatttaacattaaattaaaaagcagattatcatcataagatatttgatcaaaatactaatctatctaaacattaacaatatatactaattaatatctttatgttttgttcaaaatgtacattctacaaaacttttgtgggtttagttaacttttgttgatatatatatatatatatatatatatcagcttgtagaagaggggaacctttaatcgtgctaacacggacccgatccagttaaagtgcttgtatagcaaaaaattgatctgactatttattgcattaattggtatggtcacgttaataaatcttattacattgcgattgacgttaacgtatgatgttactgctaacaagaattcaaatcaaatttacaagagaaaggttcaattcaagccaccatttttgcttttctttttttcgcttcacaaaaagttggattagtgaagcatactacaacactctctttagggatcggacccctctatgcactgttatgtcggctagtgtccgcacaccctacgcagtattatttattgatacttacacatagaatattttttgccaacatttttagtaccttggaatatagtatataccgttgctcaaatagtttcactaataatgtggttaaaaacagacgatatttgatacaatgtactttctctgtttcatttaactcttatattcacattgtttttctctttcaaaataagtgatgtatgcaaaattacctcattgtcccaatttatccttattgtttttcatactatatctgtatttttttaaaactttttttttgaagaaactatttgtaattattgcattgcttgtaacatagagataattatttgttttgcatgttttcctaataattgtgcatttatccaaaatatatttattttggaaaagtagagtaatattctctccgtttaacaaaaaaaaaaaaaagacttatttaaacgtaagaatgataaagaaaaatagtttttatttccatttcaagcgtataaggttatagcaaaatgaaacagccagttcatagacaaatttgaagatagtttttcgtacatcggtacatatgataatgaagaagtctagacccagacacccagctaacggatcttaatctttctagagtatgcgacttagtaaaagatcaattcatagatcaattcactgacgttattatatcgaaagctttcatgcccacataatgtcaaatatctaccattttctcgaacttacatttgaaccatcgatctcaaatgtaacatgtatgatcgatgtataatatcatatttgtatgatgaatgtgtataattgtctatgtgtaacaagacttaaggcgcacgtatcagccaccagggcggctcgttttgattattacatgtcgaaaaagttttcacaaagagtccgcgtgaatttaatgccccaacctaactctcctcacttatttcccactccttccatttttaaagtttaatctttgaaatgaaatatgtctctgtatgcgatcgaccatacaactattgttacagtttttttgaccgaaacgtaaatatctttttaggcattattcattagcattagacaataatcaattattctagacactgttagaaaacacagctgcctagctgccaagacgactatctaggcaatcaacggttttcttccgtcaaaaatagtcccaaatcgactacactaattaatcttatgacacaaccgaatcttacatatctaagactaagttcagaatcactatgtccaaatttacaagaaccattaaacaataatatacgacccgatgatagtttttcgagaaaaaatctccaccaatcaaacgataggatcgatcgtgtttgacatattatatcaaaaccatcgtgatcaatatcttataacgcagttatttgtgagccgacaaatccttttaccacgaacatacatttacagcgtagttattattatttcaatcccataagatgtcattaactacagttctcttcgttttttttggtgcaaccaattatagttctcaaaacgagacaccaaaacaaatacaatttataattggacccatcgattttaaagtaaagtatgccacaaactttaaaaaggctaaaaaaagaaaagaaaatataaatacacttacgtttctcagactccatatataggactcaaaacttctctggattcttcacatttcaccacaacgaccaccactcctacactaacacttatatcaccaacacattgtgttctactatacataaaattcagttcctaagtatttttgttttgttttgtgagatcgatg

SEQ ID NO: 34654 - DNA, 3000 bp, Unknown
  misc_feature (1)..( 3000): 2750-1469P.txt file - cDNA_ID_3080911; gDNA_ID_2910716; Annot_ID_193500
ggaatccgtctggttgtgttgacatatacggtttcttttaactcaccatgtaagaaagctgtcttaacatcgagatagtgattttcccaattgtttgacccttcaaggtttaaaagaatccttattgtctcaactcgagccactggagcaaaaacttcatcgaaatcgattctgtatcactggacatatccttttgcgataagtcgggtcttgtacttgttaatgcttccgtctgagtttctttttagtttgaagacccattttaagccaatggcttttgcaccaaccggaagttcaacaaactcccatgtctgatttttctttgtagactaaatctcatcctcacaagcaagcatccattctcgtgattctctagcttcataaaaatctcttggctcattattcagacacaacaacagcctttctccttcctcttctgcaagtaacacgtagtcctcaagatacttaggtcttgaagttggtctctctgatcttctcaacacgttttcaacttgaaccggattgttgttcacattctccatctcttcttctcgagtaccttcatcattctgattttcttgctttgtattaatcgcatcattgtctatctcggtttgatctccgcttatttgaacttcagaacacacaagttaaaaaattcctctctttattagctttagaaaatcaactcaaaactaaagctctcttttggttctctcaaatctctctcacaaaactcataaggactatcacatctcgataactccttatataagaaacttaaaaccaaaacctaattgtttagataactcataactcctaaacaaaaattttcttagataactcctaaatatcctatcttttatctcttttttcaataataatttattccttaagttattttcttcaaacttaatccaacatacttagagcacgtccaacgtacagtagaaactctataaattaataatgttgggaccatgcaattttattaatttatagtgatattaatttatcctataaattaataaatttatcgtataagttaataaatattaatttatagatatatttacgtaaatacaatactatattcttttaaaaatgttattaatttaattttctatatgttttgttgtttgcatatatacttatgttagatttttatttttctttgacttttttaatttatttttcggcaagatattgtgtctgtatatctacgacattaacgtgaacgtaaacatgaagcttaatccaatttctctttacacaaatcttagcaatgctttctcaaataaaagattttacaaaatcaactatgacggatcaaatatgcaaatagttatgtgagtacaacaaagatcatactagttgtatttttaaaaagttgtaattgtaacttgaacaaaaatttcatataaaaatgagtcttaaaatataaacttaagatctatgattattaatttataatattattgggactataattttacatagggatttcaaaaaaattattatcttattatcttatcgattttggttaatttttacattggcccgacttgggaccgacaaaatttattaatttatcgtgtttattaatttatcgagtattaatttatagagtttctactatatagggttcatatagtttctggaaaaaaaaaaaattaatattttacttttatatccaaaaaacaaaaaaactaacgtatagaaattgtataaacgatcctaaaattaggaattttagagattctctcatatctatcttaatttttaaatatttttatttttttaattgtatgagtttctactaaaaatctaccgccttggtgttaaagccacttagactacatgggttttgacccaaatagttaattaatctgatatgggttttgcgataaactcctcactctagaaagtagtctcacaattttatttatttaatgttgttaaatttgataggaaaaatgggcctaatgggcttttatatcttttttcaataataatttattccttaagttatcttcttcaagtttaatccaacatacttaagccacttagactatatgggttttgacccaaatagttaattaatctgatatgggctttgcgataaacttagtctcacaattttatttatttgtgttgttaaatttgacaggaaaagtaggcctaatggaccttatcgagttttcttcatgagcttagctgttttgctccataaaaaacgacgccgtttcctgtgcgaactgagaaatatttcttcctcaagtcgctttatgtcggtgaccgacggcgggttaagtttagtgaataaacaaacaatcttcgtaaaccaaaattgataatttttaaattttggtgtgaaatcagatccaaattctggtattttaacaccgtaactatgctgagtaactagtacgattgctgctcactcaccacttgctcctgcgatataaaaactttgcaatctagtaggatcattgtatcttactctctctggttctttctactagatccggatctggaactttctctactctctgctcataaagtttcattctttggggagatctgaggcaaccctttttctctggtgagtatctctctctctttcttttgatgttcttgcttctgggtatctctacaaatgcaagattcggatatgtacatgagcttttcttgttccttttacttcttaaactctctttgctcttaattttgttttaaactactgtgattttagttttcctaatgttcgatttgttcgttaaacgtgtaaatcaagtgtgattgtggtatatgatcttgcggacttggtttagtttctgtttttctagatctgcaattatttgcttaaacttagacattggacttaatccgtcaaaaccatacctttttgattgatactcttactggtcactaatgccattgtactttgttgttgcaggtgcatgtgactagggattgtgccgtgggtttaggatcatg

SEQ ID NO: 34655 - DNA, 3003 bp, Unknown
  misc_feature (1)..( 3003): 2750-1469P.txt file - cDNA_ID_3080915; gDNA_ID_2910718; Annot_ID_193527
aaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattcattcgacattatatggtacaaggctgaaacaatttgcaattctttttgtttcgattatgtctctcggtcgtttagttacttgttgataatctatttctaagggaatttttttacaatgaaataacaattttctttaaggttttatcatttaaatggctttttagaaaaatggcgttgtggacaataatctcaaaatataaagaaaagtgaactcttaacggtcactggtgagcaacggctataggaggagccactgcagtagcaacgtcgggtccacacgtgtgtcgaactgtcgatatatgtgcggccaattggttttgaattttaaatagttatcttttgatgttgttgtattcatgtaccaacaataatcgtgacaacattaacttatcttcttacaaatattgaaatgtatataaatacgtcaggtcatattattttattgtcagatgaaaaccaccggccataccagatgttatcaactactcttattaaagcttagatgatacttggttgatttcgtataaaatatagtaataatgtaagatcatctctaatagttaagaaccaattacttcttaaccttgaatattaacgttattttaaattaaaatttcactgttttgaaggtaagaaaaattagagaagattttaacaaattactattccaatgattaagaatcccttcttaagaagataaaaatcaaattattgcaaaacattgttttggttaacaaattactattccaatgacacatgtgtcattcttaccttaagaaaaacatcttagttaaaatacatatcttaattggtttgattaattataattgcttttaatgctaagatgtttgctaagattaggctaagatatacgctggggatgctctaagatttttaccatattttaattctggttaagctaatttttggtgatgcatatcgatcagagtctaattttgaacacaactcgtttcatcaaataatttataattctatttaatcatatattgacaacaacatcaaaaagatattgtattacttaaaaaaggatcagaaatttagctacggatggtagatgcatgaactggtcaagaaatcttgtcgaaagaaacgtttgttgtatctttaatgttatgttatgttatgactcacttttcctttgaaccttctttcgtggtacaactcccttgaaacgttcgcattattgaaagttcataaaacaatttcaaaattctttgtcatcaatggtgaaatgaaaattatatatataattatcatgagattatgtaatatattagtattatgttaatggtgtattaaataattcaaagctagaaatgtaaagatttcgtgaatggtacttgttgaatgggggtaatcgtaatataggaggaggattctacgaacctacatgattcattagtactcataatgcatttagatatttttcaaatcatacaatattataaagatatactaatgtataatgatgatttaggcttttgagatatgaatttttgtagaaagaggacccatccatgtgcaacggcaataatctcggttttcagaccagttcaagtttcctaaatgttagtattttaagtctctgattaatccctccaatctcttttaaagaaaatgattaatcactttaattaatggttagtttttgttccctttacaaagaatcacacgtggcaagatatcattgcaagaatgactcacaataccgtcgttagcctgcaagccaaaagccacgttaacattcccgttagattaatgacggcaacatcaccacgttacatagtctcccttattccgtttatcagataagatcataagaatgggtaaatcaaaacaattaatttttctaaatggagaaattataaatggtacttatcaatccataaattttaaacttttaggagatattaaaataaatgaaattcaatttaaagtataaaaataaagggaatattcgatgacttattttataaaacaaatttgatggataaaaaataaaatgaatgcaaagaaacggtcgtagatgtgaaaagtaacggcgttaagaatatacaaaatccggaaaaggctaagaagcgcgtctatttaaagaaagagctctctccttcttccaaaaaaaaaaatctagactttgcctttcttttagcgattttttttcaattcattcctcaggaaaaaaaaaatcatcgatccgaaaaatctacaacgatctttccagaaatctgtggttttgagatctaaagatcttcaatttcatcaccatttcctcgatcttcgtttgattgttgttgcttaagaggagattcatgaatttataggtgtacttatttgggttcgtctctgttaggttcgtgagggaggggttgatctagttgttgttgttaggatttggatcgattcttttcatggaagggtgtctcttattgatacccgtacgagaagattattgtttagatttggattagagctaggttttttttgtttcaataggaaatg

SEQ ID NO: 34656 - DNA, 1953 bp, Unknown
  misc_feature (1)..( 1953): 2750-1469P.txt file - cDNA_ID_3080943; gDNA_ID_2910719; Annot_ID_193552
agccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccctgcaggtcgaaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatg

SEQ ID NO: 34657 - DNA, 3000 bp, Unknown
  misc_feature (1)..( 3000): 2750-1469P.txt file - cDNA_ID_3080947; gDNA_ID_2910719; Annot_ID_193551
ggtgctgatggcgtatactatgaaggatccattcttaaaaagatcacaattatgcgaaagactgccttaagcagattgttggataggctttatcaattgtttggattagataagcagaaatcagagttcaaaatcttcggtaagtaccctgtagatgtttcaccggatctctttacgtatgtacattttcccgtgttgaacgactctagtttggagactatgcttgaggttccaaggaatcatccttctgtaaacaatttggaattctatttggaagctcaaccaacttctgatgctgtcgttgttcctgttacttgttcatcgccactggaaagtcctgatagttcctcaaaaagacagaggatcacacaacaagaaatagtggataataattcaggctcagctggcatcttggttaaagttgtcaattctggtgctttaaaaccctgtcttctgcctagactgtggattgatgacgatcatgacatgcatttaggactgtgttttaaagatagagatgagttaaagaaggcagtggattggtggtgcattagaaggcggcgaaattgtatagtaagagagaccgagaaggaaatgtacacgtttgagtgcgtaagatggaaatgcaagtggtcactacgggcagcaagaatggaagaacacggacttgttgagataaccaaatatactggcccacatacttgtagtcatgagtatccaaatgattttgagtcagagtttgcagcagatgagattgaacgtgttgtcaggatacagcccacactctcaattgcagagttgaagaaatggtggaaagaaaaaactggctatgagcttcaaacttccaagatgcgggatgggaaactggaagtaatcaaaagagtatttggagatgaggatcaaagtttcagagtcatgcccaagttaatatctgcatttcactcatctaatgggcttctcgtggactggcaatatgatctttttcctaatcctgattttgcatccttccgtggcgtgttttggtcattttcacagtctatcgaagggtttcaacactgtagacctttgatcgtcgtggacactaaaagtttgaacggtaagtaccaattgaaactgatgattgcctcaggagtagatgcagccaacaaattttttccccttgcctttgcggttactaaagaagtgtctactgatagttggcgttggtttttcactaaaatcagagagaaggttacgcaaaggaaagacctttgcctcatctccagtcctctccgggacatagtcgctgttgttaatgaaccagggtctctgtggcaagaaccatgggctcatcacaagttctgtctgaatcatttgcgctctcaattccttggcgtttttcgagactacaacctggagagtcttgtggagcaggctggatccacgaatcagaaggaagaatttgattcctacatgaatgacatcaaagagaagaacccagaagcttggaaatggttagatcaaatcccaagacataagtgggcattggctcatgacagtggtctgagatatggaatcatagagatagatagagaagctctatttgcagtttgtagaggctttccttattgtacagttgcaatgacagggggtgtgatgcttatgtttgatgagttgagatcctcttttgataagtctcttagttctatttatagctctcttaaccgcggtgttgtgtacacagaacctttcatggacaagcttgaagagttcatgacagattccattccttacgttataacgcagttagagagagattcatttaaggtctcagagtcctcagaaaaggaggaatggattgtccagttaaatgtctcaacctgcacgtgtaggaagttccaaagttacaagttcccatgtctgcacgctctagcagtctttgagaagctcaaaatcaaccctttgcagtatgtagacgagtgttacactgttgaacaatattgcaaaacttacgctgctacattttctcctgttccggacgttgcagcttggccggaagattgcagagttccaacactgtttcctcctagtcagcagcttagtcctaacacataactagtaagaagaagagctggaagttagatggatttgtgtcaaaccaaaccgagcattttggttgattatactagtgactatgtagtatcttttgactttaggaaagtaggataagtcaggttccggttatataacggagacgttatgtttatgcttgttcataagcactttttggtgatcccctaaaaaccgatatgaaaactaagctaaactggattagaaatgtgacgtcttcttcttcttcttctttacgatctctttcccaatcttattgtagctttcttttactcttactctcgcatccatgcctctctcgtaatatacaaatagtatgtgtatgtgtgtttttagcttgtttaatcaagtttcttatctgcaaaggcttaatgtggacaaaaatcatcctgcaaaaactagttcttttctacaactcgtacttaccaattttctaattctaatgcatatattgattcttaaaaacaaaatattaaatcattgggacattgaaagttaatttttggcgggaatgaaattgaatgttttgctagtttataaacgggctcaaaacgggctttcttctttcggcccaattgtactttattttatttttgttcgaataggtgtgacatttatggcatatgaaaaagttaggtggtgtcttcgtcatcggtgacaagtggcttcgtcaccggagaagtcctcagcgacaggcgaaattagttgaagttcttgcaaaatccaagcttctctgccacacccgatctgaaattctccagttttgagttacgtagacctttacaagtcttagtattgagtatcactgtttattgtttagagtttatgtgttttgaatggatttatctgcttctgtcgccaaaaagctttagcctttattttttagacatg

SEQ ID NO: 34658 - DNA, 3003 bp, Unknown
  misc_feature (1)..( 3003): 2750-1469P.txt file - cDNA_ID_3080951; gDNA_ID_2910719; Annot_ID_193550
ctcctgaataaagagtgcaacaagagaagctacgagtcatggtttgtcaatcttaatctccttagaaccaatcgtatttcgggatacttcatacaacactacatagtaaaaggacacgaacttcgaaccagttttgtccatgagaggagtgatttacaaaacaatggagtctccatcgactttctgccacccggaatgataaagatcgaagcttgtgatgcaagtcatgggatattgctttgtgttaagtatacaaaaccatcacgtggatacatagtcttcaaaccaaccactaaacagtatcaggtcataccaaagccagaagtgaagggttgggatatgtcattgggtttagcggtaatcggattgaaccctttccggtataaaatacaaaggctttcgcagtctcggcgtatgtgtatgtctcggggtatctaccatttgaatcacagaacttttatgtgcgaagttttcgattctgattcgtttacctggaagagattagaaaatttgcgtctaccaaaaacagacagattaattttttccaacccgatacaagtttcggggttcttgcattggatatcacggaacaacaatgtgatccggttttgtctcaaaaccgaaacttggtccttcttccatactccgaactctgatgttttctcaggattagtcagatacgaagggaagctaggtgctattcgtcagtggacaaacaaagatcaagaagatgttcacgagttatgggttttaaagagcagttttgaaaagtcgtgggttaaagtgaaagatattaaaagcattggagtagatttgattacgtggactccaagcaacgacgttgtattgtttcgtagtagtgatcgtggttgcctctacaacataaacgcagagaagttgaatttagtttatgcaaaaaaagagggatctgattgttctttcgtttgttttccgttttgttctgattacgagagggttgatctgaacggaagaagcaacgggccgacactttaaaaaaaaaataaaaaaaatgggccgacaaatgcaaacgtagttgacaaggatctcaagtctcaagtctcaattggctcgctcattgtggggcataaatatatctagtgatgtttaattgttttttataaggtaaaaaggaatattgaattttgtttcttaggtttatgtaataataccaaacattgttttatgaatatttaatctgattttttggctagttattttattatatcaagggttcctgtttatagttgaaaacagttactgtatagaaaatagtgtcccaattttctctcttaaataatatattagttaataaaagatattttaatatattagatatacaataatatctaaagcaacacatatttagacacaacacgtaatatcttactattgtttacatatatttatagcttaccaatataacccgtatctatgttttataagcttttatacaatatatgtacggtatgctgtccacgtatatatattctccaaaaaaaacgcatggtacacaaaatttattaaatatttggcaattgggtgtttatctaaagtttatcacaatatttatcaactataatagatggtagaagataaaaaaattatatcagattgattcaattaaattttataatatatcattttaaaaaattaattaaaagaaaactatttcataaaattgttcaaaagataattagtaaaattaattaaatatgtgatgctattgagttatagagagttattgtaaatttacttaaaatcatacaaatcttatcctaatttaacttatcatttaagaaatacaaaagtaaaaaacgcggaaagcaataatttatttaccttattataactcctatataaagtactctgtttattcaacataatcttacgttgttgtattcataggcatctttaacctatcttttcattttctgatctcgatcgttttcgatccaacaaaatgagtctaccggtgaggaaccaagaggtgattatgcagattccttcttcttctcagtttccagcaacatcgagtccggaaaacaccaatcaagtgaaggatgagccaaatttgtttagacgtgttatgaatttgcttttacgtcgtagttattgaaaaagctgatttatcgcatgattcagaacgagaagttgaaggcaaataactaaagaagtcttttatatgtatacaataattgtttttaaatcaaatcctaattaaaaaaatatattcattatgactttcatgtttttaatgtaatttattcctatatctataatgattttgttgtgaagagcgttttcatttgctatagaacaaggagaatagttccaggaaatattcgacttgatttaattatagtgtaaacatgctgaacactgaaaattactttttcaataaacgaaaaatataatatacattacaaaacttatgtgaataaagcatgaaacttaatatacgttccctttatcattttacttcaaagaaaataaacagaaatgtaactttcacatgtaaatctaattcttaaatttaaaaaataatatttatatatttatatgaaaataacgaaccggatgaaaaataaattttatatatttatatcatctccaaatctagtttggttcaggggcttaccgaaccggattgaacttctcatatacaaaaattagcaacacaaaatgtctccggtataaatactaacatttataacccgaaccggtttagcttcctgttatatctttttaaaaaagatctctgacaaagattcctttcctggaaatttaccggttttggtgaaatgtaaaccgtgggacgaggatgcttcttcatatctcaccaccactctcgttgacttgacttggctctgctcgtcaatggttatcttcgatctttaaccaaatccagttgataaggtctcttcgttgattagcagagatctctttaatttgtgaatttcaattcatcggaacctgttgatg

SEQ ID NO: 34659 - DNA, 3000 bp, Unknown
  misc_feature (1)..( 3000): 2750-1469P.txt file - cDNA_ID_3080975; gDNA_ID_2910719; Annot_ID_193543
gagagtaccaatcttgataagatgaagaataggaaagtatgggactgcgaaagcacactctacgactcgttcgagctcaactctttcaatcgccaactcaactcagccatctcttcctcagctagatccatgtccatgcctcacctctcttctcctcctccaccgtcagaaacaacatcttcttcaaccaagaagcaacaatcccctaccaagaagatctcacgttctctcgggaaactcattaaatcaatgttcaaacagaaacaatcaaacgctctgtttaagacaggtcatagcggtgtagacatggacaaatactacgttgtttttgacaagacgggctcactcaccacgatccccgagtctggagagtcaacagagatggttggctcagagatcaactcgcttgttaggaaaacaacgtccgagcgaatcccgcagagtcggctcgttggtatatcatcttcttaattattttcatttgattataatactataccgcagttaagtcactaaacattagtatgatgattaaaatagcctttaaataaataactattatggcttccaaaaacatactattactagaatatgactcgcaagataaatatatatactttttgttataaacttttgatattgttgtatttttatattttataggtataaacttatgtttgaatttgataaaccgtggatcaatttttaataactaaagttttcaatgttaagtaatttttgttttctttagcgtttaaaattataattgtattttgattgttaattctaaaatttgacttgtatataccgtctcgtattaagatcgatccaaacttgtcctatcatataactccctctcttaaaattaaacatcaatttgtttatttttttaataatacgtttatttaaaagacatataattcaatatacattgcaagattaataatttattctgttttttataaatcgatgaatttagactatatctaatacttttgtttttgttgttttttggttagaaaataatgattaattatgtatggtttgtaataaggtgtaagtttttgatatttaagtctattattattttgttttttatatggtttttgatattatttggatatacaaacaatattattttttacattattttattcttagttaaacctacaccaaacgataaatcgtctaaaatcgaggaacaaaattgatggaataatttaaaataaataaatatccaaattagtacttattttgtgttagtaaaattcaagtttatattagcacgtgggtcaatttattttattaaaattaaaaaaaaaattaataatttattatttggttatattttagattgtacacatacttttttcttcattacttgagtaatatatgtccatttatgaaaaacattaatcacatcatatcagaaaaaactaaaattttgttaagcatatatattttataatacttcaaataaaataatgtaaaatcaaataaaaatgaaatgaaaatcatatatttatgtttaaattaggtagagagatttttaaaaattggcacaattttttatattaacattaaatcatcatatttgattttcttatatgtaatagtagttaaggatatgccgtaataaaaattttaggcataataattagttaagaaatatacattttaccgattttatgaattaatttatttttgggttttgtcacaaaaaaaatatctgattgaagattttttggtcaaaattaaaaacaaatccgacttgaataaagagtaaatatgtatttcaaaaatattagtacatatattttaataatataaaataatcaaataaaagtgaaatgagaatcaagaaattgggccaattttttatattagcattaaaacatcatatttgattttttttatatgtaaaaatcgtagtgaaattttttgtaataaagtgggcaagtaagattggttctgctcccaatcgtctacaagttttaaactttcctctatgcgcgaatgtgtgatgagtcttggtttcagtttcgggataaccggagaagatgttgatggggcttgagcaactggcaggatggctcttacattgttggaggcagctctgcgaacaacagtgacccaactatcaccaccgacgtctagagacataaagccaaggaatccatcctcgacgacatgacaacagttatctctcacctccatccagaagcagctcaagaacgcctcttggatgcctacactaattcaacttcagtttggctaaagaacttgaagcggatctgcaatccctcttggatgctttcattgaaatccaaggccaagtattaaccatcatgttgtagaatctgtatcattaaaattagtagctgatacttgttgagactagatgttatttgtagagtggttcaaatatttatagaaattttattgtatatatatttatataatgacacttctaatcaattttgaagttgaatcaagatattattatttttgaaattgtacagatatttcaccatataaagcaacaccttatgttttgtgtgaggtagcatagaaaacatatcttatatggctacataatttgggttgaacaaaggaaccgacaatcttactatttattaaaataaccgttaatattttaacgaaaagttgtgataataaaacacaatagttcaaaagtgtaaaaacaatatttattaagatttttatcattaataaaatcttaataattttaaactttacaattattttttattaatgtataagattaaaaaaagttaagaaaatatttaataaaaaattacgttttgtatcggctaacggtccaataggaaattatggaagagtcaatttcaacaaatgcgattagtcgattgcataaataggccagttaaatgcataacaggcccaatattttggcccaagtcttgataattcgaattaaacgaaaaaaatcgctgaagctcatcggaggcgaaaatg

SEQ ID NO: 34660 - DNA, 3000 bp, Unknown
  misc_feature (1)..( 3000): 2750-1469P.txt file - cDNA_ID_3080979; gDNA_ID_2910719; Annot_ID_193542
gactttaaagactagtctacaagttgatgtgattttagacgtgtggaaacgaaacactgtagcttagacccaaaagcataaacgaaatcatgtagtctttgttaatttggtttggtgtcaatttggtgaaagatgaagaagaacaaaagcataagcgcctataaatttagacaactcagtgggatcgtttgcaatcacagatatcaaaaaccacaacaaacagagatcgtgatactgatattgagaatggttttggagaatgtgttagagatgttggagagtggtaccgttcatcacagaaacatatattttattatcgatccttgagttaataatggtgattcccttgtctgcgatacggatcatggtagcacgtggaacccataaggccttaacttgagcccaacgtctctaatttaagatttggcctccaccaaatctccaattcgccactgattttcgttggccacatgattaccctaaaccccaaaacatgtttctttaacttcatattgttatactcattatatggacaagtcaggtatattcatgtttttgacttttaaattaaaattctattctaaatttaaatattttgtaattgtgatgtttaaacttaattaataatataactaaaaaaaattaacttacatatgaaaatcaatttataagttaaattaccaatattcatacacataaattaaatgttaggttaaagctagataacatatcactcaatatcggttaaagcatatcctccactcgtcttcgaatcgggttgaaatatagttttcgtcgtcatcgttctttcaacaattgtataaatattgttattttcatacctttctctatagttgtttctactacatgttcttttacttaatcaatataccatcaaccacaacatttttattatggtcatcttctgactatgatcccaatttacctttgtaaatctaccaccgtttagccactgtgatatcggtttctattcaagttggctaccaatttagcctctgttttttgtcgttatgatgaaaaaacaatttaattttttaaagcttgtggccacaaaaaaatcaatcatgaatttgtggctgattagccacaacttaactaccaatattatcaatagctaatcagccaccgattagccaccaatatgtcaaaaatattttagtagctaatcggtggctatttctagcaattgacaaaatttggtggctagacattggccgatttgctgttttgttacaagatttttgtcgctccgtctctatgacatcgagatcaaagcgacaactcctctcttaaaaaatttgtacaaatgttgaactactcacattttggatgtacaagtccaaacatgtattattttctcgtttccacgtaatcaaaacaaatatttgaagggtctaaataataagaaaataaaaacaaaactcaattttgtttgtatcttttgtaaaaaaagtgtctcttatttaatattgtaatgcaatggtcatattaccaattttatctcatctatttctcgttcaaattacattttcctcttgagtttgagtaaaaatccctcaagtcttatttgcgcttgcaatttgaaattcataaactcaaattggaacagatcagcttttgaataaactcaaattggaacagatcagcttttgaacagaccttaaggatgagggatgcactatagcttttgaatatgagcctcatgtgaccaaggaggacttctcccaagcgttgacaacttacttgcggttgcaagacgaagagaacatttcagctcttgtggaagagttgaagagctcggaaaatcaaagtaaagaaaggtgtaaaaagagaagacaaagcttataaagaaagtgtctatgagacttgctcctgagttctttatagatgccaatagatttacactctgctgacttttatcaacctaaggaaaaggagtatcgtcctatcaatatcaaacataagagcaaagttgaagaaaaagttgaaaaagaagttgaagaagaagttgaaaagtatgttcaagaatctcagtctgcgacgagtgaaggtataaaaccctctttttataatactttagaggaatctatatggaaataagaaaagctctatgctaaactaggtttcttgatgatatgtctctagacgtcttatattggtagattgccatggtctacttgtatcgattgattgctgcatttgtttgctttctaagttgaaaggtggaaaaaggatagctgaacaaactatcatgagtgtgaagaggtggaagatggatacaatttatttatcagatagatattagtttattattatctttaattgttgtgattattagagaacgaaatctaaaaaattatataatgtgattacataattttaaaaattgcagtataaatgttgattattgtatgtgtatcagtaacgtgtaatcacttaaaaaatatattaaagtgaaatggtaaagatttgcgacaaattacaatcaataacaaaataaaacaatacgtttgacctaaactaatgcagtaaataatcataaatattttagttttaaatttacatatagttattttatattttgatatatattcggatagtttaatattcaaaccgctatgatgtcaaatactaaaatattttatcaccactttttatcatatataatttttctttcatttttatataaccactttttcatcaattaaatttcatatattcttaaactgtattggaataaataaacaatatctaaaactgatgtaatttacaaaatataaagttgtaatatatatcactaaacccgcatgggtccacttctagtaaaaaaagttaaacgcaaatccttgattttgtttttttacacagaatcacagatcaaaaaaggcaaaaagttatactctatcttcttttctttctctcctcctcacatccaccaactctttccttctctcaccgcgagagtaaccgagagacatg

SEQ ID NO: 34661 - DNA, 3000 bp, Unknown
  misc_feature (1)..( 3000): 2750-1469P.txt file - cDNA_ID_3080994; gDNA_ID_2910719; Annot_ID_193536
gaatatcgtttctttgacggctagggtggaccatcacagttttagacttttagtttcatgaacatattatctaaagttgacaattttctaaaaatctatatgtgagtgtctaccgcaaaagaagcaattcagcaaaaatattaaaatgtctcgcataaaccattagaagttacttttttctgtcaaattattaaaattttcttgacaaaattttatagttacatgcaacagcattttaatattttatatgcgagacattttacaaatgtttgtatctaagactatgaactggttaaacatatatacttttttttttttaaacatatatactttctttagactatattgagttttcatttacgaagttgagttttttcatgggatgaacttatttatgggttcaaaagtcattctgagtaaaactatattataaataccaatatatacaaggcgaacatgatagtagtgttagtaacttaatattataatacttctttttcaaatgctaagttttatatcatatatatatatatatatatatatgtatctgttcaatcttaatgtacaatccattaaactagtacatggaaattctagaaacttacacgagctggatgtactttctattaattcacacatttctccctaattattgatgtggattacgtaactaattaataagtgatttctcttcaacatatattgatatgctactatagatctgtattaatctacgtgtgctcatagactgtatatatgaggtccccacttatccctaacgtagaccttcaatttttctaaagcatatattttggccatactttttgaggacctaccagtctccttcttaattattttcattttaatcacattatacgtgataacacacagctacgaagtaagaggattcgatgctaaggcaacatatttcatgcaccctatgaccagatcaaatcttcgtatttcacaaatagtcaactactaagtgttatcatctaccgaattaggcatcgatagtttctatttagatgtcacatatataaacaactattctacaacaaaaatcacataacgatttcagattctaaatatatattattttctgtttagtctgggaaaacacatatactagatagtttgaatttgaatctaatactaatccaatagatccattgaaaaagtttaattgagaaaacacatatactagttagtttgaatttgacgaatacttgttttagatgatttttttttaatattgtttccatttcattcttataaggaatatccaatatatctgtataataaaaactctcatctccaaactggcaaaaagaaactggttttaacatttcacacaacatccttatgaaatgtcgacaagatcgtgttttgaatgagaattccaaattccatgtagaaaagtcgtttgcaaaaacaaaactgataaacaaagaatttgattgtttcacttcacatagctgacttggtcttggttctccacagagtataattgattaataatcaaaaacttcaataattaagatagaatggagctggacgtggacctggtcggtttgaccttcttcatttaaattaatatatttgctttcaaattattgaacctgtttttttgttgttgccaaaacattattgaaactttagcgtgactatgcattgtaaagcagtaaagcttatttatttattgtattttctctttttggttgttaattaattatatgcactctatcacattattctaacaattcaataccccagaattaaggtaagttgactttcttcgttgacaagacacgtggcgagttcagtaccgacgccaagtggaggagcttagactttttaactaattaatttgcgtatggttctttttcttcccatgcaggtattagttgtctagcagctggttcatgttggtattcgtttacgtctcaattattattcgtatgatcatactatattactatatgatgtttcaacctccatttttcaaagataagtacgtaagttcgtttactcaattgaaaaatcatataatagacaagatttttatgaaattagttctcatcttagacattttctatatccgtggtccgtggaatggttcgtaaacaagaatcgaagctgttttagataaatacattggttcaagattcattttgctcaccattaattaatgtggtcgaagaatcactttgcgtgttactcgcttatgacatctattaacgtgagtacggctctgcacttcattaacatcgtttacaatctacaaaggtcataaaggtccgtttataagaataagtaagcttgtttgattaattgaagagattaattatagtattgaataaattaatcctattaacacgtcctagtagactataaacacgacttattttttctttcatttctccttagttgatactacggagaatatacagagtctctttgaagatcatttatcatttacatatcatccattcagggaaaagaaaataaaaatggacggagtttggtttatgtgaaagaatattaataaagtgggctttgatagtcaaactttcatactaaaccctaacgacccaatacgatattttttcctttatttcggcccaagtctgctagtttttatcaaaatccaaacggtgtcgtttagaaacactgtgagtctgggacgaagtcaaaaaagatgtacaacgacgactaaagtcaaaacgtgagtctcttctcttctctagtggtgcgtggtgactcacacaagtctcgagccaatccaattctcgagaatcacaaaacggagattcaaaccgatgaacaaaaccattcgaaaatcagaagaatccgagtccaattgttgcgaggtcggttttgatcttcatttctgatgtttgcttcttcacttaataacacaacaacagagctcttgatttgcgaaatttgatgaatttcagatgaaattttgagttactttaagcgtcgtcaaaaatg

SEQ ID NO: 34662 - DNA, 3000 bp, Unknown
  misc_feature (1)..( 3000): 2750-1469P.txt file - cDNA_ID_3080998; gDNA_ID_2910719; Annot_ID_193535
acaatgataaaataaagcaaacaaataaaacaatatttgttgtcattgatgacattccaatgggaactataccctattttttttgggtcaaatatagagtcagagttaaaaaccagacaacggcttttcgttttgggctttttgactgttgatggttgaaggatgtgtcacatgaccccgactaacaatcttaaactacacgtattcatggcactccatcgagagatcgagtggtccttttttttttcttttttttttctttcacccattcagttaaaaaataatacatttttactgttgttagttattctaattggttgggaagtacaaagagtgggacctatgaccaaaaacgatcacctgagtggaaaggtgccgtgaccgtgactcaaccggcgacactcggtctaaaccggagcttttgcctcttcttacgtgtcagtttactttttaattaaaacaattttaaaatagcattagcagatcaaagatactaggttttttttagtaaaataaacttatttattttttgattaaataaactaaaagataagatgattatatatggtcaaaagaaaaaagcaaacctggagaaatttcatttataaaacaaaacaaaagaattgagataaagtgaagaattaggaagaaaaaaagaaggggtaaagttgtaaataaaatgattcggcgggaggccgttgattgcggttgggaataaagccatctgacaaggaggcttgtccgttttgacccccccccatccctttcttcctttgtcttttttcttcttcttgtaatatacctacgtatacgactaattctaaactattttcttatgttaagattaaacgtgattagtttagatttcgatttacttattacttgttctgtttagacaaaatagtaataaaaaaaaaagatcttaatttttgctctaatttgtaggccatctttggttcatttttttttccactggaattgtagattatattgatgaaataaggactgaatacaatagccggcaaggcaataaaccttccaaaaacataagccggcgagtacaagccattttcggttcatttgtaacatcaaaatttgaaatatatatatatatattttttgaagtgtattttattttagatacatgaaaaatcaagtcatttgtaacaatcaaaattttaaaccagttgaatagctaagttgaaatcttttatttcttctacaaggttcagttgtagtttctattttgttaacttgtatcgtcgtaaataataatactaaaggaaagtgaaactggaataataaatagaagaagaagagtgttagttgtcggtttgtcgggttaaccacttagatggttcgcagaaaaccagatgtcaaagccgctcgtcaacgtgttttctgtttttttttttcttttcttcttttttttttactcttaaatgttgtttgcctttgccattgtcatcttggcatgagtttccgtaatttagtatgcacattactctaaagttcatcttactatattgtatgatttcgcaaaatccggactcttgatctataaaagatccctctagtcccctaaccatcgtttctatacatcccatttacttgttataaaccagaaacaatgaagtattttttgttcaatgcgaagaacatatgagcaaaacatcattagaaaaaagagtacagactaatgccattttactctttttctacttttcacgatggtacaaattatatcaaggataatacactatataaaatcaaactattactaatacactttactgatgaaacaaaaaaaaaaaaaatatcacaaaaaaaggacgttaaagttttagatccaacctcttctttttatgacatatcgaaaacaagaaaaattataccaaattactattattatggtgttatacttcaaacatactatttttatttctaaaatgcactagttttcaatattttgaaaagtgctaaaaatttgaaaacaaatggagcgtgttaatcttaaaattatataaggttcgtggcattttaaaattcttaaaaataagacctagcaatgaaatgttacgttcacattaaggggtattaaggagaattgacacaaaggcgaacaaattcagttagtaggaaattacctttttcacctttttttgtgtgtgttgcctcaaaaactcctcagtcttcatacttaccatataacgccttgatgatagtattagattaattttaatcaaaccattaatattacctttactaataacaaaactcgttttagtaatactattactttatgtgaatgtaaacacattcatttaccaccttgccgcccctatgtgaaaagaaagattcatgggaacactcacatgactttgttccttttcattttttcttcataactaataaattattatttcttccaaaatattgttgtaattactctgagttcctacaaaaagcaattaactaacattaataaaaataatagaataattgtttttgtaattaatttatgattaatgcggaagtcacaattttccacctgattaattaacaaaattttctatcaaagaaaaatctttgtcttaaacgtatacatagatgatgtacatttcaaaatttcgaccaacacttaaaacacgaaataaaaaaagtactcacttgataatcatactcaataataataaaatcaaaaggaaatgtgaataataaaacataataatgaatgaaaaggaaattaaattatcattaaatgaaagctaactgtcaaaaatttctgtctcttggtaccttcctgctttctccttcctctcatttccatataaagatcacttaagctcgtctcttcgtcttcacaaatcaccaatccatcttcttcttcttcctctctccttctccggccactttcctcactctctgctctccctatatcagcgctttttagctgatcctctctccggcatttctctctctctcttttttttagccatg

SEQ ID NO: 34663 - DNA, 3003 bp, Unknown
  misc_feature (1)..( 3003): 2750-1469P.txt file - cDNA_ID_3081002; gDNA_ID_2910719; Annot_ID_193534
ttcgacaacagaaaatgtaagttggatttgaagctggatacaggacatacagacgtctgtaacgtaaagtatccaaggccgcctctgacatataagtgaatctaatgggctacaaatgtaacttataagcctaaactaaagccctatttgtgaaatgaaactgacccatacaatgatattacatagaacatcaaactggcccatacaaattgtatcatacaatgatgtaaactggcacagcattaacatattttttgtttttcaggactatacaaattttcaattcaacggttgcactagcatgacaagaagaactaaaaaccaaccttttaaactattgctgaatatagttattttctaatagggttcgaatgtataacacttgaaaaccatgagatacaaatcaagaccacgaagtacaaggtttgggttctttcatatttgttcgtacaaaaaaaaacttccaagattttcaaatccgttagttaacttcttcccttatcttatctataacgacttgttcccttatatgcaacgacttgttgtggttgaactgcatatatagcttcgtaatccaagtcaatatatttatataaaggtaccaagaatcttaaggatgtggtttgaaacattcaaaagatcatacgactttttctttgttataaacaaaacaaatgctcacaagtcttcatttagaagaattcaaagtcaacggtatgaaacttcgccaaaacgacaaataagccgtcgtactagttttggttgcatctatttacattaaggaattggtgacgaaatcaactctgtaattttctataatcagtttttcgtacggactttcgttcttgactattgacatgaatcccacctttatgtttcatttatccttaaactaaatcatgtaacaagaattttaaatttagttcaaatttcatttgctttagaacaaacaaattttgatttgttaataacgttaaatttgaatatttctcattatataactagtctgaactcataacttatgtcagaaaaaaaaatatgcagaggaaatctatggattttagttttcttgattagtcaatactcactaagcttatttataaattaaaaagcaacatagtgaccgtgacaaagcaaggttatcatgaataagaattgatgaatttctatttgtacatatattaattataataaaatggaaatagaatcgcatatatacattagacatggaaattgaagggcgactaagttcataaatatggatcaatgatgtagaataactaattaataagagtggtccgttattgatcaaacttcaattgcctagttaggtacgaactaatccaaatgcgacgtgatggaaaaaatgatagtggcccgtatccataaatttcgtttttaactttatatcctataatgttgtccacgaaaaatgccaagattataaataagttcgtaaactttttttctatttcaactaacacctaatgaacataatggcggtgcgaaaagaaatatattgatctctattcagatgataatgatactagggatctacttacttcataaagttatataactttatcaattttaaaataattatggtagaataaaatatacatcaaagatttaatcttaatcagagtttaagttttgttatcatggaacaaaagtaccattccattttatcttgcatgccttcatcattctcggttacgttggtcctctacgaaaatgtattcttaaacactcttcaatggagtttattccaatcaatctcacacacacaaaaaaaatttgatcgattgacgattctaggtgactcacttgtgctccaataaacctcttagctcgaaccttctgaatgaattggagtgtttgtcgtagctgattataacaaactttgaaatccgtttaaaggaaaacggaaaaaacaaagacaccacaatttaatgaaaatgtagtcaatggataatataaagataattcgtgacacaaaggaaaaaaaaatatagtcggatgaattcatgtttctgtcatatatttgtcttgctcttatcccgaatctcaagtaaaaatcaaaatcagaccaaatgtttcattacttaacttcatgccgcttccagatgttggcaacatatttttagtcaacaagggtttttatggttatggttaaccactatgtatggtatatatttctgataaagtgtttatttgtatattgattatattttaaaatgtcatatactcatatggcctctataatatttggttagcaatatattattactgtttttataagtcaaatctcaatattataagcaacgatcttacacttgtgtgctgtcaatagaaagtggtaatttaataatttgattttttttttttttttaattttcgtatagtacttaattacttagaggtctgggtcattagaaatatgtgactaacatgtacaccagttattagatcccaaaatgttaacatatcctaaaagcagtagaacaatgatacaagacccaatatatattttatgtttccacattaatttacatttaaatcaattgttatatcattcaaaatgttttaacaaatgtggagaaaagtcaaactttataagtttatatcactgtaactagtcgagaatagtcattctgatcataaaatacggaaaggtaataaaatcaaaagtgtattaacactttattatgtcttcttttttattttttgtcaaattatttccattttgttagttgataaatagacaaaatttaattagcttcattgagggaaaaaaaaataatatttaattttcttataaataccacccaatattgaggattggtcagctaccctcgtgtccttgaaatgttttgttcctcaatcatcattataacattcacaccccattttaaatttctctctacttgctccttttacatttcaacgaacaaaacacatgtatacatagaaagaaacgcaaatacgcagatataataaatg

SEQ ID NO: 34664 - DNA, 3000 bp, Unknown
  misc_feature (1)..( 3000): 2750-1469P.txt file - cDNA_ID_3081010; gDNA_ID_2910719; Annot_ID_193531
agaggaacatttatataaaaaaacaggagtaataatatagttatcaatcttgaaattacacatatctgaaactgtttttccaagtaggtgtttgatggttagatcatgcattagattatcaagcttcatcttgaaaatccgacaaatgatgtctggtctatcttcagacttcaagttcctctctttacagaatctaactatttcaggccactttggattgcaagtaaacgttatgaaaagtgatggaaatccaaagtgtttgcaaatagccattgcatccaaatagttgtttgtcatgtaccttggtccgcctgtaaaagaaggtggaattttaacttctttaccttggttttccaaatcattgtttccagagttggatgcattctgaattgattctttgttagaacttctaaattgtggttgattattcttaatatacctcagcctgttagactcaatcatagtgtaagcatcaactatgaactgctgcagcaaacgcttagaacgaaataaaacgtgtttctccgccttcctttcttgtagacgatatgcaaaccactgtctcatgcttacgtctttttgttctttttttgcatcgccacgaccatttgttctagctttctttatgccaagtgtataaccatcttccccgcgtgcgaataacagaggatattttttcgatgagttccttatttaaacttttcttcttttggccgttttcagattcgttctcattgctgaataatagagaaacaaattagtttagtgatgtagtactaaactgtatagttgtaaagattgaaaaataaaatagaagatacctcattatgttatatctgttgttaacctcattttcagtatcaacaatatacagctgttgaaactttgctttagcaactgattttggcttcaaagcacctatgagatggtaattttcaccttgtattgcaaacatgttaggcccacgacccttaggaagacaatgatctactttaccccctatagatgtgaatgagaacagcatgttgtaagctctgatattttctctaaaatgcttagcgagttcatcatcgcttgtaagcaaataccacaaaaattctggcgattccttcagggaaggcaatacgatctgtccttgcatacaacatcctgaatatattggatttcttgaattcctcctcttgtttaaacgttccccataccaaaaaatagcaccacacttgtctgaaattgttggcgagttggagaatcgagtagagctctggatatttattctgtatggatgagttgttgatcgatatagtcctgtcgccttagtcactgaaaattcctcgatgattgtccagtgtcctatcttcacatacctctgtagtttgagtagatgttccttttttattcctgcttgaattttatttccctgaaaatagcataagaaaacgtgaatgcgagagttaaaaacaattaaagacaaccattaagattatagacaaattgtaaagcctaaaatacttacatcctcatctgctaacatcatttcataagacatcccagaacctttggtataatgattccacgcatggagaattttaacttgaatacaccaagaggttttgaacggtttcaagtttttgatagctgtgtatggactcacttcatccattttgtttggttttgcagtgagtaatgaattggtttatgagagaaggcacatagatatcgtgaaggtattcttactcacgtttatttataataagtgctgggtggattagatagatagagattttcgatttagatagagatcttcgatttgataagtgtgtttcgatttgttatatagaatattatttgttaagaggaagatataccaaaagaaataattgcaaacgtatctttgcgagaaatgcgtttaccataaattgttcaaaacaacaaaagatacgttttgcattttctcaaataacaatatattgttttgagtcgtcgagtgttttaattaatattcgtgataatatcctaacctttgcaacttctcaaacaacaatatattgttttgaagtcgacgagtgttttaattaatattcgtgatatctaatatagtatagtaagattatgcagattttgtgcaaaataaatatctctaaatattaattgataagtaaaactcaaaaataacattccttttgtcccaatatataaaatgttttaggctttttcttttgttacatgttgttctttcttttcaatttttatccataaatgcgacagagagaatatttcatttacaaataatttacagcttattaacatttactaaatctttacatatttttatgtgttattatattatttaaattacacaaatattaaatcaaaaatggaaaatagagactaagaaagaaatacgctaatcgattttaatgtcagatcattttctttaatttagtgacattgattttttttttttaaactttaaaactttttatcattattattatgatgtaagaaaaaagagtatgattgttgatttgttatttattatacataacacattatactgatttaaattaaaataaaaatgcaagcttcaatctttgggggtgtagctcatatggtagagcgctcgcttcgcatgcgagaggcacggggttcgattccccgcacctccattccatttaaataataaattttgtgacaatattttatatcagaaagttcaaccgtccgattgttttttttttctgttttcgggtgaaaaatcgaaaacagaaagttcagaaagttcaatattttatatcaaaaacatttactaaatctttacatatttttatgtgttattaaattaaccgaagcaatagatagaaccaaaaaaaatactatcattagagaccgttggtttcttcttccctctttcttagcctctcgtttctcatctccgagaaccaccaccgatgctcctccgtcttcttcgccggtgattttgtcttccgattgttatcaatg

SEQ ID NO: 34665 - DNA, 3000 bp, Unknown
  misc_feature (1)..( 3000): 2750-1469P.txt file - cDNA_ID_3081014; gDNA_ID_2910719; Annot_ID_193530
atatggtagagcgctcgcttcgcatgcgagaggcacggggttcgattccccgcacctccattccatttaaataataaattttgtgacaatattttatatcagaaagttcaaccgtccgattgttttttttttctgttttcgggtgaaaaatcgaaaacagaaagttcagaaagttcaatattttatatcaaaaacatttactaaatctttacatatttttatgtgttattaaattaaccgaagcaatagatagaaccaaaaaaaatactatcattagagaccgttggtttcttcttccctctttcttagcctctcgtttctcatctccgagaaccaccaccgatgctcctccgtcttcttcgccggtgattttgtcttccgattgttatcaatgagtcttcgtgtagtttcctccgttttctccggaatcaatcgaatccctaacctccacgagactcatactcttcttcgctctcatgtcttctctttcttcttcaaaccggcgaatatcggtagtatacggcgactggtcttatccccatcatatggagaccggagcagagatagtgttggctccgccgccgatgtttcgtcatctattctcgacgacgagcttctgagcagcgtatccgccgttagagatgccgatgaagcgctcgcgatgatttctgatcggttcgggtcaaatcgcggtggaatcgttgaacttgaagattgccgttcgattatctccgctgctgtcagtcgcggcaatgtggaccttgcgttgtcgatattctacaccatgcgagcgagtttcgatttaggtactctcatctcaactttactattaacccagagtaggagtttctgtgattgattaagcaaatttaggattgattgtttgttttcacaggtggaagtgacaatgatcgatggagttggtcaaggcctgatgttgaagtgtacacgatgttggttaatggtcttgctgcttccttaagggtttctgattctttaaggattatcagagatatttgccgtgttggtatctcccctgctgaggaggtaacactttgctatgataccttgaaattcgtttgaacttacttaagattcatgtaattagtttgtaagcatgattgctattgattttaggttccctttggtaaaattgtgagatgtccgagctgtttgattgccatagctgttgcacaaccacagcatggagttcaggtaatgatgatccaattcgatcttcaatgaatgctctacaaatcttatatggaataactggatgatttgctgtctatgttactagattgtatcttgcgctaattgccgttaccaatacgagcttttctctggtgacataactagcattgactcagaagagctcgggttagttctcttcagtatttctcttctttgtttcctagctctaggggaaaggtgatacagcttatgttgggtgtgagagcggtttttgtttgttaatttaaccttgaaaacaaattgagacttgtgtgtttgttgatactgggatattcactttctctaaggagctacatctgccgaacgcagcaaggacattcctctctgggaaaaagggctcagacttatccagataaagaagaacaaaatcacatcttcagtgcactctattgtggtaatcgccactgttaacacattctcatttcaaaataataacatttggtaaggcagatatagtaaccattgcattggatttcaggtacagactccttccggtacagcacgaacgcaccggtttgccactgagacagccgaactccctgcgcaagaaggagaaagagtgacaattgcatccgctgctccttctaatgtttacagacaagtgggacctttcaagtttatctccaaagctccaaacttttaccctggagaacctatgagcctcacaaaacacaaggatggacgagaatctatcttgctaaggcctcctagtaaagatggagataagatcttacaaccctcgtttctaataccccttcttgcaattttggctactggagatgctgcttctggtgttattgatcccagtttgcctcagttactctcagttgctactgttacatcactagcgataggagcaaccgtaaattcttttgtccttcctaagctaaatcaggtttatattctctatcacatgaactgcgtcaagtaaacatatgatagtctcttgggtatgaatctcataatcccttgcacggtttcagctccctgagcgaacagtagatgtggttggtatcaagcagcaacttttatctcaatatgatgtgctccagcgtcgcattagagatctaaaagaagcagttgagaaagaggtaccaagtctcatttatccataccttttgaaacccacaatatgtaatcaaaaacacttacaaaacttcgttgtatctatttaggtgtggatgttggctcgaatgtgccagctcgagaacaaaattttagcagtgggagagccagcttaccggtatgagcctctcagatcattggaacctcatcatctaagaaattgttaacagaactatgataacatgtgtatcttactcaaatatagtactcgaagaacaagagtaaagaaggtacgagaaagtctagagaactccataaagggaaagattgatctgatcgatagttatgctagagtaagaaaacgatacaaaaccaatttagatcttcaaaatgtcacttgatcttctgtttttttaacttttcagctcgatttctttaacgtttagatatcttcaatgattgagattgaggtggaaatggacagtgatgttcttgcagccgaggcagtgaacaatactgtaagttatttctaagagtttagttatgaacctgacatgttcgaatctgagagttgtgtgtaaaactccaaatgcttcacaggaaaacattgctcaacagatagagcagatcatggaacttgaaaaccttgaagaggtatagagttcgaaactcatttacatg

SEQ ID NO: 34666 - DNA, 3003 bp, Unknown
  misc_feature (1)..( 3003): 2750-1469P.txt file - cDNA_ID_3081082; gDNA_ID_2936552; Annot_ID_194093
acctaggacaagttatatagttataacaaatatttcaaacaggtatctctccagacatggagatttacaaaaactaaattgaagtacttagcactgatgatgatgattgatgactagtcactttccattgtaataatttgggtgaaacaaattgtcatagtttctactacacatactttgcttatattgttgttcaatgattatgatgaatattcttaattattgtttgagacttcattaatacataattttttttatcattttcagatttaggaaattgagatagcaaattcgaagagggttgttgctaaaatacgctggccttcaaatgacctgacctaaaagtttattttgttcctatagacgctaatggagttcgcgtctgagtagatatagtaaaggtaaatgatgcagcagtttggaggcattcttctaagtttaagtgtatggaagatgcgttcagtttcactatagcatggctaaaggccaaagtagtgctcgtctaagctgatgtaagatgcattttgtactttcttttgtgttgcatggttcaaacttttgttgagacttgatacttgaacgaatgaatcaatggttgttttaaaatacttattgtaatagtcagatgatatgtactgtattttatgtagatgtttctattaaattctttttatatattgaaatttttgcaaaagcatatctacgatcaatagaaacaaaaatcataaatatatagcataaaaataaattttacatagaacatggccaaatatcatagctacataatacaaaaattataatagaaatattgttatactggtagtatattattaatttattatcaattttttcatgagttttagattttttttaactagtccatttggattagatgaaagatgtaaaagaagtaatgtattaatatatatatatatatatatatatatatatatatgtttagctattgcagtttaaaataaatatcttattttaactctatcagactatgtctgatttcagaactcatacatcgactagcgaccagcgacatcatacattgttcgtttgtctgtcgctgtattcagcgacctattacagcgacaatcgctaaaaactgtcgatgtgttgttcgtttgactgtcgctataaatagtcgctatatttttaaaatatttaattatttttcgtgctaatgtatattttaaaatcaaaatgtaaattatatatatcatacaccatgcgaaaaaataaattaatatatttatttattttagtattatcaaatttaatttacgttatttgaatttatttttttttttaataagaattattttaacttaattagaactcaaaccccacgtgatatcgcaaagaaatatattataaatttgtttatataataatttctttacaacaaatctaactcaaaatgatgcatattataaatttttgtagttatttaagagtatatatataactaaccggaaaaaaataaccgtaaatattttgacagaaaattacaatataggaaagttgcaataaatgacacaagcgagaaaaacaaccgtcaatatttttttacggaaaattgcgattaaaagacacaacctttcaaagtacaaaaggcatttatttaagtttaatttaatttaattctgtttaatttaattatttttaatttatattttttgatcgataagttgttcgtttgcatgtcgctggattcagcgaccaaaagcagcgactaatcgctaaaaattttaacgacaaaaaattacggtcgctggtccctggcgactgtcgctacttttgatcgctgaaccagcgacaagcaaacgaacaacttttgatcgctgtcgctggtttcagtcgccagcgacaggcaaaagaacaggaccttaaacatcagtgaccttctttaagtatacggaaggtataaaatttaagtataaaattcgttacttacattaaaatggttcgttacttacattaaaatggtcaaaactcatcctctttacaatgtaagaactaacacatcgaatgaacaaacaataccgaaaaaagtttatgggcccatctaggatcattagttgggcctatattgtacctaaactttaactattcaaattagattaaacaaatcaaaaacaaattcagaaattaaataaaaattttgattattgttctaaggagaggaaaaaaaggctcattgtttcttcatacgtttcgttcccaaaaaattgacacagaagagagaaaaccaaattaacaaaaaacaatttctcgcctctactcgcaaaaaccctaatttcatcatcttcctatctgattccaattatttcttctacaagtttccttcttcttataatccatcgtttcttccttctatcgcgtttcacaaagcttgtcgtttttctctccttgtgggttggttaggccaatttgtttcgattgagcgattgaatctacgagacgcaacaatctctttctgggttagggtttcttcacataaccttttgtggtttcttgttttgggcggagtttggtggtttctggaaccctagatagagaggagccttagggtggttaatattggcactggtgatttagatatagagaaagagatttgagagatatatgtgtaggtgttagggttttcattacttgtgaattgtggctgtggcattgaatagaggtgtttggggttttgtccctttggtaaaggatgagtgttctctagtgtgaagctaaattggtcttctaagccatctgtgtgagggatggaagtgtagaaggtgctgaaacaactcatttggattagggattggaattggattcgtcttgtggcctttaccgtggtagggatttagatggtagagaaagctagggtagattaaattttttgtaagaggagctttctctgttgttgttggtggggggtgaagaaggttagagagagtgtgtgttctttcttgtatctgatgaggtacagctttcctaatg

SEQ ID NO: 34667 - DNA, 1153 bp, Unknown
  misc_feature (1)..( 1153): 2750-1469P.txt file - cDNA_ID_3081082; gDNA_ID_2910729; Annot_ID_193593
tcgctgtcgctggtttcagtcgccagcgacaggcaaaagaacaggaccttaaacatcagtgaccttctttaagtatacggaaggtataaaatttaagtataaaattcgttacttacattaaaatggttcgttacttacattaaaatggtcaaaactcatcctctttacaatgtaagaactaacacatcgaatgaacaaacaataccgaaaaaagtttatgggcccatctaggatcattagttgggcctatattgtacctaaactttaactattcaaattagattaaacaaatcaaaaacaaattcagaaattaaataaaaattttgattattgttctaaggagaggaaaaaaaggctcattgtttcttcatacgtttcgttcccaaaaaattgacacagaagagagaaaaccaaattaacaaaaaacaatttctcgcctctactcgcaaaaaccctaatttcatcatcttcctatctgattccaattatttcttctacaagtttccttcttcttataatccatcgtttcttccttctatcgcgtttcacaaagcttgtcgtttttctctccttgtgggttggttaggccaatttgtttcgattgagcgattgaatctacgagacgcaacaatctctttctgggttagggtttcttcacataaccttttgtggtttcttgttttgggcggagtttggtggtttctggaaccctagatagagaggagccttagggtggttaatattggcactggtgatttagatatagagaaagagatttgagagatatatgtgtaggtgttagggttttcattacttgtgaattgtggctgtggcattgaatagaggtgtttggggttttgtccctttggtaaaggatgagtgttctctagtgtgaagctaaattggtcttctaagccatctgtgtgagggatggaagtgtagaaggtgctgaaacaactcatttggattagggattggaattggattcgtcttgtggcctttaccgtggtagggatttagatggtagagaaagctagggtagattaaattttttgtaagaggagctttctctgttgttgttggtggggggtgaagaaggttagagagagtgtgtgttctttcttgtatctgatgaggtacagctttcctaatg

SEQ ID NO: 34668 - DNA, 2561 bp, Unknown
  misc_feature (1)..( 2561): 2750-1469P.txt file - cDNA_ID_3081107; gDNA_ID_2910737; Annot_ID_193643
acccaaatatcctcaccgtataccatcaacgtgcctagcaacttgtgttggcatatccggctcgtatctatcttctaaaccggacacaaattgatattcatatgaacaaaccggaccaagcgaattaaaccggttctaatctataagccctagattcccaaatcaaattttcacttttgctttcttcaacctgtcgacaacactcccgaatttttctctggtaatgtttttattagcttgatttttcgtcggaattgataattgtggaagtatgtactaataaagtttgatactttaacttgttctggggattgaatccgttatgatatgaatttctggaattttagtttttatatgtgaatctaaagcttattcgtttgttatgtgttgatgttcttatgcacctaaagcttgaattgaaatagtcttgtattgattccatttttgtaggcagtgtgtttaaaaaccaatggcgctagttgtgatttgtgggcaaccttgtagtggtaagtcaatagctgcagtaactttagctgaaacattgaaagagtctgaaacgaaacagagtgttaggatcatcgatgaggcttcgtttcatctagaccgcaaccaaaactatgctaacatgcctgctgagaagaatctgagaggaaagcttaggtcagatgttgatagatcagtttcgacaggcgagattgttattgtagattccttgaatagtatcaaaggttacagatatgagctatggtgtatcgctcgtgctgctgggattaggtattgtgttgtttattgtgatgtagatgaagctcattgtaggcaatggaataaggaacggagtgatagaggtgaagatggatatgacgatggtatattcgaagatctggttagaagatttgagaaacctgagagaagaaaccgatgggattcacctctctttgagctatacccttctcgtgaagttatagacaaatcctctcctgtgattttagaggctgtgacttatctaaccaagactgttgactccaaaacccaagatgtgagaattctccaaccaagtattgccactcaggctgctagattttcagaagcaaattctctttacgagttggacagagcgacacaagaaatcatcaacgcgattgtggaacaacaatcactgggcgcggctataagcagagttactcttggcaatgaactacctccgattgaaatctgcagaccgattgggctaccggagctaaggaggcttcgaagaacgtttgttaaattgatgggtcaatcgagtctaagcggtccaccgttaccaactgatgcagacagtgcaaagagacgttttgtggattacttgaacagagagtttggaggtaataacgcttgaaatttgttgggtgaaaaacatcttatttcttaaaggtttggttatgtattttcttaactcaagacttgttcttcttcatcgaaattcttttttggggctaaattgatgtgttataataggcccgttataataatgcaaacatattttggggctatagtatattttcttgttcttcttttttggttgtcgtattttcttgtttttctaacattgaaatttcaaaagacaacgacacgtttgacatttttggatgtatattaatttataataaatatgtcggcaaataaaaaattattcatttacaacaaatatgctttgatttgaaaataaccactacggtaattaaaagaaaacatacagcaacagttcttatctttgctaatcatattcttaattattttaaacagcttcattaatcgctaatgctttatttttgtcgacattcgttcatttaataattaatgaatgcagcttacttttattcatacaaataatataaaatcataaaacgacgaagtaagagacacagagcagaaaaagcttacactcatatcactgagctgctttggcttcgccaatcgccattgttgtttcgaaatataattactgcttctcaaaacccttttgttggtttttgttttcgttgtcgatcattgcttcaatctctttcctttcgatctgaatcatctgatctctgatcttcttcgagatctcactaataggattttgagattgagttttgtccacagaatcacgaggttcgttcttggctcgattctcttacgataactatacgttgacgtagagaaaagtaattttcctttttgcatttcattgttcaaaatactgaaaagtgtaaaaagttttgatttttgatctgagaaatttggttgcaggttttgttgatttggtgtaccgtaattggcaattacgagttagttatggatttggcgttcagtgactaatggtctttcctgatttggaatattcttgaagttttgggtaatgattcaatgtgaaacaaatgttgcctatacatgagaataaatggcttgattaggtaaatgttagttggagttttaggtaaatgagaagccttttagggacagaaagaggagttggttgttgtatagtgtagagatttgcttacaataaaagctcttgttttgaacctgggaccatg

SEQ ID NO: 34669 - DNA, 3003 bp, Unknown
  misc_feature (1)..( 3003): 2750-1469P.txt file - cDNA_ID_3081113; gDNA_ID_2910737; Annot_ID_193641
agtgtactgcagacagagaagctttagtcggcttaatccccttttccaacatctctttcacaagtttgactgccttaagtacaaatccattcctacaacaaccagctattaacgctgtgtaaggcacaacatcaggctttaccccactttcaatcattcgatcaaagatcatttttgcctctttaagatatcccatcttacagcaacaagctattagtgctgtgtaaggcgcagcatcaggatccaccccactctcgatcatttgatcaaaaattcttttcgcctctccaagatccccaatcttgcactgccaatcaatcaaaaccgtgtagtagaaaacgtctggtttaacatcaaaggctttcatttcccttgaaagattccgttctggtttgtttttgagtaaaactgtgtatgttaccacatcaggtacgatttctctcctcttcatgtctttaaaaagagcatagactttcttcaggtcgtttaaatggcaatatctgttaatcatgattgtgtagtagacgacgtctggaataacatcaaaggcttccatttccctcttcatatccaactctggatcgctattgagtaaaactgagtatgttaccacatcaggtttgacatctctcctcttcatgtcttcaaaaagagcataggcttgcttcggctcgtttaaccggcaataggtgttaatcatgattgtataagtgaacaaatcagggacaatctttttagtaactaaaatttcaaaaaactcccgggcttttctcacattattaactcgacaccaagcaccaattaactttccatacatgctcttctcaggttcgactccaagtttccacattctatccagtaagtcttgagctttgctgatataatctttctcggcgcaaagactagtgaatagagtaaaatacacactcttgggcagaggaaattccagtctaatgaatcgttcaaaggcatgatcaagacagccagcggcacaaaaacccttcaccatacttgcatcgttttcccgagatttatgttccaaactctcatagaaagcttcagccttgtctagttcacctgcatcaatcaggccttcaatgaccatgttgtgtgtaacataagtgggttttacaccccgattttccatcattttcagagtttcgaatgcctcttgtgcaagaccattcgtagccaatccaccagcaagtacgttatatataacaatatcaggtgttttacctgttccgtccatttcaatcatcaaatcaaaggcatcagaacatttaccttgtagacagcaaccccctatcaaagtcgtgtagttgatgacatcaggagctattcctttacccgtcatttctctgaacaactcaatagcttcttctactttgccaagctttcccaaagcatcaaatgcaacattgtagcaaactctatcaagagaaatgttcgtctctctaaactctttaaatagatcataagcttccgagaaatttcccatctgacaatagcattgaaggattgagcttacaatcacacagtttattctttttcttttcttcaacattttgttaaaaacatccacagctttaggtatattcatattcttgcgatgtccctcaattatcgccgagtaaacatagacatccggatcaatcccatgtttctccatgtcaagaacaacactttcagcgtcttctattctcatctcataacataaaccacgcaccactttgcgatatgcaattccaagatcactcttatccaccagaatatttgcatccctcaatggttggagtagaaaataagctatatctgtcatctgattcaaacacagtccttcaataaaattcaaataaaatacgcaagggttcctagtctctgagattaacagtctactaagaagcttctctaattcttccttatcatcattcctccacaatgcttgaaccacaagaacataagtatgtgcatctgcatccaacccgagacgctctatttcccagaaaaaaccaaccaccatatcacttctcccagatgcaatcatacggctgatcaaaaaattcaatgcctttatatccggagcacgtcctagagaatagtaagctcggaagaaaatatcaatagcttcgtcaaacatatcaagattagcataggctttaaccaatgcagtggagactcgaatcaacaacaccaatgactgttccatttctccaatggcctttaacaaatccattacactgaaaccgcgtccctcatctcctcttctaacgagttcaaatagaaaagtatccaatttcttatccaaaccccaaccacaaacgattctgataacagttgcataagcttggacactaggcaaagtcacatttccttcaattcgtttgagaaacgataaagcaagataaggatcatctttcatactattcaacacacgaagaaccccaatgtcatttaactccaatgctttataatcaaaagtaccttcttttacttgctcagagtgtgagattgtaaggtttgtccgggcaagtgcaggaaccacgtagaatcgcgaagagggtccttgtcgaatcaatcctctcacatgtgagagtaatggaatcggaaaaacccgcatgaaatattttccgatcttgtggcagccggaaaaaaaaaaactagcagagactaattgagaagagattttccgaccaagagagaactgaagattcagggttttactttacagagaaggacatagaaatcgacccgaaccaattccaaattagaactcgaaccgaaaataacattgtaattaaattataccgaatctaaccgaaatattcgaaccggataacggaagtaaaatgattttaatggtacggccgtaaaatgtttgggccaatacggcccattcgttatgactttttttattattattacagaatcgtttccattaaacccttaaaagtttcagaatcgaactcgtctattctccgccggtgtgccgtcgccgatatg

SEQ ID NO: 34670 - DNA, 42 bp, Unknown
  misc_feature (1)..( 42): 2750-1469P.txt file - cDNA_ID_3081121; gDNA_ID_2910737; Annot_ID_193639
gaattcgattaatttattgtttgttaatgctattaggtcatg

SEQ ID NO: 34671 - DNA, 3003 bp, Unknown
  misc_feature (1)..( 3003): 2750-1469P.txt file - cDNA_ID_3081128; gDNA_ID_2910738; Annot_ID_193652
atgtgattcttatctgccttttatatatagagagagaaaaagtgggcctgtggtattgtggatcgatgttgtgtgttttagaatccagtgggactcttaaatctttgggtagcaggcagcaagtggtttttgtctgacttttgtgtcgcatttatatctcgcccccaaaaccagctgttccacctggcttaggattcttcttctctgcttaattttggtattaacaaacataaaccataaaatttaatattcaaaatattaattttacttgaaatacgatctacaaagacattaaattttatggagattcatgtattaatttttcgtatgcttattattagaaagcaaaaaccatagtagtaacatattctttcatgcaataaagggtggccaacatagtggttctttgttgaaaatgagataaaataaaaacatcaagaaataccatgggaattaattttaattaggtagtagttgaaatcaaaaccatcaaatcacattaaattgaattacattattgaatataaaccccttttatggctccatgtgtgggcaatgccataaacatacatgttgactttttgtttataaacatacatatttcgggtcaaccaaattaattgtttaagcataaggcctttgattttcacagtccaaattcggcccagttgctactttaaacagcccagtatatctctgaaaaaacccgattcggtcattgacccgtccgtctccaggaatcccacactctaaaccgccatttattatatttgtggttaaaccaaacccgccggtccggttagctgccaaatccgccgcctaggtcggtattttccgatcatgacgtcatggcacgaaggtttgggactctgtggcgtcatccaaaaccaaagtgctgtttgaaaagctatcactgaattatttgacaccgtttctggattccttagaccgtcgaatcctaaggctcgaccggccggtccgtaattgtagttccttatatcccaaaaagtaaaatgacaattagaaaataatataattacgatgtggaatcttgcatggtatagttttatacaaatcgaaaactataaatgatagaattcaaaatatatatttgaatgaagatacggaccactattagtgaaaatgaacctaccacgatagttgaattggacctcttccttgataagtcttgttagggaaacaaggccactgtgtatcagaagaatcacaataagtgctttgtggactcacttcttctttaaagcataatccccaagcgtacggtccgtctggtgccgttgcccatcctccggtcgtctcgtgtgaaatctgagccaaaaatgcagccacttcgagtcgttgtgtcacggggcttcctacgctcccgaactcggaaaccgcctcgtcgcttggacaaatgattcgtaagtgtagaaaccatttgcgggacaagcggtattgtccttgtggatgaaaattttgttgtagaggtctcttggcactaatctctcgattgaggtggcttcggtttgggcggaagatagtaaataagagattgagaggaagaagcataagaggagaaaagagtgttgttgagccatttttagagagggatcgatcttgatggttttggtgtaagaagatgagtttgttatatagatgtgtaaatgatcaacgcgttgacttttgactttaacggtggacttttttttcattggtctgaaggttcgtttatacatgctctcatgtgttttcattcatcaaacgatgcttctttcacgttaagtgaaactttttctatagtttttggtataatttttcatatagtttacaccttaattagattagatatcaagacaacaacaaaaagcgaatacgtgaaggggaaaaaaacaacaaaagcaattattttttattgtagagaaaaaaacaaataacggcttttcactaaaatgacattttttttagctgacattacttaatatgaaaccgagatcatacaaaataaaaacaacttatcaatataatcattgaatgatatagatagtgtgtattacgattaaaatgatagtggatgacgatattcttattcggtcgacgtagcagtattaccgaaaaagactgatttcaatttttaatgcttgaagactcattcttgctatggaaaatctcattattttatcttgatggaagactcattcgtattttttattaatgtggtggaatctacacaaaaaattctcgttcggcggctaactaattggtaaagttgtatatacattttattatatgttcctatttcagagccgaaacaaattacaacactttaagttgtgcaaaagttgacaaaaatgttttttgacaataaactcgtttctttttctgatttctcatccaaaaataaaaactaaatttcggttccttactatcatatcaactaagtcttccgtttttatgtgttttaggtccattccaaatacatgattaaacttttttaaaaaatcacaatctctatgaaactttttaaattcttctttttaataagttgtatcaacaatgtacagaaaaaatcagaaaattagtataaaatttaaccttttaccaaaaaaaaaaaaatcacaatctctatgaaacaaatctcatctttcgaagaagataatgttacaaaagacattcaaacagaaatatttgtaatccttctaaaaaactgacattcattgtaatttcttattactgtggatttattcatattctgtcgattagtgactagtgtttacataattatgaaatacgtgactaaaaataatatagttaagagagactacacaaaagtacactaaagtaaaaaaacgacaccaagtcttatgtactgtaaactgcacgccgttttcagctatcttaaacgacataaagttttgccttaaaccctaccatcgtcactcactctgtcctcgataggtttagagaagaaatagattttgatcgatccttacaacaaaaatg

SEQ ID NO: 34672 - DNA, 396 bp, Unknown
  misc_feature (1)..( 396): 2750-1469P.txt file - cDNA_ID_3081128; gDNA_ID_1591956; Annot_ID_151751
aaaaaaaaatcacaatctctatgaaacaaatctcatctttcgaagaagataatgttacaaaagacattcaaacagaaatatttgtaatccttctaaaaaactgacattcattgtaatttcttattactgtggatttattcatattctgtcgattagtgactagtgtttacataattatgaaatacgtgactaaaaataatatagttaagagagactacacaaaagtacactaaagtaaaaaaacgacaccaagtcttatgtactgtaaactgcacgccgttttcagctatcttaaacgacataaagttttgccttaaaccctaccatcgtcactcactctgtcctcgataggtttagagaagaaatagattttgatcgatccttacaacaaaaatg

SEQ ID NO: 34673 - DNA, 3000 bp, Unknown
  misc_feature (1)..( 3000): 2750-1469P.txt file - cDNA_ID_3081132; gDNA_ID_2910738; Annot_ID_193651
tcatagccaaatccgctttatcgttctccaacagatggatcatcagaagctgtctcgctttggagaaaggacctttagactttttcatggcaccatcaagaatcttctctgcttcttcatacatattccctttcaaatacgtgttaatcgcgatattagccagcctcatatcgtaagcccagcatttcgattcccactctgtgaaaatcttcttaatcccatctaagtcgcctagtttactcatcgcttgtaacatgactagatagctcaagttgttgacctcaggacgagccttcttcagcgattcccaaaccctataaacctcaggacctttcgagattccagcgtacaaactcatgagaaaatggtgggaatcacggttgttaggattcattttctcctccatagatttcagtgcagaatccgccttctcgtaaagaccagctttagtgtagattgcagccagattagagaaagtattccaagtggttttagcttcactgtctttccccatctcatctataatcttctctaatccatctaagtcattcaaacttccacagctctgcatccatatagagtaagtgacaccacaaggagatatacccctctgtttcatcgcatcaaccaacacaggtaccttctccggttgactcaaccgcatgtacatagacatcatgttattaaacggtaacgaattgttaacaaagttaagctcatccattatctcaaaatgagcctttgctttctcttcctcaagttcaacacagtaacagttcatgagcgccccataagtcgactgatgattctttgcagaaggatctaagttgttaaagtagttctcagctgcttctaaacctttagtctttccaattagatccaaacaaattgcatgatcagacacagaaaatgtcattttcctcttctccatccaatcaaagatctgaaatttcatcaacaatggactcaatcaaactctaacaaacttaaaaatgccatttttaatctctatccattcgaaaaaagtgaaatttcattcaacaacgagcatgaccctaattacaccctaaaactagtgaaatcactaaaccctaaatctaaagccagcccctttaagagtaattttccatagataatgaaatatctccaatttcaatgttaaaatcagatacttgcttaagagatatgaagagggacctcaaaagcgtgttgaggtcgacggaatttgcgaagggttttagcacagcgaaagagatcgtcttttctgacagtaataccctccatgatgaactgatttaacgtctctgccactgttcctcccgtcacactaagcatagaaagtttcttgtacaactctcgctgccttgaagccaccgtcggagcagcaacagaggttctgacgccattctccgccgccggagaagaaacagaggcttcgacgacattcgccgccgctggagaagaaacagaggcttcgacgatgccagtcgccgacgccggagcaaataccgttgcacagaacctcttgccgaggcgagaaccggaagcaatcagattacggaaattcatttttgttgtaaggatcgatcaaaatctatttcttctctaaacctatcgaggacagagtgagtgacgatggtagggtttaaggcaaaactttatgtcgtttaagatagctgaaaacggcgtgcagtttacagtacataagacttggtgtcgtttttttactttagtgtacttttgtgtagtctctcttaactatattatttttagtcacgtatttcataattatgtaaacactagtcactaatcgacagaatatgaataaatccacagtaataagaaattacaatgaatgtcagttttttagaaggattacaaatatttctgtttgaatgtcttttgtaacattatcttcttcgaaagatgagatttgtttcatagagattgtgatttttttttttttggtaaaaggttaaattttatactaattttctgattttttctgtacattgttgatacaacttattaaaaagaagaatttaaaaagtttcatagagattgtgattttttaaaaaagtttaatcatgtatttggaatggacctaaaacacataaaaacggaagacttagttgatatgatagtaaggaaccgaaatttagtttttatttttggatgagaaatcagaaaaagaaacgagtttattgtcaaaaaacatttttgtcaacttttgcacaacttaaagtgttgtaatttgtttcggctctgaaataggaacatataataaaatgtatatacaactttaccaattagttagccgccgaacgagaattttttgtgtagattccaccacattaataaaaaatacgaatgagtcttccatcaagataaaataatgagattttccatagcaagaatgagtcttcaagcattaaaaattgaaatcagtctttttcggtaatactgctacgtcgaccgaataagaatatcgtcatccactatcattttaatcgtaatacacactatctatatcattcaatgattatattgataagttgtttttattttgtatgatctcggtttcatattaagtaatgtcagctaaaaaaaatgtcattttagtgaaaagccgttatttgtttttttctctacaataaaaaataattgcttttgttgtttttttccccttcacgtattcgctttttgttgttgtcttgatatctaatctaattaaggtgtaaactatatgaaaaattataccaaaaactatagaaaaagtttcacttaacgtgaaagaagcatcgtttgatgaatgaaaacacatgagagcatgtataaacgaaccttcagaccaatgaaaaaaaagtccaccgttaaagtcaaaagtcaacgcgttgatcatttacacatctatataacaaactcatcttcttacaccaaaaccatcaagatcgatccctctctaaaaatggctcaacaacactcttttctcctcttatg

SEQ ID NO: 34674 - DNA, 3003 bp, Unknown
  misc_feature (1)..( 3003): 2750-1469P.txt file - cDNA_ID_3081137; gDNA_ID_2910739; Annot_ID_193661
ggctccatagtagttataattatttgaaaaattcagattaaacacacacatacgttacaaactaacataataattgaacagacttggtcaattagtggatactgtgcatgaacacagacaatactttgagacgtcgtcaaagaatcaaaattggagacgtcaacgagtaaagatttgacttgttattcctcttcgtcatttttaaaatgacaagttgtaaataaaaagcaggaatcatggggtcctcactttccgaacattcctctgtctcatgtcttttctttttctgttattggtatttatcgtaataataataataatttgaaaatctttcagaaaaaataagaacaacaacccgtctctctgtcaattgttgttgagtgtgttaataaattccacgtgttgtttctcttttattagctcggcgacgaatgattacatacgcacggttagagatttggcatgtgagatcattgatctgacgatcgagaatttatggggacagaagtctagcgaagtgagtgagctgatcagagacgttcgtagcgattcgatcctacggttgaatcactatccaccagcaccgtacgcgttaagtggcgttggtcaaataggtttcggagaacattctgaccctcagatcttgacggtgttaagatccaacgacgtagatggacttgagatttgctcacgtgacggcttgtggatcccaatcccatctgaccctacatgcttcttcgtattggtcggtgactgccttcaggtactaaccacattttgtttcgtaaagacttacaaaatagttttcatcaattaattaattaatgaaataatctttgaaaataggcattgacgaatgggagattcactagcgtgaggcatagggttttagcaaacacagcaaagaagccacgtatgtcggcgatgtactttgcagctccaccgttagaggcgaaaatatcaccgttgccaaaaatggtgtcgccggaaaatccaagacgttataattcattcacatggggtgactacaaaaaagctacatactctctccgtttagatgtccctcgtctcgagtttttcaagactttatagattatattcataccattgaaagctagattttttattttttttttgcttgttgaaaaagaaaatatgattgttggattgttacaaatatataccatgtgaaatgtatagatttagatgaacaaaaagaaaaagaaaattgagttttggtcatttactttgtaatttactaatttcacatgtgaatcagtggatcattgcaatttctaaagaaaagctctaaaacattccagtaagagaaattataccttttttttcttcaactacaagtctacaagtcatgcatcatcagtacatcacaatcataaaaaacgacttatgataaaaataaaaataaacttgagcttctgatcggtagaaactatgatccatgaaacgcgtccgatcacaatggactctttggtccactgcagttgtactctcgatcataattacacgaattaaaacctctttatacaaaatcggctattacttatctaggtatgcttgatttcatttgaaggttttataaaaggttgcaggggacaagtccaaataatatgaaccacatctgaccctaactataaaaattaatccacaatcgattataattattaaaaaaaactgtatctaaagcatacgccaatccgttaaaagtaaacaaaatctttatgcaaaccttatagaagttcgaaaacaacaacataaataatttctgatcataatcaaagaatcagaaaaaccataactccaaacacgaacagcttcatcaccgaaaagctttctactgccacagccgctccatagtaattttcaatagggtacaagtctcccggcggatatgtgaatacgtaattaggtggaggtggaggtggcggtggcggcagaggcgatggtggacaggaagatttcttcgggggtggtggtgacggaggaggaggggagggtgtacaagaaggaggtggcggagacggaggcggaggcggttgattttggagacaaggtatgcagttaacgtcaacttcggctgaagaatcttcggcgttgattatgatcggagatgcgaggatcacgatagccatgaggattgtggccgcaagatccgtcgatcggcgagttttaggcgacatgttgtaacaatgttttgggcttagacttgtgtatataaaaagatgatcaaacttatggaatgtatattagtgaagttatttgtggaagattattacagagagatccatcacaataaatgaaataatttcgtaataacatcggagatatggaaatcttaaatgacagcagatttgtccaaaattagatacatgtaataaacacgttaaatttaagtatgaaatgacaatattccttgtatactctaattttcatttgggctttattgggccaaataatatgggcttacaattaaaaattcgactgaacggatgtgaataatttttttttgaaagaaccgactatctttattcttaccagaccacaaagacaagtcgttgtttgacttgttgactttttttttaatccacaagtttttttttttttgttgcgtcagattttttgtttgttttccagtgacgtctttgatctccctcccgccgacgacacaagcacgccgtctggtttacctgtaagtcttctattctcttcttttcctttcgcgtgcttcctctttgataggttacattctttaatcgatcatggcatcgttcttggcctctgattcgattacgctcgggtgattttttttttttcccccgattattgatctcgccggaggttgcggaagggagaaattgggtttcaaattttcgaaattttcaagtaatgtaatctgggttcgtgtttattgtgcagataagtgtttttgtgtggtgtctgtgtctcactgtgtcgatagattaaaataatttctcttcggccatg

SEQ ID NO: 34675 - DNA, 3003 bp, Unknown
  misc_feature (1)..( 3003): 2750-1469P.txt file - cDNA_ID_3081142; gDNA_ID_2910739; Annot_ID_193659
cctaattattaaccttaaaagacttctcggcttttgtgagacatgacaatatcaatgtacaggtaacattgagccgaaacttgctattgttcttgtctcacttcttaatataactttagcccaaaatatttgtttatgcttgatgataattcttttttttttaagtaggcaaagaaaacgttaacgactaattacttttacaacccatgaaaaagggattttttttttttaaaagctaaaaagagagggataacttttatatttttaatttatacacaagtaaaatgcatttctaatttttttttgttccataagttaatttgccattccatgacttttcccttttagttaactaatttactaacaaaaagaaggaaaaagagactttcgaacagtattattctttagttcaaattcatatataatgatcttattttattctcccccccccccccccccaaaattataacacaaggccgaacacaaagggtggacttgccaacatgcctttttgtatcaaagtttaattaaaaaaacacatataaaaaaaatagggaggaaaaagcgtttcaacgaccaaagaaattccaacggccgttttgctcatcccattcctatgcatgtgccttcccatttgctttgcttttttgtagtttgtgtcgccggttctttgcatgccacagaacttaatagttttatcataaactaaaaatttttgttgaatactctgcacgtaattatatttcatgttccgacattagcccaaattacggtaaaacatacatgcaggttcatcttaagataatgtattgactatgttaatattagaatatacagaatataatatgcgtttaaactcatagatccaaacctccatactagtaatattaatgaaattggtattttatcaatgctgaaattagtatctatgctacgttacattgtctaacaacgctgatacttcaaaattgaataccaagtaaactaaaataaaaacataaataaatgaaaaaaaaaaacagaaacctcagattggatgtcttggagtttggtgaccgactgtctactttagactcataattgatctaaaattgtgtatataagttcaagaagagacgtataaaatcataaattaatatcgaattgtttagcaaatatggtcaccaaaatttaaaatgataagagttaggttttgatataaccgatatgtatgtttcattcatggggataatgtcggctaatatgccagatgacatgttcattgatccatcctgtctccggtcaatttttctcccatacttatttttatattttctatctttaatatttagaggaattcaaatgaattgaaggtatatccattcatcaatttgttgttcaaatgttgtaacaaagaaacaaatgtgttgttcaaaatgtggattatcaattttgagtccactcaaattcaattaactgttatttttcaacaaaacacatttctgtattgatcaatcgaatatgttattgtccaaagtgcttataactagtataaaatataatataatgaatcttgcaaacatgaaaatatgcatcacttcaaaattcaacaattttgaactgaaaatcgactatacttttgaatgttaatttcgtaaaaaagtgggtaggtactaggtattggtagagaaagagttgagagaataataattgaaagaatatgggctatgaaaagagtctttttagttaaatcggacggctaatgggagccgtcaaggttgaccatttccactacgtgccgacatatcagccttacacatgccccatcctcctcacctttcccacttccttgtgactcttttccacgcgcctcttctagcatttgcttcttctttttatttgcctcttcatcagaaaaaatattataaatctaaacagttaaaatatctatctacgaaagacaaatcttgaaatgttttagtactgcattttgttggtcacaattaacaataataattgtgatgcatgttttgttagccagacacctaattagttctctctaacttcaaacagagaaagaagtattgtatttgtcaacgctgatacaaaactgacactttcaagtttaagtttgtcatatttcttttaccaaacttgaaactactgcatttttttttataacttgttcatttgaacaaataatatttttatttttttttgccaaacttgtcaatataatatctaagatcggactcctcctattgtcaatcttaatatatcacaacaataattgatctaacttatattgtatacttaattcattgaaataagaaatcaatattaaatatacgcgagtcttatgactaaccaaacacggtgatttaggcaataagtgctcaatctttcaattattttaagaattgaacatcaacatcatctactactttcctatcaccaaatttcaaactacccgattttaatagtaataactaggttaggcaagaatgttgacaataaaaaaaatgtataacacaatttttaagttttttttttttttaatcgtatcataaaaattcctagtttgaaaatgactagactgatataaacgtaattttaattttaaaataatttgcttgtacaacttaagatccaatttaatggagatagacatgcatgtcaaatttcattattagtagacaagagctttattcatcttggcaataattttggttttaaagaactcgaccgtccccattgatgacatgcccaccttacgcgatttgtaggatgagaagattactttaaattcccccatttgtcaaccgtatggaaaccgtagaatttaaaactaaatttcgaaaaaagtctttgaatttaaaatatttattttatccttccttctcttcccaattcccatacactatatatataagagctcgtcactcttctttcagattcaaaacctcctgatttcattctttactactaataatcattttttgaaaaaaataaaaaagggacatg

SEQ ID NO: 34676 - DNA, 2720 bp, Unknown
  misc_feature (1)..( 2720): 2750-1469P.txt file - cDNA_ID_3081144; gDNA_ID_2910739; Annot_ID_193658
aaaaggttgaaagcagccaagacgtcaccatcatctccatgcattaccattttctccatgataataacggctatattcttcgcctttctagtcttccaaggtacctttttacttattcccttttcaactcttaatgaaaaccaaaaaatgctactttggtcttcatatgaatttgtctctgaagaaagattctatatagttttagattcattgcttttaagatactctgatataacttgaaaactatattattagtctttgtatctcatcaggataaaaagagtttgttgtgttaagaacaaatctttttccgttttgcaggattctccacaggcagttcgagtatgaattcggacaaatcacctgcaccaacagtttcacctaacaaccaaatgatttcagttcagttctacaatgattttgctcccgttgagcaaaccgatcccagcccgaccacctcattaaggtaagaagaggaacaatttatatataactcattctcattgttaaatcaaagaagacactttctaaaaacaagtgctgatatgaacaatttcgttctttgatcgaatctctgtaaattcagatacacgaggaagcgaatttcgggtgcagaagaagaagactcgagagacgttactagatgagttctctgttttggtcttcttgacccaaactgttaactcatttggtcaaagttttgttcatagactaaaatttgtaaaaacgactgcgttttaaacaatgatgatgatatattgatatgtcactaaccgggccagtttttcaattattttgaaaataaaaagattgtgagcatcgtagtaattacggtatttaatgaagggaaaaatgatgtaaaacttgttgttgaccttacaaatataaaaaaacaattgtttttttcaatgcgaatctgaaaatgacttccataccaattggattctgcaacgtttatggtatataacaatatcaaacatttcaaaccctacacaaataaattctacatgtaaaagccacaattgttctactaaatatagaaaatttctttttgataagaaaatgaattgtatggctggtctatctgctaagtgttaccctgcgtgagatagtaatccgctaaatcatttttgtcgtatatgataagtatggaagtgtaatcaacacagtttataatgtcaagattagcaacttttgtttagtatatatctcttcaattgagtttttttcccagctaaactcaaaattgtattatctagcagggtggaaattttgtttctttaatcggttgacttactgataattccatcagcaacgatatgctttcgatcgtttgtagttgatattcttagattagatgttacggtggcaagagtcttgattgtgaggcttttattggatatacgaaatatcaattgagaatttgcatatttgactagagtttctaaataaaaggaaagcaaccaaaatggagaactttcgtcttcaagtttgaaatgattaatgaatttaattttgtcattaagatcgaaactttagtgtgaacatgtatacatacacacctaatcctttatttggtagtgattattttggagagtgcatatataaattaggtatacgtcgcacatcattgaatgttcgaaattttccaagacataacactaattcatttgaataatacattctctacgatttttagacatttcttgtacaatacggcccaaatttctcactttgtttcaaactgatatatgttttatcttttccctactttttcatatataaaattaaaatgtcctcaaacacctatttttattttcttactaatgtatgttcatttttgccttggctataattgtcttaattggtacgtcttaaacttcttcgtttcttaccttagtacgtcctctagcaactgaatggacttcatttattagaatctaatttaatgaaagtatttacaattttgaaataacaacactttgtgtatttcgaaagctagaatacaataacatgtaattttttgtcatcttataagaaaaataaccaatcgaagagaagaattcgcaatattaaacggatctcaggcagtatgatctcttagtcaactttatcttatattttattttttcaaatcgatgaatgacgttaatcaagtggctcgatctctcagcagccgagtaattggaaattgaacgtgctaaaactataagtctactactataaaaagacttgtatttgtatgattgtatattcataatatctggtagttaatttatcccttgtaaaaaacagatttaagttaacttaacaaactcttatttagattatttggtttcgatatctaattcacactaaaccgtaccaaaaaagaagaagccgactttaaattgaattattccttaagtcttctcacattttatctttgctagagacgcaatatttggaatagatcaagccgaactaaatatcgacgcgtacgtgtacttttcagatttaaacattcagatcattaattacaatcatgcaagctgtacgggaagaagtggaaccatcatcaatggcattcctcgtaaatatcaaacacgttcgaagggtatttacgtcatggtctcattatataactgtcagagccccttccgtttctctcgacatgcagagtctagattccagcgacaccatataatatagttattagaaaacgagaggtcaaaaccatg

SEQ ID NO: 34677 - DNA, 3003 bp, Unknown
  misc_feature (1)..( 3003): 2750-1469P.txt file - cDNA_ID_3081180; gDNA_ID_2910741; Annot_ID_193688
cacactcacatgaagaaatagctaactaaagaaaccacaaacaaacacaaaaatcctcttatagatcaaataacctatcgaatcatatacagaaggaaagagtattaattcagatggaaacactcccaagccccaactgatattccttgtaaacaaagaaaccatcaaaaaaccctagaccctcttaattaatcattctttcgagagaaaggcttgaagctccttctctatgtgttcttgagcagtttttttggccgcaagaaacggacgatagtgatcagtgagcatccataccatacatttggtcatcatcgcaaagactccaacgttggtagcttcatcagtgcaatcttcccagtcagtaaatggttccttgcaaccacctcctctcatgaacgctgaaaacacctctcctttctcttcttcttcccttacttcatttggggataccgattcccctggatctcgctaatcagttgacggcaagaatccttcatcatcagttttctcgcatcgagaaagggaagatagtaatcagaagtctctccatacacttctccaacatcgtataacacaaagatataggtccttatcttcttctcagctcctccacacaacctttaaaggccgtataatgtttccttggatgcaccttctttcataaacacttgtaatcgattttgccaaagacttcacgaatctcctactttctctggctagacttgttttttttttgagatttggtatcggaattctccggtttcagatccgtggatgacaattaatcagtgattatcatttcattaggtcagagaattacaatatatgtagggatatgataatttacaattaagtatttgataattgcaattttttaaaatattcgataattacagtttctttacgcatgtagggatgtagtcatgtagggatgcatcatgtctatataacataagacatattgggatgcatcagaatcatataacataaatagtttggaaccaaataaacgttgaacgaggcttttctcacaccatatatcttttcaaaacatactaacaagtcaaaaattgatatccatgtaacttgaaaatcatgcacagacaatgctacctttgaatggtcattaaaaaaagaagctaaacacacttcagatccaaccatatatgtgatcaaagccagtgataaaagtcgagtcattcttggcagctaacgactaaggtaagcaaagaatcatatggtcatgtatggaggctgataacagagatgaagttctgtaatgtttcacatctccctacaaattagaaacacgacatacatacataccaggcaaaactgggatctgtaaaaaaaactatcttcgaggagatatcaaccaaacagaacgtcatcgatcatgaatgaaagtgttaaaaacaaatgctagtgtatcttaagcacaaagtgagtcaacatagaagtaaacttgatctttagacaaactagaaaatgctggaaccagaagctatcactacaaaaggtctgaccttttctgtttcagaagcaacaaatcacattccaatgagaaatagcttagcaaaccacaaagaagacaagatttcttcactgaaccattaatgggtctcaacaaaagtcatgacctttaaagagcaaattctctctcgaatcatataaaaaggagtatgaattcagatgacctcaatcaatcaacttattaattagagaagaaacatgatcatcaatgggatcttataagttatgattctaacaacgaactttcctctgttcctagagaacaatttttatccccaaattccaatcttttgatattcccataaacaagaaaccataacaaaattacccttgagcttgcttcttcgcagctacctcctcttccgagatcttctcttcttcttccttcttcttctcagcttcaagctccttcttaacctctgcttcagcagctttctccgcagcgagaatgggctgatagtaatcggaatgttcatccatacacttcttcaacatcgaagtgacttccatacaattagtaacaatatcttccttgttcttctcagctgcttcaacacactcttcccaagcaacaaacgaatctttgcaaccacctcctttcataaacaagcaaaacccacactctccttcctcttcaccatctgcgtctcctcctcctccttcttctggtttttcatccgattcggaatcttctgggtctctccaaacagttgatgaatctccgagttcctcagatggagctggagtcgacggagacgcatctccgagtttctcagatttagctggaggagcttcttcgttgttttgagatttggggtcggaaaaagtctctgtttttggatctgtggatgatgtaattcccatttttctctcaggagagagtgagatcggatcttatggaaattggaggattcaggaggagaaaaagatgtctctttttaagggttttaaggttctctctcggtgccgccgccgattctctttacaagccagagagaaatgatcaatcgaaacgtctttatgttaaaacccctcaaaaacctttctattgaaccggatattctaaaccggaccaaaccgaacttaaacctttgttaaaccgtaagaatttaaccaaagtgaatatgataaaacaacaacaaaagaatgatctgtccacaagacgattcaagaataatgtattgttaagatttcaacatcaatgtttgttgctaattaaacacaagtctcctatttgctacaaatcgaatatagacaccaacatcattcgttttatagtaataaaaggaagataaatatagggagtaatcattagattaatattacagtcgctttcagatttcgtcaaatttcacaggcagacaagtttctttgacttggtcactataagagttgtaaactctttgataaataattgaatacagcaattatttcaaatctccggtgaagtttttctgggctctaagtatg

SEQ ID NO: 34678 - DNA, 3003 bp, Unknown; identical to SEQ ID NO: 20859
  misc_feature (1)..( 3003): 2750-1469P.txt file - cDNA_ID_3081188; gDNA_ID_2910741; Annot_ID_193686

SEQ ID NO: 34679 - DNA, 3003 bp, Unknown
  misc_feature (1)..( 3003): 2750-1469P.txt file - cDNA_ID_3081192; gDNA_ID_2910741; Annot_ID_193684
atgctgggacgcagacatgaaccagagaccgtcgtttctggacattctcaagagacttgaaaagatcaaggaaactctaccatcagatcaccattggggcttattcacttcataatacacaaaatccatttttaagcgcaaaaacaaccagaaacaagaaagtatcattctctgtttgccttattaatccctgtttcatttcttttgtaaagattgtttctttttcatcttttcatttgctttaaaagagtgtgagatagaaagcttttattgttgttacatggattggattgagtttgcaggttaatgagaagttcatatcatatcagacaggataaaatgtctgtttccgaaaaattcagtaacaaaatgaaaaatgagttcagtagtgtatataaagctatagtcatagggttttcaatacaatctctgccctcaggagatggtaatggttttcagataagcttctttttctggaagaaagtcttcaagtgccaaaactgaagacctgcgaccgataaacaaactgcaagcgacacgaaactcaaccatgccatcttcgaatttgtcgctatgttcagattgtgcatttcttcttccctgtaatataccaaatgaagaagggttttgagttttgattcactctcatcctctgatcaagtgacttcaagggaagacaggttttgttgtcattacctgtcgcggagatagaacatctcatcgtggattccattcacggtttcaaataacttcttaacctcaaactccatcgtctggccaataaataaaacaagatccaaccataacaaggttaacaaaacattccttcaaaaactctgcaatctctttaagaggctatgttacatttcaagctagtcttgctctgtagtatgttaaagcctagtcctatctaccacatttcaagatagtaattttctgcgtctgttaaagcctagtcctatccaccttcatttagcagggaaagaactcctgaatgagctgaagaaatcgatggggttcaaaggtgaaactaatgaagctattttctcatatgcaagactgcagacacaggtcagtaacacacgagccctgtcagcttaattcatggccttgttctaaccaaaccaatgcaccaacataacctataaaccaagactacatagcatttctcacttcagatataactttccactttccagcactatgtcttggtgtaacttaggcagctatcaaattctcacacatccggcgcaatgctctattgttcatgtcattagaagcatcaaaatctatttcctctaaagagattagtttgactaagttaagacttcaagagtaaagaaaaagcgaaaaacttacttcgacttggctcttctttgccacattcgaccaatccttggtatgaatacccgtcctccaatcaaagtcaatgatcagcgtcgtctctggtttgtgatcgacggcggagaagcaacttatgtaatcccctgtttccacagctacaaacgagaattgtcccgattctactccgtccgattcgtgataagccgtcccttgtggcgatgtgaccttaaaaatcaaacacattgcattatactgaaatcgccggaagaagaaattgaagggaaatgcgatccgatcggatgattattaccctgacggtgactttatgggaagaaggaagaggatgatcctcgtgagggtttataatgctgtattttccgatggtcattgcgtttgcgtgaatctcctctgagatgcatttcgtgtgcccagaaagtagctcgtatcgtatagagagtgtcacgggagataaaattgagaggatcaatagtacgatcgagctccgacgatgattcatgacggctccgatatagagagaaatcgatctgacggatttcaaagtttagctatttttcttgttaaacggaaggaaggaaacaaaagaaagtcaacacgtgcattgccacgtgttagtatttcattcgttaaaacacgtggagtactaccctctggaattgggctttaaaattaaggcccattaataatgttggacctatatacttgtagtggatcacactaaagtaagttagaagtaaataaagaaacaaataacacatccagattttataattcaagcataactacatatgacttggtaatgttaattttaaacttaattgggaaattttgttgaaaagacaattgtactcgagtttttagtaaagaataaaatagtaatctttccttggaagggatgttaataatgcaacattgaggtacgtgtcatgatttcgtttcagtttttgttttgttttacaacagcttgaaaatatctgaataaaggagatgaatataaacagtggtttgaatcgtgattagtgcaataaatagatgacagtaataaaaaaagtacgggagaacaattaggtgaatccgttgacgaatgacaacgactatcaaaaaggcaaaatgtgtcatctttctttatatgtttttcaatgttgaatattcttgaaatctttatttatcatatgtttttctgatcaatcattatccttgaaacctatttttttttttttttggttatagaataatctttgacatttaatgatatatataatgaaacaagttaggaaaattgaagctttctgaattaggaaataaattgtgtaagcaatagaatgagtttcttgggaaaacaataaatagaagaagaagaagacactttgacggttaattaacttattttcccatctctcaccgttaccacctcttttttttttttttccgtctcgtgatttttttttcttcttctgaatttcgaaagaaaaaaaaactcctcgagattcaaaccatttgacacaaaggagagaagaagcatttcatttcgcgtttgtcatctaatttcaatttctgacatctcacaagatcggagaaatttaggttatagtaattttattctcatgaagcggcgacgacgatcgtcggaggagggagatg

SEQ ID NO: 34680 - DNA, 3003 bp, Unknown; identical to SEQ ID NO: 20862
  misc_feature (1)..( 3003): 2750-1469P.txt file - cDNA_ID_3081196; gDNA_ID_2910741; Annot_ID_193682

SEQ ID NO: 34681 - DNA, 3003 bp, Unknown
  misc_feature (1)..( 3003): 2750-1469P.txt file - cDNA_ID_3081211; gDNA_ID_2910741; Annot_ID_193670
ttgctatgaaaattgtcaatattaacgcatttgattcaattttttttctcaagcttaaattttccagacaatattccatgagtgtttaatcctaatatattgaattgatccaatctaaatcaaaccgatccaaataaattaatctaatttaccttttgatattcaaaaagcatataaccaaacaaaaatagaaaacatcaaatccatactataattggttacacttatgctttggcataatcaacattccaatgctcgattgattagcctctacaattgttgaatgtatatatactctcatacactacataatgtaattacagcaaaacttcttcaatctgtaattacagcaaattcttcaaaaaaaaacacatgaatcatactatgtaacaagaatcactattattatagtgcacaaaaacttatgttatatatcttcccagctgtagttgtaaagaaacatggttcttaccgtgggaaaaaaaggatactatacaaatcgtgcctctaaataatagactcagttcaacattatgtgattatgtctcctcgttcttgactgggatccaacggtttccagacgaagatttctttccccgggtaaaaaacccgataatgaaccctaaaagcacacccacaaccatcaagcctgctcctttggcataccacaaagcattagattctgattttcccataagtgtagcagaagcaggaacggttttcagatttgggattttagtactctctttgctcccactgattactaccccagatgctaacatctcaacagtatcatgaacttcgccatcgtgattacccacaaaagaaacagtgagcttttctttgtttgcaactaaacgagtgtaaccaaactcacctgtacgatacattgattgttcaggctgagggaatataggaagatctggatggtttggtctaggctgccaaatcggttgccaatcttgaccagccataccgatcacaagatgaaccggatttccttgccactgtgtgccgcaagtgttgttgcttatgggacaaaacctttcgtatctatgaacatgtccccatagagcaagtgtgacattgtttttcacaaacaaaggttctagatgctcaaccatcttttgtcgaatcatagtgtctctaacctcgttgctcgtagtgtacattggtctatgtccttgcacaacaacaaacggtgttttcttcctgtctacagactctagatctcgctttatgaattcatattgactacctcctttaagaaaattcgtctctgtggagatataaacgaaatggaccgttcccatatcataagaataatataaattccttgtcggaggagctttcattcctgtagactctgaagaattcccaggcatgttaaacttcaagctatacggcacaccacattcgccaccaccatcgtttccataaatagaagctgcccaatcaggtttccacggctgagtagagaaatcatactcatggttaccaatgcaaacatggtaaggaactgtcgaggcaataggctcaacctgagcaaagaactcatcccatacccacgagtaaccacgagcataacttatatctccaatgtgtgaaatcatagctggcttatcaccaagagcttcaatgtcacggaggatccacttcactgtagatatgctctcatcttgtgtgcggataaatgtcgtgtatggtgtagcacaacccatatctccaaacatgaaagctacggtttcttctgcagtcacatctcgagcaatgtagctatggatctcactccatcccttagaatcactcccaacctaattcatagaatcataaatttgatcaatcaaaacatatttctcccaaatctatcatgcataagcttcaaaatcgagactttatattacctgataatagtatctaacgccatcattcaaattcttcatgacggtatcaaaaatccaaccaggatctctccaaccaatagtggaattcgccggcgaatcacacatgtgctctctctcgtacctcatcccacgcgccgccgcggaattacctaacaaatccttcgattcaccgtatctaacaaaacgttcttcaccatctccagctacaaacataacacgcatcgtgttaaccatatttgtgaacgacaaatggatctgctccggcataccaacaccggatccgaaagtcagctgctccgattcagctagaagatgtttagttcctggtaaaggattctgatcatgatccttatgtttcggatcaatctcggattcgctccaacggaagatccggaatgtgtaatttgatcggagattggttaaaggaagagaaatcgaaccgaaaccatctttccaagtggacgattcattgaggaatttgtaaccaataaagtgatcattaggagactccggcggcgagtagagtcctaaccaatcgagatctgacggagaatcgacaccggaccattgtatcacaacggaatcgccagatcgattgagagcattaggggaaattgaaatggtcgctttagaatcagcagaggaaacgaagacggagacgaagagaaggaggaagaaagagaaattaacgatcatggcgacggaggaacgtaagaataaatgttgccggaacaccggagatggaagatatataaacagttgtttaaacgacgacgtttctaccgttcgttatgattggttagctatttttaaaaccaatattgatttatgacgtatcaccttcttatatatgggcctatctaagcccaatattatgggccttactcggtctatttaatatattaaaatattgttggaatttgaactgtttttggttagtttagtttccactgagcttgctttcttccatggcgatgataaataattcttcttcttcctcacacacaatttcactttccgattttataaaattgattcttctcttcttcttaaacccatgaagagttcatgatttcttaagctcgcagcataatcgatg

SEQ ID NO: 34682 - DNA, 3000 bp, Unknown; identical to SEQ ID NO: 15113
  misc_feature (1)..( 3000): 2750-1469P.txt file - cDNA_ID_3081248; gDNA_ID_2910742; Annot_ID_193725

SEQ ID NO: 34683 - DNA, 3000 bp, Unknown; identical to SEQ ID NO: 15113
  misc_feature (1)..( 3000): 2750-1469P.txt file - cDNA_ID_3081248; gDNA_ID_2910750; Annot_ID_193799

SEQ ID NO: 34684 - DNA, 3000 bp, Unknown
  misc_feature (1)..( 3000): 2750-1469P.txt file - cDNA_ID_3081260; gDNA_ID_2910742; Annot_ID_193722
aaaaatcatttgcataattcaaagtccaatactttcattttgtttcctctttttcttttgtctatttaattattgttttttacgcaaccccaccactaccagatctttaaaaggcacacgacacgatcaagaaataagactttaggaccaaccggagttaaacgtagtcaaccgcagacgattcagaggagagtttcatttccgccggaatatttcaactccggtaagttaaattttcaccttactctacggccctccggtcactgaaccatgtttgcgtttccacttcatcttttgttgatcatatatatataaagtcaatattttggtgtaaacgatcgagacaaagatctctcaagcatgcttatttcagtcagaggccaatttttgagaaactaacgtttgcaaattgtgaaattcgtttaatctggtcatttgtatttcagtcttgatacaaaaaagctatgcaaggacgagttaggggaagtggggaagacaggataagcatattacctgaaccattgctatgtcatatacttagctttcttaggactaaagattctgttaggacaagtgttctgtcttctagatggagagatctctggctatgggttcctagattagacttggacaaatccgacttctctgatgacaatccatctgccagtttcgtcgataagtttctgaattttcgaggtgaatcttacttgcgtggattcaagttaaacactgaccacgatgtctatgacatttctacactcgacgcctgtctgatgagacttgataagtgtaagattcagcattttgaaatcgagaattgttttggcttttgtatcctcctgatgcctttgataattccaatgtgtcacactttggtaagcttgaaactcagtttcgtaattctgagtaaattcgggtctctttctttaccctgtctcgagataatgcactttgaaaaggttatatttcccagtgacaagtctgcagaggtgctaattgcatgctctccggttcttagagatttgagaataagccagagtggagatgatgctgttgaagttttacgcgtctgctctgcctcactgaagagcttcactctgaaacggacggatcatgattatgttggaaatggtgaatatacagttgtgatcgatactccgagacttgagtatctgaatctcaaagattatcaatgccaaggcttcaagatagtcagtatgagtgaatatgtcagggttcatgttgatgtcgtatttgaagtgataggtggtactgtattgtcgaaaagaaatatcatttgtgattttctatcctgtgtctcaaacgtcagatatatgaccatctcaaggaggagtcttgaggtatatatactaagtactaacacacactgatccgtaaacttttccctgagaatatttacttaatttactttaccttgcagttcatctatcgtcacctggaattgaagccacgattcaaatttcatgacttggctcgtttgcgtgctactatgttctcaaactcctctccggaaatgttgccagtcattcttgagacatgcccgaatctgaaacacctcaccttggtgattcgttgctttgactctacaacttcttacaaagattattttctatgtggtacactcatcttggttttgggatttgcaggaattggttcatgattctctagtgacggaggggacaagtggacttttgactgtgctgcctcgttgtttgatatcatcccttgcatctgtcgatatcgaaagcccaatcacggataaagcaacggaactgaaactggttagctacttgttggagaactcgacaactctgaagaagcttgttctacgtttgaatcagtcttgtagagataaatatgagccaggtctcttgaaacaagtcttacaatctccaaggtgctctagtttgtgtcaattagtcattctctgacagaacgttgttgatgcagtacacatagttgatcttgatttatgatacagcctgagtaatgaatgtctttctttttaagaatgctcaaactgaaacttacaaagtctaaacctcaacttaacttgagaagttatttgattgataaagaagtaactacaactagttgcagagagcttgatctgaggtcttggaatgtaatgagacacagaaaagaatcgagtatccgtcacttcatcttctgctcagtgaagaggacatgacggttgactcgaggatcgtacttacggaactcgagcttctcaagaagtcccttggtactcttcctcttgacatagaagaaaccagttccagcagctgagacaagacggatgaacatgaacgtcttcttcctcttgtcccccattttctcacttgactacaccatagagaggagatcattaacgatcaaatctcagttcaatatgtgcatcaagcgacataaaaacctagacaaactaaagaccaaagtgcaatcacgaaacttttctttttagattttgaaagcagagaactgagaacattaggaacattaccattcgaaagattacagaaaataaacaaaaagatgcaaaaacgtaatcctagatcattcaatccaaaatgggcaaaaaaacttgcgctaataacaaaatgaaacattagaattcaccgaaatgcaacttcaacaagaaaaaatactcacagatgctcaaacacagagctgaaagcatcagaaactaaagaaacttaccgatggcaaaaggcgacaacacggtggtgatacggcggcggagatgaaacgggaatgagaccaaggaagtaggaacactgtcattaaaaagagacaagacactaaattttcattcggcccattaaatctgaataggcccaatattcttttagctactctcacctggttttgttgttctcttttctctctctcttttctctctctcttttctatttccgtcggactcagtggagaagaagaagaagatccaaatcgatccgttgaaaaggtacgacgatg

SEQ ID NO: 34685 - DNA, 3000 bp, Unknown
  misc_feature (1)..( 3000): 2750-1469P.txt file - cDNA_ID_3081267; gDNA_ID_2910742; Annot_ID_193720
cagttttattgttcgatggttcactaatcagcacagaatggaacaattgtttttatctgcttatattctaccatacttgacagtatactagtaattttgtgactaaaaactgttagagaaccatatccaacagctaggatgtcttgctatgatcttgtggttatgcttgtggatattggtgaaacattgaaggtttgttacaaaacagagaatggaacttaagttgggttatctaaaatgaaacaaacaaacaaaacaaaaagagcaaaaatatttatagtaaaacttcagattcctcttatgtttcactaaggaagttgcctacttcaaagccaaaatagtattatagaaagccattccttcttcttatttatcaacgactgcaacaaaacaccattcatcatcagtcatcacagatgttaatagagatagagttggatgtgagtgaatcaaactaaatgtcaatggcgctagctctagtccttgatctagagaggcatttagattaaataacaatgcagctatttatttaccttaaggatcgagaacgggaccttgacagacatcgagacctgattggagtaagcaccctctcctctctaggacttctacagtttctagacttgtattccctctcatttcgaggcaaaggagaacgtgaaatagatcttgaccttcttcgaggagagtacaaatcatcctctcttactttactatgcctgtgcttgtgccagtgaaaaagaagaagattaaaacggcttttacatactgagacaattaattttgttctaaacatacaatacaagaagaatgaaaacgtattactaatgttcttcaaatggcttttgttccttctcacgctataactgagaaaagttgtttctttatctaatgactaccttcaacacattttctggaagatacatttataacttgaaagatctcttctctccaacttttctggagcaaaacgctccaaaatctctcatttctccgagtttatggaacaaaacctatctttaatcttgtgaaatttctctactgtccacaacattgaatggctctatttctccaaataccattctttctttggccactataagtctattcattcattatttgaccggatgacaaaatggcatacgcaaaacaaaacacaagtcaagctcaattcagtacagatagtacctacaaaactctcttgctaaagttatagataacttgttgaccaagtggtattcaagctctagcttaccaaagctggtgaagatgacatttggtgaaataagtcttcaggttcagattttaggaaaaacagacaccctaataaacattttttctacaagacttatcaacctagacgtgtccaatttgtgccttgtcattgtattatccacacacaactgacagacaatctaagtgactaggaaccagtgccgtttgcattcacatgagcgagttccaagaataaataaagagccttatgaaacagagagtcatcatacactattataacaaatgcctaatagatatagatgagaatcaaaccttgactctcgccttggaggcgaacgcgaacgtgaatgagctgatgacaagaaaggacatagttagtaaacatcacagggtacataggtattgttctaaccatacactgcagttgtcctgagacatatcaaaaatgttaaaagcaaaccaaaaagctacttacaacgatatctgcgccttggtgatctgtgtgaagtcctcttgtagtccccgtgtcgaccactatattaaacgaaataggatttggaagtaactaagataattacttacaaaacatttacattcatataaaaatatgatacaaacacaagaaaacggactcttcaccttgtaccgttagtagtacgcatttcttgtggagttttccggttctcctcagcgaaaacaatggctatctcacgcccaccaataactttgtgattcattcgtttcattgcctcagctgcatcttcagcataacgatacttaacaaatccaaaccctctcggctccctaaaccacaaaataatatcacattaaagttaagagttcctactcaacaaacaactacttgaactgacaccaaaagttaccaatcaaattagtcaagaatccatacacattgacaatgtgacattgttaagagaaataaccagtaagctaaagctaagctaggaaatagctaaaagcatctgattataaaagacaaagcttgacatatacccagtataataattcctaggcaggtatatgtccttgagtggaccaaaccgttcaaacgaatccctaagatcgttcggcctgaaaaacaagaaaacattccaaaactcgtgtcaattaatcaacattagagaacttgtgatgtccttgatggaatctgaacagtagagaaggacggagagacctagcatcgagagggagattacggataagcaaaccagaaggaccagaggattcgtgatcacgagaagacggacgttcgcggaggcgattatcgtcgtagcctttccgttcgcgaggtggtgacctgtcacgaggacggggactatagcttctgctccggcttctcgctctagccatcgaagatttctcttccttaggtcttcttctcaaacaaatccaatcttcggagcaattgaatagcaaaaccctaaccctgtcggaaaacgagttagagagtgaattttggagggagagaggaagaaatcgacgactgtgaaagtttttcaaaacacaacacttgccggaagctggctacggtctgactttgtttgttaattcttatgggctttcaaatttgcaaactatgggcttatataaatcaaagctttaaaggctttgtgtcaaagttgttgacaaaaaaaaagaaaaaactcgtaccttgactcgtccggttccaaaaactcggtcacccaaaaataaaaatcaaaacccttcgataaacctcccggaggagaggagacacccgaaatg

SEQ ID NO: 34686 - DNA, 3000 bp, Unknown
  misc_feature (1)..( 3000): 2750-1469P.txt file - cDNA_ID_3081277; gDNA_ID_2910742; Annot_ID_193717
aatacaggcagactgttcaccagatagcggcggaaaagagactgatcctctgttaaacaaagaggttgtcatgaacgtaaatgacataggagactggccaaggaagtcgtgtataaaaacgcactcagctttagcattcaggtcccgtcaaactatgttcttaatcgctacgttcgctgtctgttttgctgtctgtgcggttctctaccatccaaacaaggtcacacagcttgcagtggcaatccgaatgagattggtacacaaaatttgaatataagttcaacggcagagactctcattaacgtgtgtgcatcaaaaagctcgaagagagctgtaagagtgttcaacagagctcagccacaacagcttctcagagagtttcccttcagaaagagacaggatatgatcagatgaggtcttgctctttctgtgtgttcttcttcccaatttctataagaccggtgatgctgcaactgtaataacaagaaatgctcagatcagtgattaattatctctagtcgaatagtgttttatgtatattagggtttacttttgctcactgtaacctgttttttctttgtttcttggtctaagaaatgattcttgaacaaatcctaatcgtaactttatgcaattttctacttcaagcaatgtcttggctcttgagatctctctaaactctgtttggtcacctctattatcaaatgttatctttgacttttcttattattattgtcagtccaatagattaactagtactcaagtagcataataatttgagatggttttattcttttcttctctttttgaagtacaactgtattaagatgcatgttggattgagaaatcggcactgagattgattgcaacatagaaggcaaatgggtagaaaaagacaaagaagatgagatttgaaaacaacgaagagacacacatataaggaaatgcgtcagttctgagtcatatattttggtaaacgacaacattctaacattttatttatttgctttagatgtattcacctttctttaaacgtatcaaacgctagctttaacgtgctaatttaaacatagactaatctattttgcctttaaaagtttgctcaaacttagaagcatttctctttaacaaaagaaaactattagagattacttggacgtatgcaagatacaatctcaattctcaccgaaaaagtttgtacaagttcatttcacttttgcagtcattagttaggttagtatttttctttaaatatatgcatgctacgcgtggttgctgcgtttgttcaacagctaacgtagagaattaaattgcatttttttttcatttttttgtcgtagagaaattgcattttaattacgtctcattacctttgacaaaaaaaaaaaaaaatacgtcttggagatactttttatagattcatttcagtttgtcaattagttattatgttattataaataaaaaaatgtaataacacccttttttcctcaaatgtaataacaccttatatttttcagaagagaaaaatataatgctgaactcatcattatacccgcacaccaaaatgagtgatgtcatgcgttcaaacatatgatttggtacatcaaaataatgtccgaccgtacgtgtacatataatattggaaaatttagaacttgcgccaaacaacacatcacatgattcattgaacaaaatgatatgcacatgactcaaatgagttgtacgatagcctaaaatcactgttttaaaaatacgcaaaacggttatatcgatttcgtttgtaattacagaaggaaaaaaaatcatcttggaaatgtgctttaattaacggaaggtacagtttagttcatgtttattaatttgatgatctagaagtaagataacccgtcggattagaaaagtccatgcatgaaatcctaccaacggcatgaacataacgcatccacaaatatctttaaagacgaattttgatacgattttgcctttgttcagaacaatttagaggttagtagtgacagtagttagatattacagtatacaaaattacgtaataaatcataaaaagaaaccaataaacatgtacaaacaaatctagtatataagtacatgtggacccaaaaaaagcaagcaaatgtggacaaaatattgctgaagctcgtacatgggtacatgatcgcaatcactatggctagtttggaaaatacccacatggtaagatatcaacatgaaatccgaaatcagtttcaaaacaatttttatagatttattgtcagtgccggctgagatggtaaggcaggtgcgacagccgtatagtactttagtgacgagtaaaaattaaagtttgtaacccttccaaaaaggtattaagaaaattgtatgatcaattcgatctttaaaataacatgttttccatttcatgaatatcaagacttataaacttttgttgttttatataagttgatacaattgttttaattttatgtaaaataataatgaattacttaaacgtgaaaaacaacttcatatgttttgttcgatgtatacagttacaaattacattgaatctcacaagaaaggaaagtcgtagtattatgagattacattacttgaaagattagatataaatagtaatagtaatgtaaaagaacaaggaaaaacttattaggtagtaaaaaagaagagaatgaagtggagatgactaactctaggggtaaacatcagagccaagtcagtgagagcttcatcacagtccccacatgagaactatttttgtcagtattaatctcaatcattatcgcatttaatatttcattaatctattttgccgtcgaaggacaaatattgtaaaaatcttcgtcccatgtcgagactttacatacatctattacctataaatacctaattcacgaaccaaagtactcttcacatctatctctttctctctctttccttgcaaattttcagctctcaaagagttaagagttagagagagagaggatg

SEQ ID NO: 34687 - DNA, 3000 bp, Unknown
  misc_feature (1)..( 3000): 2750-1469P.txt file - cDNA_ID_3081281; gDNA_ID_2910742; Annot_ID_193715
tcaagtgggttttgaccaaactgaatcatcaaactccaataaaacccataaaacaaagcacgttaccttttggtgcacgccaatattctttttttatcaagtttgtatcttcgatatgttgatttactattttaattacatcctgaattgatatgtttgcagtagcgaaggtcgataatatgattttcgaatattatccctatttgtagtcgagagtgtgtacatctagttacagaatgtaaccatccgttcttgcagttttaaatatgattccgaaatcagaacagatgtcagatcaagcaagatattaattcaccctttttatttcagctcccacctttagtttctagtgatgcgaagcatgcatagctaatgtggccaactccgcattttctatacatatatatttcagtaataaattatgatgaaagactcaaagagataatgtagggacctccattcgacctagaaactagtatttttcgggcttaattctgcttttttcagcttatttcgatctacatagttacgtagtaagatttaagaataatgcaaatgaaatctttttccgttttaatagattactacatgatatattgtctcaaacgtaatgtggaaatatcggaaattttcgtatgaatgacacaaatatatcgtttgtcctcttatataagggaaaactacctccttttaggacaaactccttcattggcacatctctggcaaattggcaattccaaaagaatcataaagtttagatcttccgagtttgacttctcagcttctcgctttttcttttcttttctttgttgcgacttatcttcttcatttgcttataaaagtcgaatcttcttattcatcattacattgttacacgctatgaatattttatggttttatgctatgcatatttaaatgtatcacgcgatatatgagagtatagtttagtaatagttaatatcatcgatgtattattatccaaattgtatactacatgttgatatatatatatcaataagctaatggttggcatgcctagatttaatttatgtttaagtcttctatttatgtagtccatacatattattaatttgtaatgtgaatccttcaccatttcacattcgaaaaaataaatatcatcacataagacaacgactttcactgctttattattaaaaaagaccgaaaataaaattagaagaaacgggtcacagaaaatcataattttaccgatcgattttattagacaaatgtattaaaaaggacagctaattaatacaacattggacatgtcatccgccatcggtggacttccaacaataaccgatcacgtcacatggtattgtcgtcgtgttttccacgtgattattgaagccaacactctcttcttttggtaaacctgttggagaaaatcaagtcaaacaaaaaatatgtcgtagagaaccttttaaattaaagatacacacacatacacacccataagagcatcttcattagataaaaattgataaatgtctttagtattaataagtaataaaaattaaaaacacttcttttattatgtatctaaaatgtctccagaaaaacacaaatttcagtttaaaaacacttattattttgttattatcatttttattactattatatttagagacactcacaaacaaataatcactaatgtagatggtctaacactttcgtgattacacatttctcgaaacatttcttgttttctctcgttatttaaatctaattaaaaatttgtattaatcacaagttgtgattgtttattactactctctttgatgacggatccgaatctttttctcgtttgacttgggaaataatatttagaagaaaatgtgatcagaagttggaaaatataaactaaaacactacaaatattattttgacagcattcgtcttgttttagttgtaaatgaaatcacggtcgaataagaaatataatacaaacatgtttcccacgtaaaagataagatatctatattcgtgcacacatatgtttcgaactaccttgaaaaacatgctcccattttcttctattatttgctataaaagctaactaaagtgatggacgtattaactaattcattataaaaattagcaaagaaaacactaattcattatagtttagtcgttgaatggttagtttgtaggtacataaattcatgtaattccaactatcttatccataaacaagaattacttagatgatgtcgctaatgacgtgatttaacccaaaaaagaaaagaaaaaacgttatgcacgtattataatgaacaattattgagaagcaaaaagaatatggaccggaatattaaaagaagtagtaagaaaaataaaaacctcactagtcacaataaaaaaaaagtagggaacgttcaagacacattcgaaggaagttgacttcaagtttttccgtatatttcattttatatacctaatttagatgtcattttttcttttttttttattatcgattctggtccctagtcgccaaccatttctcttttttctttttttcgtctctctctgcatctgcacgtctgttttatcttttcttgatctttgttttcctgtaaacttatcacagaactatttatgtaagccaagagatttttaagtttttaagctgctcataacagaaagttctgaagaacaagaagacgttgaaaaaagaaaaagaaatcttatattttgctatattggctttttgtctaatttgtaaggctttgatgtaacagtctctctctctcctttgagctgattcgtcacttgtccataaacaaaggaacccaccttcctcattcttcttacctattccttctctttggtttggacatttgattctagtttatgtaatggtttcttgatctgatttttctgggtctcttgccatttggtgaaacagatcttgggttttgtttcagattcagacaggaaaataatcaccaatctttctgacatcttcttaagatg

SEQ ID NO: 34688 - DNA, 3000 bp, Unknown
  misc_feature (1)..( 3000): 2750-1469P.txt file - cDNA_ID_3081309; gDNA_ID_2910742; Annot_ID_193706
caaggaaaaaaaaaaattgtgaattggtttgtatatggtcattttaccaacacggggcaaaattcagttcgaacgttgttcaaggcggatttaagtcacatcaaatcataaggtctctttttcctcttgtgaaattcatcttgtgttttcttaatctgatgttactttaccaatctgaaaaaaacaaaagaaaaaaggatgaacattttgtagtgcgggcttcaatcctgttcaaataaatatttaatttatacaataatcagaagtaaattctgatcgtttagcatgattgttaataaaatttaaactatagtataatacgtactctttaatcatctacatgcatttatgtaagtgtaacatagctttgcttacaagataagagctacaaaacattaacaagttactaaaaataacaatgattcaaaccgtcaaatatgagaaatactatagtttattagaaaataatccgacgcatatatttctatctaacattttcactatataagaaaaaatgtatgataaaattaagttctctaatttaaatatttataagtagatggagcataaaataaaatgggagtaggggaaaatgagactaatgaggataaattgagtgctactgtatcatgcgcacacaagtttatatccaaaaataattaacgaaagcggcccacttccttcacacacaccatatgttaattcatcactatctcatgttgtcttcctaataatctttctcattatcattttttttgcttataaataactatgttttttttatctaacagaatatagatattgcgaccatatatctttatttcttttcatcagatatcatgaccagccgggatatatatatatattttgatacatggccgctaaaccaaactttgaaattacaccaaaaaaaataaaaaataaatcgctcagacactaatataacttcaatcgattccacctaacttttttttcaaagagtcttcttgcggtaagtacattaatcttcaaggaagatgaagaaagagaagcgcatgtggagaaaaggagacgacgcgtataagattaagatgtgcctcgacctcgagcccaaaaacaaaatctataatcaatatcgacactcgatagtgttattgctatttctatatataataatacgatgagttatattattcttatgaggttgtttggtacatatgaggcaatttattattcgatgcaaatcattccccgtgcctcttatgctgtgtttttctttataataaacatcagaataattattttgaaatttgattatgttgagaattttaaacaataataagaagaagaggaaagaatctgatggacccttgtggtttctccacgcaagaatcataccattgaaagggctaaatacatgcatgcattataactttcgactcctggaccaacatttgcttcattattcaagtccgtaaaattcaaacgattagactttgttttgctaatgaagtttctaggaccaccaattatttgatctgaaatcagtaaaacaaattaaacatataataactacaaccattatataatatgaatatttaaaaaaattctgatccataaaactaccttaagttaggttttttaaaatataaatgcagctatgccgataataattaacaaagtagtcaagtacgtatcgtcatctcttgagcatagtattgtttatctaaagttgaacagtttccacaataatgagacgtgctggcgtaagcatgcgtcatctctttgtcatattgtgcaaatccaacaagacattattatatgtgacacttatgtaatggagagactttcaagagatttggttcagtctatcttatttcctcttctatttaatactttttaataagatagctgatgatgagagaagggtgaggcatggaggccatcatgttccctcttccccaaaccctttgtcctcttcaaaaggtatctgattctctctttaaaaaaaaatgtacaaaactgtacattagattcattttacctcacacactattgcttctatagcttcttcaataatttactttcaaaaactttttcaagtgaatatagttaatttgaaatgggttttgtcaaacaattagcatggtgtgccaaaaagaaaatccactttgaatttcgcattgaggtgtgctctaaacggcaggattatggacatcttggaactcttaaattatgtttatgtatatatatgatgcactaactaataatcagttaattaacaactagtcaattattttttgcttaaaaataatctgaatccgttgccgcatataattagagtataagcctagctatgcatgtatcataattacttattttgtgcaatgttatagaatattcatctaagttttggcttgtgggctcattcatttgcttataaatactgtcccctacttctttatatgttttttctaactaataaatatatagttgatgattatacatcctactacgccctaataacgacaatcaaaaatatcatgtgaatatatggactcaaacttgagtttgaaggaacgctaatagaagtaatcgctaaataaactttttttttgtatatatattaattaacgatctcttacctcatatgagtttttagtttttgatatattatacactattattttacaaggtataaacttcttcatgtttattttctcagatctctgaagactttgggacatataatttgcggatatatttattttattttattttaagagcaataaggaattttcggaagaggtgaaggaggaatttatatgctgatgatgatgttgctggggatatgaggagtttgatagtgaaggggcacattgatatgacagtgtctccaaatcaaaagccctaactcctatgcaataaacacatatgtttgggttttagggtttcactttttaactctctaaggtagacaaatcataaccttatcaactatctaaggtagacacatcaatg

SEQ ID NO: 34689 - DNA, 3000 bp, Unknown
  misc_feature (1)..( 3000): 2750-1469P.txt file - cDNA_ID_3081316; gDNA_ID_2910742; Annot_ID_193703
cataatgacacttttgaaggtgagcgatgaatttgtggtttcatttttcaaatttttcacaaattcatacgttatatcatgttaatggttcatgttcatttgagtaggactcgagcaagaacattcagatatcagccttccatatatttaaggtaacagatcgctttctttttgtagttaatttggtaataattgaggatgaagttgttattatcagagtttgaagccttttttaaaccttatatatttgtgtgcttacagatctttgttgcgaatcctaataagccgcaagaagtgaagatcatattggcaagaaaccatgagaaattactcgaactcctccacgatttgtcccctggtaaaggtatgtttcaaactatttcaatactaaaattctataaatcttaccctttaaactagactcattcctttacttaaaaatcttgcttaggttccgaagatgatcaattcgaagaggaaaaggagctcatcatcgaggagattcaaaaattgtctggcttgaaaaacctcgaacgttaaaaattcttttgcctcctcatctctctgttccacgcagatgaagtttcttgtgaactctgtgtgtccaatgtttcataactgctcgtcttaacatgaaactgctgcttttcctagtgagtgtagtaatgtaacttttgattcactctgtgttgcccctgagttgttcagattcaaatataacttgtcctacatttaaagaccacaaccttttgttaccttttaatatctttatatgaagattctgcttttgtatgtaatctttgaaatggacaagaatcattcaatgaaaccgtttttgttttattaaccaaaaaaaatacagatgctaaaaaaaggaattggcctttttgtggatgatgaatcaacctaatgttatacagttctagagtcagacaagactcccaacaaaaataagtttctttcagacaatctctagatttaaagaagttgcaacagaatcagacatcttcagatttctcactagtgcagcatatgccataccagaaggcttcaaacctaaggccttaagctccttgtatagtttcaagcctttctcaaccttgttttctttgcaaaatccttttatcaaagcgttatacgtgattgcattcggtgtaaccccggtttcagacatattcttgaaaatctcgaaggcctcgtctgattttccatgtgagcagaaaccctttatcatcgtattgcagcttaacattgttcctccatagccatttctcaacatctcattgtagaatgcttcaacaagcgaaatttcgcctcttttaaaatgcccgtgtatcatcacattgtaagcgaactcgtttggtcgcatccctttctttatcatctcaaaccaaagcttcctcgcgctccctaaccatcccttctcacagaatcctcgaatcatcgtagtatacacaactctatcaggtgcatagcctttatctttcagattcttgaatatacaataagcctcaagctgcttcttattcatacacaacccctttataatcttctggtatatatacatactcgggaaatggttccacgctatcatcgtatgaagaacctccgacatacaagcatagttcccaatctcacagaatccagatatcagtttagcatacacatactgtcctggatcaagcccttgtttcaatccctgcttcaaaagctcatagccttctgaaacatccccaccatcacacaaagctcgaatcaaacaccgaatcctctctgaatcaaactcagattctaccatttccttatgaagttcccaaaaccgatcgagtttcctcgctttcaagcaacctaataaaacagaattgcaagtcacaactgaagaactaattcccatatctttcagtacattatacacttcaatagcttcctctaccaacccttcttcactaagacacttcacgtattgctctaataacgtaggctcaggtttaaagccagtggtatcgagaaaactcttcgcagctttcacggcttttccatccaaaagggcaccaaagagaatattcaaagaaacaggaccaggtgtgtaatcataattggaacacaaccaccggaaaaaccacagagaaaacagaacattgttctgagatttcaacagttcgccgaaaaacagaggatcagcgaaatcaaacgaaggaaaatcagataccagagtttgttgccatctctgtctctctctcatgatggtagacacagttttagccatctccgtataactcacagccgatttttgctcatcgggcttggattcacaatcacgagactcgacagttagactccgtatctgggtattagggttctttcgagttcggtttctaaagaagctaatcaaatacgactgacctctactcatggcgtatcactaactcaaaaaactcgtgggcaaactcgaaatcaagctccaaagagagccagaagcaaattgtagaagaaaggaggtgaattttttattccgggaaaagaaagtcgaatacttatcaccggaaccctagatttggatctttctgtgtcatttccaggagatgatgaaaaaggtttggactttggagtaaataagaataattaaacaaagtttattacagcatcaaatataatttgtcaataatgttatgacgacatcaatttttagattggtcttgcttttaaaaaaaaaataaaaaagaggtcaatttgacggataaaaaaagtgcttgctttgctttagcttcttcttcttctctctctgtatctatctatctatctatcgtcttcgctgaaatccctaattaatttggttcctaccaccctcaatttcccgcgcaaagagaatgtggaaggtcatgaaatgaatccttttagtaaattccaatcgacgacatctagctgaaagtttcaagctttctcgcaatctccgtcctttaccgattcgtttggtctttggtggtcgcttcgacgagaatg

SEQ ID NO: 34690 - DNA, 3 bp, Unknown
  misc_feature (1)..( 3): 2750-1469P.txt file - cDNA_ID_3081324; gDNA_ID_2910742; Annot_ID_193701
ttt

SEQ ID NO: 34691 - DNA, 3000 bp, Unknown
  misc_feature (1)..( 3000): 2750-1469P.txt file - cDNA_ID_3081368; gDNA_ID_2910745; Annot_ID_193759
gttctttatcgccaaatttctcactaatagaggggtatccattcccaccattgcttgaagaaacctcgtcgactctaatctctttaatctcttcaggaacactaggaggaatctggcgactaacagggattagattagaagaagatctagaggtttttcttctgaaagtaagccatagcgatatagctaaaactacaacgaatatcgcggagagaacaatcactattatctcccatagctccaaaccattgtagttccgagataatgtgtcatttaaaccagaacccatcttctgacctccgctttattcacctgaaaaggcagagaattttaaactcaaaactcttgtataaaccataacttttgctgcttaaacaagaaaaaaagaagttcgagaagaatcatttcaagacctgaatcaaagtaatcaaaacaaaccagaaacacaaagcttataccaaatattagatttgagctactcaaacatagaaatctaaccaaacccataaagaaaatgcacatagcctctctcttaagaagtcaaaattggaaaggaacaagcaaaaagacaagaaattgaacaaaaaaggactaagaaaaatcagattcaacaaaaccaacattgtatttgtacctaagtcccaagaattgccagctgccagaatattcagttctcagaccaaacgccagctaaacactacgctggaaagaaaactacagctgaagaaaactaaaaaatatctaccgacaatagaaactattcagaacacacaaaaatccgtcgcattgtctgataaacacccaaaaaacagagtctagagaaattcaagaattgaacttacaattagaaactagggttcataagtgagagaagaaccaacctgatgggcccaaaaatttaggggatttcagagcgacattgaagggaaaaagtcagatcttaagcagcattgactagaaagtttccagctttggatctttggaaaggatctctctaaacctaacagacaaagaacctaagcagtgaaaagaaaagcaatcaaagaccagagaaaatgaatgtgagtgggaaagattgaagctttaccctccttgtagctgtgttccaataataaacagtaagaaaagaaaaaaaagatttaatccaattatttattctggcttttattagctagcaaaagtgacgaccgacgaaacaatgtcaagactttttttttttttttggtgcaaaggtgaagacttttttggttttgtgaggaatggataaaaagagtgaagaagaagactaacctaaaaagttttaatcttgttgtaactgacagagtgtgtaactaatgggaatgtcaaactaaatctcgttgactaaatacacaactcttttacttttggtcttaaatgaaattgttgaacatatgtttgttttgggtctgttttattataaataaatgtcaaattaatgccatttgtttcactattctgatgtttggttttctctcaaaactttgtttatgcaagtaaataatctcattgaagtttttcgataaatagatagacaaaaataaataaagaaagacatttatatatatatatatatatatcattatcagcaaatgtttgtaaggaaagaaagacataatttttaatgcatgtgaaagtacgagtgttaatttaattttaagcagctgagacataattttgatatatcccaagtttagctgatataatcaaattcataaagcccaagttcaaaaagaagagaatgtccacagtctagttaggcggcttggttcgttttgaagaattctttaaaataatcatctccatgacaaaccgatgaaaatgactttatgtttcagataacgtaaaattatcaagttgatgctaatttcacttgtttgattaattagcccctggaaagattaacggtctattactagatagtttctctgaaatcaatatcatcattagatttatttatttatttcatgagtactactacctctaataatactattatgaaagtataataaaacttacggaaatttcttttatgttaagttgttaacatgttggaaacggtaaacaacctaatgatgtgttttagactattagtacgtttttaaaaaatggtatagagtaacattgatacaaaaaacacatagggtatgacactatgactaatatactagctaaatccctttgctaaacatgaaaagtagtatacaaaaccttaatcttagagaatagagaattgttttagctattttatgtttaaataagaaatatctggtatttaatatgtctgaaattagtcggagttttcttgcgtatagaaaaacagtagtggaactttccaaaacacattaagacagaaaaaataatatgaaaagtgtgcattaaatacaatccaacccgcactatgataaaacttgtaagcattattcttctttgcggataagcaaacaaacagaagaattacaaaaacttatgtataatcccaaaacgttaaaaacatactacaatttcttattaaaaaattctgaaagacgtgcataaaattctcgtaaactgacattatcaaaaccaatgtttattatttcaagataatttccttttgaaagaaacgagaaattttttgacatttggttttgttggggtgaaatttgaattatttgtaaatacaggggtcttaatagaaaacgttgaaagaaagggacaaaatctgaaaaagggaataaaaagcacagaaaacaaataaaaagggccaaactccaaactccaaaggcacaccaccattgaattgaacttccctcacacgcaagtaccacaccttctctctctctctctctatcatctcttttctttttctctcatcgccttgaagctctgagaagtagagagaagctccgatctgataggaactgtgagtttccttgagtctccggagaaagaagtcgccgatttgctcctgataatcttagtctcgaaatcaaaacgatg

SEQ ID NO: 34692 - DNA, 3000 bp, Unknown
  misc_feature (1)..( 3000): 2750-1469P.txt file - cDNA_ID_3081372; gDNA_ID_2910745; Annot_ID_193758
aactccaaactccaaaggcacaccaccattgaattgaacttccctcacacgcaagtaccacaccttctctctctctctctctatcatctcttttctttttctctcatcgccttgaagctctgagaagtagagagaagctccgatctgataggaactgtgagtttccttgagtctccggagaaagaagtcgccgatttgctcctgataatcttagtctcgaaatcaaaacgatgttttgcgattgcttctactggaataaaggtttctccgagttggaatcggaatcgtccgagtcaaagcccttctcgcttccatctcctcttcctcaatggccacaaggtacagtagtaccatcatcttttcttggaaattgcaattatttacaaatcaacttgcagatttttttgttgtcaaacagttatctatttttatttctaattttggatattttcatgatttctatacattacattaaagatcaaattgatgtttaatgtttccatatcatcatgaattgatattcaatgttatggataataattttactttttgagttttccttttctgaataaaattcgttggaatattcaacattggcacctgttgttgtctgttttactagttcattgttttgacatttgtttcatgatttttgttctgtggtcaaagtttttggactaacaacattttaattgaccttaagaaaaattagttactgacttacacaaggtaggtttttttgagcttcaataatgtgagcaataatgcatgaccttatagaaagagttattaatgtagcacgatgaaaatggatatggtataattactctatcatagttttgattctttaattctttatcgtttcccaacaaccctttggataatgttgagtaatggttgatgatgataacgtgttgattagtctttgtttctaatggttgtttgtctttgtttcaggcagaggttttgctactggaaggataagtcttggagaaatccaagtggtgaaagtcaccgagttcgatagagtttggaaatgtggcacctcgcgtggtaaattaagatgcgcatctttttacaaacctgtggggataccagaaggtttccattgccttggtcattactgccagccaaacaatcagccattgagaggctttgttcttgcagctcgggctaacaagcccggtcatctagcggatgatcatcgccctcctttgaaaaagcctttgaattattctttagtttggagttcagattcagattgctacttctggttacctaatcctcctgttggttatagagccgtgggagttattgtcactgatggatcagaggagcctgaagttgatgaagtgagatgtgtacgagaggatcttacagagagctgtgaaaccggtgagaaggttcttggtgtaggatcttttaatgtttggagcactaaaccttgcgagagaggtatttggtctcgtggagtggaggttgggtcattcgtttgctctactaatgatctgtcttctgataataaagccgccatgaacattgcgtgtttgaaaaatctcgacccgagcctacaaggtatgccaaatcttgatcaggtccatgcacttattcaccattatggaccgatggtctacttccatcccgaagagacttacatgccttcgtctgtgccatggttctttaaaaacggagctttgttgcaccggtttgggaaatctcaaggcgaaccgattaactcagctggctcgaacttgcctgcgggtggagaaaacgatgggagcttctggattgatctccctgaagatgaagaagttagaagtaatctaaagaagggaaatatagaaagctcagagctttacgtccacgtgaaacccgcgcttggcgggattttcacggacgttgtaatgtggatattctgtccatttaatggtccagccactctcaaaatcgggcttctcacggtaccaatgaaccgccttggagagcatgttggtgattgggaacatttcacattccggataagcaacttcaacggcgatcttacacagatgttcttctcacagcatagtggtggaggatgggttgatgtatcggatcttgagtttgtcaaaggaagcaataaaccggttgtgtactcatccaaacacggtcacgctagtttcccacacccgggaatgtatcttcaaggcccgtcgaagctcgggattggagtaagaaacgatgttgcgaaaagcaagtatatggtggattctagtcaaaggtacagaatcgtagcagcagagtatttaggcgaaggagcggtttcagaaccgtactggctgcagtttatgagagaatggggaccaactatagtatatgattcagcagctgagatcaataagatcattgatctacttccactgattctgaggaattcttttgagagtctgtttcctattgagctttacggtgaggaaggtcctacaggaccaaaggagaaggataattgggaaggagatgaaatttgttgaaaacagagctcctctgtttcagtgaagctttttgctaagtgtatgtgtaaataagtgtgtatatatatatatatggaaattgtatacaaattttggattcaatattaatcatttcgatcttacaagcctgttattaactctatatatatattcaaattgcccttaaatccatgtgaggtacagatagatagattcctaagtgatcaaagttggattagtgaacatgtgcctttttacttatcgaaacgaggaaacgacgtagtttaataattaacataaggatctagaatatgttgtggtagacttcgtcgtaggttataaaaactttctcggtttctaaaacgacggcggtgacaaggaacaaaggtgaggtttcagacacagacagaacaaacaacgaagaaaattcaaaatcttatttcaattcaacgtatactttccttaaattaggaatttggttttcgagaaaattgagatccgaataactatg

SEQ ID NO: 34693 - DNA, 3003 bp, Unknown
  misc_feature (1)..( 3003): 2750-1469P.txt file - cDNA_ID_3081379; gDNA_ID_2910745; Annot_ID_193756
tactaacatgtgctagtatgtacatctctttttattgtgcaataaatatatggttattgatgcattatctcccaaaacatgatatagtactttatatctcgaaactcttcaatacttagttaaaatataaatatgatcgctatcacttgaactgcagaactaacatcaaaacgtgttggtcatcgttgtcaacaattggaaagtgaacaagaaaccaatatgtgatttttggcgcagcgtttgctatgctttgaaagtccctcatcatgccatgttgatatccgattatcgggcgaccatttatagttaattatactgtatttatagaaatttaatatatagaaatttctgcctggttaagattgtatataaaaaaacatatatagctatataattgtcacacataaaaagtagatcactgaagttctacgtaacaaaaaggtattattgtagttaagaacatgatactactgtctactgatgacttagtagttgctatataggtaggttcacactaattgcataatgatttaattaatgtaacattataaatacattaattagattcaactagtattacgaatcagacgacgcagaagcatctaaagttggggatttgagcagagtccaaagaaaaaccattataaataatccgttttgttcatcttgaccatcggattaagatatatgtttaccttactctttttcttctaatctaatctaatccaacaacctttctttttgtaatttatatgcaatcttatgataatgtatccaaaaaaatttagaagtacattagtcatatcatataatttcacccacgtgaacattgattgtaaacatgcatgcatatatttttcttttcttttcatttttttttacagccaaaacatgtatgtacatatgcgatccacccatttatttttcagtgactctaacatgtaagcaattcagatttatacacgaaattcaaatgattatttggcacaattgctaactattttgtcggtgtatactgttattcatcacgaattatttgtagtgacactaaacataaacttaagatcttgaaatatttaacaagcttttcaaaacaatatacgattattgtttatcctaagatatatattgttttgagcagactttttttagaatgaaatttccataagttttctctcatgcgaatgatagatatgcatgtaaatcaacgttacagtattatgaacccctcgtccgaaacagctggatcagactccgttttccatcttaaaaagaaatataaaaaaatatacaaattatggggacgattagttgaattgtttataattttcttacatatccatatcccaaaagatcagatcaacttgaatctgataattcttttcgaactaagttcggatcaaactcgagccggatatattgattgacccaattgatagacgtataaattttactagacgatctgtcgtggaccactacaataaaatggtccacagtgactttatatacgcatttgttatttttttaactttgacttgtacatatcatttgattgagtaggaaaaaattaatcttgatcctagattagcatttagatttttttggtcaacgagattaaatattactactatttagttgcacaaaacaaaagggaatataaattttagggaaatgacaaaaatttaattgattataactttgaattcagttggtatgttcataattcatttgttgaaattggttcagccatcgcattcagagtgtgtacttatgtgcatatacgcaaaatatatcttaaatcggtgtgtatgagtacgcaattaaagaacgccacgtgggacaaactaccaaatttagatgatgtaactaaaaaagctggatcgattgagagaccctcaagcaaagatattaaaagtctcccataaagttttactgaaaattcaaaatgattagattattattatactcatgtgactggttttgatctgcctcgtgcatttccactagaaccttaattactagatctttgtaacagaagcaatgtgatgatattatattggacgctaaccagaattcttattgaactcctcctactatgaaaggaaaatgaactcaaccatattaaaacactttctctactttgactctttgctatataatatatagttccaaactaaatttaaaccaagaaaaaattcgttcattttaaaaaggtaaaacaattttggttattgttgtcttgtatagacaagttatacaattcacacgagtcgaattttacgacgtacaagtacaataccaaaaatatgtactcttacatttttggctataaagtattttctaagttggaatttaaattttagaaaaaagagaaaaaagaaaagagtagtgacagatgaaaacattgaaggagtgtcataaaagggaagaaaggtttagttagttgggtaggtctctctattgtatttatagtttttcctttgcttctttttcatttatttcccttaactttattttaatcaattttgctttagtctctctcacacacatgtataaaatgaataatttctcatcttctctcttttttatttataagaaagaaaagacaagaattaaatctatcaactatataaaaatgaagccaatgcagggcaatgatgatgaatcttgatttgatcttcttctcgaaaacctcattgcttctgcttcttctcttccatttccatatttacacttcataatatctcttcacccacttctcttcttccccatttataactcacaaatatatacatactcttacatttatatatcttgggctagctaagtagctatagtaattttctaatatctctttccatttcttgaaatggtcctcctctcaccttaactttataagaatctgaccacctctcaggtttccagtttcttcactttctcgttctctggacactgaatgtgatacatatatagaagaagaaagctataagagattgatcgatg

SEQ ID NO: 34694 - DNA, 3003 bp, Unknown
  misc_feature (1)..( 3003): 2750-1469P.txt file - cDNA_ID_3081387; gDNA_ID_2910745; Annot_ID_193754
atatattttttttttgctattattaaccaaatttcttttaatcattgctatatttacttacctgtttttcattctatgtcattgggtgcaaaatgcaaatactctataagtaaatcaaatcaaaacaagtttatccaattaaaattttaagaaagaacaagttaaattgagactgagttatcttatttcatactcttgtactcggtagtcgatacatatatcttgcgagtgaaataaacaaaaccgagtttcccacttcaacgtgtgtggctcatagggcaagagcagagctaaggttcatggggttcatatacttggtggtaccggtcaagatatgtcggactatcatgcggtttgctttctcagtcggatgaaacgcatcccaaaagacgtataactcacggttcggacacaagtttgatagaaccgtacacaaacccatcccattgtacggcccttgtccgcaacaagcaaccttcgatgttacaaatcctataacataaataaataattgttataaccctttcttctcgacaaaaagtagataattagaaagggaaaactagtggtaattaccatatcttcgtggagtgcttagaaaatcctcttgcatttggttagtgttagcagcaataaacacatttctcccaatttttttgttaagttcatttatcatttgaagtagctgaggatcatatagagatgcagctcgttgtagctcggccgagcatcttccattcgacgtacctgatctcgccagttcggccggtgcacatcctagtggtccagctcctgtcactagaactcgacccactccaagtgaatttaacctctacaaataacacacaattaaattgtttgcaacaatactcaaatagtcaaatcattgcaagagagtgaaagttcttgaaatcatatgagttcaactgcctaagactatatcatcattccaattcaattttggtcttacaataatgaagcaaattataataagactgttaccacttaccaatagtatttttttgtattcagaaattaggagtcggacgtaatccggtagagtgaattggcgtgatctagcggaatatggaaacaagaaatagttgttcacaaaatcgtttccaccgaccgtgattaatacaagcgcttgactcacgagccgctgagtttgcggtttcccaatcaagcgactcacacgttgttggtattgttggaagtaatcgagttgttggtacattcttataatgttgatctgcatgccaaaatttatatctaataaataaccggaaactaatatgaaaattttcatttgatgtcagactcggttatatatatacttacgaattgaaatccggtatcattgagaattccgataccagcggaggcgaaattagcaccgttaagaagactccggccccttagctctggactaaggtaaggtaacggtggctcttcgttaccgattgcctcacctaaccaatatttaaccagtttattattatgtctttttggtaaataaatagcttcttatgactaaatatttgtatactcatctgaatcaagattactctaaaccggtttatgagattagtaaccaaacgtaactgataagatctggaatgttaagaccgttggaaaaccggccggttggtctccgagttggaaaatcgattccatacggtggagagtcggcacgtgcagttgtcaccagatagttgttgttgccactgtcgacgagcgagtcaccgaacacgaaaaaagcacgtccctccaccactatcggaccagacataacaaatactaggaacatggacatgaatgctataaccgttgatatcgtcataaaagcgttttgtttaatgactgtgacaaaaattacaattgaaatggaaaacgaaggaaggctggaaattatatagctaagagttttggtttctcactttttcatatggtttattcaaatgtattcgatcccgtgttatgacatattgacagccaaaaaggtgcttcaattgtttttaggtttttatagtattgctaccaaaaaacaagaacagactactatattacacaatatttattagaattatcaaagtactggtagtccaagggaatgataatattgtacatttatgtattattatcgtacataagttcacatcctttttctgctattgctatctcactgactactcttaacactttacttaaaaagacctgctttggttttatacaattgtttgttgtatgttataaactaaattacgaatcatcaaatactagtgttaaacattttcaagttagaaccatttttttgtttgttttccttgtgagattatttctctttttttttaacataatgatgagatcatttccatccaattgttatttaataccacctatatccacctctcaagtttcacaagaaggaacgaacgtaagcgttgggacacaaatgacaaaaccctttactctttaacaagaactcacatgaggcttgcgtaatgtttatgacagaacaatgatattatactgtcctagcgatatttgggtttgattgagttaccaatataacccaattggcccacaagtatccaacattctggcccatttgacgttcagtatattatcagcgtggaccatcaatctgactccgcgccacgtcttcaagcaaattaaccggtttggttcgcggtttaattatgagaatgagatatacaaaacagagtcttcgatttcagagttgatttaggtttcttgattctttcttctttcgcttcaacacagtcgagtgactcgccatagcttcaacgccgacgaaacccactattcaaggtagccaatttcttctacagagcaacgtatcgatttgatttcgacctctttttgtttcttcttacttgcccattatctcaatttgtcactgaacagagatttaagttttagagttcaaaagcaatcctaaaaccctaaaccctaagctgagcaaaatccttcataatg

SEQ ID NO: 34695 - DNA, 3000 bp, Unknown
  misc_feature (1)..( 3000): 2750-1469P.txt file - cDNA_ID_3081391; gDNA_ID_2910745; Annot_ID_193753
aagtggaatttctcaaattgatcctatatttctattaatgcagagtgtctagaccaaaataaagggtacctgacgacgcatttttgcttcctcatcaaggatgctggctgaaacatttttctttactttctgcaaacaggtaatttagcattcaaaattttcaccaaaggagtgaatttcaacaaattaaagctggtgggagagggagagcgactctaaccttttcaacaaggaatttcgttggataattcttacgtcgagcttcacgccattgctgaacttctcttggtgtatacatcaaagcatatgatcttctcttggagaaaaacaacatcaaaaaaaaatattagagattggctgacatgataacaaaagatgtaatccagattaaatcccattcaatactacgacttataaggatcacactgcttcatgaacgtgaaaatttagggagtcaaaatgccttaggaacgaaaagaaattcagtgacacctaacactaccttttcttctccttagctatgttaccagtatcagatccatcgagccctgttttcatcttattattgttccctgtatatgaagtcatatatggagagatcagaaaaacaccttcaaacattctcaaaaatgttccagaaaattaaaggaaaggaatacagaaatattggcaatacaatgataatacaacaacactactaacttgaaatatatagctatatagctaacaactatagtcaacaatcctctccctaatgacagtagacatatccagggaaaactgaaagagttggaagtttataccattttgaccaaaattcttacaattgcaaaccagagatgtaatccgatgtaaaaagctaacctttgcccctgtgatccttattgaatccagactttctcttgccattatctgcttgatgcaactgaggtctctggaatctacaataaactcagaatacatataaaccaagattatagcaaacaaatcactgaaaggcgagtaagtagtaggaacatacccttgaccagggcctttgaaattttgatgctttggaaacttatttcgaaaatcattcccgttaggacctgaaccattggtattatcgacagactgcccctgtagaagctcaagttaacttagagagcaagaagtactggaaacaacttagacaagtctcccttttgatagagaaaaagcaatgtaaataagaagtttttacctgtggtcttggctctgagaaacccggaggccctgattggtgattttgatggggatttggaaccggaggataaggaagggagttaaaggaattaagctgtggtcgagaagagaaagcatgaggttcaagagaaggctggaaaaagttgggaagagagtgacccataaggttactgttagcaactgcaaactgaagattccccaagagattgggaagtagctggttgatatggttgggcatagcaaactgaggaagttgttgaggcatattgttaaagaactgaggatgtattggcatattgggcattggcatgttgtgacccatcattggattattcatcatctgtggattcatcatccctaattgattagcgttcattgggttctgatacccattatgttgttgttgttgatgattagaaaacccattgatctgcagatggcaaagcaaacacagagacatcaatacgaaaagttttttactttgtggtgaaaaaggagagatttttattgagtggcagagaaatagaaagagaaagacctgttgttgttgttgtagttgatgttgcggtcgataaggacgagcttgaggctggaaggaattgtacggaggtcgcattatgaaggattttgctcagcttagggtttagggttttaggattgcttttgaactctaaaacttaaatctctgttcagtgacaaattgagataatgggcaagtaagaagaaacaaaaagaggtcgaaatcaaatcgatacgttgctctgtagaagaaattggctaccttgaatagtgggtttcgtcggcgttgaagctatggcgagtcactcgactgtgttgaagcgaaagaagaaagaatcaagaaacctaaatcaactctgaaatcgaagactctgttttgtatatctcattctcataattaaaccgcgaaccaaaccggttaatttgcttgaagacgtggcgcggagtcagattgatggtccacgctgataatatactgaacgtcaaatgggccagaatgttggatacttgtgggccaattgggttatattggtaactcaatcaaacccaaatatcgctaggacagtataatatcattgttctgtcataaacattacgcaagcctcatgtgagttcttgttaaagagtaaagggttttgtcatttgtgtcccaacgcttacgttcgttccttcttgtgaaacttgagaggtggatataggtggtattaaataacaattggatggaaatgatctcatcattatgttaaaaaaaaagagaaataatctcacaaggaaaacaaacaaaaaaatggttctaacttgaaaatgtttaacactagtatttgatgattcgtaatttagtttataacatacaacaaacaattgtataaaaccaaagcaggtctttttaagtaaagtgttaagagtagtcagtgagatagcaatagcagaaaaaggatgtgaacttatgtacgataataatacataaatgtacaatattatcattcccttggactaccagtactttgataattctaataaatattgtgtaatatagtagtctgttcttgttttttggtagcaatactataaaaacctaaaaacaattgaagcacctttttggctgtcaatatgtcataacacgggatcgaatacatttgaataaaccatatgaaaaagtgagaaaccaaaactcttagctatataatttccagccttccttcgttttccatttcaattgtaatttttgtcacagtcattaaacaaaacgcttttatg

SEQ ID NO: 34696 - DNA, 3000 bp, Unknown; identical to SEQ ID NO: 15102
  misc_feature (1)..( 3000): 2750-1469P.txt file - cDNA_ID_3081395; gDNA_ID_2910745; Annot_ID_193752

SEQ ID NO: 34697 - DNA, 3000 bp, Unknown; identical to SEQ ID NO: 15104
  misc_feature (1)..( 3000): 2750-1469P.txt file - cDNA_ID_3081421; gDNA_ID_2910745; Annot_ID_193744
  misc_feature (1352)..(1352): n is a, c, g, or t

SEQ ID NO: 34698 - DNA, 3003 bp, Unknown
  misc_feature (1)..( 3003): 2750-1469P.txt file - cDNA_ID_3081476; gDNA_ID_2926221; Annot_ID_142436
taaaccaacaatataatgccaataagatccgacaaaacagacttccttaaaccaaaccaagaccagactgctagattatcagacagaaagtatctaactgggtctaaccaaaaaagtcaatattgtttcagtggcaattcgatcaaagacagatgttcatcattcaagctcttccatttatagaatactactatttgatcaacaactaaagcaccaaagacatgacttagcttcatatcaatttcagagctcttaagacataaatctgagaccctttttcaaaaatcatagaggaaacaagttgaagaaaactattttaccaatagtaggagcaagatcttcaacggagctagaaatgaagctgacaagcaaactgcttttaccaacaccagaatcaccaatcaacaagatcttaaaagacagatcgtatccactttgcccagaagaagatcccattttctaaaacctcagatttgctgtttctcgatctgtaattctagaagatcaaatcaaatcctacttaaccaccaactactacaaaagcaaacttttagataaacaataatatgaatctatgaagcagtaatgatgataatgataatgataatgatgcttcctcgtttgataattacatctatctgcactctctactttataagtagtagcaatctaagaaaaagggagaatttttatttgcctgtgaatgatgcaaacaaatgttttgattaaaataaggaaaagaaatgtgatgaagaaactggaagatttattctttacggagaaagagaggagaactggtaaaatgagagttttttttttttttttcttttgaagaagaagacaagacacagacctgagatagtaacgtttgttctttgctttcttctctccgacactttgcttcactcaaacgtctctgttttggtttccaggttcttttgtcgacgtgtgtgtgtagcgttttggaatcgcggctgcggttgccatatctattaaccactgcggttggagactaaccgttttcgtgggctaccaattgaaacgatttgattttgtcagttagtttgttaaagcgttttaaattagcgattgtaaaaagggaatgagcattatttttggacagactaatttaaacagtctaaaaaattagacgattcattgaaccgcttagaaaaagtggttggaattcattattatttttaaattttaatgtgtctatactttcatgaattttgttttttatatctataaaacaatttatgatatgtcactagcttactatacatatttttttagtcattaacatcatttctcattgctttaggctatattgtattctctacaatataaattgaaataaggaaaaaaaaaacttacaatgactaaattttagtcaccaatggaactaattattttgtaagaaggttgaaaactacttttttttttttctagaagagtcggcgaacagtgatggttaaatgaattatgggagccatgtttggccttcgtctgctgtcagccaagcccctgcgaaaccccacccctggcctgtgcaaaagtttacgcgcgcattctgagaacgtgctttccacgctccgattaagacgtcactaagagtcaaagcactttgattttctcttcttttctcacaaaacactttctttttttatatacagtatgatttttttttttgtcgtcatttttttttatttatttatttaatatgcctcttatggtaaaacatatttcaagaaggtttatgtttctataaactaaaagttatcaacggcagatgaataaatatggaactaattttctctctaaatatccaaaaatatgagaatgttgtccatggttttgggaacagaatgagtgacggaaaagccatgaaaagaaaaggtatcttaggaatatcatcttccttttgctcgcctaacctttttttattgttcttctctttttgaatttaaaatatttttctgctctctagtaaacatttaaaccatcgtaataaattgagaataaagtgtgtgtatgtttgtgtgtgtgaatgttcggtgtgatttcaatttattggaggatagaactgttgtgtcgaaattgacacaccaaggtgccaagttgagtacaaaataaagatcctctagaggctacatcttcgtctaacaatcctcataagtcttcttcttcttcttttttttttagttttcaacacactaatgtcaagtgttttgttcatttctttttagttataatatgtctcttgagaaaatgttgatatttagtttgttgttgagccatttattttctgagacaaatttggtcgttaatggataatattcttagagatagatctacagtactgtgacttttgtgtaaaaacaaatttgtagccgtatttaatgggctatttcgtatttggacaatagccttttattttgtgggccatgatatgtcaacactgctcaatgcttataaatgttgtcgacatttaacgaacgatataacaccaaaaacttcgagtttgtaaagaaaaattatgagaggattacattatggttagcatatctgactataataaattgaaaaattacattactggttgatggaaagacaaatttttattgaagtgtacttatttctttaattttattggaatataatattcgatatgtgttattatggttagcgtctgcatatattaatttacgattacattattggttaatggaaatacaaaattttattgaaccttaattatttctataattctgttataaaaatatttaaaacagaggtcaatatttttaagagaatgttcaacaatctggttaagtaaggggaaagaaaaagcttagctggctttgaaccggctcggcattcctctgtcacccaccaaaccaaaccgagtcatccttcgtcgtctctctttctttttcttcaacttccatttttcgaaaggcgacgagaaaaagtatttctccagttttggaattcgccatg

SEQ ID NO: 34699 - DNA, 3003 bp, Unknown; identical to SEQ ID NO: 34698
  misc_feature (1)..( 3003): 2750-1469P.txt file - cDNA_ID_3081476; gDNA_ID_2926221; Annot_ID_203321

SEQ ID NO: 34700 - DNA, 3003 bp, Unknown
  misc_feature (1)..( 3003): 2750-1469P.txt file - cDNA_ID_3081497; gDNA_ID_2926221; Annot_ID_142429
gtgcgagaaggctcgtgaattatcttgatgagaagaaagaagatactggaatcaaaaacatcatgatcttggaacgcggctttaacggttgggaagcttctggaaaaccggtctgccgctgtgcagaggttccttgcaagggcgattgcgcctaaaccctactaaaccatattgggacctaattgatgttccacattgtcatgtactaaagttgaatgaagattatcataaataatctcttatcagtatgtttggtttacatggagcacaaacaccaaacttgcaacaacaatactaaaagggcttttatggtattgcacgtttgtggagcgtcaaagccacgttgatatcttaacgccgtcaaaataataatggatttttcggtatcttctctggaagaggcacgttactttattaacgccgtcaaaactctctcgctgatacagagtgtttgctttcttttgtagatttttaaagtcataaagcaaaagcaacgacgacttcagagaactacaatcataatttgtgatctctctccaattttcatcttttggtcgaaattcccaattccctgagtcaagaaccctaatttcaacatggtaagatttgttcgatatcgcttgtttttttttttatggatctagcttccgtttgtctatcttgcggcttccatttcagattgtttgaagaaattcctgaattttgtaggtttgcgttatgtgtttggtgcctctgttcctcgtcccgctcatcaatttaatgcctcgaatcatcgattatttcatggtaattgactcgtgctttcttaatattccttgaagttttgatttttccttggaattttgatgggaagaatgatcagatttcatgggaaattaaatgtcaggatccaaatttcgaattttagggttctaaagagtgtggaattcgtttagtctcaaaggagatatctttatttgaaagaaataacaaaattagagattagaaagggaagaagatagtgaagatgataatcaggataagcgagagagcacatgatcataatctttgcttgtaaaagtgaaaaacgaagagctatatagcttttgttatttgcttgaggttggctcttggaaagttgaacatgttagcaatgtttagatcttagttctgttggtgtttcatatcgatttctttagactgtatcttttttaagtgaaaaaaaaaacagtgctttagtgaatcttgcaggtagtatttacttgtgaacatttgttaactcaagtactgtctgttcatgctaaaaaataaactaggctaaattgtacgcgtggctcggatgggagtacaggaagccagcgagagttcctccagcttgtcctttcaagccagttgctaaaaacgacaacgccaccaaagtaagtgaaaggactttactcattttttattcttggttgagtcgtttcttagttgaagcagtttagttgatggaaacatagattctatcctccaattggtgttatatgtttatacttcaattcaacaatatgccatgatcccagtagcttccgagaactgacattcactgtttatctgatttctgagtttttgtcttttgagccttatgtgtaacactttgtctgttttaggtgggtgcggaaactggaactgaaggtacagaaacaatagctaaacctggcgttgtagaggagacgggtggtattaagcaggattgaggccgagtcttttcttcaataaaaccttttgtatttgtggatatgttttggataagagaagaagctggaagttgaaattacctgatgtgatactgataatgaatgatgtacgttgaaaatgctacgtaacagataattttcttatatgtttacttctctctctctctctctttttgtctagaatctttttgcatgtgggagatttcgaatttctcagtaaaactcggatcactctctgctagttcttgagcttaatgcgttatatgttgtctcgtaaagtctaagttgcattattagttttatggtaagtttagttttagaaacacttaaatttagatttaaccacctaaactttttcaagcaaagccaaaatcattgtcttcttgttagttgctataatatcccttcgttttcttcaaaggttgttattatccatagtgaagagtttggaacaagaaatttttaaagattttgtctattgcgactactcgatatttgatttcatcatcaaacattcaaaatctagtgatgaccacttgtcattattttgtattgtcatgttaaatcttaaatggagagttgaaattcatgtcttttaattttattttttaagcataacgtaatgttttataattaaaaaaaaaaacgaagtaagcatctcgttttgcataattatagtcattattattcatatatgaatggaccaaattgttaaagttgcgagcacttcactcacaagccacgtgcactaagccatcacacttacgctagcgtttaggataaaatcataaaaatgttttaccaaaaatcaaaataatttttaaaaacactttaataaatatcttcgtgtctttggttctgatttgaaaagacaataaagagagagattttgaataacagaagaaatttaatatcgttacctttaattttatattttctgtttccattttaatttgaagatccttccctttctttctttctctctctctctcgctcgccgggaaaaatcgctgtccaaatctccggtcatttctccgaggatctcttctatcaatccaacggttttgttttcatcttctcagatctcacagaacaatagtcaaagactgatgcagaagaagcgttagtacaaggtttttgttggaaagcaattgaatctgaattcatctttcattttcacgctttgatccaatttgagttctctcttccactgaatccctcatacgtaaaacctagggtttctaaattagggttctcctgaggtctgtttatagtgcgtaaagccatg

SEQ ID NO: 34701 - DNA, 3003 bp, Unknown; identical to SEQ ID NO: 34700
  misc_feature (1)..( 3003): 2750-1469P.txt file - cDNA_ID_3081497; gDNA_ID_2926221; Annot_ID_203313

SEQ ID NO: 34702 - DNA, 3000 bp, Unknown; identical to SEQ ID NO: 28812
  misc_feature (1)..( 3000): 2750-1469P.txt file - cDNA_ID_3081501; gDNA_ID_2926221; Annot_ID_203310

SEQ ID NO: 34703 - DNA, 3003 bp, Unknown; identical to SEQ ID NO: 28810
  misc_feature (1)..( 3003): 2750-1469P.txt file - cDNA_ID_3081512; gDNA_ID_2926221; Annot_ID_203306

SEQ ID NO: 34704 - DNA, 3003 bp, Unknown; identical to SEQ ID NO: 28809
  misc_feature (1)..( 3003): 2750-1469P.txt file - cDNA_ID_3081516; gDNA_ID_2926221; Annot_ID_203305

SEQ ID NO: 34705 - DNA, 3003 bp, Unknown
  misc_feature (1)..( 3003): 2750-1469P.txt file - cDNA_ID_3081520; gDNA_ID_2926221; Annot_ID_203304
cggctattatcctctcgttatttgtatcatattttcttatctgatcctgtgtgagtctgaaaaatatgtaggccttcagaatctgatatagagaaacaaacacttgcatagctcgggaaatgctcctagctcttcccgtttatttgtgcaaataaactgttttatttccacaaaacgtatgagcataggatcaataagatgtatatttttacattacaaattgtagttgtcaaccttttttagttttcaaaactgtagttgttcttgtagtgaaaaactgtttgcctttgaatatctggttcttattttcctctttgatttgttgccagaactgggagaagaagtatagaacattgtggtgtttgctttggagctgcagccaagtcaagaatctaatataaaaatcaaggtgttgtcttcaggtgtgcagttttaatgactgaagagtagtctctaacattaaccgttgtttgtttcattaacatgaaccttttatttcattgtccttaaaactttttttaaagagattgagttgaaaattggatcgtggaaggtttttttttttttcaatcaagaatcattatattcagggatcttgaatattttttccatcaatatttacaaaacataatttttgattagtgggggaaatggttctctgaaactcatgatgatatggcgagagacaaaacgatggtgcaaaagatatgatccacaactcgtaaacaagatcgagaaaataaaataagaaacgaaagcatacattaaagaagttaacagacaaactcagactcgataattaagaaacttacatagaaactcgataactaagacgagaaaacataaaactccataattaagacaagaaaacataaaactccataattaagaaacttattattagatagttctagaagaacacatgaagtccatctctgaaacacttagtctgatcaacttaagtacccgtacatgatctcccaatacttagcctcggtaacaaagtgaactttacgctcctcccagtaatctgtcttctctttcaaaccccaaaccttaccctcatcagcctcaccctcagcctcagcttctttctcctttgcccaaatttcaatctcttcttctgacatcatctgtgcaatctcaacgtcagaatcttcttcactctgcttcttcatctcccacttcttgaaccagtactcggactcattcttcattgctaccgtcctcttcacgaactcgaggcgtttagcctcctggatcttgtttccagattcaccgcagtgtgtggtgagggcggagacaaataagcattctacatgaaattggaatacattattaacttagtgacatgaagttgttaaaatttacatgaaatgttacataacaaaaacaaaactctcataaatgaaaaaaagtttttgtatcttaatttatatctatgtacaattaattctctattctccatacaagttacaaccaaacacaattagaatattcttacattatcaaataatttaatgaattctctatttctgctaccatgcttcatgtagaatttctgtacaattcttctcaactaatatttatattcttttttttttgaatttctatttgttcagttggtaattttttagagtaatgtagtgaaagtagaaaatagacggaaaaataaaagtgtaaaaatatagataaaggtaaaacctaaactcatcaatgacttgaacaaaaaatttagttttttttttcaaataatattttcagcgaaagatgtaaattagtcaaatttttaggttattagcgtgaccataattaaaacattaatcaaactccataattaaaacacttatcagataaaggtggaacacataaatttcataaataaaacactttaaattgcgattgatagttgctgtgattcgtcgttgcatccaacggcagacaaacgaacaaatttttgataactgtcgatggtcgttgtcgcctaagtatccgtacatgatctcccaatacttagactctgtgacaaagtaaacatgctgctccttccagtaatcaatcttctcttcaatacctcacaccttaccatcatctacctcatccttaacctctttcttcttagcccatatttccatctcctcgtctattatcatcaatgctctctccaactcagaatcttcttcacctcgccgtttcatcttccacttcttgtaaccgtaatctgaatcaatattcatttctattgtattcttcaaaaaatttaggcgttcatcttttctttacgactgagttttccttcccacttcttcacgtatttcatcgcactgtatggtgacaatggagacataagtttcgacggtgatgatgatggcagaatctccgtcaagttgctacgaactctcctccaacactcttaatgacgtcatcaatccgccccctttctttgcttcttacctctgttttgcaactctccagtgatgaagcttaattagtggcttttaaattatgtaacttgggtgttataattagggccgttctaaaggagtgctggaggtgcaaaagtacaaggtccaacaattttttcttaaattttagagtaaaaaaattgtagaaatataatttttaagaaaaaagtttagaataaacggcaaaaattaggtttagaagaaaaaggtgaacacatacataatttacatgagttaaataatattagacttaattaaaactagatgtcatgtctataacaaagtctatctaagtcaaagaaaccattaatatcccaaagtaactgaaattgacgcccaaaccacgactaagagaaaaaatcaaaaccctcagatgaatctagagggtttcgtttttcaccaaaacaatctctattctattcttcttcaacactgcaaaacttgagataaaaatagagtctttcctcttgtttttctctttgttttgctgattgtatctcactaagctgaagaagcaaacaacaatagaaaagagatg

SEQ ID NO: 34706 - DNA, 3003 bp, Unknown
  misc_feature (1)..( 3003): 2750-1469P.txt file - cDNA_ID_3081528; gDNA_ID_2926221; Annot_ID_142418
ttctaaccggccaatcttgccggtttagattaccggactcggaagtttccgtgctttcgtagtataccatttttgtcatagctaacattctcaccctatattgttttagttatttacattttcctccccatttgttttactcacatcacagaacacccatttggattctcatcactaaacaactcaggcgcacgcatgtgaccataaggatctgcgtaaccttgttggttcatatatggtggtggtggagcttcttgtccatacccttgaccgtaaccttggttcatatacgattcttgcacgtatccttggttcgaatacggttcttgtacatacgattgcgatgattgaccttgcatcatgtaatgttgttgaccgtatacttgtccttctgggtagtaatacatcggctgtggaggataaccgtaaccgttatactccgatttcttcacatccatagcaccaccgtctcctccacctccacctcctcctccaccgccgccaacagcaacttctttcttcttctcaccaccaccgtcgactttcttttctccaacatctttaatctctttcttttcaccagcaactttgtccttcttctcaccgccagctggagccgccgctgcagctgccactggtgctccgtcatcctttttggccggaacaacttccaccgtgcgtttaagcttctcgttaagataaggagtgagttgtttcacgtcaatgatccccttaactataaccaaatccttggcactatcaatagcaaccgaattaacccctgtaaaaaaaaatttatacattaattaattaacattaacagaataattaagctggaagattaggctaactacttcttagctaaccatatgatattttctcactaaaataataaataagctaacaataggttgttgagtccaacctaatttaaggaataataaaactttctattgcttccgttatcttcttcaatcaccaaccgtatcaatttgtttaattaaaatgggattaatgatcataaacatacctttaattttgttgactattcttttgattttgtgttcgcaaccttcacaatgtaacttggtcttcaaaaccacagtactctgtatcacatcaaagaaatttcattagaaacaacgattatgatcatagttaaaatcttaattataactaaaggaatcatctttatataaagatagaaaaagtcatccaaatatatttggaattgaacgagtgtaaataccgtaaagtttcgaagtggacacacacacgttatagaccacaaaaacaaatatatattacttttaatatatagtttcgctatctgaatttttaagtttgtttataaaattctttaattagaagagataaatgacagatagagacaattaatgaattaattacctctttaggtggtggtggaggagaagctttcttctctccttcctctttcttcttctcttcttttttctcaccgggtttctcaacggcggctggtttcttctcagccggtttctcctccgctgccggagaaggcttcttctctgcaccgcctgatgaaggaggtgtctctttcttcggcggcgctactgtagagacaagttcgactggtctcttaattttgtcggccactttatcacgaacttccactggatctacgtttccgatcaccgtcaatttgttactcttataatcaatcttcacatcttccacacctaaattacaattaaaattcgggttagggtttcaaattcgatagtaatcaaatccagagagaaatcagttgatttaaatacctttgaaatgtttgaagatgcgtttgatttttttgccgcaaccttcacaatgcatatcaagcttcataacgacggtggtgattccaccatcggtaggtttcttctctccttgaggtttcgtcgccgtttcttcctttttctgcaaaatcgaaagagaaattgaaatcaatcacgtgtttgttagagagatcggacagagaaatcgaagaagaagaagatgaagtgactaacctcacccatcgtagtagtagtagtagagagaatcagattaatttttactttttaaggaagaatttgaatatacgctctggaaaaaaccgagagaatatatttttggtctggtttggagaataaggaaaaagggcaagatgaggaatatatagaccctcttttttttatgtgtgtatgattaatgatgtgtttgatggtgatgatataactttgtaatatatcattatatatatatatataatacgaggtcaggattagtatgcgggttatttttgtatgccgtcgaattggacctcatcattaaatgggcccatttacgacgaggataaacgacgacgtttatttatttattattgcagccaatgaatgacggtctttaaaacttcttccagtttttaaccgggactggtgcaattgacgaaacgattctcggcccattggatttgactttaagggtttgagtcaaacttattttgccttgactttgtactaccatgctttttgttgaactgttgttgacgatttttatttttttttgttactttagattatgttatactttttggaactttctctctaccgctaatgggtagtaataatgttttctagcatttgactgctgttgagttatatgagaacatatagcgctactaaaatgaaagctaatatcacacactacataaacgtgttaaccagttcccttttgttatctttttcttctgtttcttcctaatctaaaccaattcagcttgatttgatttattcggttatgattcccttaatttaccacgtttaaccgaaatcgaatcaaactccctaagtcgagtactgataaagcgagaatgcaaaaatggaaacttagggtaaaagggaaaaaaatggaagttttgggaaagtaaggaagtgaagcaagcaagggttgggttttagggttttggttagccgtctagggttttcattttcaacaatg

SEQ ID NO: 34707 - DNA, 3003 bp, Unknown; identical to SEQ ID NO: 34706
  misc_feature (1)..( 3003): 2750-1469P.txt file - cDNA_ID_3081528; gDNA_ID_2926221; Annot_ID_203302

SEQ ID NO: 34708 - DNA, 3003 bp, Unknown
  misc_feature (1)..( 3003): 2750-1469P.txt file - cDNA_ID_3081542; gDNA_ID_2926221; Annot_ID_203297
catcagtgtttatcaatctgaaacatggaaatttggtagttattatatttcccgatgattgaatgaccaccaaagactcatgtttattgataagaaactgtcgtctagagatgttctaggtcaaacattgatgtttctttaatactttgtgcagctaaggttttctaaaatgcaggacattcaaagggacattttctagtttatatttggtccagttacgattatgggtttcaagagctttaaccagttctgctcctggctaattcaatcagtttatatttgtttcattggctctttagacccactttggttccttctatgtcgcagcctctcccctacctttttgtacattaggttcttgaattggttttgagtttggcttttgctagataaagtgaatatctcctgttaactggtttctttcaaaaaatttgcagggcggtgtttttaccagataattcggatttcatgatattcaatcaccgtggcagactgttcccaccgcagatcgacatgaagttttgaatttttatcacactgcttagtcaaacactgatctgtgtaatgttatgagatgtttccattgaaattctactctaagtaactactctgctttgcatcaatttttgattcttgaaacgagtcttgtgatgtttctgtgtgtcaggtctctacttagaatcttttagaatgaagaatcaacataacaacaagtgcacaggtcctagcaggataggatactgtgtaaatagtcaaatacaaacaattaaaacaacaaaatttgctattttattcattccggttacaactttctgatacattagaaaaagcataaccgaacagaaccggtttagattctcttggcactgttctggaaggtccaactccaaatgtcatgacgttcaacgccacggcccatggcaccagaaaaaccggggtacatattttgaagaaaaaccttagagagatctaaatgggcaacgatcaaaggcttcttaggtttcttaacggtttctggcgcgagagtaactgtaaccttggagtttctatactcaatccaagccttgtacctctctccattactcagcttgaactctttaaacgaccagtgtttcattttcccaattcctgtctgaacccaataaccagctttctcagcaacaacggaagtaacagagttgatattaatcccgacatggttatcattaatgtctccaaaacctttgtcctgaaaaacgtcgaattcgacagcaaagatgtggtttttggggttgccattgttggttttgttgaatatcccgaggtatccagcgggtccaggaccgtcactttcaatggaagggacgacaacaaaagcaaggccgtgaccaggggcgggtttgatgcgagtagagatggagaaagtgaaagaagtttcaaatggataaggagaagaagagtttgaagaaggcttgaaagggactggagtggaccaaagactttggccgtgagagaatgggttctcgtctcgtgtcatggagagagctccggagcggctgacgccatcagaagcaggaccgagctcagcgtctccaaggaagaccaactctgaggttttgaggttgaggttgaggttgacggcggaagtggtgtgagctaagagcagagcaagaaaacagagtttatgaatcttcattgcgttttcgtaactgctgtttactcaagtgagagtttgaaagagtgaaattattaacgtggtgatttataaagagtaaaacataagcccatgtacatgacgtcatattgtatgatgtcaagtaaacgcatcacctacaagatttccttatcctttccataaattgaactcgaccaataaaaaacgtgattgttaataatggaaagaaaaaaaaattaaaacaaaatcatcgaatggtcacatcagcacatgacattttgtcaagtaaacgcgtgaagacactgttgtgaatacactcattcagcagagtatgtgtacagtgtacgcatatctcgtatattagattgtacttgtcttttgcgatgtgaaagcatagtatacggtatcattatgtggatgaatgaatagaaaacactacgtcaaaaggataaggaaaatctagtgggttctttaattctttacccaccacatagacaacactacgtcgtatagaaatttacttagagagtattgaagaggaacatagacaaccttgtgtttcttcggtgtaattggtctagaaaaggaccaatgcaatgcaaagatcgattgctgtttatttttctacgagagatattttcaaagaaaattcactcaggaaaaagtaatttgctttgcatcccaaattctcatcagtttatcacacatatgaaatgttcaacaatcttaccattgatttcttagtaaatcgatctctgatttttcgtttgaacgatttttaaatagtaatcgtaatattgtagtttaacccaaaaatacttgcacaattggttaaaaagttcaaattttttagagagatcaaaggttcatattttctcaacaaataaatattgtgaacttacaataaaaaatagaaaatggagggttcttttgcaaaaaggagcaaaaacggattgagcagtgtagttgaggctttaaatatggcccatgagtcgttgtggcccacaacttaatatagaaaaaggtgcaagttgcataggccaacgccaatgtaaccctcattaacttcattattagtctaagaaaaactcttaggcacgatccgcaagctacggacagcttgagattgtcttgtcacactttatttttttaatctctaaaagttgaccgttgaatttgtattcgaacagcctgtaatatgggatggagagtggatagcctgtatacatgattatacattgtttggttagataaacatataccaatatagagagagcagcaaacataccaaaatcattcaaatctctcgcttaattactcagataaactctctatcggcgaacgctatg

SEQ ID NO: 34709 - DNA, 3003 bp, Unknown; identical to SEQ ID NO: 28804
  misc_feature (1)..( 3003): 2750-1469P.txt file - cDNA_ID_3081552; gDNA_ID_2926221; Annot_ID_203293

SEQ ID NO: 34710 - DNA, 3003 bp, Unknown
  misc_feature (1)..( 3003): 2750-1469P.txt file - cDNA_ID_3081582; gDNA_ID_2926222; Annot_ID_203370
gatttagagatgtatattaacattcttatttccactgggccaatagatgtttccagaactttgatgtggaagattcttataacaacttcattaatttgaatatcccaaaggagaatgaaagaaacagaacaaacttttatttcatcttagaacaaaacaccatatccctcacgcattccgattacattcatcaaatccataaatcaaaacaaaatagataaatccaacacacaatcacaaaacaaactcaagcaacttgaacttgaattgtctttggtttctttggttccggaggaggaagtttctgaacagtaaccttcaacacaccgtcatgacaaacagcagagatcttgtccaaatctgcattttcaggcaactgaaacttcctcatgaacttacccattcttctctccatcctcacatacttcacaccttcgttttctttgttctctctctgcctctctccactcaccacaagcacattgtcgttctcgacctgaaccttgatctcatctcctttgattccaggcatgtccacgacgaatgcatatgcgttagggtgctcgatgacgtcagcaggtgtagcagccattgccttagcgtctcgcatgtaaactcgtgaagggttgttgcgggtcttctcgttgttgtggtcttcggggacttcaagcatgtcttcgaggattgagattattggaaaccttcctaaatccattgttagttgtgttgtgtttgctttcctgattctttgattcttggctttttgttttctttgatgagtttgatgtgagaaatgtggggacttaaataggagtggagatggatatttctagaggattgtcgagagagcgattgtcgcggtctttagaagttcttccgtattgttcgagaaacgtcttggtcgttctggtttttgtgaactctgtaactcaggtttgataaaatatgagccataactttacagaatttttaatatctatatgggcttttaaattaggaatatatcaaggcccattccatatgtgaaaatagttcatgattcataagattagtgttttagcaaattaaagaacaaattttgtgatttaaggaatccgaacaatattgctcattttaaagaatacattcaactggaaagtacatacaattgctgaagacttggattacaagtgtacaacatgcacctcaagatcagaagttcaaagtcttaatgatggaaacaagactaaattagtatatgctctggtttctggtcagaaaaattaatgaaagaccatatttattttagtgaccaaagaaaaatactatatatgtggtagcactaactcactgaataccactaaatcgtgtataacgacattaatataagctattaaagacggttacaaatctgcacaaaacttgatttgtcttaaaactcagttgatgttatttgcattcgcaaatgcaaatttcatttaaaaaataatgtagcagattgagatatcagacttcgtattatactacagatgtagtagctgaagattcagttacgttatccaacatgaaaaaagtacaaagagttgtttggattttaaaatcagaataacaaaattgtttcctttcatctaatacttaaaggataaaattgaatatgtaagagtttttgcagatataataacactgtgttactgatctcatacccataaattacttcaagggacataactccaaaaatatattttgctgactgcagagataagggtgaaatgcaaatgtggatttgatggccaatgtgctaaatagcaccaatgatattaggaaaggatgaacagtaataatttctgcaaaaacagaggaatgaccattcggtgtcttttttgttgtggtcctatttttgcctcataagcatggatggttcaagagagcaaaaacttcattgatttgaagattgaacacaaagacaaatatgaacagagaaaactatttttatttcattttacaacgaacaccaagaggtagttgcttatcgattacattcattaaaacacaaaaacacgatcacaaacaaactcaagcgacttgaacttgtatagtctttggtttctttggctcaggaggaggaagtttcggaatagtcactttcaacacaccgtcattacaagccgcagagatcttctccaaatctgcattatcaggtaactgaaacttcctcataaacttccccatcctcctctccatcctcacaaacttcacaccttcattctccttgttgtccctctgtcttttgccactcaccacaagcacgttctcgttctctatctggacctgaatctcatctcctttgattccaggcatgtccacggcgaaaacgtacgcatccgggtgctcgataacgtcagctggtgtagcagccattgcctttgcgtctcgcatgtaagctcttgaagggttgttacgagtcttctcggtttgttcttcaggggcttcaagcatgtcttcgaggattgaaaatattggaaaccttccaaactccaaatccattcttagctgttgtgttaactttcttgcttcttggctttttctttggtttgattgattttgattttgatgtaagaaagtattaaatagaagttgagttggatagttctagagcaatgtagagagagcgattgtttcggtgttatagaacttaaaagcgcttctctaacgttcgagaaacgtcttgatcgttggagaagtgtagatggatatttctagacgaatgtagagaaaagcgattgattcggtcaggcccaagaccaattcgttttcaggcccatatgtattctgttttggatttagtaaggatgttaaatttatccggtttggtacgatttcattcgaatttagtgtataaaattgattgaaccgcgtcaatacggttgaaacgcaaacgcagaggattcatgagtcatggcttttgtgaggtgaagtatcaatatcatctacctacctatatgatcatcggactaaagtgaaatg

SEQ ID NO: 34711 - DNA, 3000 bp, Unknown; identical to SEQ ID NO: 28824
  misc_feature (1)..( 3000): 2750-1469P.txt file - cDNA_ID_3081586; gDNA_ID_2926222; Annot_ID_203366

SEQ ID NO: 34712 - DNA, 3000 bp, Unknown; identical to SEQ ID NO: 28823
  misc_feature (1)..( 3000): 2750-1469P.txt file - cDNA_ID_3081594; gDNA_ID_2926222; Annot_ID_203364

SEQ ID NO: 34713 - DNA, 3000 bp, Unknown
  misc_feature (1)..( 3000): 2750-1469P.txt file - cDNA_ID_3081598; gDNA_ID_2926222; Annot_ID_203363
aaatataggctcttggtggcaagttacttacggaatatcccaaaatgaactaatgttaatgtgaacaacgtatcaactaacaatgcatatatatatactaaggatccaaaagctttggaataacatatggatcatgtctgtcgaacaaacattggatgatgttataattctcatattaaaacatgtagatatagattaatttaacaattctggaagaaagcataactattagtggaacaaaagattggactgaccaattacaaatcaacagagcctcatcatgaaaaagttcagccacaccctcaatatccaatacggcgctaaactaaagcatcttaaagcatgcatgcttttcgaaaaacattttataaatggtatgatttcttacatcacaaattaaattcgtcttattaccaccacaaattatataatataactacaagaatctttctactaaaacatatatatatccctaataatttatactagtatcatctttttttttttaacatcactagctagtatcatcttatatataaccatccgaaattagaattagtagggtacataatgacaaataaaactataagaatgttccatttggaacaagccacatcattgttaattgatttcaaaagttttcatttgaaataaaataaaattaacggtgatgagatctgtcgagaatgcgaatacatatgtaatgtaatgatgatgacacctggtgcattgcaagctttcagttgcagcattggtggtgcgttcaatcagagtagaataaaattagttattttctgtcagaggaggatagataccaccacaataattaaactataaatttctggctgataattccgaatatggaagtgcgcatacgttgtccttccttgacaactttcctttttaggcaaaacacacacaattgcatcatattttgtttgatttttgtttttctgttattgctctttttttttttaatgcatgcatttttgatatttacttatataacttgcatgtttcaacttaatttacaagtaaatgaaaattacaaaaaataaaaagatatacaaaaggaaggtataatatatacattatagaaattccaaaaattaattgtgtatatatatttatggtatatcatcgaacgataagggaatcaaatgttgagggccatacccactttgacttctaatttggatccattatggattcggtgtggcttgaatttgaagcctcaacaaaaggaaaaagaagaaacaaagttagaagatggttaaattaaaatgcattaattagacctaataatgtatttctacgaaaactaagtaattgtaattttattgcaagtgacttcatcaacttaatcaaaaactatccgtttaccattagttactgaataaataaactagtcatgtaatcattaatgtttcgttgactacaaaaatcaaaacttgtatccaaatccaattctagaagcgaatttcttaattagtgcaatggaagttaatatgtctctttttcattcctcttttctatcatcaaaaagctccaaaccaaagtccataattgtacttcagatcatcgatcataacatggttaggctctctctctctatctgttgtttgtacatgttttaaaatcctaatcaaagagataagtatatcactattgctttagtgttgatgttagagatccataaggcaatgttcgtgagacggatcacagatgacagtactagtgatacagaatcacagatggtgtacttaccattgtttgatcaaatcaaaaagaatatataaagtgaccacagacagaacaagagtttaatattactattaagattctcctctgatactcaaactctgtttctctttccactttcggcgtgggaatcacgtggtcagcccctgaggagacacgtggtgggaacgaatatgccgcccaaccccacatcgtaagtggacgagacgacatcagaaccacgctggtcaagtgggtcatctcatcattttatccttctcttttaagatttcaattcgatttggtttaagtttaattgtcggtatatggcatatccatattcccggttaagtagtcaaccggaaatgttgaggagcctgtgggctactgggcttgggcttagtaaaaggcctaagagaccattcgctgcatccagatgtcttaaaacttgtcaatttgtatgttacacatttacttttttcagttttcggttttggaccttagctatgataaatatttcggtctttttttttataatactatttatcaatttactttctgatacattaattatagaaaactatcaactactttttcatttgggaaaatgatagctcgtggaaaatgaagccattgattaaaagttgtgcagtatataatatggtcttaaatgttagttggtagtcacattcccaggaaaatgtgtgactactgaatacaaacatcacgcctatatttgttgttcaataaagaaaaaagaaaaaaagaacatcacgcctatcaattaatttttggattcgtgaacattatcacacacaacttgcccgttgaccgctaatgcagatcaacggtcaacggtcaattacacacaaaaaaaacaaacttctacttcatatttatttccattattcttaatttgtctgaaatttcacactctagtaaattttcttaattttattatcttctgtttcttaattattaaaattttccaaacgcgttagcgttataataatatctgttacattttttcttatttgctttttcttatctccatttgctttatttgttttctctcttttaaattacagaaaacaaatgaaaataattcatataacgtggagcaacaaattgagaccagctcaaaagacacgtccttttttgcgttactattattctcctcctttctctccaattattctctgagctgtaataacataaacaaaaaaaagattctctcgatcaaacttgccggcgtccatg

SEQ ID NO: 34714 - DNA, 3000 bp, Unknown; identical to SEQ ID NO: 28822
  misc_feature (1)..( 3000): 2750-1469P.txt file - cDNA_ID_3081602; gDNA_ID_2926222; Annot_ID_203362

SEQ ID NO: 34715 - DNA, 3003 bp, Unknown
  misc_feature (1)..( 3003): 2750-1469P.txt file - cDNA_ID_3081606; gDNA_ID_2926222; Annot_ID_203361
ttggactgatggatctcacaaagtcactatcccattatctgtcaggacacaaatgttgatgtacttcgaccagtgagtttgcatttttttcccaattaccatgtctttacttaacccagagcggtggtgtgtaaaaaattcaataattgtgggggaataacatatactatctaaaaaccatcatatactgcaacctattgttttctgccacttaaagaaaaacatggattcaaagttgaaattctaaacaaatagaaacacacaaaaccaaaattttgtgtttggatgttcttgataagcattacattatttttatatatctatatatatattaatatatgcgtttgcaataggtaacaaaatgtatcttataatttgctctcttttttttaatcattttttcattataatttccggttgtccaattttatttgtagggattattagaaattttcgaaattttcgggatatccgtgaagttgggccgaagcccattcgtctctacgtgtcaaaatgaagtgatttggtttttcttaataaataatgaagtgaagtgaatttcgatgaagaaagaaagacatgttataaatgctgactttttttatttcatacatttttaagcctcgatcgagcggaatacaggtacagagaggacaatcaattttaggtaagccatgttggggacatcacttttcaaattgtcttggaaaataaattcaaatattaaaaggttaatgtctttttctatataacagcataatccatatatatatatatatatatatatatatatatatatttttttttttttcgcaatgcattaatgaaataattgcattagaaatgaatcattcatgttacttttatttttatatcataaagaatcccatcgaattttagatatcgtaagtaaaagatacggccgtgaatgatacaaaacagaaaaaataaataaagatatatattggtgcatgcatttgggtgcttgcattggttttgtatacaaaattggcccggtcaatggtaatgaagacatgtatcatataaaattgttgtagatatatctaagattatttatttatgttggcatgtttaaagaatgataaacctacaaactcttggtaagaaataaaattattaactttcgaaaagaagaagaggctggtaactgaatgcattataaaattaaaatttcggccgccagtgactttttagtcttcatcaaaagtgtgaatacttagttctggtcacgcatgactcatagagtgaaaaaacaaatacgtacgggagacctgatactaagtttattttataagaaatgaaaaccaaattctgaaaatttgctacttaacttctctttttcccaacaatgcaaaattgaatatgaatggtgagataacaacactattaatacaatcattaggttatatatgcatgacatttatactattttaatttgtttatgtttatacgattatatattcgatgtttcggaagtgatgtgtcttatatgtttttaatttttctggtttttttcttcatatcgggttattatgggaaagataactggttgctatatcgatgtattgaaaataacctaaaaactaaatttagaataataagtaacgttgttttcgaatgatttccaaaaaatcggaatggaaataagaattaacttctcaacaacatgactctaagatctcaccaaaaataacaacatgactctaagaataagaatatcaatgcatcgttatatatatcagccagcaccaccataccatgaatgcatgatcaactataagtttataacagttcacatatccattaatctaaaagactaaaaccaagaatggatcaaggtagttccgtttaatttattgcctcaaccattaataccctcaagaaagcaaacacgttaaagaatttgatatatagtgatcaaacgagaaaaaaaaatggataccttatattacatagttgacaaaaaaaaagttggatataaaaatacaaaaggagacagattggcgttggacgagggaaggagctgtgggaggctcatgtgggcttcctctgttcgccatataactaatttcgattttagtgtatacgtatgcaattttttgtcacctatggccgttgtccctggatgatgaccatggcctacaagataaacaaagaaaaaaaaagatctgcagtgaataataaaagattcaaagtgttcaggtaatttggttgagtatgtgatgaaaattgtctaatggtttcaagaaaaaaaaatcaagtttttatttgaattttggatttttgaggaaaaaacatgtaaatacgctaaatgcaccaaagtgatgtttttcaacatcttgttaactgttattcggtagattaatttaaagtattttttttatgaaactccgatcgattaaccgccaaaataactttttatttacctccaagataccataatcattatccaccacattttcttaataattattattaagctctataattctgtaaaaaacccatttaaatacaaaagccgatttcttccaatctcaagttagagttttttctccattttgtttgcattctatatagtatcgtcacacaaaggtttcgtcttgtcactttactttgtttgcccccctttggttttttgtgcttcccttctcttttttttttgtttgacgacctgagggaataccttgatttgtagatttttatccattaatggaagataatcagcgaagcagattcagaaaaatctgtgtcttttgcggaagccactctggtcacagagaagttttcagtgatgctgccatcgaactcggcaatgaactcgtttgctctctatctctcttctcttcttcttttgattgcttcttgtttggttttgtgataaaaatatgaacttttcttcaaatcaatacagatatcaccttcgctcggtttttgaatgtcaaaatacgaactttttagtttacttgttcatttcaaacaatg

SEQ ID NO: 34716 - DNA, 3003 bp, Unknown
  misc_feature (1)..( 3003): 2750-1469P.txt file - cDNA_ID_3081617; gDNA_ID_2926222; Annot_ID_142450
aactgtgtttatcaaaccgtttattatcacccccgagaccgtgagacattaagtaactcagcaaagcgatttaaattcgcgatgtaataggaacaactgatctcatggagtcttggttacttgtactgatatcacctgactcatcatctttcttaggatccaatttaaagaatgagagaacgattgaagcaagctgatgctggtgagaagtgaactcatgatcagctccttcaataacatacagcttatgattctttatctgtttagcaaattcggacgcttctgttacatgcacaatcctatcatttgacccatggactgtcaagaccctgaaattttaagagaagcattagttcctctattagaatgaaaccaaaagagaaaaatccttatagagtatgatgatagacctgcagttttcacgaattgagagacatgcttcatgagcattggttgtgagacggtccattagactctcttctgttacccgatattcaaactttcctgcaacgacctcgaacagtaccggtaaatgccaaacaccatgtaacctggttctaacaatcataaaactaaaaagataaaagaattaccctttctgttgctaacatcaatgaatccattatctttgattctcttgaagtagtccttaccaagccgaaattcgattcctctgtcaagaaaaaaccgccctgagatattcacaacagtctgcacatcattgtactttgctgcatacaaaagcaccacatttccacctgcacaaaattcaatgacaacaacagcaaagctccagtcttcagatattctttcttgaattttctgaaacatgagatccacattagttttacgttcatatacctttactatgtccgataatcgcagaaatcacacggttaacaccacgcaagtgttgcaaaacagagcgcaaatcttcaacttcacggcgatagttaccatactgaaatgatccttggctttccctgaagttgagaaacatgagtgtaaaggcaaaaaaacaattcaaccagtttaaaagaaagaagagagatgttacaatttacccgttgccagcaaagtcaaaccggaaagaactgatcattgctctttcaaagaaacttgcaatggtcagcattggaatccgattctagaagtaaatttatgaaaggttacaatgtttagagaaaaccaatacaaattcaaatctcatggaatctaaaatgtgaatcaaaggaagttgaaaatgatgagaatggtacaaaaaaaaagacctttgatgaacgaaatccatggcagatgacaacagtctctgtagaaccagtatcatgcaaaactcctacgagtttctcaccatgactgttctcaattacaactctttggtgctgaatctctgcgcataatccaatcaccaacaatgttaaagcagatataaagcttgttctatgatcaatcaaacattgaaagccgaatacaatcaaattggtggttctaggaacaatttgaacataacctcacacatcaaaatcgcagtacaatccaaatgataagcgaatgtcagaatcagaagtgtatggatcacaattcaatggtacaactttagattttgaggggtcatgaatcgagaaaggagctgaagcctacctgatttttcgatttgttcatcgctagactgattccggcgagtctctgacatcgtcgcgcggaggagatacctcgaaaagcttaaagtgactcggaattttttcatattatataattccaactagtaaataattaatgtatgatatggtcaacgtaatttggattaggaagaaaatcaatattaatgtgtcgaatatagaaagtgactcttgggattttatcacaatttgttttttattttttttcgtttttagtacttgatcattttgatttgaggttataaatgaaatattttgtcaaaaataacactttcactttttgtgtaataaaaaataattattcgacggttcatgttattttgatctgaagttagaaaaggattattttatcaaaaaaaaaaaatgtataagtttcaaaataatactttccctttcagtgtaatgaaaaaattgtgtcaaaacatgacacaaatgatatctctttgttataatcacaaatttgaaggccttaaatgattgcatattgaaaggaaattccttacataaacaaagaccatcgaccaagttgattaaaagcatgactatttgttaatcaaacgcataaagtaaaatagctatgatatcaaatggcaaataatatgatatcaagtaaaaatagctagctatcagacaaaataatatgatactatttgttaaaaacaccctactattattattggtgtaattacttggtactaatcatgaaccccatattgttgttattggtgtgattacttggtgctttcaacgacttaaggattgagccatacgatcgatgccgtctcattctctttaatacaaactttaaagattagattattacaacttgaaagggtcttttcctcaaacaaagaccatccatatacaggtctatcatatactaaagaaaggataagtattttcataaacaatgactaaggaccacattgactaaaatataattaacaccacttgatgaagtttccgcaatgataatagaactcacatttagtgaataatccaaagaccttacctgtaatgtattagactattagtattaacaaagactggcgactgcaaagcttaattaataattataataaaaattcagtagagctaattaacaactatcagtgggtttcttccacgatacttcgagcttaagacaaaataagaagaatttgtcaatgtcaactccaatggcagtataagtacgatgaatttttctgatgactctataatcatttgatcttggcaagatctcgagagcatttataaagaaattaaagcaacacatacacacatcaatttcgtaatcgttgcagagtaagaccgatcatcgatg

SEQ ID NO: 34717 - DNA, 3003 bp, Unknown; identical to SEQ ID NO: 34716
  misc_feature (1)..( 3003): 2750-1469P.txt file - cDNA_ID_3081617; gDNA_ID_2926222; Annot_ID_203357

SEQ ID NO: 34718 - DNA, 3000 bp, Unknown; identical to SEQ ID NO: 28820
  misc_feature (1)..( 3000): 2750-1469P.txt file - cDNA_ID_3081621; gDNA_ID_2926222; Annot_ID_203356

SEQ ID NO: 34719 - DNA, 3003 bp, Unknown; identical to SEQ ID NO: 28819
  misc_feature (1)..( 3003): 2750-1469P.txt file - cDNA_ID_3081625; gDNA_ID_2926222; Annot_ID_203355

SEQ ID NO: 34720 - DNA, 3003 bp, Unknown
  misc_feature (1)..( 3003): 2750-1469P.txt file - cDNA_ID_3081627; gDNA_ID_2926222; Annot_ID_203354
aatcatgagaaccgcagcatctctgaatatatccacctgaaataaacagaacatacgtgaatatgcaaagctcaagactcaagagttaaaatttaagagattgattacattaaaacacaaattaaaaggaactatagtcggagttacctttgtaatggtagaaccaagatgacaatgagctccaacaagcttcagctctttgggatgtgccttcacttcatccagaaaccattgaagcttctcgttcctaataccaaacttcgagttcttgttcccagtagctacatatggatgcacctaaaatggtaacaaacagaaaaagctcattcatatccaagctaaagaatagattctaggacatgctgctaaaagattgaaaatttaaccatacctgaggatcaacatcaggattgatacgcaacaacacattgacctgcttaccagaaattcttgaagcttccacaatgttattcaagtcaaactcactatcaacatttacgaaaacaccttcttgagcagctagaactaaatcttccaaagactttccatttccattgaaaatacacctattcatttcatccacaccgaagacatggtcaaaaactacacatcaacatgagaccaaataaaaaaatattcaaactttattattggggataaagaatcgtactttgtgggatcgaaaccagcaagaagagcaagcctgagctcatttccactaaccaacacagcaccacagcccaaactcctcaaatgctccaaaatcttgagattgttattagctttaatagcgtaaccaataacagatctcactccttccaaagcctctttataagcctcaaggtttctcgtgatctgaggtttgctatataagtaaaagggtcgtttctcgactgtttccatgatatcttgaaccttggttccttcgcaatagagaaacccatctgatgatttcttgaaacagtggtcgaaagaggaagcagattctttcgtgagggttttggtggagttttgggaaacggcggctttgacggagaggcgtttaagtggcttcaatgttgacttgagagacaaaaatgggattcttgagagtgaagtctgattcaattggtactgatttagggttccgcggattgatgaaggttgggagagaaattgagtaactgccgccatggctggaggatttttgttaggtgtgcgactgttacagtaacactgaagggtttagaaaaaaaaagtcaacaagtttaagagtagttcctgtcgggtccggttttagatatccgacaatatcgaaccggtggttatagtcgaaccgatggttaaaagaagaaagaacaaagtcgattttaacttcttttggatatggtttttgtccttgggggatagtttctgctagtgtttgttttgttcggttgtgttagttgtgtgttgtaataatcttgatgcttaaggggtcacctaaagcagtcatggaaatctagccctatctataaaaatttgccatttctcatcacctaccaatacttctatttgttcgtattatgcggatattcagaggataatgtaaaacattttgttgaatgctaacgatgaagtgctctatctagccgtgcacgttgtggagaagttatgttttagaatccacatttgttgaagttatgcttatcatactctcttaattatctatatctattacaaagagcaaggaatgttcttagttaggatttgttttgtttggcaaccattgcttctggttatttgtgctctgcctcctttgtaagttaggatttgttttattcttacaactttgcttctctcgtcatactatataatctctgactatgtatgtaattgcattcatgtcgatggttgtgggatgtatatttaggtgtttgactgtaagacgttaaaaacaaactttaccataagttattgggatgtctagacacttttatggtttggtgaagtaggctcaatgttttgccctttatgtttccattgttgatgtttatgtaccttgctggttggaaccacttgtggatgtttccgacaatgcttctctgtaatgcagttatcttttaatgaaatgtgatcgatcttgagtgttatttatttttatttttttaaagactttatggtgtggacacttgaccgggtgataattggtaactatactacatagttagagagctcttgaattattaatcacgctaaatcttgggaattgagagctcggaagcaaaggttattaacaaaattcaaagcagagcagcattgccgatgaaataattattgacttgggatttactctctgaagtctgaaccaaatcgagattattctaattatatttttaatttcggatccctaatctattaatactccaatatctgcactcatttaattatttcctctttttttaacctgcactgacttaaattcaaacttatttcaattgcgtgcacactttagtgaactactaccactatcactatatgtgtcggtggattattatttccgtcattttgatatttaattacatctttaattgttactcttttttgcccattcttcttcttcatttgattacattatactctattgtgaattactaaattctgaaaacaagaaaaatttgagtacacaggacacatcttagtattactcgttactaaaatactacacgtgtaaataattttttcagaaataaatggggccactttgtaagtaataaatcagcttacattaattattttaccacccaataaaaagattccacagacttggcatggaagtcatgaacattcacaaaaatctaagaaaaactgaaaaccgaaaaaaaaacaaattattaaaaagcaataaataaataaactcagaaaaaaaagctattaagattccacaaaaactctgtattgtctctttctctctcactatctctctctcttttgtgagctcagatctgaccagagagaaagaaacaaccggagaagaagaagatg

SEQ ID NO: 34721 - DNA, 3000 bp, Unknown; identical to SEQ ID NO: 28818
  misc_feature (1)..( 3000): 2750-1469P.txt file - cDNA_ID_3081631; gDNA_ID_2926222; Annot_ID_203353

SEQ ID NO: 34722 - DNA, 3000 bp, Unknown; identical to SEQ ID NO: 28817
  misc_feature (1)..( 3000): 2750-1469P.txt file - cDNA_ID_3081638; gDNA_ID_2926222; Annot_ID_203351

SEQ ID NO: 34723 - DNA, 3000 bp, Unknown; identical to SEQ ID NO: 28816
  misc_feature (1)..( 3000): 2750-1469P.txt file - cDNA_ID_3081642; gDNA_ID_2926222; Annot_ID_203350

SEQ ID NO: 34724 - DNA, 3000 bp, Unknown; identical to SEQ ID NO: 28815
  misc_feature (1)..( 3000): 2750-1469P.txt file - cDNA_ID_3081646; gDNA_ID_2926222; Annot_ID_203349

SEQ ID NO: 34725 - DNA, 3000 bp, Unknown; identical to SEQ ID NO: 28828
  misc_feature (1)..( 3000): 2750-1469P.txt file - cDNA_ID_3081661; gDNA_ID_2926223; Annot_ID_203408

SEQ ID NO: 34726 - DNA, 3003 bp, Unknown
  misc_feature (1)..( 3003): 2750-1469P.txt file - cDNA_ID_3081672; gDNA_ID_2926223; Annot_ID_142475
agccccacccgtttatatttttcgttcataaaaaatttagtggatcggttcaagttgtatccgactcatacattggatattcgatatttaatagtatatatgtttagaagatttgattaagatttaaatttatgattcttctatcattttatttcattttaaaaaaaaaactattttcaataatcatgtgatatataaagtaaacagaaaattaattttttttttactttatattatgatttgaaattttaaaaacaaacatatattactcaattgaaaaaaattgtgtatcaacgtttcacattgactaaaatatttagataataattcaaaatcatgaatcagattaacattagtaaaagaaataggatacacaagtgagttcttcaaggcgtcttggtccattgtagggaatgacttcatagctgcaattcaatcttttttcatcaaagggtttttaccaaagggtttaaacactacaatcttggttcttgtaccaaaaacaaaggacgcaatgatgatggaggattatcgtcctgtttcgtgctgcaatgtcgtatacaatgtcgataattgcggtgggctttttaaattgcatttacattgcatatttttggtgtgtttttgtattttttgacttatagttcggatggtcgttgttgtgatcctaactttaaagcggggacttttcgtgattatgatcccattagtagagtggagactggtccgattgagagttgggacatccggtataacacccgtgcttcatatgctcataagattttacggctcgtgtccacaaaatcattggaccttttttttgtatttatctctttgtcccttttacatagatcccattttgatcttacaaggtgaatatttaatgggaataaaatgaaggaaaattaatttgaataacaatggagcatttattggtatggccgtatgatgtttcaagccgcgtaaaatgtttaaaattttgatagtcacaaaacaaaacactgccgtaacaatttgataaaatcaaacggaccatcgctgattacgtaggagagccacatgggctcctttgaaacttataccacatgcaaaggaataaaagtcctttagtcaaatatacacatgtatcatgcactaattttatttatcaatcatattcataattcaatatgcaaactactattgggcatgagtttttttttgttcttctactgttgtcgcatgttgacccatattatctactatttatagaagaagctaatgtatcgttctctaaatcaattaagaaaattagttttacaatttaataatccttggaataagaaaaattaaacatttgttccttaagaaactgagtttctttcatcatgagttatatggttttaattttataaggtaacgaatatataatctcttaagaaagaaaaaaacctacaaaagtttcatacttactaaatttaataaggagtgcttatattactcttacacttaaatttcttaatcgatcgacttagagaggaaaacttacaaaaattgaaaattttcatacagattaattgtattaataataaaattttattcaaaagaataatcattaattctaaccaccggtattaatgaaaaagatagtaaaatttggtagtactatgttgataataccccatttactaaactcaccattcaatttttgttctttccttttgtattaactatgtatcttttaataaagtaaaatgtattgtatattgttcttagaaactaatattttactttaaatttggggttttgtttaaaattgtacatatagaattacatatatataattttcttccattctaaaactcatttatacatttaacatttgaagcatgatcatttttaatttttatcagttaaaagttgaagtatatttttgtaatattatattattattttaccatctcatttattttacatatttcgtttttaatttagttaaatatttttattaattataaataacataaatatgcactaaatgaatattttaaattttgttttaatttaaattaaatagtgatgtttagaagagtgcttaggtggatgcttaggtggataggctagatggagaaagtattatcctcttatacataaaatatgatgcatagtcggtgattcgtctatgtttaaaagacatggagctgaacaaatagattgtgttgttttcaaacaaattgcccaaaatcttgcaaccagaaaacaaaactgtaccaagtcataatttgtcctcagccggctatcaagaacctttctttacaccttcatagttagctggcatatttatgatgtctgattttatttttgttatatatataatgtacggatttaaatcaagaaaataaaaataatctcgttatgaaacatttaattaactgaaaaacattctcagtgttttcttctttcagattttattcagtttctatgattttttttttttgttcaaccatactttaaattaaaccttacgaagaggttgatactaggactcagcctctgaattagatcccctagggatgaaaacacaagaaaaaaaaccccaagtttttcaatgcacaaaaaaatatctgacaaaacacgatgcagtttcgataaaaaggtcttcgacttgacttgctgaccgggacacaatctgacaatgtttgccacaaagaaaatactataactttaataataccgaatttttaagatcaaatagttaaagaaaacaaaaatcagaaagacatgatttgccgttttgcgttgtcagcacggatcaaaccttgtagaaaattagaggatactggtcttacttattttactaaaattagaattattggaggatattatagactttcctgttcgtactacgtcgtttacaactataaattcccttccacttcttctttgcaacatatactcatttcttctttgttagtgacaaaaaaaaaatcatttcctcagagttagaccaaagtccaaacaatg

SEQ ID NO: 34727 - DNA, 3003 bp, Unknown; identical to SEQ ID NO: 34726
  misc_feature (1)..( 3003): 2750-1469P.txt file - cDNA_ID_3081672; gDNA_ID_2926223; Annot_ID_203404

SEQ ID NO: 34728 - DNA, 3003 bp, Unknown; identical to SEQ ID NO: 28827
  misc_feature (1)..( 3003): 2750-1469P.txt file - cDNA_ID_3081676; gDNA_ID_2926223; Annot_ID_203402

SEQ ID NO: 34729 - DNA, 3003 bp, Unknown
  misc_feature (1)..( 3003): 2750-1469P.txt file - cDNA_ID_3081680; gDNA_ID_2926223; Annot_ID_142473
aattggctctgatcctccagccatgacagctactactcctatgactatagacaatgacaaaccagtctctctggagaatccagcggctttggatataggtgtgtgtgagaaaacgggttctgaggaccgggataaacaagaccagaactcaagagactcgggctcttgaacttctctcgatgttttgtttttgtatatcaagctcagagagctgtgtaaagcttctcagttaggcgttgttaaagattgatagcagagaaaaaggatgagatgtaacagagggatgttgagagtctctcaggttagttatatagtgacccggtttgggttttttttttttgtttttgttagttttcttacttttcaaaattaacaatattttgtatcaatccatttatgtttctctttttgttgtgttttaatcaagttttaccattttagaatataatgtttctaaatataacatatactaaaatccttcttgaaggtcaagcctattctctttttaaggtgaaagaaaaatgtgaccaaggttgattctggaccattattagagatatgtttcgtactcaaatcaatctagcaacattaacaaaacgtttgtgggaggcttcttttgttttatttgagccttcatttcaaacccaaatattgtctcatgagaagcccactacatttttcattaggtgctcttattcagggaacctatgtccgaactccgaattggcttgatatgtccgatgcatttagacaaaaatcaaattgttttgaatatcatcgctggcttcttcatattttgttgttcaaaagaaaagttgtttgttgtacagtgaatatttgtatggccacaatcagatttagtttgatattatcaattattcaaatttatgcagaattttcttcaagttacatacatggcttgtatgcatattcttccgtagcagttctaaccccgacataagggatagggcagcggtgtatggacctcatatttaatattaaaaaattataaaaaaattgttagtggtataaaatactctcgaaaatataaatacatttttttttgtcacaataatacatatttatatttgcaaatatagaattttatttaaataacaagactaaaatcttcttttttttccctaaggctctttttacagttgggccggggctgatcagttcgctattgaagtatacatgtcaaagaaaatgaaggagaataaaccatcgtattaattaaatcgatttgactaatgagacaacttaattcagctttaatatagtttaaatttcgtacatgaccaggtaatcaaattttctaaacaaatggaacaatatcagatagggtaaactgttaccatctgtgtaactttgcaaattagtaagtctaaattataagaaacgatgacttgtacttctaaaactccagcatatcatataaaattttgaggtttgagacatttctataagttcagatttaattcttcctaacgtatgaggttaggtattttctgtcgctttaccaaaaaatttgacgtttcccatacgttttagcttgttatgtcattgttgcataatttatgaccaaccaaacctaagaccaaatcaggtttttagatagtccttttttcctttgaaattataagatgttttggttgtattggcatagattacaaaaattactccccccattttagattagctgtcgttgaagatttttacagaataataaaaaaacattcaatttttctgttttaccctaattaatgtattgttatatttgatatcatcaataaatacgtttaaaaatgttgataaaattggaaactttgtcaaacatctgcattgtaatatataatctaaaaaaaatgatttcttatattctatcaaatatggctaactatacacatataatttgggctgagctgtcatctttcgacatgaaattactccgaattatacataatttgccagagaagttatgttacataacaacactcatattcaaaagaaaactagatgtataatgtattagctattatttaagtaacactaacaactaaataaaatagaatggatgaaactataaaaaattaagaattattattgaatgagtatatttttttctattttggtcaaacgtcgaggtggagtttaagaaaatcgtgattctaaaatagtgcaataatgaaatattaaaaaatcacgttatcatcttgttcttttattttccactattttctcttgaaatttaaatgaaatatgttattttccaaaatgttgttacaaccgatttactatctcataaatatgttcttttgtgattttaatttttgtattattaatgttcccctgctttttgttgactaaacaactcgttactcgttagatatatattcacgttgagaaaaaagcgtttaaccaaaacacttaggtatattgaagagttctaaaattagaacgccaaccttccaaatcaacacacctacgacaattctagtcctacaacatagatccttctagcaaaccacaaggaaacttcttgtggaaaacactaacactatcctcactcagttactctcgtattgctctacctagagtttctaattctgctatgttataaaaattcttacatacttattcttttttttctttctaaacattccattcgttttaaaagctaggcccacgattagtagttaaaatattttaatttttaaaaatatgggttacatattttttattctttttagagctccgagatttcagagcatgttctaattggatatgtgatatttaatcagaagtagttttaatattgttttttttttataaaagaaaatgtaggtaggtttacgtacaagtagtagatatgatggctcaacaaaacgggtcaacatttacgggtctatatatattcgtgcctcatcgccgaaggtgttatggttcaaaacaatctatcgtacttagttattaattggatagatataagtttcttcaatg

SEQ ID NO: 34730 - DNA, 3003 bp, Unknown; identical to SEQ ID NO: 34729
  misc_feature (1)..( 3003): 2750-1469P.txt file - cDNA_ID_3081680; gDNA_ID_2926223; Annot_ID_203400

SEQ ID NO: 34731 - DNA, 3000 bp, Unknown
  misc_feature (1)..( 3000): 2750-1469P.txt file - cDNA_ID_3081688; gDNA_ID_2926223; Annot_ID_142470
tctcaacttggccgatctaccaatctagagactgtggatcgtttatgaaatttcctccgatctttgacctcccatcctccgtgcacaacttctttatctagaacgtgggacgaagcaaatgaatatcacaaaatattgcaaagcggagaggaagagtaggatcaggcccggcccaaggctaaagctcatgaagctgatgctttaggcatcacagatatattgtaaaagttgaggacatcattccaaatttaacttgtggcatagtggtacaactgtactaaaacgtccacgagatgactggttcgtgttctttattttcctttttttggatttttcatttaagttttgtttgttagtgggcttaaaaaaaattttgctttaggcatggaaattgtttgggccggcccttagtaggatgttagccaaaaaaagaaaagaaattaagcttaatgaaaaatatgatacacactagaattggattctcaacccttaggccttggtgcatggctggcttagaataatttcaaacctaaaaaaagaaaaaatatatttaggtttatctacaaagacaatatataattaaattgtataaaagtttttgaatgattttattttaaagtttggcatttttatagtggaaagggtttggagttaactagtattacaccacaactatggtcctaaaagcaatactagtgttctcggttgatagttttaagtcagggcccggatttgcctaagtgaattgccatgagagcaacccaaatggagcactaattttgaacactcgttttacagctttttttttaccgcaccattaattatttacgaaaccgcctaagcaacactaaacaattctgaaccgatgaagactgatgtgaatatctatactaagataactattgatttgagtgaatatgtgttcaattctttaaattgtcctttctttctctggccccctggctttctccttcaaagtagtagtccgaatattccagtgattcttgaaatattctattaaaaagattcataatcgaaccaataagggaaaaccaattatgtttatataaaataaaataatactattcaaccgtttaataattagaataatgattctactaacaattccagctagatctaccttccctccttgtcctaatgcttaacatattcttcttgatcttcttcgtttttcttcttcacaaggtcaacaacaatggaggaacatcttcaaggaagaatcaaacttcacgatggtagatacttggcctacaaggaaagaggtgtccccaaggatgatgcaaagttcacgatcgttcttgttcatggatttggtagctccaaggatatgaacttcaatgtctcacaagtatacactgatcctttatttccttgatcctctcgattcctatattatatatttttctgagtccttgatccaaaatttgtagttttaatcacatatatccaaaagtatgtgcttcaaattctgctttcttttttgtgttcagcatcgttagtttccattccattacaagattcaagaaactgacttctggagatcacatatgattttgtaattgtaatctttaatgtggaatgtttgaaaaattagatgtctgaaaagctaaattatttttcaagtttctaaagattaaacaagcaaaaaaagttagaaaaagagatgttgttagagatatggttgaagactaatgaggcttgttttagttataatctcaggagcttgtgaatgaaattggtatatactttgtgctatatgatcgagctggttacggagagagcgacccgaatcctaaacgttcgttgaagagtgaagcctacgatgttcaggaactggcggatggtttagagatcggatccaggttttatttgattggaatttcaatgggttcctacactgtttggagctgccttaaacatattcctcaaaggtaaagaaatcaaatcgattaaattaattataaattaatttatttataatgcattcaagtcttgcaagccaaagccacatgttgcaaaaaataattgcttgaagattggataaaaattgtcagagcaaacgttcaaattcatattgtaggatcaactgctttttaatctttgttgacataatcttttcttgctctagatttaaatcttcaaaatagcacataattgtttttttacctagctagcaaacataattctgttcaactaagtactaacggtttagaccatctctaatgtaaatctctattttttcttctaaaatagagtaactctaaaatagaacataattctctccgatatatcactatatgttactctaaaatataaatagtgtaaaaaaatagagttactctatatatatagagcaatcatattatttactctattttagagcaggcccgactctaggggtgtgtcagaggtgccaatacagagggtcctcatatttatttcttaatttttgtgttatagtaataggtttagaagaagaatacaataaatatatgtcacataagattattttgtttagatttaagggtttaaagatggtcattttttttgtagcacagggcccaataaaatattgagccggacctgttttagagtaacatatagagtgagattggagaaaatttattctaaaatagagtggatttggagatgctggtagaggaactctattttagaagtcttactagttagaaatattttagtctggttcatactatataatttttactagtacatacaaaaacaaatctcgaatcaatcaggcttgaatagtagactcgtagttagtacattgctttacaccttttgagttatgattagtgtacttttccggattgaaccgattgatttgagccgttaactaaagaacttgttaagaaaaaaaaaacagaaatcttcaagaataatatttatattaaaatcagaattgtaaagtttcataaacatatgaaattgaacaggttagcaggagtggcaatg

SEQ ID NO: 34732 - DNA, 3000 bp, Unknown; identical to SEQ ID NO: 28826
  misc_feature (1)..( 3000): 2750-1469P.txt file - cDNA_ID_3081688; gDNA_ID_2926223; Annot_ID_203398

SEQ ID NO: 34733 - DNA, 3003 bp, Unknown
  misc_feature (1)..( 3003): 2750-1469P.txt file - cDNA_ID_3081698; gDNA_ID_2926223; Annot_ID_142468
ttgtttctgaccaaaggcattcatacagaagatttgaaaagcctcgtcatttgatggatattcgaccttgtaaacatgattgatcccatgagccttcaaaactcctagatcttctgttgtgataataatccgacttccaggaccaaaccatcgagtttctttcgccaaggcatctagttgtcctaattgatccacttcatcgagaacaagaaacactttcttgtctctcaaccgttcttgagccactcctaaatgagaaatcatgatatctttatgattgatcatctgggacaacatttggttttgtagttgcaattgtgcactgtactcatcgaaacaaggtcttggatagcatcctttgatattgaccatgattgcactaagttggaatctgtcggagacttgattaaacagaaatctggcgatagttgtcttaccaatcccaggcggtccccaaatcccgatcatccttacttcatccaaatctaggcgcaacaattgttccagcatatccatatgagctctcatccctactaacccgtcgaaatctcttgatggtgtgaaactatttaacatgtttgaaacatcagtggatattttctcaatcatgtctgcttcattcctcctgacaatagaggatagatatcaaatcaatatacaatcgttgcgataaaatggtcacgaagatctgaaagaatacactttaacaaggaaatattaattaaggagaatataaatcaagaagacaaaccagctgtgagaatgatatccggcgattgttgccacatcctccaaagcttttctccatctctcaacttgctcttttggtttacctctacatgtttttgtgaaggcttttccaaattcaccggtctgtttctttatgtcagttggatcaacttcatagaaaatggtcatgacaatctgacccaccatttgcctgcatttcatgatctcggccaactcatcaagacaccaagacgaagaagcatattttcttgagagcaaaacgattgcgatctttgatcctttgatagcttctttgagctcaggaccgatcgacttactcctctctatattattatcaatgaatgtgtcaattccctttcttctgaacgattccatgatgtgactaagaaaggttcttcggacatctgctccgtggaagctcgggaagacatcgtgtttccagtttcgagacacagaagttgcaggggagggaagagataaagaagaagaattactttcttggttatcttgttggaatctgaaatttgttaaagctacggctgccactgagccaagggaaataagaataattcattagtatggtaaagagtggatcaagatttaagatggcctttatgtgaatggatacagaccactgatgactctgttggcacataaactccatggatgtttccaagatgactcatcctgaatgaatctgcaattctcagcatcgtttgttgagcatatctttcgtcttttacgagattcggaatcaacatcctgatttgttgctttcctcttggaacagcccaagctcattacagaacccatgagaactttgattatcgaagaatcaagaaattaatataaaatcaagaacacataatcaagaaatgagctcaaaacactaatcaaagcatcaatatcagcataatcatcaagagccagtccaatcaattcgattccacagtgataaaaccttaagcaaaacttaaaaatagttggaaaatctcaccgatacatgaaaggatgagaaatctctagagagttgaagaatcacacgggtttagtggaatttttgtagttgaaacgatttgtgtgactgaagatatagatcgttgacgactctaaactccatggatgtttcctggaaaatatagtgagattttgtggaaaatattgcaaacgacaaaattactgtccctatgctccaccattcactgtctcaaacaaagttacgtccacacaatatatatttttttctttctatttctctcctaataataataatgataaaacaaaagagttaatatcattcaatcttgtaaagagttcatatcattcaatcgtgtaaagagttcagtttaacaagatttatatcagcaagtttcaagcttcacatcatttttctgttataatactgtccagcaaagactcacaagcatcttctagcaagtccagtacctatgaaagaaacaggtagacaagtaacagatcaagattcaactttcgaagtgacttttgtcctaacaaaatagatcaaacaggaaatataagcattcccccttgcaaaattctcgaacggaaggcaatttgggagtgacaacaatggtatgctaatgccatagtaaagtcttataaaccaaatcaaccattttgaaaagacaacatagctgaaattttataggtagcatctgcctaaaccaaaaagttactaatccacaactggcttagtctctaatggtaattaccttctcaaaaccttgagctccaccatcatatggatcaggaacaaacttgcattgtgtttcttgcaatacgaacacattagcttaacctgaaaactcaatgaaagtgttctaaaaagagttccaaagtccagcaaacaacaacaaacaacaacggtaccttcttatctgcatcgggtgggattccctctcgctttccacacattataagccttcaatatatcctctgcaaacatcaaacattcatactcacattagctagacctaaaaattcaatgaaaatgctctgaaaaatctcctaaaaagagttccaaagtccagcaaaaaccaaaaaaacactaacggtaccttcttatctgcctctggctttccacacattataagcctttaatatatcctctacaaacattcaaactcatattatcgactaggatgctttaatctctctattgatggtgctttttcttcttgtaatcaaaaatctcccgtttgctaatttctttgcgaatcgggttttgaaatg

SEQ ID NO: 34734 - DNA, 3003 bp, Unknown; identical to SEQ ID NO: 34733
  misc_feature (1)..( 3003): 2750-1469P.txt file - cDNA_ID_3081698; gDNA_ID_2926223; Annot_ID_203395

SEQ ID NO: 34735 - DNA, 3000 bp, Unknown; identical to SEQ ID NO: 28825
  misc_feature (1)..( 3000): 2750-1469P.txt file - cDNA_ID_3081701; gDNA_ID_2926223; Annot_ID_203394

SEQ ID NO: 34736 - DNA, 3003 bp, Unknown; identical to SEQ ID NO: 28831
  misc_feature (1)..( 3003): 2750-1469P.txt file - cDNA_ID_3081744; gDNA_ID_1620310; Annot_ID_152946

SEQ ID NO: 34737 - DNA, 3003 bp, Unknown; identical to SEQ ID NO: 28831
  misc_feature (1)..( 3003): 2750-1469P.txt file - cDNA_ID_3081744; gDNA_ID_2926224; Annot_ID_203429

SEQ ID NO: 34738 - DNA, 3003 bp, Unknown
  misc_feature (1)..( 3003): 2750-1469P.txt file - cDNA_ID_3081752; gDNA_ID_2926224; Annot_ID_142492
taattctaccaaaaaaaacttagttaaacgaaaaaaatattttcataatcaaaaaatagtttacataataaagatattgaaaaaacaataaaaattaatctaaacattacttccatgataagagattgaactaataacatctcttacagacccatcggatgaaactaataacacctctcacggacccatcagcatcggatgaaactaataacacctctcacggatccatcagatgggacggggtgcttagtccggtttatttttaatgcattgaaattcaacatttagattttttgaaaaccaaattattttatataataaaacaaattgttgacaataatcaaaaatataactaaaaagatagtttacataataagaatattttaaaaaaaccataaaattaatcttagtgttaaatttacttgcgtgaaaagcggttgacctaataacacggcttaaggacccgtaggatgggacggcatgcttagtccgatttgttctcaatgcattgaaatttaacacttcgattttttaaaaaccaaaataatttatacactaacaacgtttagttaaaaaaaatatatacattttatataattaaaaagatagtttacataataagaatatttttaaaaaactataaaaattaatcttagtgttaaatttacttgcgtgaaaagcggttgaactaataacacgacttaaggacccgtaggatggcacggcatgcttaatccggtttgttctcaatgcattgaaatttaacacttagttttttttaaaaccaaaatagtttataaaactttagttataataaaacaaaacaaaaaaagcatattcaaaaatataattaaaacatagttatttaataaaaaaataatttgcttaaggagagagaatgataccaatttatgatcgagattgaagcattcttgtgttatcaaacattcagaagaaccctagatttgaagaagaacggaagataaaataccacggaagagaggaaactactttctgcgtttaatgtctcgttacaataatcctgcataaaatagagcccaagtaggaaagttaattgaagatgaacagctgatgataccaattcacaacgaatcagaatcaaatctcaaaaataattttaaataaaaaaatctcttaccataagtttttggatttaaaggatccgggagaatcgtcgtccttgcttttgcttaaagcagaaacctagatgaatcatacctgttgacgtgcaaaaatcagaaaacagagtcacgtaacgataaaaagagaatcgatgaaccctagaagaccccaacatatatgaatcatcaacgacggagtgaaatagagagagagataatgaatttaagttaacctgatcgtagagatggctctctcagactgagatcgctgatcctttagtcaatcagaataagagaattagagagaatgaagacgacgaacaagtgtaagaaattgttgttgcaaaaattgtaatattggggataaatagaagcatagcattagtaaaaaagaaaaaaggaaataacaggagcgtggaaaatcactaacgttaataattggagtcaaatcaaccgactctaccaattaataaatatagcattcagttctctctctctagtcgccgccgcaaaccagaccccttttccaaacgccttttgcctctccggtgatcggcttcggccggcgccgtgagagggcttctcttcctctcttctctttttagtttttcttttttctttgtgtcgttttcttttagtcagcggcggctcctccttctttgtggcttaatcagagacttttaagctgacggcgagcggttgttgttctctcagatggaggttcgttggtggatctacaatggggaacattggctctcgacgactgcagcagatctgatggtttccttcttcagccccttcacggaggtacctctcctccgatgagcctccttggtggtggtggttcagtgttaagaaggtacagagggaggtggatcgtggttttcgagcttggctgtgaagatcttaccgatcctgggcagatttacatgtttcaaggccttctagctatgctgccgccaacgactcctaatggaaaaataatttgaagtgggagagaaaagaaaaccatttggatggttgaagaagaaggaaagctctccaataaagccccggcttcaagaacttttgtctcagcccggtattcggttgagtttcagtcggattagtatatccgttttaggcttaggaccgaaatagtgaaagccaaggagtcaaaacctttctgaagttgcgcttttggcgtagatgctattaggacacgttctacactcggatcttgagggactaatagcttggaattggattggatctcaggataggatttgatgtgctttgtgttagtaattgtttttgtgtcattgggtgaatttaggtggtttaagagatgatttcacttagagtcgtggtgtaatttatctcgttatggttgaaaaaatacagtgaatttcagttgggtaacgttgaatccatcttagtgtttcagggtgatactagactgattcattgtatttggttaaaatatgttgtggtctaatgatttgtacctttgaattggttaatggaaagttgttgttgagccaaaaaaaaataaaaaaaaatcaaccgactctgctaagaaaaggaaaatcagtcgattactaacggctacttatggaaacaaatggaaattaaccgactttaattttaagctaacagtaaaaaaaacactgacgttatatgttgaaaatttgaaataaccgactttggtttattatttgtatcatcactattcaaattacctttacggcccaactaaataatatagggctttgaagaagcccatctagaagttaatataaattaagtttttaagggcacaagaatgacgtcatattagtaaaccccaattacaactctgattctccttcccggcgatatg

SEQ ID NO: 34739 - DNA, 3003 bp, Unknown; identical to SEQ ID NO: 34738
  misc_feature (1)..( 3003): 2750-1469P.txt file - cDNA_ID_3081752; gDNA_ID_2926224; Annot_ID_203425

SEQ ID NO: 34740 - DNA, 3003 bp, Unknown; identical to SEQ ID NO: 28830
  misc_feature (1)..( 3003): 2750-1469P.txt file - cDNA_ID_3081757; gDNA_ID_2926224; Annot_ID_203423

SEQ ID NO: 34741 - DNA, 3000 bp, Unknown; identical to SEQ ID NO: 28829
  misc_feature (1)..( 3000): 2750-1469P.txt file - cDNA_ID_3081767; gDNA_ID_2926224; Annot_ID_203420

SEQ ID NO: 34742 - DNA, 3000 bp, Unknown
  misc_feature (1)..( 3000): 2750-1469P.txt file - cDNA_ID_3081816; gDNA_ID_2926225; Annot_ID_203473
aaaaaatgacataatacttggccattaatacatttaacaccaaaaccaaatcctttatctcatcatttgcacaaaacacacagaatttgaagacgaaactattgtcagctcaagtgaaggtattgctattagcacgcaacaagtgatactagtatttaggggctgaagactgaagacaatctttcataatctcctgaatccttctctgcaacaccttgtccttaactctaccaatcatgtcttcatagaaagcttgaagcctcatcagctgactcttatcagcactctccagcatctctccccactcttttcccatatcgaaatacccagaaacccgtaatgaatatgggatatcttcctcttcattaaaaggttttccgaatatggatccatgaagtatgcttgcatatctttccatcaccattagttttgattctagccgtttaatctcctcagttgatgcgctttttccatcatcgggtacttcttctttctcaggtttcagctcattcggccagaagacgagagtagggacataacagtcgctaacattcccagttccgagcactccatttcttcctcttccccaagaccacagcttgtaaccaccatctaccacaagaactgtatgtgcagccccgcaagaaacctgaaccgggtcacgaaatcttgacgacccacctgaaatctttcttggtacactatcatctcctgcttccacctctgtgaagttgacatcggggcataatcctaatcctctttccattccccacgaccacacgtatccctcagaggacaccacgcttgtgtggaataatccacagtctacagaaactaagtaagcgtgttctgggagatctgaaactggctctggaagcgatgagctcttgttacttctatgcccaagctgaccattttctccaaagccgaacgtccagcaaatgcttggtcctttaggtgtctccttcctgtaggtgagaagagctgtgtgatgagcaccacaagctatgtcgtagactgtaagacccgacttctggttaaatgtctccacagtctgaggccttgcacggctctctccatctccaagtcctaactggccatgatgattatttccccaagaatacagcacggatacatcataactgttgtctttgtggatatccccaggaccaacgagggcaacaacgtgttcatccccacatgctaccttcaaaaccgtccggccatggaagtcgagtataggaaatggaatcgggatgctagtaaaagacaaacgagggtcaggttcactgtcttgtggaggaacattgccccacatccaaagacctccgacattatcaatggcaagagacatcatggagccagcctttacagtacaaacctacaagacataccgaaaatcattatgctacacttttttttacttgtaaaccaacacctaagaatgcatttctaggaccatacctttaaatctgatccaacttctctacctgaatcatttagagaagaactagatgtttctcgttcaaacaaatttttgatcaagcatggtgccaaggagttttccccatcaaaaccaagttggccatctatttaccagtcaaggattgaagcaaccaatggagagttcaggacactagaaaatgtagttatgaaacaatcatatcaagctagaaacactcagataaaggatacaaatgttgtaaccccaacaccaaaccgagccatcatctgccaaaagcttacaaggcaaaagaaacaaaaggcaagagaatggtcaatacagatccatatcataaacatacaaagtaaaacctatagtcacaattcaagcatatttattatttctcaaaaggaagttcatagatgcaaacaaaggaactaatttgatcaaacaaaatctttgatcatcacagtcaccaatttctcaaaataaatcatatggtcaaatcagcaacacaagctaatagaaaagcgaaattagacatatgaatagaagaaaccacctgagacagcgagactgtgataagcaccagcagcaacaccaacgattcgaatccgatctccttccgcttgatttgggaactcgactagaactggaacaagctcgtccgactccttacccgtaccgagacggccaaacattcctcttccccatgagtaaacacatccatcgcctgcaaataaattccaaagaacaaaattaaactcaatatcgcatttctctatctactaaattgaagcagtggaactttttattttaccggtcagagcgattgtatgagcttcaccggcggcaagagagattattttccgggataaatcttcagaaatcagtaacgtcggtgatttgtcctccattgccactgtgacggataaggttcgtcctcagttgctttctaaaataaggcttcaccgatcatcagcactctgtgcttaaaaaagttaaaatatcttcagtctcagtcttagcagcaaactcaagatgtagcctgttttctactttatttacatgggcctataagtttaaataggcccattaataaattatccgacccataattagtctttagtaaacagttttattcaacgaaaaaatagtaaacatgattttgaaaagaaatctgttattgtgtcgttgttctctcaagtctttattcgtaaatgagcctatgaatgttggataaataaataaaattatgattttcgtggagaaagcatatatcttagttcttttctataagattcatgccgcaaacaaacgaaaaaggagaacaaaactttaatttcttattccttataataaaactttaaaaatatttccatggaccttgtttaggttaggtaggatacttacttttgttttcaattagatatcgttaaaatgatttttctgatcgctaatctgatcgcgacatgggaacaacgtcataacataaggcatatattatcaaaaccaccaagagtaaaaaaaccttcaagagaaagagactgaaaatg

SEQ ID NO: 34743 - DNA, 3000 bp, Unknown
  misc_feature (1)..( 3000): 2750-1469P.txt file - cDNA_ID_3081820; gDNA_ID_2926225; Annot_ID_142522
ggaaagacgtatttgactgttagcaacgaactgagctataaattttaacgatacaagatggtataccgtatacctaagcaggaaaccattttttattggatgattttacgatgagaactcatgaggtaaccatatatgcagtactcctagtgtcctatgtacctagtctctcaagcatgaaacatcgccgggtagagatttaagctaagtaaccagattatatggtataatgaagtttcatacgattggttttgagttgaattttataggtttttgattaattgaaaactgattgtcaaggactagattaatttcgatttttgtgtagaattctaatgtctcctcgaagaaagactcttatcatttaatctcgatatctcactcaaacctatattaaacttatttagataaaataattaagcttcatgaatttccaattcagaatcatttcaaaattatttgcaataagttgacttcgacatgcatattatgtttagttccttcaaactcccaaaatgattccgatcatatgtattgtttttttttttttctctttatttggtcaattataatatgtttagaaaaacctcatgtgtttttgcatgttcatggattggtcattttcattaactattggcatgaacatgtgaggtggtctctatctatacttgggaggcatctctacgataccagaacatcgccaggtcaagtcatagcaactctgatgctactatataatatatatgtacatatatatatatattacaagtagtagaaccttatatgaattttactctaattaatgttacaagcctacttaaaaaaatcaataatcacaaaggtagaagcttataacacgaattaatcatacataatctttgctctgactatcaaactggtataaacgagtacgtattgttcaataagaagtgacacctgacatatatataccaacattgtttgaactttgaactagcacacgtttacatacacataatttaaaaatgcatattcaacttaaccaggtgcggtagtgtaaatagcaaaatagtgatataggttttcatcaaaactgtttttaagcataaaagtaaccatgatctactgatctagaagcatgcatgatcagtattaatgaccaaatattactttaaactattgatacaattatatatgaccaacaatagtagtcgatccaaagtccaaaccataatttggtttgcggtaataccggtcaatgaggtattgaggtgctacaatattaccatatgtaacaggcctataacgtttgtctaacacagcatatatataacctccaaatagaacaaaaaagatcgtttaatatatagaatttttatcactccatactagtttggcagaattaggatcactcaacagataagtaaatagcatcgagtagcgagaattaccattaatcagcggatactagttaggaacaaaaaaccaccacatatcataagtatacttctttcttcttacagaaatgaagtactctacgtcaaactctagaacacccaaacgacgtaaagactttttgcattgtctaaatttctaaatatactaaaatggttttatctataattaatgcttgaattaatcttacaccatctatcacaaaaaatgttgtattttgtatgttttatgactggagctggtcaagctctccaaattattgagtcctaaagaaaattaatttcttcaaaattgacataatagtattggtttaaaattttaataatctaaattctaatttgataaaattattttgattatattaatccgatttaatgactgtctacgtttgagaaaagctctaattctaagattttagaccgtcatgatcctttggcttagcggatccgaccgttaaatagggttatatctatatgagtcaggccaactcagtgatcaactttttaaaagaataaaatcggtcctacaaaagctggaccgaattggcatgagggttttgttcccaccagaacatcttttattatacacgtatcggtcattcggttggcgagggggaacaacgactttagagggtttggttgcctgttactccatgataataatggtattgtaccaattttttaagtcgtaaccaactaaaatatagtattggattatctactctataatattctgattctcaaaactttctgaatagtaatcaccaatgtcaaggaattgtaatcataaccctcactcaaatgcttaactatgttagtcctgaaattatataatatctccagtacatatatcgattattttacgtaccggtgttattcacgttatcgctatacgttatcaatatcaattatttttgatgatgtcaactaaaatagatatcatcgattttattcaactgatgttggattacataataacttatagctagtatcaactttcttttcttttcaaattagtataaaccatagttaaactaattataagcatcagtagtctttttacgctttaaaaccaaacactacatgctttcccttgttgtacttttttgtcagatcaattattttgtcaatttccgcctttttctctttaaccccactgtttttcatctattacaccaacatctatacaagtgtatctatacatatattttatgaatgatgatgacatacttagtgggtattatatttcagatcttaaccctacattattttccataatttaggttttgacccagatcttataatacgaatttttaattcctagcctcttaggataaatcaacggcgacaaaaaaggacaagtcacactatacaatatccttaattccttaccaaaaacataagatacatcatatacttaaatataaaaagatccggcaatattgatttccttctaagcaatattttcaatcttcaaacgcatttatacatagttaacataacctccaaaacaaaaatatcacagatccaaaagatcggattaacataatctctccaaataatcatg

SEQ ID NO: 34744 - DNA, 3000 bp, Unknown; identical to SEQ ID NO: 34743
  misc_feature (1)..( 3000): 2750-1469P.txt file - cDNA_ID_3081820; gDNA_ID_2926225; Annot_ID_203471

SEQ ID NO: 34745 - DNA, 3003 bp, Unknown; identical to SEQ ID NO: 28838
  misc_feature (1)..( 3003): 2750-1469P.txt file - cDNA_ID_3081823; gDNA_ID_2926225; Annot_ID_203470

SEQ ID NO: 34746 - DNA, 3003 bp, Unknown
  misc_feature (1)..( 3003): 2750-1469P.txt file - cDNA_ID_3081827; gDNA_ID_2926225; Annot_ID_142519
ttctttgagttagatttatggatttactggaagttgtgtactcacccctatttgagagctgtttttttggcatgtctattgtccactcatgttgtgttggctattttcaaactttgatgtttgttgatatgaataagggtttgttcttccttttttcaaaaacaaactagagttgagtttcatagcatttctattgatcatatgctgctgagcaaatcgtttgcggttcagtaagtttattcataactgggatgtatgagtaaacttatggtaaatcatgtctactctatactcattctttttttgctaatgtcaatctttgatgtgtttagacatgtataggttgtctttatcttctaatttgaatattttatttttcttataaactttaggagcttcacgaccaagctgctaaaagtaattttcatttgatgcaggtttcacgtggataaaatgtcgtcagctcatgtttacttgaggcttcatagaggccaaagttttgatgacattagtgaaggtgtgctggaggactgtgctcagcttgtgaaagctaactccattcaaggtaatctttttttctacctgtcgtgaacttaacatttgcataaccattagtcttagagtaccagtttgttttttagaaggagggcacatataggttttttctgttttcttaccgactggtgtctgggattatgtgccaggcaacaaggtgaacaacgttgatgttgtgtacactccgtggtccaacttgaagaaaactgcctccatggatgttggtcaagttggtttccacaattcaaagatggtaagcttcttcatctctaaagaaattttggttgcgcatacataaactgctcaaagtatggttgtaaagcttcgatgatattgatacctaactcatatttgtttcgttcaggtccggactatcagagtggagaagcgagtcaatgaaatagttaacagactgaacaaaacaaaagttgaaagaacccctgatctgagaggttagtatttgttttgtgagctcttcctcagattctaataggtagaagattgatcatgcatacatctttctcgtttaacaattttcctgctgatgaagtgtcagttaagtgtctgtagtttttccagtcagtataacttcaagatctatgaaaataatttgattgttcataactgtgttgatgaagccgagagagaagcagtgaatgccgcagaaagggcagagaggaaacaacatctgagggagaaggtcagtgtctgtttttggtcgttatcatcttaaacgtctttgattagggttttgactgaaatcctcggttgtttctggattttgcagaagaaacgtgaagagatagataggcttgagaaggagaggcaatcagagatgaggagttacaagggactaatggtaactgataaaatgacatccaacaaagacattgcttcaagcaacaaatcgcttcaagaacttgaagacgatttcatgtaaaagctctgaagaaatgagaaacaaaacaaaccaagtcggtaacattctgccagagatgatctggtaccgtccttcaaagaaggcttatgatgttctactcgccttaactatgatgttgatggttgtccggttctatgttttctttaaaaaaatcttgaatacctaaaaccctaatctggttcttggactccttggtccattgaaatgtttcaaaaggattgaatctgatctgtgggaaaaaggagagcattatattctatatatgacacaggtgaaccagtgatctggtgcaattatggtttactctgcattgctgtgtaacctgaaatttgtttactaccccataaagcttcatgtgttactctgcattgggttgggttttggaatcactttattcttgaccatagttgctattgttaaaacttgcgggttgaatttaaacagtcctgtctcgtgattgcagtgggtctatcgggttattactgtaagttagcggggctagtcactagtgcttagactacttttttttagcgaccatagttggcttgttgatgatatatgatttgaaataattatggtggcccctaaagtgatttgaatcaataatccaactgttggtgtacttggaaatctaagggtattaaataaatctgagtgaaaatttgaaaaaaagggaaaaagaagggaaaataaaggataagaaactaaataattatgtccgttaaatactaaaaaaagataggagacacgtgaccgaaaatatttaaaatggacggctgagattaagactgagagccgctcaaaaaaaaaaaaaaaaaaaaaccaaacgttattgacttgtatagggtttgttgaagaaggagactttaacatttttgaatttccgccagtcttgttttgaaatagctctgccgaccgtttagatttctctcttttatctatcttctctgggaaaattttcaattaatctctctttattaactcagatcgtgaacatttatctccgattggaggagatttctagtttttgattggatttactttgggcattttggtctctccagtttctgggtatcgtcgttgtctctctccgatttatgaaccacttccatttctgaagctcgcataggtttgttttatgactccatggttctatatttgaatctaggttggtttgggtatgatttgattttgaatttattgtctgcttgatctaaatagtttgctctttttaaaaatgactgcgaacaaaagttcacaattagtagtcattgtaattattttcaagcttcgagtatgttttgtcctgattagcgaccgactttttttggagctgaatccttagtgttttttttctttacaatttatcttaggaagattgtgagatggtacaaaggagggaatagtagttttgaaatataatgttttggagttacaacattgcagagaagaaaggcaacgtatgggaattggggtgactatttttgcattttcattgactagttatg

SEQ ID NO: 34747 - DNA, 3003 bp, Unknown; identical to SEQ ID NO: 34746
  misc_feature (1)..( 3003): 2750-1469P.txt file - cDNA_ID_3081827; gDNA_ID_2926225; Annot_ID_203468

SEQ ID NO: 34748 - DNA, 3003 bp, Unknown
  misc_feature (1)..( 3003): 2750-1469P.txt file - cDNA_ID_3081831; gDNA_ID_2926225; Annot_ID_142517
gcgtcgtttttctgtcttttaaaagttttttaaaaatgcggtgagcgtggatcgaacacgcgaccttcagatcttcagtctgacgctctcccaactgagctatccccgcttgatgcttatatgcttaaccttttatctatatttcctatatttgcgaataattttgttgtttttttcgtttgtttgttgatttttacaaaagtttagtagagtccgaatacattacaagttgtaacacaaatacattaaacaaaatctcagcgttgcattaatcaaagacagtgcccaaataattggtacactaactgttagttttgtcgttttacactaactgttatataagtctccttataaaaagataatatggagaagtgttgttttggttctcagtgtttgagccagtagtttcttagctgagccatatgcaacaatatctcgtcccgaccttgattcgtcacactgctggtcataatccatggcggtgttgtctcaaagaacccttggatcaagtcttggaactcctttatgttcgcctccggtttcttccctccatttttcttcttctttctcttgtcgcattttgtgaatatcaaagtcattggaacctgagagatatagatagcaatcattcatttcacagagacattacacaattagtacaagtcttgaccatgattgccaattaatgggttaaagtggggttttcaaggtttaggtactttttatacctggttttgaccaagccagcttgcatactcgagatcgattggctttacaggaatgctggcatcaactagtaaaaacaccgagaccaatgttgatcgatttagaaaatagtctttggtgaatttgttccagtcttgtttgagttcatgcggtgctgatgcatacctggatatataaaatgtatcaactttcattttctatactgaaagtcctcaaattccctggcacagaaactgtaattgtatccaacagacacaaacaaaaaactaggaaagacagagacttgccagagcaattttaaggtgctatggcatgaaaaacaaaataatatcagttaaacttacccgtaaccaggcaaatctaccaagtaccacttgtcgttgatccggaaatgattaatgcattgcgtctttcctacatgaagaataaactaccagaagttataatcaacctatatgtagcataagcacaagcacaagcacggcatggatgcctatcagtttccaattctaatatcacgtctatcaacctttctaagtggttcactaggaaggagtatttgtgaatgagatgttcggtcgacactatagagatactttcatcatatatacatccaaatcccattttcatgaaattattatagcatggtctagcagcaacacatattactcaaagattatatccactgatgccatatcttggttcgtattctctacaacaataccccatcttcaaaagtactagaaaccaacaaatgccgatgctccaaggcaaatctgttcaatctaaccaagtggggatagtctattggttttgtcctattgactattgactattgattgagactagagactgattcccactcaatgcctcacttggccactacagaattcaaatgctaggcgttagcccatgattagtgtggactctagcaaaacccagttatagaagaatcatttcaataaatcaattgacctaagcttccaacaacaacaaaaactgacttctccttactgctttaccaacactctccaatctcctcatgaacattaaaaaactgactacatcactctgtctcaaagatgtgattgcttcagtttcacatgacatttcaacgggaataagccaagttgttctcttaatctatcatctacttaaccagtgcttcaggtccccaaaatggaagcttttgatccataaatataatgacactcaaaataatgtagaaatcacacaccagctaaatgataagcacgatggagcaaaactcagcttaccaggtttcttagaagtcaaggcaaggcgtttcctcctcaccaacgaattgagaagcgatgatttcccaacattggatctcccaacaagcgcaaactccggcaacccatcggccggacaatcctccgtcttgacactactcttcacataatcagcctgaaccacctgtgcgtccctcgcgtacttgctcagcacaatattcgaacccttaagtatcctcgtcgttaaactcgccgagtcttcaccggatatatcggtctccggcggaataaaaagcttgtcgagcgcaatctcgacaggtgcatcatccaaatcggttgaatctgagaccgataatggtatgggttcaacagtggcgagattcgatttagacgcgaatgagaaaagggttcgagatactgttaccgaaggcttagggtttaagaaactgaaatgcgaagaagagagagagaaagaaggtttcgcgaggattgagagatggaatcttggaagatgcgctaaaatcatatctgatcgattctcttctaagtaatagtcttatgagctttttagttctctttagattctgtgagcagccatggatgtaggactgaacttacggatgcggaggaggtcggggaaacaatatccacatcaaaacgctacgttttgatggtggtaatctggacgatgaactttccttatattacaatttgcccgctctattttaacgattgtatcatttcgccactatcttctaattagagagtaaatgggtaaattagaaagaaaacaaaaagtataaggagtatatagcaaaatcgggtcgttggcatctccttccacctctccaagcacggacgagacttcgaccagtgaaccaaaatctctctcaaatttatcaccccgtgcttctgatcacggtgggattctctccgatcggtgacatatcgtggttcatactccggtggatctcacggcgtaataatttatcatatctgaatcgcaatcttattaaccatg

SEQ ID NO: 34749 - DNA, 3003 bp, Unknown; identical to SEQ ID NO: 34748
  misc_feature (1)..( 3003): 2750-1469P.txt file - cDNA_ID_3081831; gDNA_ID_2926225; Annot_ID_203466

SEQ ID NO: 34750 - DNA, 3003 bp, Unknown
  misc_feature (1)..( 3003): 2750-1469P.txt file - cDNA_ID_3081839; gDNA_ID_2926225; Annot_ID_203462
ggctcatcttttttcttcttcttttggttaaggttattgattcctacgttgctgatcagagagttggctacgcagagccagcttcaggagtggagctttacctttgcccaacacgtggggagactctagatttgctaaacaaagtcatctctcaagaacagctcgatgaggtcaagtctttggatattggattggttggagttgttgtgtggagacgagccgtcgttcccaagcccggttccggttcaaaacgtcagcattctttttcttcttctattggttctaaaacctctgttttgcctgtaaacaagaagcagagagtgcatgttacagagaaacctcttgttgttgcatcaatgagaaatcaccatcatggttatgtgaaacatgatactgctgctgatgatgatgtgccgcctggatttggtcctgtggcttcaagagacgaagatgatttaccggaatttaactttaattcctcggttgtgccagtttcttctcctcagccattaccagctcaatctaagtctttggatcaagtaagaaagctcatacacaagtatggaaaatctgcaagcacttatgatgatgatgacgatgaggacgacatacctgaatggcagccacacgtccctagccaccagcttccaccaccgccgcctccacctctcggcttcagacccgaggtatttagaccgcctcaagatggttggtatgataatcaaaacggaggatcagggcaacactatgagcggaaccagtcaagaaacagaggattttaatatctctgttgagtgttctctgtaattgtagttttttggtttcctagtctctctttagtttttcgttttcaaaaaatttgtagccatcgtagaatgcaaatgttcgaagagtcccaacttttcaaataaaacatttcagagtttcctcaagaaaacgaaaatcagtattgctctgcttttaaagacaagtttgattgtggaatcttgctaaaatgtcaaaatcttgtttgaacatcaaatttaatccggaaatcagcaagtaatttcttctatctaggtttcaccatgaatctaaaaggattattgaaaatgaggctaacgagagtaagattttttgatgggccgctcggctcagagttcaagcctgcaggaaaatttgctctaaacggatgaagatttcagtttatttcggtttacaagttaataataaggttataacttataaagattctcctttgtcaaagttactggtactagttttaaaaggatgattacatatacaccataataaacatatcaatatcatattattcataggaaaatccaatccacagatggagctgcaaaataaaaaaaggggtcaaaaaagaccagactaatctaatctgcccaaacaacacaccactcagatttgaacttccaaaactatacattttccaactactcacatatcatcatttctcttagataccatcaacttcattgatacaatacccccattactgtacttattatgggtatgcaaaccaaaacaaaagaaaaagaagaagaagcaaaacttcacaactaaaggattcatgagatcaggccgatacaggtgcattagggataaccgatgatgtggatgcagcgacttcagtagattttgatgttgaaggccctgactcagagatatccccaatatcaagtgtctctggcaggttttcttcagattcagtgctgtatatctatatagaaaaagagtgatcaaaatcatcacttaagatcattacatcaaacaaaaaataaacgtgagtaatgaatatacctcaagctgattcagcatctcaatggttgcttcaagatcaccgccattagcgaggtaaacatcagtgatagactcttgtgagagaccagagaaagtgacaagaaggtattcaatatccatgtctatatccatctccaaatccaaatcatcatccctgatctgcttataagccatttcagaggatttcttcggcattgacacttcaaccgtgggggactttgctgcaaacaccaaaccatcatcaccgccaccataatccactcttttggagattggtacatacgatgctgcatgtggattcaatgcaaatgctcctggcttcattgctttgtcttgctgataaagttactgctaaatttagaagttaattaagagtcagagacagaaaagaaatacaaaacaatgatatattgattagaaccaaacatgtcgtatgcagcaaaatctaacaatctcaaatttggtctaacgaggtatgatgaaacaacctttaatgatttcaacaaaaaaaaataaaaaggatatgaagagacctaactcctaagccaacgtttcgatggcgtaacacagagtatataaggaatctaaaggaaataaattgaagatattaaaataaagaaatgtggttacattagaatctggctcgcgttgttactgcatggaaaaatcgatgtcggaaaatacagaaaacagggcaaaagtaaaagattcttgacaaagaagaaatgatgcgaagaagagtggattatatgcaaaacaaaatgaaaagaaggaataatgtttgttgaccttgtcaacgatcgacgtaaaaggagaagaagaaacgaaacattaggagagaagaaaatgagcttaccaaacaaaaactagcgttgaagatcgctcgaataaattgtagagacagagacctaaatgatgcgattaatgtggcaaacccatgtatttatggaattattatcgtataggttagtgtccgtttacatgaaggacaccaaacatcacgatggggttcgtttggatacccggttatatttatctttaaccgggatactaatatacgtgattgaaattaattcggtttaataaaccgattgataaccaccggtttaaaaagtatcaaaacgaaggagtgaatggatgagagctaaagggaagaagcaaagtgaagaagctccagaacacgccatagctatg

SEQ ID NO: 34751 - DNA, 3003 bp, Unknown
  misc_feature (1)..( 3003): 2750-1469P.txt file - cDNA_ID_3081847; gDNA_ID_2926225; Annot_ID_142511
taatttcaacgcagggatgttaccaaacggcgactttgaactaggaccaaaaccatcggacatgaaaggaacgcaagtaataaacaagaaggcgattcctagctgggagctttcaggcttcgtcgaatacataaagtccggtcaaaaacaaggagacatgcttctcgtagtcccggccggaaagttcgcaatccggctaggcaacgaggcatcgatcaaacaaagacttaacgttacaaaaggaatgtattactcactgacgttcagtgccgcaaggacatgtgcccaagacgaacggctcaacatatcggtggcacctgactcaggcgttattcctatacagacggtgtacagtagcagtggatgggacctttacgcatgggcgttccaagccgagagtaacgtggcagagatcgtgattcataatcctggtgaggaggaagatcctgcttgtggaccactcattgatggtgtggcaatcaaagctctataccctcctcggcccaccaatagtaagtattcatttattatatgaattgagtttgtataatcaaatcttttttcagatatcacgcaatgtgatccatcatgttacaactatatgtagttatgtattaactcgttatcgttaggccttaggggttgacatttgacactccggtttggtttgtcaaaatttcagtttggtttagtccagttttgatattttcaaattaatcattataaatctatttttaatatatgtactagatacttgtaaataaactttttggtttgggttatttggtagacctgtaaagtatttctatttccattatggttttcaaaaaattggcctggttggatttgatttatgtggccacttataagtatagtcattttggtgttagaacatattttaatggatcggttacatgacgtgacatgtgttagccaagattcagaacaataaattaattgatatgattttgctattatataataaaacagagaatatattgaagaacggaggatttgaagaaggtccctacgtactcccaaacgcaacaaccggcgttctggttcctccctttatagaagatgaccactctcctttacccgcgtggatggtcgaatcactcaaagccatcaaatacgttgatgtcgagcatttctcggtcccacaaggccgtcgagccgtggagctagtggcaggcaaagaaagcgcaatcgctcaggtagctaggaccgttgtgggaaaaacttacgtgctttcgtttgcggttggagatgctaacaatgcttgccaaggatcgatggtggtcgaggcatttgcgggaaaagacactctaaaggtaccttatgagtctcgaggcaaaggagggttcaaacgcgcttctctacggtttgtggcggtttcgacccgcacaagagttatgttttacagcacattttactcgatgagaagcgatgatttctcatcactgtgtgggcccgtgatcgatgatgttaagctcctcagtgctcgtaagccgtaagatggccattgttttatttctaaggttcttcgtataagccagtgtggttttttatataaatatgattttcttaatctctaatgcttttgaaatgagatgagtaatactgaaagggtgtttgtggtgtagggttttatataaggcaaaaaggtcttgcttatatatattttcttgtatgagaaggctaaagaaatgttgtctgtttttactaaattgggttctttcaaggagatcgggtgattgtgagaataaaaatgtaatacagatatatatggtagagaggaatgaggataataatttaactttagcttcttgtgtactaccaatccgtgttaggatcaagcttttctaatcagtttcaaactgaactgccttgaaatccatgttagtagctgaagcaatggctcaaaattttaaaactatagtgaacagttaaaacgtagcaaaaaggaccaaagggtgtggaagcaaatggttacagttttgagcattattaaacggtttaaacgatttaaacgattggtatatcgattaacatgcgttttttaacatctggatttattatatattgcaaattatgagaagtatggctaagatgcttttatgagatgcttttgactgtttgatagcgcatatggtaattgttaaatttccggaaaaggatgtttatatgcaatttatcatattaaaaagaaaaaacccaaaacaaaactgtagtctcgttgtaacaccaaaacggtggcgcttgcgcacagttgtagtcttgtagatattaagctgagaagttattaaaaatgtaagtgggccttttcatcatgatccaatatatttttcgcataagcccaatagcccaatatgtgcgatccacgtcgagcacagagtttccttttatcacaaagcaaagagaagagagagcttcagaatcatcacaaacgctaatccgtctcatccggattggttcctctcgtcacctagacctagggtttcttccttttctcctgtcttcccctgaatctctgcatctgcaagctccggccgatacgagggagcttttttttttttgctcaaacttgtattcaggtatgtatctctgtccgcgattagccgcgagatgcgtcaatgtatctgttcttttagggttgaatctttgggtctctggtctttgtttttgatacatctagttgatattctcaatcgtgtgaattcaattatctgttaatttgaatctgtgtttgaattcattgccctttcgattttggtgaattttcatgggatttagctgattcggttgtctaattgagatctcgaaattagtttttggtgatacgagcagagaaattgattctgtaattttgactctttttctgtttgtttacctcgcagctgttaaggtgtatgttcaagtcatcttgagcctttctctctctctctctctctctctctgcggaatccgaattttgtaaagaaacaaactttgatggagatg

SEQ ID NO: 34752 - DNA, 3003 bp, Unknown; identical to SEQ ID NO: 34751
  misc_feature (1)..( 3003): 2750-1469P.txt file - cDNA_ID_3081847; gDNA_ID_2926225; Annot_ID_203460

SEQ ID NO: 34753 - DNA, 3003 bp, Unknown
  misc_feature (1)..( 3003): 2750-1469P.txt file - cDNA_ID_3081851; gDNA_ID_2926225; Annot_ID_142510
ttttgtatctatcaatttcaatttctccgcacacaatcaatttttcacattagctataaaaagcattaaatcagatgatttaagaagtcatctctaattactccttaagcttacatcatttaaacacaaacacgaaaattataatttacatattataatggcctattaattatagtaattttgaaatttatgagatcaaagtggagaagtgtatctagaaaaggataggcatggagggaaagagagtgaaggcattcccatgtgagtcacattcacacgagggtcctaaaaatattgatgagcttatcttccttgtcttctattaatgctttttaagttcccagctaatattgttagtagtttgatagtgatataccacatgtaaatatatatatttttttgaaatatatgagagattgagagttcttgaagatacttcatgagatgatgcaatggataattaatcaagatcctaatttattttcttaggtaacatgcttttgtagttaaattcttaacaacaatagcttaccatcacaattttaatcaatcaaccctttagtttttactttaagtgaaaattccaacccttttgactatatcaacttgtctatgagttaattcgtctatatatatgatgagaacttagccaatatgactgaataacctcattcttcttttctttttggtttcttggaaaactagtagctcattaataaaagagcaaccaaaaaaaatggaggatcattaatttgtcatatgattagttttctgaactttctttcagtcttggattttgttaagaagactgtatcggctccttgtgtgttggcacgtggttcaaaaaaattggacatgatgacgaacctgattttggatgttcatgggaaggccacatgacacgagagccgtttaagccgccgttaaatatggatggaagacaggttttcctccgtcagtgcctgagaagttgacgtcaattgacagagtcaagtgggacgttagccgcaaccggaaataagcagaagactctccacactcacatgcccacactcttaaccttcttaatggattaatgcacacttgcatcttcttatcatatagtatacgataaatgatatttatctataagaatttgtcattgaatgatataatatatgatccataaattgtgtctgctttgttataagtggtgtaagtcgggtcatgggcccgtgagatagtaaaagaagtgttgcatgtaagagaagggtgatgagagacagtggcacgacggtagcttaagcgctctgtttctctaatttctgccgtctccttttcaaaaagaccccacccacgttcctcttcttctctcatttacccttcttgtctctatactcactgctcatgagattattttatatgcattaagaaatattgggcaaatatagtttatattttttgtgtttttgaccaagagtaacagagtattatggtcacctgtaaagaataaactttttctaaagtagacgaaaatgtataatactattttggcgatcatagtaattgagtaggttttccaaaattttgtatgttctgtattaactcacaaaattacctaagttcggcttcgttgcgagaagccgtgaataatgaaaagaagtatatttgacttttgaaaaaaaaatagttaccacaattataatctaataaaattgaaagccctctaagattcaattattccacgattctaaatcaaaacaaggctaaatttttaaataacgatatacaggatctattttaagcatatattagggagatgccgacaaagaaaaaaaacatatagcggaactgtagagtatattatatcaagccgacaaagaaaaacatgtattattttagttatactgttttgagtttaactcaagctaaaagacgaaagagctaattggcaaagcctttcagaaaatataagaacaaaagcaatgctaaggccacgtccagattttagccgaacaatggtaaaaaaacacaaagcctgaacaaagacaataactatcaaatgttgtcaaataaaataaatcgaataaattacacgcaaatctaaaaaagtgagatccaacagcttcgtataactttagtgacaaagaaagctcacacgatcctccccgtagcaactccaccgcatacattatgtatctcgaccaaatgactaaatcaacaaactacccttttcactcattgcaattctactaagaaaatattctcaagactagttccaagtaatgatttacgattaatactagaataattagcagatcaaatagtattgtgtaggtataaagacagataatgagatatgagatcaaatgtctccatgagttggcatttgtgttgatacattgaccatgcatgtggatatatgatcaacacaaacttttgttaatgctcttttaattaacacatataacatgcaaaagttgtctaatgttttattttgtctacgatcatgcaaaagaaatactagcagtataagtttcaaaaataaaaggagattcggcgttaacattaacaagcactaaatgcaaatgtatgcatagtaacaactaacaacgtcgaaatttgtcattaatatatatgttaactattaaagccatatttataaacataatttggtatgtccaaaaggtgttttgtactactggccttataatttgtttttggtttaaggatgataataatcagacggcagacaaaatcattgagaaaagaaaggagtttccaggaataaccctctctgatcgatcttctgaaatcttagctaaaccccaaaagagtgagtcacggccccacgtggatacgtgaatcacatcagtggcataaatccgtaaattgtagtaaaatctagaggtattttccaagttagacttccatataagctattgctggctcctctcccaatttcccataatttactaaatatcactttctagtctcttctctttactttggtcgtccacaatg

SEQ ID NO: 34754 - DNA, 3003 bp, Unknown; identical to SEQ ID NO: 34753
  misc_feature (1)..( 3003): 2750-1469P.txt file - cDNA_ID_3081851; gDNA_ID_2926225; Annot_ID_203459

SEQ ID NO: 34755 - DNA, 3000 bp, Unknown
  misc_feature (1)..( 3000): 2750-1469P.txt file - cDNA_ID_3081858; gDNA_ID_2926225; Annot_ID_203457
ttactatctcacgggcccatgacccgacttacaccacttataacaaagcagacacaatttatggatcatatattatatcattcaatgacaaattcttatagataaatatcatttatcgtatactatatgataagaagatgcaagtgtgcattaatccattaagaaggttaagagtgtgggcatgtgagtgtggagagtcttctgcttatttccggttgcggctaacgtcccacttgactctgtcaattgacgtcaacttctcaggcactgacggaggaaaacctgtcttccatccatatttaacggcggcttaaacggctctcgtgtcatgtggccttcccatgaacatccaaaatcaggttcgtcatcatgtccaatttttttgaaccacgtgccaacacacaaggagccgatacagtcttcttaacaaaatccaagactgaaagaaagttcagaaaactaatcatatgacaaattaatgatcctccattttttttggttgctcttttattaatgagctactagttttccaagaaaccaaaaagaaaagaagaatgaggttattcagtcatattggctaagttctcatcatatatatagacgaattaactcatagacaagttgatatagtcaaaagggttggaattttcacttaaagtaaaaactaaagggttgattgattaaaattgtgatggtaagctattgttgttaagaatttaactacaaaagcatgttacctaagaaaataaattaggatcttgattaattatccattgcatcatctcatgaagtatcttcaagaactctcaatctctcatatatttcaaaaaaatatatatatttacatgtggtatatcactatcaaactactaacaatattagctgggaacttaaaaagcattaatagaagacaaggaagataagctcatcaatatttttaggaccctcgtgtgaatgtgactcacatgggaatgccttcactctctttccctccatgcctatccttttctagatacacttctccactttgatctcataaatttcaaaattactataattaataggccattataatatgtaaattataattttcgtgtttgtgtttaaatgatgtaagcttaaggagtaattagagatgacttcttaaatcatctgatttaatgctttttatagctaatgtgaaaaattgattgtgtgcggagaaattgaaattgatagatacaaaagagactcgttttatagcagtttgagtgaaataaaaagactttgggtatgggcttgggcttggatttcattttgggtccatcaaatttttcatcaactaacctataaaaggaaaagtgagcttaactcttttctataatttccctaaaccctgacacatgatatattagagataagggtaaattttcctctttgttcttcggttgtttctttttgtctctctgttcctgagcgactgagcatatatatttattgtgattttgtttctcacttcacatatacgcactctgcagatatatggtaatgaaattgtttctcgtgcattaaaaacatatctattctctcttacttattatcttcatctctttctaatacgtggaatcctctcttacttattatctttatgtctctgatttgtgttttcttgagttttttttaatgattttgatgattttagagaagttcatatatttttgtaaaatccattcaaatttcaccttaaactatgagatttagatttctgtatttttaactaaggaaatcctctcaaatcttccaaaatcattaaaattcaaatccacaaattatggattttgaaatcattagttcaataacactgaatttcatgaaactttttaaaatcattataatataggatttataaattctacacaaatctcttaaaattccactttcaatacatcccctaaattctctatttaatttccaattttctagtatctaattcctattttttattggacaaagtatgtatgcataatgaagattttcatatctagtacttttctccgattgttggattttctaaatgtatttctaattgttggaactttcttgtcactaattttttttgatacttgtgacagagacgtggctcaacattacgcgaacgaaaacgttgacactagatacactaagatatacgtgggaggtctgccttgggaaacaagaaacgaaggtttgagaagttacttcgaacaatttggagatattatacatgttaatatggtttgcgatagagaaacgggacgatcagagggttatggttttgtcacgtttagagatgctgaatctgcaacgagagcttgccagaatccaaaaccggtcatagacggacgagaggccaagtgcaatcttgcttatattggtggtagggttaacaataaccaaaacgcccaacaacaacaagtactacctatgtacccaactgggaccagtttccaccaccccaatatcatacctacacaccttatggttattggacaccccatggcccttactacgtgaaccaacctggtccttactacttgaaccaacctggcttttgacttatgagccatctctttcgctgttgtctgagacactacttgttgttctattttctgatttcaggctgtttagtctgcatgattctaatctaattatgtttactttcttatatacattgcatctcttctgttccaaacagagaacaagaatctaatttttcaagccctgtttattctagaatgtttctaaattttgccttataagcatttatatagacattggcatagtaaatagtaaatactgtggattcttttggcttttgaatgtgaacttgactttttaaagtgttgaattctgagacagcccaaccttttttgaagcttctttcacacttaaatcattttcaacctcataaaaaaacctacaagatctattaaaatataaaaatcaaaatctacagatttatcatctttatgatcaacaatg

SEQ ID NO: 34756 - DNA, 1723 bp, Unknown; identical to SEQ ID NO: 28847
  misc_feature (1)..( 1723): 2750-1469P.txt file - cDNA_ID_3081885; gDNA_ID_2926226; Annot_ID_203514

SEQ ID NO: 34757 - DNA, 3000 bp, Unknown
  misc_feature (1)..( 3000): 2750-1469P.txt file - cDNA_ID_3081891; gDNA_ID_2926226; Annot_ID_203510
aaaattaattattttggaaatttttttaatgctaatgacattagatcgtaaataagtccaagtacatgatttatttgctaaaatggctgcaaaaatgtatatatagattgttttggaatcaagattgtgttctatattttaaattgctaaaaatctgttttttcttttcttattctctaaattctcatttttaattgtttttcgattatgtataaaaaactgttttgttaaaaatcgaaaattcatttccactaccccaaccaacccacgatctctctgtatctactcaaataaaacttgtagtattcccaaaattattgtatataaaatcagaagttccataaaactcttccttaaaaattctccagaaacatcaattttcacagaattcttaaaaggatgtcaatcatacaactccgatgaatatgagttatacatgtacttctccaacacaaaatcatgttgatccttatatgttcatcttctaaacctttccaagacgacgaagaattgtttttctgttcttatttttattattttgtatttttcattttctcacccatgactctgattttctatttattggttttcatactcagaaaatctccacagtgaagaaacaatgtcaccaaaacaatggaaaggaaaaagcttggacaagaaacaagatgtgtgttcttgaagaaatcatacctagatcttgaattaattaagttcatatcactttttttttgttttttttttgtatgtgtaaaatctctaatgaatttattaactgcgttaaattcatgtttttgtcttttgtaattgacgttctggtataattatttgtaaaaaaaatagaaaagatttagtagatattgaaaacgattttgctatataaaattatttaaaaacaaaacgaaaatatttaagataataattctgttataaattttgtagtttcttttaaccatcgtttattgaaaaatatttaacacaaatattaacatcaattactattaagtgatgtaaataattgaaatcaattctcttaattgacactaatactaacatcacttaaataaatagatgtaaaatttaacatcattttttttcaattgacacatattcatatcagttagaataattgatgtaaatattttatatcttaacatcggtcattaattaactgatgtcaattatttgcatcaacaatatataagtcatttatttaagtgatgtaaaattcttttacatcaattataagtaatacaaatattcaaaataaatgatataaaatggcccttttttgtagtgcatggcgaacgtgaacaatcatatgaggagtttgcaaacagtcttccagctgatgaatgccgatatgccattttggatatcgaattcgtcccaggggagagaaagatttgcttcatcgcgtggtaaaataatttactctattctttttgttaactcatttccgtgatttgttgcttttattatcatcaatgtgtttgtttttgtgctataaggtctccatccactgccaagatgagaaagaagatgatttactcgagcactaaggataggttcaagagagaactagatggaattcaagtggagtttcacgcaactgatctaaccgatataagtcttgatgctatcagacgccgcatcaactaagaaataaaacccttgcaagagacttgaataaacttgttttctcgagtaatatgtttcctttgactattatgaaaacttttaacaccttaaatttaatttattctacagtatttggtattattgtatgtcttgatatgttttaatctatgagaactaaatgttagtgtgcgtcaacaataccgttgagatatctgatctaagattccgttatataatggaagcattagctactgtgatggctcctacacgtatttcatgtcttacatcatctatatttattactacagagtcatgagagctaatagttcaccacacattatctgcgaagagatgtaaatgttttatggtttcttgactttggtcttctttgtgatgaacatgtacgggttcttcttgggatttgtttgtgttttggttatgatccctcttttaagtctttcaaatcaagatcgccttatcctgacttagtcgctaaatgattcagaaagtaattcagccacatgttcgactaaactagagcaaaaatagattaaagaacacattttctttattgatttagaaactactcaaaactaaatctctctctctctctctctctctctctctttaggtcttatggaaaaactctcctaaacctcttattctaatctcttaggtcttagagaacaactttccatagcctcttatttatataaatttagcaaattctattataaaaagaaaaacttataaatcttaactaacttgacattatttgtatttttctattttctatctcttctagcatcttctagaaagagattactttctcctcaaataacttagaactatccaacaatcttgctagagagtaaaaacacatcaagcttagatgaagaagaagaagcaggggtttgatggagatttggattatggtgttgatgtaactagaggtcgatcgttttagtttcgggcaggatttataattagtgatatatatacttgcaattaactaagtttgatttctatttcatatttgttaatttgatgatcgaataccagataaaatgagaaaaagtcacagcattaataatcaataccaaaactaaattaaaatgaagcaaaccactcatgttatagttatacatcatcgtagatgataagatttattagaagctaatctcattaagattatatcatctcaaaagacaaacaacaaagttattaaatcatttaaaagtccgatataaggtaacactacatcactttcccgatttctgatttctcgacaaacatcttattcattcatctccaaaacctcctaatctaccctcttaaaacgatgaagctatcgggatg

SEQ ID NO: 34758 - DNA, 3003 bp, Unknown
  misc_feature (1)..( 3003): 2750-1469P.txt file - cDNA_ID_3081895; gDNA_ID_2926226; Annot_ID_142546
gatctgtatatgggagcggatcttcacgcatggatcgagatttaggatcataataagctgagttaacatcaaggttcaacaagtattttgcaggatcttctctgatacgcaaattccttacagttcctttgcttccaccatcagttgttcgaacacgttttttaacctttgcaaaatccacctgcatgctctcatcaatcttggcttcatcaacccttaagtcttcttcctctccatcaatgttcttctcctctagtttcgcaattagttgttgctcgttcaggtacttctctcgtgcattctcttttgcttcatgacgatctctcacatgacaataagacgaaggatcataaccattccatcggtcccttttgccatcatagtcaaattcaagactctcgattttctcatcaggtgcaatgtttttgtctgtgtattttgcaccaaccttacgaggtctttccatacatgttttcacatcatgcgtcattgcaccacagttttgacacgctcctttccgatacttttcggcttgataagtctttgcacctcggtcataatatgatgttgtggaaacgggtttagttttccaattcttttgatgcttcaagctcggtttttcagacttggcatataatggaggaattgtcaaatacttaggtatgtgaagattgatttcctttccaccctcgtctacctcagccggagcaagcccggctttacgagcttcctctaattccttttgcttcctatgatctttcctagacttaaaagcaactgaagccgtcgccattgttatcgttaaacttcgttactctctgcaggctacaactaaaaaagaaaagagttaggagaatgaagcttgttgagattttgtggtaaaccagggaccatctattcttctcctgtccttatgcggctgggatttggaaagctctagcgcagaacatattcaaagacaggttctccacaatctggtcagacataatcacctcaatcaatagctcatggcagaacagagaaataagtttccttgctcgatatgttttacacgtcactctgcacactatttggcgtgaacgaaacggacgacgacatggtgagaagccgatcccagcggatcatttaacaagctggatagataaacacattcgaaacaagatctcttctatccatatgagcggagacaggcgctatgagaactgcctccaaatttggtttcaagcaagaagctagaaggccgaagctctgtttctgaagtttgtctctgtttttcttgatcttcaattttgattttaatcatgtgttgcacatagttgtaaaaacgatttttctttgagtttttaatttaacattacaaattcaaaaaaaaaaaagagattttgtggcaagaaaaactaggaacccttaataaactctatcaataaattcgttctctcgtgagcttacatattattttaggaaagtttcttaaatggtaagaagaaaaattaaatgtacttgctaaattaactaaaccataattgtaaaatttccttattgcataagaatatcccttttcttctcacatgtcttcttcaattattggtttataatctccttattaatccaatagaatcttgtttgtgtaaaagtgctatttaccgttgaaacaacagtctccatctaaagagataattccaatgagtaggctcaaaacatatactcattaagcaaaacttaaaatgggagaagaataataagcagacgattctaatttcgttttgttatagatgagaccaaaagaatatattattttactttgccgcatgaaggtttcgtggtgtagttggttatcacgtcagtctaacacactaaaggtctccggttcgaacccgggcgaagccaaatgaattattatttttacatcttttctttacagtttctcttttttttcctttaaaacaaaaaatgtgtgaaggtgattttcagaagacatgaatgtttgttttgttttgatatatgcatcaattataaatcagtaattgatatagaatctagacaaatcctaatcttatattttgtatacccccggcaatgaaacaaaagaaaacgatagagagggactagtatgaagatatattcacatgttgtaatcaatgccgtggatatgacagagtcgttctcacatggatcgttcaatggttaccaatctatttaatatttattgaagatttcattagctcaaattaacaatttaacgaacaaacttttttgacatgatgaatgatttagtgataaatcacttgaaatgaggagaggctaatactctctacatctaattattatctgtgtagactttctacactactagtttgttagtggaaatgagttgtcatggactaaacaatagatcttttaaaaagggtaaaacgagaggtcgattttttagtgaacaaaatctgtgtttaggacagaaacgatgcgaaaacgtgtgtatttgttaggttaaaaaaaaacaaatatgtgctgtttcgtttattaataagtttcacaaatacacaaataattcagaagagtagagaagagagcctctcttagagaggaggaccgacaggtaaaaggcaaaagagtcggtacaatgcaacgtcacccacccattagtcatagcatagactcatagttggtaaatatatccaatgactttatgtgatattaaatatgtcatttgaccaattaatgactatgagtcaaacgcgtaattagaaaggttacacacagtcacacactaataatgactaatgactctatgagtcaaacgcgtaattagaaaaggttacacactagcttcttagatattgagacgctgagttggcatcaactctcttcaatcttcatcatcattcatcatactatattatataatccattctttgtcctctcttctctttacatgtaaattcacatatctctctaatttgctcactagatattatttctttcctcttgaaaagtccaaaaatg

SEQ ID NO: 34759 - DNA, 3003 bp, Unknown; identical to SEQ ID NO: 34758
  misc_feature (1)..( 3003): 2750-1469P.txt file - cDNA_ID_3081895; gDNA_ID_2926226; Annot_ID_203508

SEQ ID NO: 34760 - DNA, 3000 bp, Unknown
  misc_feature (1)..( 3000): 2750-1469P.txt file - cDNA_ID_3081899; gDNA_ID_2926226; Annot_ID_203507
tggtactttatcggtcgcccaaacggctccgtggcttctactcatgtaactccattgtgacgaacctactggagcaatgtcgatacctaccacttcggtttgacctccttggtacaatagctttatcgccaagtaatttggctttttgcttgcttcttccactctcacgttcaaattccttttaccgtaattgcaaggaactctgtttttcatttcccaaaccttcttattagtacatcaagtgactataaaaaaaccaataagtcaagtgtttcaagcatcgaacctttggtattcaacgtcgacgatgccttgtttgagaaggtatttgtcaacaccaacaacaggcttagccatagccctaaaagctctactactaaggacaagatcagtttggttgctcgtgttcaagtctgtgaccatcacaatggttcctttactgttacacaacttggggttcttgcatctgacttgaaagcaagctccacagccagcaccatctttgtaaatggaaggtatagcggccgcaatgtggccggcaaagaagctcgtagccatagggccataggcacaagccccggctagaaaatacccataaacaagacatgagaaaaaagaaacaaactagtagttaaacggaagtagttagaagaagatgggaatgtttacaagagagagcagaagcagaggagaaataagatgctttagaacggtgtagacatcgatcacaagcgttaacggatgaagagaagaggaagatgactacgatgaggtagagaaagcttctcatttttggacttttcaagaggaaagaaataatatctagtgagcaaattagagagatatgtgaatttacatgtaaagagaagagaggacaaagaatggattatataatatagtatgatgaatgatgatgaagattgaagagagttgatgccaactcagcgtctcaatatctaagaagctagtgtgtaaccttttctaattacgcgtttgactcatagagtcattagtcattattagtgtgtgactgtgtgtaacctttctaattacgcgtttgactcatagtcattaattggtcaaatgacatatttaatatcacataaagtcattggatatatttaccaactatgagtctatgctatgactaatgggtgggtgacgttgcattgtaccgactcttttgccttttacctgtcggtcctcctctctaagagaggctctcttctctactcttctgaattatttgtgtatttgtgaaacttattaataaacgaaacagcacatatttgtttttttttaacctaacaaatacacacgttttcgcatcgtttctgtcctaaacacagattttgttcactaaaaaatcgacctctcgttttaccctttttaaaagatctattgtttagtccatgacaactcatttccactaacaaactagtagtgtagaaagtctacacagataataattagatgtagagagtattagcctctcctcatttcaagtgatttatcactaaatcattcatcatgtcaaaaaagtttgttcgttaaattgttaatttgagctaatgaaatcttcaataaatattaaatagattggtaaccattgaacgatccatgtgagaacgactctgtcatatccacggcattgattacaacatgtgaatatatcttcatactagtccctctctatcgttttcttttgtttcattgccgggggtatacaaaatataagattaggatttgtctagattctatatcaattactgatttataattgatgcatatatcaaaacaaaacaaacattcatgtcttctgaaaatcaccttcacacattttttgttttaaaggaaaaaaaagagaaactgtaaagaaaagatgtaaaaataataattcatttggcttcgcccgggttcgaaccggagacctttagtgtgttagactgacgtgataaccaactacaccacgaaaccttcatgcggcaaagtaaaataatatattcttttggtctcatctataacaaaacgaaattagaatcgtctgcttattattcttctcccattttaagttttgcttaatgagtatatgttttgagcctactcattggaattatctctttagatggagactgttgtttcaacggtaaatagcacttttacacaaacaagattctattggattaataaggagattataaaccaataattgaagaagacatgtgagaagaaaagggatattcttatgcaataaggaaattttacaattatggtttagttaatttagcaagtacatttaatttttcttcttaccatttaagaaactttcctaaaataatatgtaagctcacgagagaacgaatttattgatagagtttattaagggttcctagtttttcttgccacaaaatctcttttttttttttgaatttgtaatgttaaattaaaaactcaaagaaaaatcgtttttacaactatgtgcaacacatgattaaaatcaaaattgaagatcaagaaaaacagagacaaacttcagaaacagagcttcggccttctagcttcttgcttgaaaccaaatttggaggcagttctcatagcgcctgtctccgctcatatggatagaagagatcttgtttcgaatgtgtttatctatccagcttgttaaatgatccgctgggatcggcttctcaccatgtcgtcgtccgtttcgttcacgccaaatagtgtgcagagtgacgtgtaaaacatatcgagcaaggaaacttatttctctgttctgccatgagctattgattgaggtgattatgtctgaccagattgtggagaacctgtctttgaatatgttctgcgctagagctttccaaatcccagccgcataaggacaggagaagaatagatggtccctggtttaccacaaaatctcaacaagcttcattctcctaactcttttcttttttagttgtagcctgcagagagtaacgaagtttaacgataacaatg

SEQ ID NO: 34761 - DNA, 3000 bp, Unknown
  misc_feature (1)..( 3000): 2750-1469P.txt file - cDNA_ID_3081922; gDNA_ID_2926226; Annot_ID_142536
ctgttggaggctatggtttcgagtattatgcagaatggttttcgcattgaggacatcaaacctgataatgagactctgttaaacattgatgtttatatgcatatatatactgttagaaaataaaatagtcactctctcgtcggcaaaaggttaagaaaacatcggagcacccaagtaattcaagaagccagagtttttgttcaatcatcggattttggtgaagagatgggagattttgtgaatagatgtcctattggtttgtttttatggtccttgtagatcaagggttcagcttcctttgaggtgatcgggatcacagccattgctgctgccgctttcttttctttgtaagatgcccaggtgacactataaagacctgctatgattgcacatccgcctaaaatgctaagagaggaggagaaaaaagcctagttagttaggaaacttcagacacatcccgttgatggctgagaatagctaagagaaaaggagagagatattaaacctccccaagtagatagggcttccaaggaagattctggacaagaaagctgaggctgcgggttgaagaggattatagagagcaaccaaggaaggacccaagatcttatttgaccatgtcaagagaccatagttgagagcagacgcgattactccctgcatagaggaagcaacagagttactcaattggagaaatttaatggatcaacaaacatatggtgtgtgaagaacatactgcgtagacaactgcaaagaactcggatcttgtgagactccagttcgtcgactcattagtcatgaaaaaagcagatgtcaccataaacatggtcccaaagaaatacgagtatgctgtgactgaaagattcgccggatacttctttaagaccggagcctgatcatatatgtttcaaatgcaaggtcagtccaaagacaagaagatatctgaaactgaaagtgtgtggatcatctagaagaaaatgacatgcctgaatagcaagaaaagcagccatgcaagtgcaattcccaatcaaacacaaaactcccaaattccatcgcccaagtccattaaaaaagccagacatgaagtgtccagatgtttcagtgtgtcttgattcaccatgacccaaggactcagcctctgtttccccaaacaaagccagtccacgaaacaaaaccatcagcaccgccccagcgacacaaatcagtgtgcctcctaccttagcttgaccttctagcttgaataaattcagtctctctgttctgcagcaacacacgaaaatggattgttctaggtttggaagagtcagagagaaagtaaaagagaaagactggatcgagtctttaccccataatgagagccaagatgaaagtaaaaaccgggatcgacggctgaatggctgcagcataagttggattggtgtaattcagaccaatgaggaacaaaagctgattaccaaatatcctaatcacaccaaaacatcactgtgatgattgcaatcatgaagataacagaaactggtagaagaaaacttgaattaccctgttaaaccaaggaagaagaaagctaagagaaactgtcgattcaaaggaggtcttgttctcttatcacggatataagcaagaggagcaagaatggagagagcaatgagatcacgaaagacacagaagacaagttggtttacaccaacgttgagagccactttggtaatgacatgatatcctccgttgaacaattgcacaccgatcatcgccacgtgagctttccacgcctctctttccaccgtactctccattggcggttttcttcttttccggcgattcttattcccggagaaagttatgaaagccagggtgagagagtgggtaagagaattaaatcttgaaactgattgtcactttgaatctcttctgtcaaaacgtgttttttgatcgaacgagacaggggaactaacaaatgatgacatcatgcttcggacacaagcatgcattgggattgatcctatttacccgccattccattatcactaatttccttaaattttcatttataaatatatatagaatctaaaaattaattatagtatggtaaaattttataaaagtaaagatacataaattcgaggaacgaatacataaatatagaatgctataattaattttcagatggttcaaattggtcttggcgtaatttatgttaagagttaagcatcatgtttctaatattataatcgatgtaaataattatttgaaacgatgtaaataatttttttcactcaccaattctaaagtcacttatataagtgatgtaaaactcatttgcatcaatatgcaaatataaaaaataagcgattcaaaacgctttttttgttgtactgtcttctacagacattgatgtgttggacatctttaacttttgattgtatgtgtttagatatctctgcatgcattggatttggtttcatcgatatataaagtctcatttctcatactcttttttgaccaccatgtgttatgtcacgtatcaattttctcatactcatttttgaccaccatgtgtatatgtcacgtatcaattttgtctttttttttttaatttcagtatgacaagtcgaaatacgatttcaaacgaacggagatttggttacaagaaaataccaaaaagataaaaattgtgaagtagcaaatgagtctttgtattttgtcttctctttcgtcattgtctttgagagtgtttatcctatcaatgacgatgattctttctgttactacttggtatgaattacttggcaatttctgatcgccaacccgttccttttgtttgtttctaatgtgcatcatcatcttttgcctaggatatttttgttattaaaaaggaaaaaaaaaaacttcgaaccaacctgtacttcacgttaatgtacagtagtcaagaaaaataaatttatttaatgcatgtgtgcttcatgatcttagacacatgcaaatcgaagaaactcaagcatg

SEQ ID NO: 34762 - DNA, 3000 bp, Unknown; identical to SEQ ID NO: 34761
  misc_feature (1)..( 3000): 2750-1469P.txt file - cDNA_ID_3081922; gDNA_ID_2926226; Annot_ID_203499

SEQ ID NO: 34763 - DNA, 3000 bp, Unknown
  misc_feature (1)..( 3000): 2750-1469P.txt file - cDNA_ID_3081926; gDNA_ID_2926226; Annot_ID_142535
ccaattctccatgaaatcagatgtgtatagcttcggggtcttggttctcgaaattataagtgggaaaaagaacagcaatgtctatcaaatggatggtactagtgctggcaatttggttacatatgtgagtatatatagagccattttttatatatcgagccttaattattattttactttatttaatagtgaccaaagttctaaatactaaaatgttcactagacttggagactatggagcaatgggtcaccgttagagctagtggatccatcctttcgtgataactatcgaataaatgaagtttcgagatgcatccatatcgctttactatgtgttcaagaagaagctgaagatcgtccaaccatgtcagctattgtccagatgctcactactagctcaattgctctcgcagttcctcaacgacctggttttttcttccggagtagtaaacatgaacaagtaggattagtggatcgtctatctatcaatacgtccgctctttgttcagtcgatgatgcttccattactaatgtaactcctcgttgaaaacaaaagtcgcgatatatgatttagtctattgaattaagcatcgatcgacaacaaacaaaggtttagttgttaattagctctttcttaggttttatagtctctttatttgttagcattaattatcgcgtttttatgattaaggtaaagcaaataaatggtgtaacatatattgtaaatgaaaatgtgtaatggttgagggagggaatcaaaacctctgaacaatgcatgtgaaaaatttcttcgttttagtgtttttattgagtaactagattatatttaccaaataaagagagttgaagtaagacacaagcatatgaaatacttttgatagagtgtcttgcaagcaatatatataaaatatagatgttaatatacatacatgtgatgtatgcagatacatattagtctatatataataatttttgtagagaaattaattgtgttaccttttaaagtcatagatatgataaatgatgttatctaataacttttttcttttcaagattagatggagctctatagtagtcgtttttgctaaaatctaggatattacataacttagcaaacgataacataattgatgtaatcctagttcaattatatttctgtaaaaaaaaattcatacataactttttccaacaaatatgaactaaactatcgataccataaaaagtaaccccacatgtgtttggtaccaaaagatgctgcgtagatatgagtgcgagactgagcttgacacacaaattttatgaaaaacaaacacacacacacactcattatataaatatgtgtatgtgtgtgttgataatgagagaggagagaaagaaagcaaaagggtttgaaaaagaaaaccacatgtttgaaggatcatatcacatggctccttaaccccacacttttgccttccctctttttcttcaagcttctttattcactccttaatacacacataatctcttatatagaaaccacatgttgccaaacatatatatacacatattttccaatatatatgtatggtttgttcactaataatctatattttttgttactaattccaagaacattaaatgtggtctaacattgacaattggtttatgtaactctaatcctaattaagaagtagtgagttaaaacttaaatctaatgtttttgccttttggagatgtgatagaatagttgaaaaccccacatttgtttgatatgaaacttgggacatgtctatggtatcaaattcattggatgatgaacacatttgacttttgtaaaatttagaaaattacttctaaaattttattcataaatttttcatgatatatcaaatttccgcattatgggtggttgtcttttttttagtagatatatttaggtgagaaattagacagtttttgcattagagttgaaaaaaagttactaactaatatctcaaattcaaatttaaattttaaactttttagttaatgggactgagctacaatttaaaattgattatggaagaaaatctgaaaaggctctaacttttcccctcaaaacgggaagacaaatttttgtcttctaatccaaagttcatcaaaataataacccaaactaaaccgctaaccaatataaatcaaaccagaccaatattcacaattttatttaacttatacgcttttacaaataattaaccaaattagtaatgtgaatgaatgtaactatttttccattatcaggaatttattcattaagaagtggaaaaataaagataattaggataataaatcgtcaaaccggaaccgaaatctcggtttgctccggtcttcttaaaccgtaacgtcgtttacaaaaatttgatctttactttaagttttgtgccttttacttcatctctcatctcttcttctgctttgagaagaaggaacaataaatgcagttgaagtcacactctctctctctctctccaagtcgctctctttcgaatccaccattgctgaaacttgatccttctctgtaagtcttcaaatctccagagtgggttttgcttccgggaaaagtactactcgctgaatcatcttccaagattcttcattttgttactcgatcgtttgatccgatttcctgtcatcggtattaagagaaggatctagatatagcttggtactaaagtagctagatattgaagtagcttcagcaatgtatttacattttgttcactgattttgttttgtttttgctgattcatgaaatggagtcaatttgagtaagaaagttgctaaatttgggtcaaactgcgaaagtcttggattctagattagaacttgtagtttaagtttttgggcttctcaaagatgtgacctttaaatgcttgattggtttgagaatgttggttttggttaccttggatccatttgctcaatgtgaatgatttgtttgtgcagagaatctaaatggtagataattttagcagaatg

SEQ ID NO: 34764 - DNA, 3000 bp, Unknown; identical to SEQ ID NO: 34763
  misc_feature (1)..( 3000): 2750-1469P.txt file - cDNA_ID_3081926; gDNA_ID_2926226; Annot_ID_203498

SEQ ID NO: 34765 - DNA, 3003 bp, Unknown; identical to SEQ ID NO: 28548
  misc_feature (1)..( 3003): 2750-1469P.txt file - cDNA_ID_3081951; gDNA_ID_2926226; Annot_ID_203491

SEQ ID NO: 34766 - DNA, 3000 bp, Unknown
  misc_feature (1)..( 3000): 2750-1469P.txt file - cDNA_ID_3081985; gDNA_ID_2926227; Annot_ID_142569
tccaatccaaggttgtggacgattttataaatagcctcttgtcttttccttgtaaataaagttacctcaagatgtcttctttttttttttcttattagtcacattttgtaactaatttgttgtccataattgttgtaaattaagtcctaaaattcggttggtaaataaataagcgtggtagaaaatacgagttgttttttcttcttaacggaagatgatatcggttgtgaaagatgttgaaattttggtatctttatttatcgttgtagttagtattaacaacgttgccgcggaatcttcaacctgtttgagtatttacaaatatggtggagctccggcagttttccgatctcccaattgccctctctggaatctccagaatcgccgatccttctcctcccccgccagtcgttgccatacggcggcgattcaagggcggaggaaataccaggaggatcgtcttctctgtgcccttgatcttcgcattccctttcccggtatgcatcgttgccttgggatcgccaaagagaatcaactgttttttttttattccccaagataagatgattcgcaggcaagaagactggaacaccaaaggatgttttggttggaatcgcagctgtctttgacggccacagtggttcagaagccagtgagatggcttcacaacttttgttggattattttgctctccacatttactttctcctggacgcaacattttctaaggagctcactggaaagctaccaaattcactcatgcatctatacgacctcgattcccaaaggtagtcctcgtgacatagaatgttgttcttctcacgagatatgattttgcaaccctgtcccactcacttttttacacaggttccaagattcattgccgctcaattttcacttggatattctgaaagaagccttgctcagagctatctacgacattgatgcaacatttactaaggtgtggtgcatggccttctactctatcatttggaccgttgttttttcagtagcgtgattagactctgttgtttaatgcaggaagcatctactcgaaagttggattcaggttcaacggccacaattgcacttatcgcagatggtcaactactggttgctagcatcggtgattctaaggcacttttgtgttctgaaagatatgagactcctgaagaggctaaaggttcccgcagcatccctttttagactataaccaaccttgtgaagccactaagagtataggggaatgaatgaacgttttgttcttttggtgtttgcttattgcagctactttaataaagttgtacagagagcgtaagcgcaatcaagactcttccccatcaaggttctctgatttaaagctggaacatcgcactggactcatgcgttttattgccaaagaattgacaaaggaccatcacccagatagagaggatgaaatgctccgagtgaaagctgcaggaggttatgtcaccaagtgggccggtgtgccaagggtgaatggtcagctggctgtctcccgttcgattggtgaccttacttatagaaggttggcactgctggttgtatcctagaatctctctggaacacgattctagctggtttacactatgagaagttgaaatgtgagttttgatatctctttcagttacggtgtcatctctgcacctgaggtgatggactggcagcctctagtggctaatgacagctacttggtagtgtcatctgatggtatctttgagaagttagaggtgcaagatgcatgcgatcgcctgtgggaagtaaagaatcaaactagctttggagcaggagtgccttcatattgctcaatatctttggcagactgcttggttaatactgcctttgagaagggaagtatggataatatggctgcagtcgtggttcctctaaaatccaatctagattgggagagccaaccaaaagagcaatctgtgggtccttcgggattcaagatgaagaatacatatgcactgccatgtgagtttctctcatcacaacccaacttattccgtatgggatgaagagtgatctttcatttctaaatatatctgtttttcaacagatggaacttttaatccattgcaattgaagcagactcaaccactttcaaccatgtttaacgagttattggtatgttcccaccaagacattaccatacaaatgcccaaggaaagtgtacaagtactttataataaaatgagtcaaccttggtattgtaggttgaagaagaaaacagcagctattataaacttaatggtacctttgcatcatatgggtgacttacttactggtagcctcttccgagtcattattctctggtaagtgaagtgactgactagtatcacctcgttgcaatcttgtttaatgttttatctttttctttctggttctgtatactgcactaacattcaatcacaactcataccttgtaggtgcaactaatttttcaacaaggaccaatttttgtgtattctgttttctaccatctaattcgttagtttttggtctagccataattgttttgtttgtaaattgaaaattggaacaaagtataagaacaattataataattcaaagtacaagtgggtgtgtatatgtggacgaaaaatgtgaagaaagttgttgaaatggtttttaattggcacaatcatttgtggcaaaatccaaccaatgatgtgaaaaataaatcaaatccaatggaaatgggctgtagaaatgagtgcatcattaacgttgtttctcctcttcagaggccggcccactgaataatcttaattccaggtgtcaagatcggagccgtctgattatattatttaattgcgggacgtatcgggaaggttcttctcttggccgcctctctcggagtctattacttcttcttcttcttcaaggaggaatcgggatcgtcctcacatctcattcgcattttgctgaagacttctcaccggcgttgacaaaaaaaaacgaatccggaagatg

SEQ ID NO: 34767 - DNA, 3000 bp, Unknown; identical to SEQ ID NO: 34766
  misc_feature (1)..( 3000): 2750-1469P.txt file - cDNA_ID_3081985; gDNA_ID_2926227; Annot_ID_203549

SEQ ID NO: 34768 - DNA, 3000 bp, Unknown; identical to SEQ ID NO: 34766
  misc_feature (1)..( 3000): 2750-1469P.txt file - cDNA_ID_3081985; gDNA_ID_2926246; Annot_ID_204218

SEQ ID NO: 34769 - DNA, 3003 bp, Unknown; identical to SEQ ID NO: 28861
  misc_feature (1)..( 3003): 2750-1469P.txt file - cDNA_ID_3081989; gDNA_ID_2926227; Annot_ID_203548

SEQ ID NO: 34770 - DNA, 3003 bp, Unknown; identical to SEQ ID NO: 28861
  misc_feature (1)..( 3003): 2750-1469P.txt file - cDNA_ID_3081989; gDNA_ID_2926246; Annot_ID_204217

SEQ ID NO: 34771 - DNA, 3003 bp, Unknown; identical to SEQ ID NO: 28859
  misc_feature (1)..( 3003): 2750-1469P.txt file - cDNA_ID_3081993; gDNA_ID_2926227; Annot_ID_203546

SEQ ID NO: 34772 - DNA, 3000 bp, Unknown; identical to SEQ ID NO: 28858
  misc_feature (1)..( 3000): 2750-1469P.txt file - cDNA_ID_3081997; gDNA_ID_2926227; Annot_ID_203545

SEQ ID NO: 34773 - DNA, 3000 bp, Unknown
  misc_feature (1)..( 3000): 2750-1469P.txt file - cDNA_ID_3082001; gDNA_ID_2926227; Annot_ID_203543
tagtggtagcccgagacatatcggacaaaagcaatgttatgaaacttttcttcaggtatcaacaccagattaacatcatgccagttggacctacaaaaatagattcatccttaagtgtgattaccatactttgtgaactactaatcttttgagaggagtggactatatccccaacggaactgtttgttttggcaatgtaaatgttatttttttaataataattggtgttttcttttagtattgagttgttgggttccattatattcgctctctgcgttgaaaagtttgtgattctacggaaaggaatatgctctggtggatgcgtctcggttttggttctttgtgctcacaagtaacgacggacgaagattcccaacaaattcacatgacaaactataaactatagtctataacaaattacgtaatctgatttatttctttattatgaattacacaattaaatacagtagtcatcttaaagagagattattacagtggaccttttggtttcgatagattgcgtcacaaaccaaaaaggttattcatttctcgatgtacaaatattattaaagtcgaatgtaaatttacaagaaatttgggggaaacgaataaacggcgacggaagggctgccactagaccgagaagaagcaaagacagacgagctctgtttttgcaagagagagttttttataataaaaactggaaaagggcaacaaaacgactctttggccggtgaaactgtcaaaaagacattaagacttggtctctctcccactgcaccgccgatccttctctacttgtcaaactataaaagaaaaagagtatttttttttgtggagaccaccaccaccaccttcgatcgatttctactaacttgttcttcttcttctttctcaactctcttgtcttttgtctctccaccaattttttcttgttctttctctctccaccacataaaaaaaaaaaacctagctttgtcccctcaactcactgattgaactgcttgattttcgattgatcatctgggtggttttgaatcgaagagtattgttgtattagtggctggtggctctccaaaagagtaaggccggagagagaaatcaatggcctctggcggcggagaggcggataaatcacttgaaatcgggtccgggaccgcggatcccaaaataggcggtactgggagcaggagcgccggagaagaacgatacttcagggcagatacactggatttcagtaaatgggatttgcatatgggtcaaacctctactagcagcgtcctcaccaattccgcttccacgagcgctcccgcaccggcgatgcaggaatgggagattgacctctccaaactcgatatgaagcacgtcctcgctcacggtacttacggcactgtctaccgcggtgtctacgccggccaagaagtcgcaggtccgtcttttctcctagactaagatatatatgattcattaggatagacactggtggtcttttttggggatctcccgtctgatggatgttatggtttgctgcagtgaaagtgttagattggggagaagatggttacgccacaccagctgaaactacagctctccgtgcttccttcgagcaagaggtcgccgtctggcagaagctcgatcatcccaacgttaccaaggtattctttttacattcaccgattaaggtagaagaagaaccttttgatcaaaggacttattcatttgacctctctctctctgtggcagtttataggagcatccatgggaacctctgatctgcggatccctcctgctggtgatactggcggacgtggtaacggtgcacatcctgcgagggcctgttgtgttgtggttgaatatgttgccggaggcacgcttaagaagttcctcatcaagaaatatagggccaaactacccatcaaggatgtcattcagctcgctttggatctcgctagagggtaatctctcctttactttatgtttcctgatttgccattcatttctgaaactattcagacaaagatgcttcctttatcaacaaaactcttcctaccttttttctttgtctcaggcttagttacctccactccaaggcgattgtacatagggacgtgaagtcagagaacatgctgttacagcctaacaagacgctgaagatcgctgatttcggggtagctagagttgaagctcagaaccctcaagacatgacgggtgaaactggaacacttggatacatggcaccagaggtatgtaatgttgttcctgtagagtcaaaatccttgtgtttcgtaataggaaagatgagaatgttagcttttgttgcataggttcttgaaggaaagccttacaacaggaaatgcgatgtctatagctttggggtatgcctctgggaaatatactgctgtgacatgccctatgctgactgtagttttgctgagatctctcacgccgttgttcatagggttcctctctctctctctgtctatacatacaatctctcctatgttaaagctaatcaggaaatctaatgaagtcactgtttggtgcatcttgctcagaatctgagaccagagattccgaaatgctgcccgcatgcggtggcaaacatcatgaagagatgctgggacccgaatccagacaggcgtccggagatggaggaggtggtgaagctgcttgaagccatagacacaagcaaaggtggtggaatgatagctccggaccagtttcaggggtgcctctgtttcttcaaacctcgaggcccctgaatctctctccctctctttcctttttgctccgtgtctgatatattcttgagagctgcgtgattctttggattttgtatttactttgagctatgggagttggattggtgtgggttttgtcataagaatctttctgcgctctatgtatttatatacttaacacagtcgtgtataattcgattaagctttattttattttttgatgttgattcgaatttcatatatacacgacgcacacatg

SEQ ID NO: 34774 - DNA, 3000 bp, Unknown; identical to SEQ ID NO: 28852
  misc_feature (1)..( 3000): 2750-1469P.txt file - cDNA_ID_3082013; gDNA_ID_2926227; Annot_ID_203537

SEQ ID NO: 34775 - DNA, 3000 bp, Unknown
  misc_feature (1)..( 3000): 2750-1469P.txt file - cDNA_ID_3082017; gDNA_ID_2926227; Annot_ID_203536
agtgatttgcaggtaaaccaaaccacacaggagttggtttgttgatacgacaaaaaagcgagagagagaattatttgatggttaagtgtggctgactaaactttgatttgattggtaatgacagaaactaattgatgtatacatgaagaagatagaggagctctacaaacagaaagaaaaggtaacagttttgtgtcaatgtttctagtctacttttgtatctgatccatcttgtggattgattagccattaattactacacacatatatgaatccacaggaattgatgaaggtgtgaccataatggttgttaggggaggagacgtaattcaacaatctggtaaaatcccgcaatttccaatgccttcgtttcttttactatttgccctgatgtttccttggggtacaagcatgtcttttgggaattgagagcaactttgtttaaattttcggttgcaaaatttttagaagaagcctctgatattttgtttcttttattaaaggatccctctttgtacagcaaaactcttgttaattttggttcatcaccccaattatcaaatcttatttttggcttattgtgtttggaactgaaaatttaaaagtacgtattacaatattagattaagatattctttgtattataatctgataaaataggttattggagccacttcaaatgcgtttatcttattataatcacacctcgccgcattgagaaatccgtcaaacccaaaatatgtttgtctatgtttgcaaagcatcgaaagttgggatcagtgggttaaaattgattaaaaatacaaatcatcgaattattttaattgtctattaaactgtatagtacacgtttttccctccgtagctggcgaatttgacttctctgaacctacaaaaattttataatgataaaaattctatttttttcatctttaaaacgctattacttcatacaggtttaattttctaaacataaatcgctacttcattcaacttatccttccaaatctttcaaattgagaaaaaaatgtgacaatttcacgttttatctatatagcaaacggatgcggatctcgatttaaaaactaaaaagtcccaaaatgacaattagtttattcgtggttgttacttgtaacttgtaacttgtaagacatgcatgcatcaatattcaatagtggtgtgttatttaatactccatatagatatttagtctctactaatattctaaagtgttgttattattattaattaagtgatcccataaaccgagggttaacccatgatgattattttaattagtaggcttcatgggagagtatattttaatttgtctagtcacaataagaaaacattttatgtcactaattattatactggtaatctttatacaaaaaagcatcgatatactactgactattctagtactatatgacaagtggctgagatgttggattccttacatcggaactccaactaaactttcgttaatttgtgcttcaaagtttcattacaataaggtttttatttatttattgatttgtgtttatataatataggatagggtcaaaaacattataaaagcactttaaaaatagtctatgaagattattgtacttactttggttctcccttcatttaactgcataaaacaccgttcgtcagtcaacacttcaaagataaattaactcatactagttgatatatacatataccatcatgtagctttagtcactagtcgaatattttagttaatcttgatatgtttgtttcattcgcattatcttcgtcaattattttattcattcatattttttataaaatagtttaatcttggtacataatttaagttaaagctcgctttgataggattttaagtcgtttgaacccagtcatacacaaaagtggaatacaaaataagaaaaatggttaagtagttcatgacgttatattggtgtgcccaacggtaatctgatgatgatgagccatgatcccatgagagagcgaatcaccgtggatctgtagcttattcgacacgtggcactatgaatggtgaaaagagtgagcctcgcgagtgtacgtattctctatactcgccgtgtgcccgtggcgcagtgacaagttagtcatccaaatatactaacataatttgtacttttactaaatgatcactcttccaaattttttgtttactagtatttaataacatgttttgacaataatatcgttgtaaatcagctttatttttgtttttatataaatttgagtgcagttgttttcaaattgcatatcagttataaaaagacactgtaaaataagcagtcccaaaattttcagtgacaatggtacgtgggtgtcgttcccacgcatatagaccgcgcgtggttagtagtacaacttgctaacattcatataaaattacaaaaaattgttcttttaaaatgtgcactctttttttatatattagatttgttcatacggtcatggagtgaaataatattaaaaatacagcaatgaacatattatattcatatgtttttgggtgggcacaagaaatcaataattattatatatgatagacttgtattaaaaaaaatgtagtcatagaatatatgaataagataataattatagtatgtgatattaaaaaaagggaaacagataataataatatatgtgactaaacattgagcagtggctttattccataagaaagtgacgtttctgccatgctggcatttcgagatcgcagccgtccaaatcacggtaagatccaacggctaacattaagacattctggtcatttgaagatcttgaaccgtcgtctctcttacatccttttttccaggggtaggttttttctgtgcacaaaacatttgaggagaaggagacgacgagagctctgaaactgaaatacagagaaggaagcttcaaaactttgaaggagtggaatctgattttactcagttgatgggagcttagtctttctagcttgcattaatg

SEQ ID NO: 34776 - DNA, 3003 bp, Unknown
  misc_feature (1)..( 3003): 2750-1469P.txt file - cDNA_ID_3082042; gDNA_ID_2926228; Annot_ID_142594
aattatttcataaacttcgaagcacgtttcgacttcgttcatcaatcatttttacttcgtaatcttttaagttaatatattcaaatcgcaatttaaaggaaataatgttgactaaaaaagtaaatggatctcgatcatttttaaaacgatgataaaatgaaacacatagctggaaaataaggactgctcaacggctgaagttgactcttatacggtcattagttttgggttaaaggaaaaggatccatgtgatccaaacatttcgttgcttctcttggtgatgcatattcgtttggtctaattggattcaaacttgaaagtaactatttataaaattaatttgaattttaacttaattttatgtattgaaagttagttaaataattaactatttttgcggatacttaagccatcactcacattacaacaccttaaacaaacatttcagtttgtaaacttcatacgaatgattcattttctgtcggtccagtaccaaaattttaaaatagtttggaatctttgaaacttagattattttttcgcacttaattgtgataggatatttcctgttttaatcagttattaagtcagtaaattgacaaattaaagtctgtatttagttggcatgtcatgtgagaacacataccgagacaattatccaacataatagacaggatttaatttgttgatcttctagacaaacgtgagttaactattacatatacgagtatttcattaaactcatagcatatattaaaaaagataccaaattaccactcttcactatcattgtttgtttcaaactttcagtttcagattaccattctttaacagaaaataaaattttatatttttcattggctttgatttctttgaatgtgaaacaagtatgtatgatgacacatgagttacgtttgtacctatatattatcatggtaacttaaaccgtaataaaaaaaatgtgtgcagaggtataataatgaaaaaaagagagaataaactaataaataataaataattggagaaaataaaatagcactacatatgttgcatgcagccagcaaagtaacatgcagtaccatgcaagtaaacataatgtataaggaccaaataccacatgggttcttacagttggactttgcttatttcactcacatttgtcactattcttttcttgctttcgtcatttacaataattctgaatcggcaattttatgttcctttctttattaaaccgatcaatagatgaaatggaacaccctaaccaaaaatgaaaagaataaataatgacaggagtacccacggacaaaggcaactagtcgcaacatagactttttagttttaactctttatttactaatcggagcagtttagctttgaacgtacccaagtcataagtatgttataggcccctaccacaggaacaaagttttatttacaaatagaataattcattaccaaaaccaaaaagtttatgcaaatattagtctttcagaaaagagaaaaaatgggcatctttgttactttagctataaaaaatatgaaaacaaaattcaaagaatcaatcaagttttgtagaaaacataattcaggaactaactggtgggatccaatgtccatatacatatcatatataattgatatcctatctactttggcactgaaactcccctagacatttttttttaaggtgttatttcaatctttatttgtcggcatatatatacgcaaacacgtacatttgtgcgtatatattaaattacgtatctatcgaatttttaaaaatgcttttttagtctccctccccttttaaaagctgggaaggggttgttgaaacctctttaattaaatgtttaacaattatatactaagtatgatgttcgatcatctgatcatacaatattgtatatcttatagttctgaaacatttaggaaattttagtgtccatttttattcggcgtgatatacgtatatgttgtataaactataaattgaaattaacggttcattagaaccaaacttaataatttgtctaagcataattgttctacaaatgggtaaacattttataaagtcattaactcattatacagttagggatttaaaaataagaaatactcaacttcggatttggtaaaagtaatatatttaatcggctacgtagtgtgcaaagatacttgccgtccatattgaaatcatgaagaaaaaactattcaacatcaaaggatcaaatcaccataataacatgaaaaataagttcagttatatttttaatttgtgtaccaagttatactaagactacattatatatgagaatttcgagaagctatcattggatatggtctaccttctatgcgaaccaccgagttgatgtatacaatgtggctcgagtggcgaagtagacaccacaccttagtcttcaagaccaagtcttcatcactcttattctcacctacttcaatgtttcattactaattttgctttatatttatatatgtgtaatgggaaagttcctaggtcaagttttttttttttttttttctaattttaaaatatttcacttttagttggagtatcatatattaattacttttgccgcttttgacaaaactatagccatctttgacattatactataaattatttgttcttacgtcaattaatcaaatattttccaacaaacactggtcttcattatatttaaaaatatacataacctgaccagaattgcgttttaacaacggattttttttatggctctaagataaaataaaaagtcgttgcatagctagtcgttattatttcgtatttagaattgatatgtttagccacgtgaaggagaggaactaaaaacaaatataatattaacataaatatgttcattatattagagaatttctcttcaatatcaaaaatgtaactggactacaatttggaacttacaagttagtcgacgagataaatctgaaacgatagataaagctcaccggcaagcaaacatg

SEQ ID NO: 34777 - DNA, 3003 bp, Unknown; identical to SEQ ID NO: 34776
  misc_feature (1)..( 3003): 2750-1469P.txt file - cDNA_ID_3082042; gDNA_ID_2926228; Annot_ID_203587

SEQ ID NO: 34778 - DNA, 3000 bp, Unknown; identical to SEQ ID NO: 669
  misc_feature (1)..( 3000): 2750-1469P.txt file - cDNA_ID_3082046; gDNA_ID_1620305; Annot_ID_152788

SEQ ID NO: 34779 - DNA, 3000 bp, Unknown; identical to SEQ ID NO: 669
  misc_feature (1)..( 3000): 2750-1469P.txt file - cDNA_ID_3082046; gDNA_ID_2926228; Annot_ID_142593

SEQ ID NO: 34780 - DNA, 3000 bp, Unknown; identical to SEQ ID NO: 669
  misc_feature (1)..( 3000): 2750-1469P.txt file - cDNA_ID_3082046; gDNA_ID_2926228; Annot_ID_203586

SEQ ID NO: 34781 - DNA, 3000 bp, Unknown
  misc_feature (1)..( 3000): 2750-1469P.txt file - cDNA_ID_3082054; gDNA_ID_2926228; Annot_ID_142590
cccattcttccaagtatgagacagcgcaaagttcctttccaagacaatctccgtagacagctgaggaaacttctcatgagatagcgttccaatgagaagcttatccgatccaacagtcacgtaaagctggattggttcggttacattgttcttactctctcccaaagcaaccttcaacaaaaataaaccaaacgtcactgtaaaatacattcttataaatcaaattaagcttgcaaattcaaaagtacctgagagatgtgcacgagcctgtctagcccaggatctaggtgaagtggtttgccattcttaacttcaacacctgcaaacgcatagaaagcatacaaatcagtaattctgcaacaaaatccccaaatgaaacctctatcggagttaaaacctagcgagagagaaaacttttcagttttccccaattttctacgaagacgaacagtccataccctagattgtcacatatactcactattcccgtttctcgtttagctaaacagaagattccatagaaaaaacagtagaaaaacatggcaaaacgaaaaaaagcgatgaaaccagaagctaaaaaaaaactaaatgcaggaaatgaagcgcagagaacgaagaagaagaaggagtaagataggagatgttttttaccccagaactccattgttgtgcgaggtagtgtgatcttgaaggcgacgatgcgtcgaaggagaaggagaaggttctagaagaagctgagagcgattcgtctctcgagagcggttttagggcgtgttgatgtgagaaggctaaaatgtccgctggaatttattaatcggaggaagggattttagggatcctctgttacgcggtccactcgaatatctcctttagttgggccatgattttaaaattagcccaacaaaactaacgtttcaagcccatactttattttgacggctttttttaacggtgtcaggacggatcgtaacggacttttaacactttatttgactgacggagttttcgtcaacatgtggggtctatatattcatgtcttcatgacaatatctatctccattcctcaaaataagtcccacggataaattgagcataatgtatcgcaaagttttaatttttttctaatccaaagaaaaaccagttaacaaaatctgtgaagagtttatatgataaaactaagtacggtccccgactacgaataattaaaattattaaatggatagttgcacgagtgagaattaaggaacactattattatattaaacacaattcattttagttagatctattcggggcctctcgtgtttagatttagaagagttctcggcatgaatcatgaacattttccaatgctcttaaatttatagtttaccaatattatactccggttttacatatcacacataatttcgatttttttcaacatatgtgatcataatcaattgttaagttttaatttatgcgcataaaaaaatatatgtttgtatagtagttaaggagaatttttttttgttatgttttagcactttttggattaatactagttttaaaagtatgattttttttttatttttttttgtgcacaaatatgatcaaacccaaaagtttctttacatagtagcaactttatattctcagcagccatggctaaaaaacgtaagttaatgacaaaaatgcgttgagtgcaatgaacctggcagtattcgatgaaccttagcggatcaaatgatataaatatgcaatagaatttaaatatttatttattgtccaagctgcgtggatagcttgatagataaattaatgacagcacattgactacccaagctgcgttgataagtacttgatcaaaatctttacatttttatgaagtactataatccaaagttaacttttaagcaaaagataattttttgtaatggttgtgaaaaattcacttataataacacgaaacataatgaagtattattagttcatttatatataatacacaaaaaacataaaggcaataaaaataaccaaattaaaaaaaaatggagaagtagaaaagaaaacgaaaaaaaaaaaaaaagagagagataagatgcatgcatggtatagaagtcgcaggccgaagaccagaaatacgaatgtgtttgaatagacaaattaaggaatataaagacagaagagcccatccattttcgcatacacgaatacatccccctcgactccaattattttattatagtccattctctcactttctattctaaatattgtggacgttataaaggctttttatttattttatgtcgagttttttagactacgtagagccgaatgaaaatttcatgtttaggtatacgaaacttggatccaatgttacggattcagattggtgtaaaagatcaaatttgatagtatttggatttgataggcaagatggtttagtattttacactgtgtatgttcctcttttagctttgcgttttctactttcactacgatactactttttatcttccaatttcagttgcttatcaccaaaatatgaaataccaaattaattgtttaaacagttttattagcgattaaattagcacaaaacatatgaatagatatcatagtcgaatacaaaaattagacaaataataatacactaaaaaacaaactaaattggagaattgttttgacaaaaaataaaaaaaatgtcaaagttccataaaaaggaggacaaaagaggaatataacgaaattatcaacagaaacgcaccgagtaagtttatttcctatgataacgcaaaaacaaaaaaaaaatccaattccattagagagagagagagagagagagagagagagagacttttttaaaaagtacaaaaaaaaaatgaaaaactagagagagaaacaagtggctagctagctcgccaaacttcttcaacaatggcggtttcctagggtttgatgtttatatgatcgggaaactctctcatctagatcgcgataactctcttttccatg

SEQ ID NO: 34782 - DNA, 3000 bp, Unknown; identical to SEQ ID NO: 34781
  misc_feature (1)..( 3000): 2750-1469P.txt file - cDNA_ID_3082054; gDNA_ID_2926228; Annot_ID_203583

SEQ ID NO: 34783 - DNA, 3003 bp, Unknown
  misc_feature (1)..( 3003): 2750-1469P.txt file - cDNA_ID_3082081; gDNA_ID_2926228; Annot_ID_142582
cctctaaagattcacttgtagaaccacatgagatctgtgctaaagatgaattggcttctgatttctccagctcaagctatgagagctcgcatgagatcagtgctagtgcagagaccaaacttgataagataagaagctctctggatttgatgaattcagagacctctcacgtttctttaacatctgcattccgtaataagaacatcaaagatgtttctgaatacggcaacaatgagatcatggaggaagattctctatctggcaaagaagttgatcagaaagattctgtctttatgtcggaacagagcgtggagattggttctttcagtgagaaatctgttgtgatgaatccagatagtcctccaaacaaactcagtttaggcggagcagccattgaagatgtcaacgaaaactcagaaatcataaacaaaggcgacggatacaacagttcaaccacgagtatcagcgaggaagaagtacaacaacagagtaataatataatgacaaggtctagctttggaaacagacctcatatgtctaaggatgtgagatgggaagctattcagcatataagggcacaacacgggcttggttcattgggtcttaggcatttcaatcttctgaagaagctcggctgcggagatattggaacggtttatctcgctgagctcacgggaacaaactgtttgtttgctataaaagtgatggataatgaattcttggagagaaggaacaagatgtctagggctcaaactgagaaagatattctcaaaatgcttgatcacccgtttcttccaacgttatacgctcacttcacttcggataacttatcttgtttggtcatggaatgttgtccgggaggtgatttacatgtcttaaggcagaagcagcccggaaggtggtttcccgagccagcagctaggtaccttggttcttacgattagtggttaacttttttatgctttatgatttgtgatgttgtagttactaattgtttttgtcttataggttctatgtcgcggaggtgcttcttgcattggagtatttgcatatgctcggggtaatataccgagatttgaagcccgagaacattttggtacgtgatgatggacatatcatggtgacagattttgatctctctttgaggtgtaccgtgagcccaacgcttctaaactcatcatctccactccatgcggatgcaatgagactctcttcgggtagccgcactggatctaactgcatcgagccatcgtgtttccgccctaaactctcccgcggatcagggcccaagaaaaaaggcaaacaacaccgcatgatgatgaaaaaactcaagaaatctgacctaatcgcgcggttcaaatcattgccacagctcgtggcagaaccaacagatgcgagatcaaactcttttgttggaacacacgagtatctcgcgcccgagatcattaaaggagaaggtcacggtgctgcggttgactggtggacatttgggatctttctatatgagcttctttacgggaaaactccattcaaaggagctactaatgaggagactatagctaatgtggtgcttcagagcttgaagtttcctgataaccctaatgtgagtttccaagctaaggatcttataagaggtttgttggtcaaggaacctgagaaccggttagggacagagaaaggagcagcggagataaaacggcatgcgttcttcgaaggcttgaactgggcgttgatccggtgtgcgatcccgcctgagcttccggatttctatgactatggagttcctaatcaagaagggaaaagcaattacttagattgcaaggcagttggggaacatcttgagtttgagttattctagaggaagatgaagaagcttacgtattattacagcctttcatagaactcttgcttgtatcctaagttacagagtcactttttggtttattattatttgtttcatttttttaaagaagtattgttattttattttactttttgtcaactattgttatttggttttaaatatatataattttttccaaatagaaaattacctgacataaatagatattgtggatactttttttttttttttttgatattgtggatattgattgatataaattttgttttttgaaaatgttgtgatccatgtaatgtatagtctcttaaacttgaaaatctgctcagtgctgctcatatatatcttgaaattagagttcataacaaaacttttgccaagaattgttcttcctccaagcgtaatatataattatcaccgaagcatccactttcaatgtacgattaagagataaacaagagatactttgtcaattggttattggttaaaaaaaaaaagtaacgtacgtacgttaaagatctgtttatgtttttgtaacgcttagttgttgccatgtaagttgctgaggatatctcaaaacggtgaaatccaaacaaaaaacataaaaaaaaattcctttcattagattgttatcctacgttaacaatccaagccaactctgaattattttttatattcttaaacagaaaaatcaaaaatggaaataccatagaagagcaaatagacattacaaaaataaatcgtactgttgaatgtacataaaaaatttcttacgcgtaatgctatgatagcttggcgatggtctcgtgacgcaagatttttggtcatataaattttggaccgttaattttaaaaaccatataataaattaataatcatagaagaagaaaaagttaaaatggacgatgggaattgcaactcgggtggaccccactcagacactgatctttaagcaatcgcttcgtttcgatttcgcaatcacaaaagtagcaaaaatcgaaaataaaaaaaacttagtagcgaacgaacgaacccgcccactcatttagtttccagatttttcttccggatctctctgctctccgaatctcccgagttttttttttttaatttttgtttctcaccggcggcgagaggatatg

SEQ ID NO: 34784 - DNA, 3003 bp, Unknown; identical to SEQ ID NO: 34783
  misc_feature (1)..( 3003): 2750-1469P.txt file - cDNA_ID_3082081; gDNA_ID_2926228; Annot_ID_203573

SEQ ID NO: 34785 - DNA, 3000 bp, Unknown; identical to SEQ ID NO: 28864
  misc_feature (1)..( 3000): 2750-1469P.txt file - cDNA_ID_3082089; gDNA_ID_2926228; Annot_ID_203571

SEQ ID NO: 34786 - DNA, 3003 bp, Unknown
  misc_feature (1)..( 3003): 2750-1469P.txt file - cDNA_ID_3082093; gDNA_ID_2926228; Annot_ID_142579
tagctttcatcataacaatttctttgaacacaattttttaaccatttttttttaattatgtaggagaaatcaatggagtggagggttcaaatcaaaatcatcacttgtatccatttaggccaacgaagctctttgtgttcggagattcttatgccgataccggaaacattaaaaaggctttctctagctcttggaaattcccttacggtatcactttccccggaaaacccgctggccgtttctccgatggccgtgtggcaacagattttctaggtatctcttcatcttcgaaagtaaaaaaacttatcatccttaaaacttatattgtatcaatcttgtttttataaatatctcgattcctaatcaaatttgttgataaatttttaaaaggcgtaatcaattttaccaactaaagtctgtaacagtccaattacttgactgacttttagttttaggcttttagcctttgagatagattatgtggaaatgggtgtaaaataaatgaatgatttggttagtgttaggtacctaactaatcgatgttttagcctcgttaaaaattagtataaccgtatctcttaataataggacagtattattattatatacgtatattttacatatatgtagagatgtgaaaaatgatgagacgtaaattgtactaatatttaaataaggttcagaaagcaatgatggaagagtggtctagtgtcaatccagtgcgcgactcacttttgcttttctttcttctcgccatcttcttattattgtactttgcttttataaaagtgaaattttttactttagtttctgtttattaatcttaaaaactatttatattctcctttttattatcctataaacctttttcttgtaacaaaatttttatatgataaccattttgtttgtgtctcgatgagcatattatggagaaaattaggaatcatttcagtttctacttgttgtgttagacagttggtttggttggtaagggaaattagttcgattatttcaccacttgtcagtgttgcgtcaaatccttcttgtcctctatatgtccaattgaccagtgtcctttttcttacgttgtcatcatttagatgttctataatgatacaatacgttttttttttgtttttgaattttaacacgttaataaggtcacacataatatgacaaataacatgtaatttacctcgaatgctataacatgtagtcatgtaccaatataattaatttatatattttggattcattgtattcgtttgctggtctctttttttctttctaaaggtaattttattattatttctgtttaatactctcatcatagcgccactaccactaagcatcaacaaagcaacatacttcagtcttttctttttcatctttttattattattatataaaaagactataaagctacacaccaacatatgcactgtcaaagtacatacattatagtttaataaacattaatctcagaaaaagtcttatgtcaatagcctttctatgtaaatttctaaggattgatgaaattgtattaaatttacattttgtcaacgatgaaatgcattaattctcaaatatatcctttttatgtgtgtttgtagctaaatttgtggggataaaatcaccaatcccatacttttggaaagattacgcgggaaagaaacgattacagtacggaatgaattttgcgtacggaggaacaggagtgttcaacactcaaactccattgcctaacatgacaactcaaatcgacatcttccagaacattctcaccaccggcgacatctactatcctcccgagcttacttcatccgtggctctcgtcagtgtcgctggcaacgactactccaatttcatcgccctaaaccgccctgcctctgtaagatacgaaaccctattttttatttcttagatagtgatgttaaaatgtatagtgattcatttcttaccttcattgcgtcttacaggaattcccagcattcataaagcaagttgtggatcaaacagaggtgaatttgagacggatccacgctttgggagtgaaaaagattgcagtaccatccctgcaaccgcttggttgtctccctcccttcacattcgtaacctcgttccagcgttgcaacgagacacaaaacgctttagttaacctccacaacaacttattgcagcaagttgtggcaaagctcaataacgagactaaacagtcgactttcatcatccttgatctctacaatgctttcttgactgtgttcaagaacaaaggatctaatccaggtaaaagaaaaaaatggcttgattttatcgcatttttgcctcctttttttgcttatgctgattggttttttgggaaatgcagggagtacaaggtttgagagtccattaaagccgtgttgcgtaggtgtgagccgcgagtataactgtggaagtgtggatgagaagggagtgaagaagtatattgtatgtgataatcctaaaactgctttcttttgggatggacttcaccctacagaagaaggatggagatcggtttactctgttttacgcgaaagtcttaccgcgtctttgattaaagcgtgagaaacaaaagaaacacacattttgcttaggttttttcttatgaagctcaatgtttgagcgctctgttcctgttttcagtatctcttcattcatttgtgtttgtgtgtttaaagattgtgtgactaataaaatctcttaactggttcatttctattactcattaaaaccctatttagtttcaaaaaaataattaactaaagctaaatataaataaatcaagtaactaatgaaccggaaaattaggttgaacatgatcctaataacaagccaaaggactctcagacttctaactaatacttagccttacgaaacagttagaaagatagtggttatttaagtattgtccactttgtttattaacactagagtgtagattttcttctcagacaagcaaatctcaaaatccaaaatatg

SEQ ID NO: 34787 - DNA, 3003 bp, Unknown; identical to SEQ ID NO: 34786
  misc_feature (1)..( 3003): 2750-1469P.txt file - cDNA_ID_3082093; gDNA_ID_2926228; Annot_ID_203570

SEQ ID NO: 34788 - DNA, 3003 bp, Unknown; identical to SEQ ID NO: 28863
  misc_feature (1)..( 3003): 2750-1469P.txt file - cDNA_ID_3082097; gDNA_ID_2926228; Annot_ID_203569

SEQ ID NO: 34789 - DNA, 3000 bp, Unknown
  misc_feature (1)..( 3000): 2750-1469P.txt file - cDNA_ID_3082122; gDNA_ID_2926229; Annot_ID_142615
acacgacacatattattcatagaatctatacaacggtattataaatttataactcagtgtactcaaaatttaaaaggaacatggacgaaacatattttctttgtaattgacatgaaagagcgtaaaaacggtggataaataacaggaaaagtgtcatctagagtattttcttaaaattggctagatgaccaaaattttattaattagttttacgaattcatgactctcttctcttggttattttaggttgagcaggtgattcaataatttattacttctttccatgcaaatccaaaggagtgatgaggaattaatggtggcttacatgtgttttttatttgttcacgtgattagccacgatttttttttcttttttctttcttttttctttctaagtatgttgcgtccactctatgatctcaggtttgaataaaatataaagttctaatgaactggccaattaagttatatcatttatacatggaatatttatagtttccattggtaatttttttgttttagtggagtgctaattttaaaatattaaacaaacgataatctggaaacatacaagcaagtcggtgatctcatttctatggttttttccccccaccaaatccacaatttgatatctagctagtctcttaaaatagtattgtaatgccattaggccacatataaaaaaacgtaaccaaacgcagcaacaactgtgtaaaacattttttttaaaaaaaattaacaaagaaattttagactttgttatataacttttttttgttgccaacctttgttatataacttttacattggtcttaatattcaaaactaaacccaaaaacaaactaaaatcaaaatctgttcgacctggcctctgcatgcggcgccatagatacatttatgatttatcatgacaaaaaaagtactgttttttttcactaaatttaatcatatttagttactagtcagtagtcaccaacgaagtccctgcgaagacatcataaaaagaagtcaccaacgaaaagctaaggttgggaaaaaacgacagaaagtagattcgttaaatatggtggaaaaaatagattttgtaaagaagttttatagttcgatttcaatttggatccgacttctgtgggagtcactctcacattgtcagtgaattattataccatgcttacatattatgcgattgaggtcccaaaacaaacatataacgcgaatctgaatttataaaagtatatcctattacatagtgtattgttgctttcgtactttatgccttcattttataaataaatgcgaattgagatgcaaacaagaacatatcgccaaatcatgttaaagaaaaaacatctcgccaatctctaatttattcacaataagattaacggtctataaccacaccattttttaaaaactgactactaaaccacccacattttcatttttttgtataactatacaaactatcatttaaacagttttagttaaataaaagttaactcaattttgagttgatggatattatactccctaagtttcacaaagaatgtaattttcacattttatatttgtttcacaaaaaatgttgttttatatttccaacgcaaaatataattgtgaataaaaaatctattttgactctatttttttaatatattaacaagaaagatcatttttttagtgtattaataaggagtattgtagaatttttactagttttcatttatgtataaaagtgtagaatgacattattgtgaaaactactaaaagttctactaccttgaggagaaaaaaaaaggagtatgaactacctctcataaaatatgaattatcttgtgaacaaagctaattacttaacatatatatatatatatatatattctacaatatatatattattacaatatatatattattacaaaaaaggagtatgaactacctctcataaaattctacaatactcaaggtacatatatatatatatatatatatatatatattcaaatgcaaaataaagcatttaattagtaactaatgcaaatcatttatttattattatttttgtcggacagatatgcaaatcatttatttatatgtacatttttggtaattttataatttattttctcatgtgttataacatttactgtgaaaatttgaccggcggctaaaagacggaacaaaggaaaatgagtcatctctatattttttgcatctcataactagctagttgaacgtaaaagtcttctaattttgtttttgacgtaaaagtgttttaagtacatggacaaccactagataatcacacattcacgcttctactaaaatattaatctattggttaaaaaaaaagatataacaatcaattttttttttgataaaatgtgatacgaatacattattatttatttgtcattgactcatcatgtgttgttgtaacttgtaagagacttgtgctctttgagagtagaagacactgtttatttgtcttttctttttgttttgattgcgagactagacgagtgtcagagtgataagtgaaagtaactgaaatctatagaataatggaactattattagggtaaagagataaatcctccaaaaattatagaaaacatcaaatcaactaataaaataattctgttaagaaaatccaaataaaataatatttccccaatatacataattttgttttgagtcccgttctacagtatccaaatcaataaatttttaaccataaaaaagcagagaagtttgagagtacttcttcgattttcttacgtatttttcattttcagagactaaccaaattcttctttttcttcttcttcttctctctcgattcgacctttcgtttcccgctcttagatatttttcccccatcttccttcttgttttgcatgcccagaaaaattagacgagaaaataggataagtcagtacaaaaatattccctgaaaatttgttttttttttctcagaaatcagaaagaaaaaaaatg

SEQ ID NO: 34790 - DNA, 3000 bp, Unknown; identical to SEQ ID NO: 34789
  misc_feature (1)..( 3000): 2750-1469P.txt file - cDNA_ID_3082122; gDNA_ID_2926229; Annot_ID_203616

SEQ ID NO: 34791 - DNA, 3003 bp, Unknown
  misc_feature (1)..( 3003): 2750-1469P.txt file - cDNA_ID_3082134; gDNA_ID_2926229; Annot_ID_142612
tgcggagaactacaggttgtattcgagaagtcactttgtgaagggactagagctgcttttattgctagttgtttatcaaatctatgggcattcataccggagttcaaacctttatctgtatatcacagtctcgatgtggtttatggttggttcttggttgtttgcaccatttatattcaatccttcggggtttgagtggcaaaagacagttgacgattggactgattggaaacgatggcttggagatcggggtggtataggcatcccggttgaaaaaagctgggaatcgtggtggaacgtagagcaagaacacctcaaacatacaagtattagagggaggattctggaaatcacacttgctctccgctttttcatttatcagtacggaattgtttaccagctcaatatctctcagcgcagcaagagctttttggtataaaaaaatgttccttcacttttcatgcatcaaagagctttttatgatcctttagtctcagtctcttttttacttcctctttgtaggtttatggactctcttgggtggtcttgctcacatcattacttgttctaaaggtttcacaatccttcatcctttatacacacatacatatagtcataaacaatgcttatataagcttaattacttactttgagtgtaaactgtgtcagatggtatctatgggcagacgaagatttggaacagattttcagctaatgttcaggattcttaaagcacttctcttcctcggctttttgtcagtcatgacaatattatttgtggtgttcaaactcacactcaccgatctctctgcttcagttcttgcttttcttccaaccgggtgggcgattcttctggtaaatagccatcaaaacccccttcagaatcatagtatcggaatttgcatcatgttcttagaaaaaactaatggaaatttctctcagattgggcaagtactgaggtcaccgatcaaagctttaggggtttgggactcggtgaaagagctaggaagagcgtatgagaatatcatgggacttgtaatctttgcaccaatcgctgttctgtcttggtttcccattgtctccgagtttcaagctcgtctgcttttcaatcaagcttttagcagaggccttcaaatctctatgattctcgctggtcggaaagacaaagcaacttcttcgcacaagtaaaaccataaatactcagtgttgtttccgggtttcttctgtcttaagcaacaaacctgcttctttagaacggtgtcgttttagcgtagttcaatagatgtctataaggttatagggatattttagtttggttggacttggacacctcacactctcatcacactcatgtgttgtagttatcacaatgattttgacatatggtctttaataatatagctcaattgatttcttttggtttctgattaaaattattatttgcgggaaaactcgatgaagaaaaatattgacttgatactaaaattcttgaatgcacatcatggaaagaaactccatgattcttttctacttgtttttttttggatgattataatattaatacaacttctagtcattgctagatacaccaattacatgtccgaggcattatatgatgaaacttcaatttcattattctttggcattttcttgcatgtgacaaatattgtattgtatcaaagagatacaaacaaaataataatgtggtgttccttagagtttatcttcattcttttactggagtcttaagtatagaaaatcaaacttaaatccaaaaaatatctttgatcataatataaaaatgatcaaataagtttcaatcttgaagtcaaacacaagaaagtcatgctacttcagcatataagaagaagataaggaggacctaaatttccaaaggctgcatctgagaattacctcttttgtaatttcgttaatcctttatccactttttcttctctatttttatttatttcttaccttatagtatataaaaaataattgtaatattgttgtatttaatcatgatccagctataaatgacacagttgtcaaagttcaccatctttgctttcccttcactgctctctctctttctctctctttgttgattttgttttcctcaaattgcaaatcaaagctttctttccagctttagaacacactctcaccaacaatctcacccaactttttttccttcttttaactcctcactaattcctaatcccacaaaccctaaactctatctctttaatcccttccttacatacattattcagtagttgagtaaagtttcaatctttcttctgattccttgttggaattacctaaattttctgggtttattttggtgggctcgtcgagagatacttcaattgcaattcatcgttaagcatatctatgctaattgcgttctcttctttatttcactttctctttggtttgcttcaatatcaaagcaaagagggaccttttcgctttgcgttcttctcttctaatcgaaaagacaagagcttagtcaccacattctaaggtaatttcatggaactaaaaaaaactgcttttttgtttttcaaggattctactttcggtagcagtttatgattcttctgtgtaatgtatatcttgcttcaatcgtaagtgattcttttccaatagtttaagagctgggtttcctcaggttttttgttttagtgacaaatgttggaaagttaatgcacgtaacttgtttgttgaaatgccgcaattaattgctgaatttgcgcgtgcctttttgaatcctgtttctctatgtgtcagcatttttggtcgaagtggtttttcaaacttctgagtcggcagctttacttaccagttttagagattctaccatttgtccaacaatccctgttttgcttgtaagatttgtgaaagtcagagatgtcttagtcttcttgttaataattgatacgtttcttgtttactaggtgggaattgtgaagttgtgagcaaaaggaaccaaaaatg

SEQ ID NO: 34792 - DNA, 3003 bp, Unknown; identical to SEQ ID NO: 34791
  misc_feature (1)..( 3003): 2750-1469P.txt file - cDNA_ID_3082134; gDNA_ID_2926229; Annot_ID_203613

SEQ ID NO: 34793 - DNA, 3003 bp, Unknown; identical to SEQ ID NO: 28873
  misc_feature (1)..( 3003): 2750-1469P.txt file - cDNA_ID_3082142; gDNA_ID_2926229; Annot_ID_203611

SEQ ID NO: 34794 - DNA, 3003 bp, Unknown
  misc_feature (1)..( 3003): 2750-1469P.txt file - cDNA_ID_3082146; gDNA_ID_2926229; Annot_ID_203610
cgatgggcatgagaatcccccagctcaatgcattcactattgcatggatttgttttaccaacaacatgtttctgttaactgattttgtggttgtgacttgtccggaaagcaaatccaaagaagccatggatttgagattatcaccactcattgcgtgcattccaagtctatctccttccttcaacggaccgtcttgccataagtgattaacgacggttgtgttaggaggcaagactaaagttgcaaatatcatcatctctccattagaatactcagcggatacttgtgttacacgaaggctaagaggagactcttgaagcataggagagtagctattaatggaggaagtataagcacgcatgacaccagaagttgagtttcgataagccacgagtgcttgagctcccaccatgcctttgcttgtcgggtttatagcccacgatatccaactagaagactcaagattggagtgatggtatgcaatttcaagaactccggtttcttgagcataattaaagtgtagataagagtttaacaccaaaagatccgtgcaagagcgaaagctttttccgttgttgaagctgtaagattcacatctagatctagcatgaagtccttgttctgttgctgctgtcgtaaaagatggaatcaacatgaacagacaacacaaaacgactaacgtggctctcgaagacaaggacatgataataattatgattgtggcttttctcggagaacactagggtttacgattttggaagaagagatttatgatttctggtgctagaagctgagtagtttcgcatatttatagcgagttatattcacttcctaagacttaggactgtatttccataatttgatattgtttacttttttttgacccttaagtatatcaacaacaaaaaaaaaaatgtgtacatatatctatattaatccaaaaaataatcttttcacatctttactatatctaatacgatctctttcaaatttggaaaaaccttttctttatgactttattgctttttaaaaaaaacttttaagttttgttagtagcaaaattttaaggaaattatcaattacattattcggaatgctagctatttgtatttcttttctaaaacatgtgattaaaatatgtataaaagaaaccgacactctaaatttttaaatttaaatttccataagataatcattaaaaataaaataaaaaatacaacattaatctcttcaaatcaaattacttattcaagttaatctatgaaaatatttatagtttctaaaaattatctaggttacgtgaatgtattatggattatttgaagtgcattaagcgtaggaaagcgatgatgcataatagtgtcgcaatgtataatacataggttagttgatgtaaaatctaatcattttactatttgtttgtttacttggaatagtgtcgcaatggaaaagtataaaccttatcttcccggtcaacttctaacgttatacgttttcgggtgacaaaaaaagccttaaggttttccgggatgttgattagttagatggttataattcagattaaggtttagattttttaaaaaacgttaatttggttggtcatggtcaaacagcttaagagaaaacgtaaggacttgtcccttaccgtcatttatacaaaactcttcttattttaaaattgttctcaaattgaatagtatggttataaccggtcaactttaacgactctgcctttagtaattagttaataatacacactaaggtgttatttattgggtccattttcattatgcgttctttgaatcttatagtaatgtattgtgacgatgtttattttattctagcatgcgtcatttaaaggtgatcgaaagttgtattggttaaagactttttttcaaagatctcattcttggtttggcggtcaaactactatagttttctctcttttattttgtgcaaatatttttctcatatttcttcatcaatactcaatagattaaagcctagataccaccacttaagtgtttgtgtcttagtatccaaatcaaattctgtttttgttaagcagtttaattgatgatgatgaattgtagttgttatattttttttcttttccaatcactttactacgagtgaattttgtttgtcttttagagattaaatgttgacaaagaaagatcaaaacgtttatcgcaaaatgatcacgtttgcttacaatcgcgccaaacagaaaaattcaccaaccacattttgtatctatgtaatctcattgaccgtagcatttatgcctcgataattcaaagttacataatattctcaaaaatataatttcatgaacttgaatattatgaaaaaatttaaaatctacatttcaaatagaagaccataaaagttcaaatatgcattagagagatcttttttcttttatagtttctctgccactactaaattttcaattgatctaagatataaaactatatcgtaattgacttaagtattaactttttaaacatttatgttgttagtgtaattcaacctaattttcatttaaaaagtacttggcagctaactataactgtttatgttcttcttgttctcttaatccctttaaaatatgatgaagaaatcaagttttaggacagaagaaacggtaaaagaaacgaagtagatatgaaaccgcgtgaagaagaagatgactttagtcaacaaatatcagctatttttttatttctctctttttcagtaatctgacttcaccaagatctctactctgttctttcctcttcttcttcttcttcttcttcttccctctctctaagctttcttaattctcctctattccttcagaaatcaaaatcttaacagtcgaaactaattaaatctttccgaagtaaagacaacttctgcttctgattctgtcacttttagttaacttttctttcccggcgactcaaagcttaattgtcgccggcgattttttgttctcaagcattgatcctaatg

SEQ ID NO: 34795 - DNA, 3000 bp, Unknown
  misc_feature (1)..( 3000): 2750-1469P.txt file - cDNA_ID_3082158; gDNA_ID_2926229; Annot_ID_142605
tggatcttttgtcatcgatgccaactaagcaatatcgttttgtgacaggttgcatggtgtctgtaaagagaatcctttggctgcagtaattggtagattaggattacctctttatcgtactagcggtgacaattcggttttgtatgatcacgatcttgagaggtgtgtacaaccgttgtggatattctaaatgtgtatattaagtaatcttctctctttgttggaaactcatggcgcaattatgttttctgcagttatgctctgttcgacaaggctggtaaccaagtttctcaagagttggtgacaaaagttggcgaaaattttgagcacattctggaagaggtgtgtacttggtgtccactttctcttttattatgttttatggatgttgcgcctctttgatttactaaacagttgtttcacaaatgcagatctgtaaagtcagggatgagcaggacgaagacatgtcaatagctcaagccttttctattgtatttaagaggaaccctgaattgaggtatggaaacatattgtctcaactcattccgttgatttgttacttatccgcttttatatttgttgcatgcttaattagattttcacttataggttggagggacttgcccataatgtgcttcagtggtacttgtgccgcatggaaggatggtttgctgctgatgctgaaaccatctcggcaaagtgttgggatcaggttagtaacttaacttctatgtctgtcctcggtttagtggttgaggtatgtccccgtttagtgatttgttaattgaaacattcacaggaagaactgttgcccggtggacatggtcttatggttagagggtatcgccctgtaatcaacactctctcgaaaggtcttgatatacgactaagtcacaggtacgattcatttgtcgaaggagtttccaccatttaacgagtctgcagctaaaaccttattggacttttgttttgtcagaattaccaagatttcaaggcgctacagtggtgtgaaggtgactacagagaaaggagacacgtttgttgcggatgctgcagtcattgctcttcctctaggagtcttaaagtcaggaatgataacattcgaaccaaagcttccacagtggaaacaagaagctatcaacgatctcggtgttggaatcgagaacaagatcatattgaattttgacaacgtcttttggccaaacgtagagtttttaggagtcgttgcagaaacttcctacggatgcagttatttcttgaacctgcataaagccacaagccatcctgtccttgtttacatgccggctggtcagctcgctagagacatcgagaaaaagtccgatgaagcagctgcaaattttgccttttcgcaactacagaaaattcttccagatgcctcttcaccggtactgctccaaactaccttttctttcacctgagttgctatattgttttgccaatgtacaagctctaatggggttttctgttggcagataaattatttggtatcaaggtggggatcagacatcaattcattgggatcatatagctatgacattgtgaacaaacctcacgacctctatgagagactgagagtgccattggataatctattctttgcgggggaagccactagctcaagctacccgggatcagtgcacggtgcttattcaaccggagtgctggcagctgaagactgcaggatgcgtgtgcttgagcgctatggagagctcgaacatgagatggaagaggaagctcctgcttctgtccctcttctgatctcccgtatgtaatttaaacctcaggtgttttatatcacctccatatgggaacattgttagatttgattttatgagatttcactagttggaactcttgtgcctattcaataccactcttttttccttcaaatctgattcagatctttagtcgaagtcaaatgtgcaatgtggagtatgtaatccatctgatataagaactatgtttaagtatcagtgccaaatgcaaacttcaaatgaagctttcttttacacagcatggtcaaagcctatcctttctttggtatcatatccttaaaggaccaatataaatcaaagacaaaagatcatctttctttctgactttacaaatcgatgcaatcattagttcattaccttacacaattcgagactacacgagtcttctttcttcttcacatcagctaaatattgaagcaaatcagcaattgctcttaaacatgtcgtatggccgtgtaaatagcaggtgctcagaggggcatcattgtcaattttccatgaaaccccgcctctaattactgaattaaattttgagttaaaaaagggtttataatgctattgaagacttgaagtagtattaagaaaaaataaaaaattatccactttgaagttttaacttttaaaggataagagaagagtagctttcttcttcttcctctcggctactgcgacagagaagaagctgcgaactttaaatgtcacaggctgtaattttcaagccgtttgtttcagttccatcaagtaatcacaggtttccttttctccttcctttctactttttacttcttaacctttttggaacagctttcattttggactttgcttttgttcttgagttttctttcgttttcaattgacgggttcgataattctatggaaaagggaccgcctttcaaaatttctacaaaaatccgtgttgggtttcgtctaattcaattgattgtgtaagctttttagcagctgtgtccaaatgggtttatcatctgaggcttagctactgctagggtttatgttcttttcgtttaggctattaaaagttttggtttttcatttacaaattcgtccatgtgttttgctttgtgtcagccagaggaaactacagaacaatattatcaatgttggtgttaaaatccaaaaccgattcagagttgtttgtatgggaatgttggctccaaggaaattcctgcaaaagaggaggaaaatg

SEQ ID NO: 34796 - DNA, 3000 bp, Unknown; identical to SEQ ID NO: 28872
  misc_feature (1)..( 3000): 2750-1469P.txt file - cDNA_ID_3082158; gDNA_ID_2926229; Annot_ID_203607

SEQ ID NO: 34797 - DNA, 3000 bp, Unknown; identical to SEQ ID NO: 28869
  misc_feature (1)..( 3000): 2750-1469P.txt file - cDNA_ID_3082162; gDNA_ID_2926229; Annot_ID_203605

SEQ ID NO: 34798 - DNA, 3000 bp, Unknown
  misc_feature (1)..( 3000): 2750-1469P.txt file - cDNA_ID_3082167; gDNA_ID_2926229; Annot_ID_142602
tctataaatatgaacggaatatgttttctttattctcccatgagagttaaaagaagattctatcttctagcattttggtactactacaaatttaaggattataattgatactatagaggtcacctaaaagcaaaacccacccactttgttccgtccattctgcagtacttcaaaattatttattttcctacgaagtattggaattgtttttttttgtttttatcaatttataatatttcatcccctcatgcatgacttaacctacgttattctccctatataaaataaagatatagtagcctttatattgtatcggactacgggggaccaacatttactattatcaaaccataatcttgttcgaatctctacttgtttattgataacatatatcgttgcatgataggattatttactaagcatatgatctaaccctaaaactgtgccttaccatcgaaatgtgcaattccttttggcccacatattcttaaacatatttatggctcatttcttcagctcactttttcattttatttgttatttttgatttttttggacattaacctaatatcattgtaaagtttcatcttacacaatttccatgcgatataagttcaaatattatataaagatactaacagctggctcatatagagtcgagatatcataatgtgatctcttcactctccaacttccattaacatcagattaatggagtaacacaaattttctacgtagatatttctgtagacattaatactgttaaatggacaaaatccgtaaacacatttaatatgaattgaggtttttgacacgaaaaactctaatcatggtagtattatactaaaagtaatacaaattctaatacactaaatgagaatcgacaagttctctttgaataattgaaatttagttgcggcttaaatttgttcccggcgggtccaagtcgttgagtagcatgcagtgacgacgacgagtgacgtgtgtcgcggccattaaatcttataagagctagggtctccgagaaaaagatatctatctcattaattacaaatttacatatccatgtgcgttaggtggaatcatttatccatgcagatatcatgcgctattaattcgtcttaaatttctcaataatactttggtacgtaactaaaaactatctctcgcatccgcatatcgtttaattggtttggaatacttaactttagatcaacaaaaatgtttacaaccttaactacgcattagctgataattagctcaataaaaagagaaccctaaatgtgaattttttttccacggaaatatatatgaaacttcttttggaattgaaactctgattcaaatatcgatataacgttctaaacagttcaagtttgtagatatatcatggtcaatcatgttttgttgatatagtttttgaaaatcctcaccaaggacctaccaaggaccaagtaccaagttctgcttaactttttgtaatcaaatcgaccataaatcagacaatcctataagatttaaaccactaattacagaaaaaagtttttctgaaaaaagttaacacatcatatacatccgcagaatcgtaaagagacgaaaaataggtgctagcatgcacatcaaatactaattactaatttgctacagtctggcaacatctaaagcccaactaaaggtttctgcttttgtctaagggtttgcattaaaatcattacatacatagaacaattaatatcggggtccatttatataatcatttaattaagaaacacttattcaaaagttgttataacatttacatctcatgcaacatttcttcttaacttttaaataaaaacaaaattttctttttgtcgtcgaatcattataaatttatagtttttagaaacaataaaaattcgtaaattgtaatcgaaaaacataaagagataatgtatcactgtaaaccaataaaatgttgagaaacaaaaacaaatcaacctttcaaaaagccatcaattattaccggacaggaagagatggtggctgtcttatatccaaaaaggttcaaaattggattattcttcaataggtttatatataataatttccttattcgttttcctatataattggttgaagcttaagagtcatgaagtaataacaagaaataaaaatggagaagaaaatagtcaaatcatacacctacaagattctattctgcgtagaagtaaaatcgtgaaagaattaattacaaccacggatgtattaagtatgaaactttatttattttggaaccgtcaatctatttgaaaacggaaacacattgatgttgacaaagtatgattgaaaaaaatttagatcagtttttttttttaccatcgaagtaactcacacattattgtcactaatacaaccaattgtttacaaaactcgatcaaatgtaatattctttatatataagaaaatttatttagtttatattgactgattcactaaaacttaaaaccacaagtaagttaaacgctatgttgatatgtcaacagtttcaacatgacaacattacagtaaaactatagttttcaataaaactatatctctttataaatatatagttttcaatcaaaaataagattttaagaaaacggtaagaaatatgctaatcaattcaaataaacttatcatttgagttttcttagaaatgtaataatattgatctaaagatatatgacctttttttcttaagagtatttccactcgtaatttttctaacccgatgtatcataacgggcaataatacattaataaaaagtctcttcccaaccttgtccttcggaactcgaatttatgaatttggtccacctcctcttcaaaaggttcttcgtacacctagttctagtttagttttttttcttaataacctagtagtagtttattacgaaactatatatagattagcaatcacataacacttcttctctactacacacgaatcatcaaagttgcacatatatcacaatg

SEQ ID NO: 34799 - DNA, 3000 bp, Unknown; identical to SEQ ID NO: 34798
  misc_feature (1)..( 3000): 2750-1469P.txt file - cDNA_ID_3082167; gDNA_ID_2926229; Annot_ID_203603

SEQ ID NO: 34800 - DNA, 3000 bp, Unknown; identical to SEQ ID NO: 28868
  misc_feature (1)..( 3000): 2750-1469P.txt file - cDNA_ID_3082177; gDNA_ID_2926229; Annot_ID_203600

SEQ ID NO: 34801 - DNA, 3000 bp, Unknown
  misc_feature (1)..( 3000): 2750-1469P.txt file - cDNA_ID_3082181; gDNA_ID_2926229; Annot_ID_142598
cgatttaagcactcccaactccttgagttgtttaatttgatttgagtggttgattcttaagataggcccaaatagagaagcccagtggtaaatatgtgggcctaactcgtttcatcatactttggtagcccaaggtcaggcgttcctgatttagtttaccgaattaaaccagtcgtatctaaaccggataaaatagaaccaatcactcacactagattcgacattttgatacccccacttaaagtttaaactctcgctctccgtgtcttttctctggagattttgggattaagcgtcgtttgtaacgaggtaaatggtcaagtgtactcatttcttctgcttctactgatgaatttcttctcttttggggggttttgctaaatttctatttgcaatttcgtctcctcctgtttttgcgatactgtagtttaaatctcgtgtacagaaggtggatcttgtcagcaatctacctgaagaggttcggtgccatatcttgtccttccttcccaccaagcacgctgctttgacttcggttctctcaaagagctggctcaatctgtggaaactagtccctaatcttgacatcgatgactctgaatttcttcttccagaagagggtaaaggggaaagggatgaaattcgtcagagctttgtggatttcgtggacagagttttggctttgcagggcgtgtctcccattaagaaatccctgagatattcctcagtaggacactagttgagctgaaaataagaagtgaacgttatgttgattggtggcgtagagatagaggcactgtcttaccaatgcttaagactcttgacattgactcagaatctattcattgtggtacgattgatatgtttctaccttctttccctgtgcttgagtatttacgaatggctaatatggagtggacagagtcggatgaaaccgtgtcaagtgcaaccatcaagctgctaagtattcatggcaccggttgtcaaggcttttgaaatccaaagagcatttcttttgatactccaagtctgctttcctttaactactctgatttagttgccgaggactatccattagttaacatgaaggcattatttgaggctcgaatcaactttatagttactgaaaaacaaatcaagcgagtaagagcaccaaatgaagattggttacaagatgatgaagttgatgttgttctccgattcagcaatgtggtgaagctcatgaatggcatacaaaatgttcagaaactttacttaactgctgatactatcgaggtcagttttctatttttcttctcttttgtctagttgtgaagcattaattgcaaaatgtctagttttcttgttttcaggtgctttctctgtgctgtgaatcggtgccgctgttcaacaacctcaaaacattaggtatcacgagtgaggagggacgaggatggcaagcgatgccagttcttgtaagtaaatgtccatatgtagaatttctactcgttgaggtccagttataaaccatgaaactacttggaaaacatgtgttaaagatgttgttcttactcaacaatcttattgtctcctttatgctttcagggtctcttacactatatgacggataaatgtggggatgcttgtgattgcatttctcgggaagacaaaggtcgttcgcttacatcttgtccagtgaagaagttagagattcgagggtttagaggaacaatgaaagagatgacaatgataaagcatttcttggtctactttccgtgtctgaaggagatgaacatctatgttgaggagtatgatcctacagagctcagattccctcaagtgtctaaagttatcatacagatgatggaagagtacaacaagttatcgagttgcaatgttcagctccttataactgattatttgtctgaaaagtggactgcagcaggaagaattctctgagaaaacaaaacttgctcaaagttttgccaaagtccccttggaatttgtcttcggttattctagtttcttttcaaaccaaaccaaattaatcccaaaaccttagtttcctcttctcttatgtttaactgaatcactctacgttttgtttccaaccaaaatctcttgtttttatgcattgtttcctgtcatttactatggttaaagctcaatataataagttcaatttgcaaaagataactttttcagaaacctaacattagtatatccattgttaccctttaagagcagtttaagatctatgacactgtttgtgactgagtgcttgtccggatatgtgggaagatgattatgatgaggaggaggataagtatgaaacctgtttgtgagtgcttgtccggatattttcctaatgtcgtgtcctgtgaaaatgctagagatcaccgattaccggggaactaaaggagatcaaaacagattcattagattgaccttgagcttgtcaaagttcgtccttatgcaacagagcccatagaaaagcattgtcttagaaacaatctactaaagcttcccagatcactcaattgcaagaccccagtttcagtttgttactacttgctctatttgttaatttaaactgttttatgtacagtgttgcttgtaggttcaactctcaaactcccaaactctcaaatgaattgttttgattttattcttcatcagaaattgcccttgagttcttctcttgttaattatgtttgaataacgataactgggcttatctagttgggcctatagtctttcacgatgcatacgcagcccagagaattgaactcgataaaatagattatacatgttctgtgtgatcgttgggtccgaaccaaaccgattctggccaggaaattaaaaccaaaaccaaaccgcttcagaaaccaaacgataccgtttcaatacatcgatatcgactatagcaatttcgccgtaagaaagttttagttacaaaatcgaaccctattctttttttttccgtcaatcgaaccctattcctcactgaccctgacgtttatg

SEQ ID NO: 34802 - DNA, 3000 bp, Unknown; identical to SEQ ID NO: 34801
  misc_feature (1)..( 3000): 2750-1469P.txt file - cDNA_ID_3082181; gDNA_ID_2926229; Annot_ID_203599

SEQ ID NO: 34803 - DNA, 3000 bp, Unknown
  misc_feature (1)..( 3000): 2750-1469P.txt file - cDNA_ID_3082209; gDNA_ID_2926230; Annot_ID_142643
tcttatcaatgaaattaaaatcatggttttagaggacctcatccatttttgtgtatccaggtggtagtctgggatcactttcttcaatcattatactgagaagcttgtccagatccatgccagtgccttcactgacccatccccattcctttgccaattccagcatttccgtaacataggatgcatcatgaagcggtccgagccacattggtcctgacacaaccagtgaagaagaagcctttgtatcactgcagggacatcccatcaaaccaagttcatcgaatctcaatgtatgagaatggccacatagattacagtgcgtgacaaaaccatagttcctacagttaaaagacacaaaacaactccaattagaaacgcaacataaccaaaactcaattcctttcgagtcaaattctaaatgtagaaacaacctgtcctcatgtagcttcccacggtgaaccctcagcatgactctaaacacaggtccgtgataagaatagtacgagaaaagaggcgtaacatgataaccaagcagagcagcttctctcactgctccacctataagcatccgcagcccaatctcattcccaaacggcattggtcgaataaatgctccataagctgctaaagaactacaccaaaacaaaccaagaaatttttcaactttcaatctcctagtccctaaatcatatcatgattcctaaaataccacaaagactaatggtattgctttcactcacttataaggtctgtgaccaccagaagagtaaccatcagtcgacgtcaagtaaagcaaaccacccaatctcaatgcattaaacgcatctctcaaaaacgaagaatcacttccaaacgaatcaatatcaatcatatcgaagaaatccgcaaccatatatctctcaatcatcgctttattagccaacatatgagtcacaacccatctcctctcatctccagtacctctctctactttactcaaattatccgtaatcactctccgattatcatcatttgcgtcgttcgccatcacgaaatcagcttcagcttccacaagataacgaagcgacctaattccacatccgcacattgcgtcgagtacccgtaagcttccattagatctcttgtatagcgtcgctgacaaaacaccgaggtctcgtcctctagcgctttcatggcggaaaaatgtctctcccgtttcaaattcgagattcctctcaatttgaacctcggatttcactaaaattcgatcaaaactacatttcaagctcttgaatcgacatgaatctggagatttacatttagggttttgcgatttgtgcacagtgaagaaggaagaagaagatagggttttaggagagagagtcaacaacatagcgggaaaaaaaaaatctgattgttttgcttgatttttttttttaatcgtctatctaaattagtccgtccgatattatgccacgtgtacggaagagataaaaacctcgtattagtaggccacgtcgtcaatcttatgattagttgggtcccacttgtgtaatcgtctatactcgagtccacctaaagatacgatacacttttttccctttcatggaattgagtttctactgtttctggaattctgggttttggaatttggagaaattagggtttttgttgaatcattcaaaaacattgaccatgaagatcatagagactaagagtctccaacaagaatgaagaaaatctattttttttcttgggttgaaaattatttgagaggagcaggtgaagttaatttttttctcattgatacaaaaatggcagattgttttagagtctccactattatgaaccttccataattttttattttatttttgcttatattatcccttaattttttgtcttggtgataattctctttctcccctcaattaaaaaaaagtttatagtatcggtttctcttctcctgatcaatgaatacaaatcggtattcgtaaacaatcccttccgtttcattttactgactcatatctgtttttatctgggtttttatttcttttcccctttgtgtttcaaaaaagtttttggtgtaacgtttattatccataagatccaaaaaaaactaaagctggaaattttgtttcgaggtgagataatctttgcttaatctttaggaatccaatgaatacaagcttaatttgcctcttaatcctcgttatcggagaaagcaaaatgatgtttcgtgtgaatctcgttttttgatttttggggttttctcttttgtcttaatccatcttcgtggtccttgtgaagcttaaagatgaaaaccaaaatgtcatattttttttcgtgtgaaaatgtcgattcgttacaaatcttaaaccctgttccaagttttgattttttttgtttgtttgttagcaggaattaaagcttcttgaatattcaaagattagcccaaagaatctctggacaactggtctaaaaccgcaggtacgcctttcactacttaaacctctcaattttgtcaacaaaaaaaaatgattttggaagagacagagctgagacttctgagctaatagtcattttttcctaaggtataatcatcactcacgcaggatagtttagctgttttgttttgttttcctttataaatattcgattttgctctgagaagctaaacattagggtacctacctaacactgaattcactattggcatgctctgtttcatttttttatgtctcttgcttaggatgtaatctcactcactctctggattagcctcgattgttcttaatcaaatttgggagctctagttattagacaatcaacttttaccttgacttcatttttttctttttctctgtctaatgtgatgacaaaaaggccaatttgaaatattttgtaattctgtttgttctgttgtttgtagatatcataattatataaggggctcattgagttgttgaggattcctgtgttatcactctgatgttagtttgaagttatgcgcacatg

SEQ ID NO: 34804 - DNA, 3000 bp, Unknown; identical to SEQ ID NO: 34803
  misc_feature (1)..( 3000): 2750-1469P.txt file - cDNA_ID_3082209; gDNA_ID_2926230; Annot_ID_203652

SEQ ID NO: 34805 - DNA, 3003 bp, Unknown
  misc_feature (1)..( 3003): 2750-1469P.txt file - cDNA_ID_3082224; gDNA_ID_2926230; Annot_ID_142636
ccaagttcttcaggccggctcatcttacaattttctcttgaaaatggttcattctgtttttgcctattttcagacagatgtctgaatggattgagttttataataagtcaaagttaagactctcgcagtatttaattaactagtaaaacacttaaaacttcttataaaagaaagtcggaccaacatgggtccaacatcttgttatcaatagttgaaaaaggtatacatacataaagatattaggtatttagaggaagcatttcttacaacaacacacaaaagcaaaagataaagaagcattgtaaaggtagattagccttccttttcatcgttagtatacttaaacttgtgatggcttagtctcggcttctgcggcttttggttcaacatcagcttttgcatcaaccttagcctcagtcttagtctcagcctcggttttagtctcagtcacggtttcgaccttaggatcagcctcggcttttggctcagcttcagcctccactggccagtaagaagtcttctttccggtctttgaaactgtttggaaaactgcttcaggctcaacattacctttcactgtcaccttttgctccttgatatcaatgtcaaatgactcaacccctgagattatataataaattatagagtcaataaattataaggcttaaaataaagggaaacaatgattagtagaaagtatttgaaagacatgaaaaaaagattagagagaaataccttccattttgcctaaaactctattgacggcaccaacgcagccttggcatgacataccaactttgaggacaacggtctgcattaattagacaatttaatccgaaaatgtaagaaccatatccatatacataggaccaattcggtccaaatatatcaacagctaattttatcacaattattaactgttatcttttgtgctctagcttaataatatttaccttttttgatgaatatttcaaagtggtgctaatcggacattatagtacttacagatagaacctagacctagaccaatcaatctcttttcttccctcttgaaatttgatattaattcattccaaaatatttattatcataaaaactgattaatcggactctcataaccgatatatatagacaattgctagcatcttttttggagatggacacaaaaagacattcctgcttccagatcaatgtctctcaaaaacattattccatcgtttcatggccaagaaatggagaaaaaaagaagaagaatatcaaagtcacaaaattacctgagccatggctagaataagaagaaaggaaacgattaagctttgagcctttgagatcgatggaccgaatcagagaatgagatgcttgtttgttgaatgagaagaaatggtgtcttctgaatatttatagtaacgcaaaagcaaagattcggagaagttagcgtaaaggaaacgagaacattatgaattagtgcatttaccatatttccaataataaagtataaaggtttaggaaggttagttatacctgatgtggaaaaaagcttaccaactttaaaatccactaacagaaagtacaagtacaaagaattctatgaggtctccttgtactacacatgttttgttgcagtaccaattacctaatttttatatatatggggtcaatcaaagtttacttttattagatagtagtatttgactatgaacttagagaaaactatttttatcctaatattttattttcaagctttctaaagaatatcatgaacaataaaacacaaatattatatgtcaatctataaaaatatcatattatacatgtggagtttgaatggtaagccgaactaactcattttatctttaggtgactaggtagtggggtgtattgatacataaataatgttgtccttttcacggattgttttgccaaaaactaaattttttgaatgatggacaaaagtttcacaatttgcggttttacattgttatcattcaaaattgcgaatatcttatctatcactattcatattgaattttataattctaaacagtaagtagctgaattttcagaatcggtcatgagaccaatatattctttgatattttgttgtttaaaaagtggctaaaaatcgatgtgtaccgttttttggaatcctactcgagtgagcataggaatgagagactcaagtataatatggtttcttatatggattcccaaacttttttttgtagttaacattatcaatatttccattgtggctttcctatgcgacgtccatcaaagaaacacatcagcatatatctatcaataatgcgtgtagttttgaaatatggcactcattctctgtccctctcaccgaacctattcgaggaactcgtgtaatgacgatcgcaatttacgtgtttcaacacaactctaaagatctcatcacataactcgaaatgcaagaatctttatattccaatcgttattgaaattacgtatatatcatacaatgctgaatcatactttgtctacttggtggttacaaagatttcagcctcacatcacaatcacctaaagttgcaattcctttattaattggtcaacaactcgcaagtctttgatacataatgctctaatactttgctcccacttctaaaaaacagttcccctctatacaatatatttaatattatccttacaaaaagaaaagcaataattttgttgatcccctacacctcatcaagttctaaaaaggtagtagaatagattatgatatgggcccagtgctgtcaaaacaaaatcatgggcccagttgataaaataaaaaatatgggcccaacgatactttcccaatttgggcttctcttaaatcctcaattattatcgtctcaagctctctcgagccttcttcagaactcttcttcttttcgtgcttttcacattcccgccaacagagagtagaaatcttctcccacaaaacctcagatgaatcatcccaagattccgacgccgggtaaacaaatg

SEQ ID NO: 34806 - DNA, 3003 bp, Unknown; identical to SEQ ID NO: 34805
  misc_feature (1)..( 3003): 2750-1469P.txt file - cDNA_ID_3082224; gDNA_ID_2926230; Annot_ID_203644

SEQ ID NO: 34807 - DNA, 3000 bp, Unknown
  misc_feature (1)..( 3000): 2750-1469P.txt file - cDNA_ID_3082231; gDNA_ID_2926230; Annot_ID_203640
gttcgagcaagacgctgaaggaggcttgtgtagggttcgtggtgcggaacatggacgacgtcgttttctcggataagtacgaacctttctctcagaaaaaccaacatctatgtgtggagatcacaagggcgttcttgatggaaacgagaagcaagagacgtgactaattaaattagtgagattatcaatgaatgtttcttctatagctgttacttgattgatctttaatcttccaagctagaccttttctttgtttgataaaaggaaaatatgttttacgcatggcccatattccggcccactaacagtaacatatataaagcccatcaaaccaacgattgggacatattaagtattaaccgttcataacctagcgaagggtttaagtggcaaaagattatcgttcccttgggcggttttaaaatcgaatcgacagaaaagggaacagagttgaagaagcgaaatggatagagaggatcttctttgcttttgagctggtcaaattcactagagaataggaatagtgtccttttgaatctccaatatgatcaagctatacacgttttcgcatattagtgatgaattaactaacttgctgctaaagaaattaattgacagatttgataatcagagagacatacaattgatttattttccttgatcatatgtctatctaaagatctctttttaggtaaaacaaatgtaaattatatatatagaaaatctaatgaatacttgatcatatatgtctagcctttttgaatcatgcatggctatcactccaggtccttattgcttctgccactgcctgtttcactgcttcagcatctatgcagtctccatcatcattctgtatttaattatttaagtaaaagtaaataaattttcaatataccattagtgattataatgatcatgattaatggactctatataaagtgatggtaaggaagaactgtgtttacatttgatgaaccaatggcatgcaagctaaatgtgtcagtacatgaaaccctagcttcaacaacatcaagtccaagatcttcaaaggtttcaagaacacaaaccaacatgcctgcctcattcttccttgacattacctttatcatgaaccccttctctagggtttccactgtaacctaccaatacaaatcaaaatcccaaagttaatcaatgcttcttagtagaaatgcatcaatgggtaatttatttgtttgtaccataggatttggatcggaagattcacggaaagattgctcagacgtggtcgcattgttgattttttctaccttctgcttaagctttttgatatattttgatgcatccactatgatagatgtttcgctctcctgcaaaacgtgcgcgcagcaaacatattagtgatttagtttaatttaaatactcaaactacaagtttagtcccttttcgcgatcatacttcggcccttataatatgtattttattgtagtatatgttcattatgtctaggagcggatcatcaagtaattgtccgagaagtaaaactatatagacaaaaataaaaactaaaatagcaaccacacatatatagatagtttctaagtttcatatagtttttgacgttttctcattcaaaatttctctctctcttttctcaatgaagaaggcactttaagaaaggaaaaaggctctatcatcgattagtcaaaatttcgaatttattaatgatcagccgccaaaccagagtttcattcatgtatatgaaaataaaattaaagctacgtagatatgtaatttgtacgaagtaaattagtttgatctctctaattaatgtatgtaaagagatatataaatcaagtaatgataaatcggcatgccaaagtatatatatgtgaaaaaagtttatatatatatgtgaatacgaatgttcatatatcaattgaaatcacatatatatagagagatagtaaatatataagtagtagctagactgattttgatttagtatcatagatcaaaataagaaacaaagtaagaaaagagaatggtgtggaataaaattacagcatgagaatcagtgattgaacgaagcaaatgaaacttctcacgcagagaggaacctctcttgtgttctctcgaaaccattcttatatgttttagcttcttcttctcctactttttggttctcttctatatatatagagaatgtgtatatgtgtgtgagagagaaagaggaagtagagatctgagattctttaaagtttataggatcctctcgatcgtctctcacatgtctaccttgtagtctctctttatttctacaaaatgtgatatacggacaaattcgattggtatctcgtgaattacttgattacctctatgcctaattacacgatgttccatattctttgtttttttttaatatatatttacgtgagaacacttacaaacgtaaaaacgtaaagaaattactaaatcgattttttcttctatatacattagcttgttgctatattaatatttaataagttaagcaatgtaaatataatatttgtatgttttgcattactccaacacatcaagaattttgtacccatagttttaccagactattcacaagtgtcgaagattagtgtggacttcggctcaacttaatatttccggttaaatgatggtacatccatcaattttaaggtacaaattacgatccatttgtgaacgtaaatattcaagtgtattatcaggttatgcccttttcaatcttggtgagctgatttgtatgcttataatctacatttattgtgccgtaattggacatgaccaactctcttcgaaggcgtatatgtctgcgtatgagtgattcttgagtatatataatgtttaaactatgaaatgtttatctacattattaaaataggagcatcgaaagaagttgacgaagaggataaaagcaaacagaagaatgttcgttgtgatattggaatgcctccaaacacacctcacggggatctttatgcatg

SEQ ID NO: 34808 - DNA, 3000 bp, Unknown
  misc_feature (1)..( 3000): 2750-1469P.txt file - cDNA_ID_3082235; gDNA_ID_2926230; Annot_ID_142630
tgagaagttcaggagaggaaagaccagcatgaggtgaagcacgtagctgagtctgacaatgtcgttgagaagagaaccaatggaagaaccagagctctggtcaaagttcactagaatatccgacatagttgcatctccaaagagaaggtaaccaaagagtccagttgcgaagtagatagcagcacacaagatgacagagatcttagttgctgggatcacttgtaatggatctttgagctcgaatccaattggatgaactgcacattttgaatcacaacaccaaactcagaaacatgaaaaaacagagaaaacagagaaacagttaccaatatggtgaaagagatgggttcttaccattgaagtgaaacgtgaaggctgtaactataacaggggaagctgtgaagagttgccagaacgatcctccattgctcaactccggaaacagtcttggattcttcgtttgtccattcaccagcgcggaaatcgccagcaccgagcttatgacaacaaatagaaccgcaagaagaaacgatacagcggaactaattgccagtctttctacataaccattaacaaaaagaaaatcatcaacaatctcatagatatccataattttgagaacacaagattatagagagaaacttaccgactcgtctacgcaggaccaatggaagcaagacaaagccgtagacaaataacaaagcgaagattctcgtgttccaccagtaagaaccaaaccattcttgcaaaactccaatatgttcaggaccaccattttcattaccagaaagcacatctcctgagagagtaaacacatacaaatccaaactcagccaatctgttcttaagctcaaatagtagctgagacctctacacttagatgattagatcaaattactttacctataataatcgaaaatataatcatacaaccaaaagtagcaaccatcgtagcaatctgtacagcgatggatcctgttttaccaaacgactctttcataactccggcgtaagtagttgattctccggcgagagttgatttcatcagaaatccaacggaaattgtggaaagccaagctatgatcgtgataatcaaaaacgctggaactattccaagaactttaaacgccgccggcatcgacattattccggctccgattatactcgttgacacgttgaaaacgatgccggaggttgatgatccatggttctcagacgaagaaggttcttgcttcggcaagagatgagttttgatctgtggtgtcatttttctaaccgccggagaaacgtaagaatttgccggcgggaagaagctttccttttttgtagttgttatgaggaatcggcttcatatagccacacggttaatagcgaaaagtacataaataccctttgaagattggggatatatgccttgaccgtttggggcaaaatcgagaaaatgatatttgaccataggtaaacctgacaggctgggcaaatcatgtcagtgagatcaccaaatgatctttcgtcacgtacttaaaaacatcacgaaaataataattttgttcaagagaggaaattacagctaaaatatgatgaacaatcataatcatattatagacagaagtgaattattaacaaaaaaaccccaaagaattatacaaaaaaatccaaaataaaatgggtccgtccaacactaatgaatgtgtgcacttggatttcttcacgaagaatgtatctagacgaaaaagtggccaaatgtgtatcatcgcttctcatctcatataagttgtccaaaaaagaaaaaaactcctaaataatttaaaattttcgtggatataataaaatccaatatataatcatatcattggcggcctcaaagatggctcacgtgtaataaactaactttagagcagacggttcgagacttttcatcaagaaaacgagagggcagcgaatgcggaatgtcgaatgaataattgaaaacgtgataaacgaaacaatataagaataattaaacactgtcttctaaagttatttttatttaatcatttcatatgaatcatattgaagttactcagttaacattatagaatgtgactgatagcaacattaatattgccgcagaaatccctcgttgcaaagttacagtttattttagatcatctctgtgtgtaaaggagaagcttcagtcaacaacaacagagcttgggtcaaactctctgctcagctcagagtctcccaaacagaatgctatgggccaagacactaagcccaataccattcaacatgtcgagaagcccaacaacagaagattacctctgcaactcacaaaagacaaaaaaattaccgattacccatgaaatgatttgctaaaaaattgaacatttcatagatttgtaacggttgttatttagccattgttgttattcatgtgtttgatattaaaaccgatattgttgttactcatgtgtttgatattaaaacatactaggtttttaccagtttgtgcattttggaacataggtttgtttagtggaaactgtcagcaatatttgtcgtgatttgagaactataataatggctaatgaagaatgtagaaggacgagcagatataacaggaaatcgttttacttgataattcatgtaagcttttcttcaatcccaactgataaacctgatcccatattttctaagcttggttaaagcgacccaataacaaagtacggaaaaacttttgattgggctaacttgggcttttcaaaacaaagcccatattttaaatagacaaatttggcccactttagtcggttgaaaaatcttttcccctatcgaagcgtgtctctgatttttcgctctcgatcgattctcgtctctctctctttcatcgcagcgaataatccaaatcgaaagcaatttctctcgacgaagaaaagagaagcaatcggagtctgtggaggtaaagaagtacacgatcaaatttcaagtcagagtttcggggaaaaaaaaggaatg

SEQ ID NO: 34809 - DNA, 3000 bp, Unknown
  misc_feature (1)..( 3000): 2750-1469P.txt file - cDNA_ID_3082235; gDNA_ID_2926230; Annot_ID_203637
caacgactagtttgctgcgaggctgtataaatttgtcgagatagcaataatgctagtggcaacagcaagaacaagcattattgcagctacgatcttctctcttgaggttgatacaccatggatattcctgccatttcagaatcagaaagcagttggtaagatttttataggaagtttgaagcaactgataaagtacatagtaaaggaaacaaagcatatctaccttagaacaatggcggctggaaatatgaatgctatggagactgtgatggttgatcccatgaactgaaagaagtaccaaatgtctggtacagcgattgcagacaagaaacagcaaatcagtagagccagagtgagtccgatgaatctttttgtgtctttttccaaggacggcttcttggggtacaagagttcgtcgagatttgctctcaatgagaagttcaggagaggaaagaccagcatgaggtgaagcacgtagctgagtctgacaatgtcgttgagaagagaaccaatggaagaaccagagctctggtcaaagttcactagaatatccgacatagttgcatctccaaagagaaggtaaccaaagagtccagttgcgaagtagatagcagcacacaagatgacagagatcttagttgctgggatcacttgtaatggatctttgagctcgaatccaattggatgaactgcacattttgaatcacaacaccaaactcagaaacatgaaaaaacagagaaaacagagaaacagttaccaatatggtgaaagagatgggttcttaccattgaagtgaaacgtgaaggctgtaactataacaggggaagctgtgaagagttgccagaacgatcctccattgctcaactccggaaacagtcttggattcttcgtttgtccattcaccagcgcggaaatcgccagcaccgagcttatgacaacaaatagaaccgcaagaagaaacgatacagcggaactaattgccagtctttctacataaccattaacaaaaagaaaatcatcaacaatctcatagatatccataattttgagaacacaagattatagagagaaacttaccgactcgtctacgcaggaccaatggaagcaagacaaagccgtagacaaataacaaagcgaagattctcgtgttccaccagtaagaaccaaaccattcttgcaaaactccaatatgttcaggaccaccattttcattaccagaaagcacatctcctgagagagtaaacacatacaaatccaaactcagccaatctgttcttaagctcaaatagtagctgagacctctacacttagatgattagatcaaattactttacctataataatcgaaaatataatcatacaaccaaaagtagcaaccatcgtagcaatctgtacagcgatggatcctgttttaccaaacgactctttcataactccggcgtaagtagttgattctccggcgagagttgatttcatcagaaatccaacggaaattgtggaaagccaagctatgatcgtgataatcaaaaacgctggaactattccaagaactttaaacgccgccggcatcgacattattccggctccgattatactcgttgacacgttgaaaacgatgccggaggttgatgatccatggttctcagacgaagaaggttcttgcttcggcaagagatgagttttgatctgtggtgtcatttttctaaccgccggagaaacgtaagaatttgccggcgggaagaagctttccttttttgtagttgttatgaggaatcggcttcatatagccacacggttaatagcgaaaagtacataaataccctttgaagattggggatatatgccttgaccgtttggggcaaaatcgagaaaatgatatttgaccataggtaaacctgacaggctgggcaaatcatgtcagtgagatcaccaaatgatctttcgtcacgtacttaaaaacatcacgaaaataataattttgttcaagagaggaaattacagctaaaatatgatgaacaatcataatcatattatagacagaagtgaattattaacaaaaaaaccccaaagaattatacaaaaaaatccaaaataaaatgggtccgtccaacactaatgaatgtgtgcacttggatttcttcacgaagaatgtatctagacgaaaaagtggccaaatgtgtatcatcgcttctcatctcatataagttgtccaaaaaagaaaaaaactcctaaataatttaaaattttcgtggatataataaaatccaatatataatcatatcattggcggcctcaaagatggctcacgtgtaataaactaactttagagcagacggttcgagacttttcatcaagaaaacgagagggcagcgaatgcggaatgtcgaatgaataattgaaaacgtgataaacgaaacaatataagaataattaaacactgtcttctaaagttatttttatttaatcatttcatatgaatcatattgaagttactcagttaacattatagaatgtgactgatagcaacattaatattgccgcagaaatccctcgttgcaaagttacagtttattttagatcatctctgtgtgtaaaggagaagcttcagtcaacaacaacagagcttgggtcaaactctctgctcagctcagagtctcccaaacagaatgctatgggccaagacactaagcccaataccattcaacatgtcgagaagcccaacaacagaagattacctctgcaactcacaaaagacaaaaaaattaccgattacccatgaaatgatttgctaaaaaattgaacatttcatagatttgtaacggttgttatttagccattgttgttattcatgtgtttgatattaaaaccgatattgttgttactcatgtgtttgatattaaaacatactaggtttttaccagtttgtgcattttggaacataggtttgtttagtggaaactgtcagcaatatttgtcgtgatttgagaactataataatg

SEQ ID NO: 34810 - DNA, 3003 bp, Unknown; identical to SEQ ID NO: 28879
  misc_feature (1)..( 3003): 2750-1469P.txt file - cDNA_ID_3082242; gDNA_ID_2926230; Annot_ID_203635

SEQ ID NO: 34811 - DNA, 3000 bp, Unknown
  misc_feature (1)..( 3000): 2750-1469P.txt file - cDNA_ID_3082248; gDNA_ID_2926230; Annot_ID_142626
atattgccaattcagcttgctggtggtaatgctgctcttgctcttgctgtgacagtggcatctaacttattaggaattttaactgtaagccgaacgacttgcatattattgttcctcctttgaaactagttgatcatgcagaatcaggggtatttttagtaagattgtttcctggtctatatttccgaattgcttagcaatttgttctcaaaacaactcatgatcttgtatctatgactatgagtaggattcaaacttcaaagtcttctattaagaatgagtattgcgtcttctgacactgaagttaacgtggtttgacctctaatcagattccattttgggtatcaagatacatagctgggggagtaggggtttcgtttcctactgaccaactattcagaagtcttatagttactctgttaattcctttaatcattggcaaggtgagacaatctttctgtttgtcctgttcttgcaatgatgaatcaatataaattctgatatacggtacaattgtgaaagctaaatttgcagaggtggttgttgccaaaagatatgtgaatactttattggaaattataatagggttgttgcgtggctcatttgaaaatgaagaaagcttactctctattatttgttactttccctgatgtttatatgaacctttcacaaacagtcatttcagcatgaagttctatcacttgccattttgcacacgtttttaaaatcgagctttgacatacttggtttcttctgttataggttattcgagaatcattcaaaggtgagcgccatttgttatattttacttctctggtgaaagtaattgaatacataccattttaaatagttagcagtcactttatcgtgacaatggatcaaaatggttctgtttataataaatatatatgcttatcgctgcctactttctgaccttgttgaaactcttgttgaaatgtgtgatacaggtttcgcaaactttgttgacaataaccgtaaactcttttcgaaaatcaacgcaatctgcctcagtttggtaagatatgaaatgttagtctcccgtaatttctacaccccttgaataactttctgaagtcatatccttggagttttgctttgttgcaggaatcttaaacttggcattttagatgcctgtacttaaaactttctcttttcttgtatgatagcttgggatttcaacattccgtggcattgatgtgccaatccaaagcttttactaaattgcaaaaaccatatttgcagtcacggttatgactttggagatagaaggacttaatacttttttcctttttatagtttaacctctgcttccctggctacttcaactggtctgactttgttattgcatttacctggttattttgggaacttaatagtgtttattccatgattaatattctaggtgccatggatccaagtgagcaggtcaagatcactgctactatccgttcaacctaaggttttccttgcagcagttggcattggaatgtacgcattcttcttttaacatatagaaaagataccaagtgaagaagctcatggaaatatttggcttgtgtgttagaaatgcggattacgtttgacagaagattcttacgtcttcttacagattgctgcatctttctctactagcattcaatgctgtttcaatccgcatcctctccggtcttacaggtggtagcaagagctccaaggaaaacagcactgcagttttgctcgtttcaagccaggtaataatagagtttgccttttagaaccgattttgatctcttaaatttgggagttcttttcttgtggtggcatagaaaacattaccggtaatggtggcggtagtagagcaattaggaggtgcatttggtgagacagggctattggttcttccttgtgtagctgcacacctgaaccaggttacaaattgtattataatcatcatgtacttgtgtgcataattttataaattattgacgtaaatctggaatgttacagatcatgattgattcagttcttgtcaacttatggctccggagaggaaaagatacttcgactaaagtaaagacagcttgagagagagagagagagatagaaagcaatgaaaccaatgctgtggagaaggttacatcctaaacacactgaatgtcagttatatacatagcagcaagactggggattttgatatctttccaatcaccaaagcttagttgatcattgaccatctctctctctctctctctttctgtatgtatatgctctagagattccggtcggtgtttgctgatccaatttgtatgatttatgaaactatgtaaaaaaaaaacttgtatctatatttgaaaacatttagtcatttgacgttaccagcgtacaaagcaattcatatgtaatctgtctgataagcagctaggaaagaggactaagaaccggttcttttctcaatttaattgaactaaccatcactacaatttcatttagtcctggttcgaccaattcggtttgtaaataaaataaaaaccgatcgagagcgttttaattgtcctcggttttcagtttcggtatggaaatagaatcaaatcgaatccggtttagtgagtaaatcacgaaaccctaattctatatattttttcatctcgaccaaaatgcttggacggctacacaccatttttgtttagattcgtaatcctcctcaagcatctccttcgcaaatctccatctccatctccatcttctgaattcaggtaattttgttcctcatcatctagcgtaacaaattttcgattctagtttggtgtagattgattcgaatcgattctaattctttgttgatacgagtctgtatctgtgacacgattgtttcgttcagattatgttcttcgaatggattggtttgttttacttataatttcgttcctctgattcactattcagatttgttacttttggtgtatcaggttcttgttgcttacgcttccagctaaaaagatg

SEQ ID NO: 34812 - DNA, 3000 bp, Unknown; identical to SEQ ID NO: 34811
  misc_feature (1)..( 3000): 2750-1469P.txt file - cDNA_ID_3082248; gDNA_ID_2926230; Annot_ID_203633

SEQ ID NO: 34813 - DNA, 3003 bp, Unknown
  misc_feature (1)..( 3003): 2750-1469P.txt file - cDNA_ID_3082252; gDNA_ID_2926230; Annot_ID_142625
tttctttttgcttttggtattgtttgtttgattccatggcacatagagtcagctactgcataagttgatagaaaatggggacacttaaatttgcttaatagtatttaacagaagctgaagacttttgataaaattaattgatgaaagcatataagagagataagaatatgcctttgttaataatactacattttcagaactaaattacgcctttttgttagtataccggcgcatgttagcaaaggaaagtgacggaccgtagtgtagtagtagatgcggcggacggagttaccaaagaagaaggccgctcaaaataattaaatttgttcaaccgtcatcttcttcaactgatcttagctcaactaacacactctttcttcttggcgtcaattcaatcaaccaaaacctttttctcctatctagctcacgctttcttcttcttccaatggcgtcttctgcagctctcggatctctccatcgtgagtctcttgctctctcactctctgcgttttacttattctgttgatttcatgaggataggaaaactagaaatggaggaccatgagtaaaatttcggaaatgaaaggcatagattggagctatccgttagtgacgttgttgcttcttagagtgtaatttagcgacttaattaagtttcaatctcggatcttgtgtgtctaatttgtatcaagagatgtttcagctagaaaaagtgaattttatttgttccattttacagagactttagggtcagccattaattcacagagtgaggttcactcgctttctggaaactggtctgcctctggtaattcatgtgtgccacggtggagattatccaacaggaacagcaactacaggctcgtgttacgtgctaaggccgctaaatcttcgacaacaaccataagtgatggtgagtttatcttccacaattcttcttcatgttcattttgctggttaatgcctttttttactatcaggcttgtctcatcactttgctaatacgatccattggccaaagatggtattaatctgttttgctcttaaaggaactggaactgaaattcttagtctcgtttgctcttaaaggaactagaaatgtaactgtaagcctcggtcttttaccagctgtcttggaaccaggagatacagtgatgtgatattggaacatttttcttttatttcctatgacttttgcttatttttggctttgcaggttcatctgatgctagtgtgtcagacgggaagaaaacagttcgacggataactttcccgaaagaagtggaggtttcttccttgcctttcatgggtcttagatattaggttctttaatttataagtttggtaggtgatgatatgacgatttcctcaaatatgcactttctagatcgtcaggattttggatgcataacttcaggcaatctactcttataatttttaatcatgacgtatggatgtacctttctttatatgttgttagatgaaatgttgcaggcactggttcacgagatgtgtgatgaaactgaggttgctgtgctgcaacttaaggcaagtctctctgccattagttttaacttcattattattattatttgtaaactttctttgaggctactacaaagacgagtgcattttactcaaccaacaatatggggctaaatatcactgatttgagataatagaatgtaggttccaacaattagactcttctgaagctttcttttgctacaggttggagatttcgagatgaacctaaaacggaagattggagcagccacaaaccccattcccgtggcggatatatctccaactgtagcgcctcctattccttctgaacctatgaataaatctgcttcttcggctcctagcccatctcaagcaaagccttcctctgagaaagtgtctccatttaagaatacatcatatgggaaaccagcaaagttggctgctttggaggcatctggatccaccaactatgtgttagtcacatctcccgcagtatgagatccatttcctaattagtggttgctttcatatcccttaatttctctgcagttttcttgtttgatttgatcttgtttcttctcttaccaaaaggtgggcaagtttcagaggagcagaactgtaaaaggaaagaaacaatctcctagctgcaaagaggtaaacgactctaaattcttttgcatctcttagaacaaaagaacagaaataagatcaaagagctaagtgaaaaaaactccttagggtgatgcaataaaggaaggccaagttattggatacttacatcagttgggaacagaacttccagtgacggtaatatcttaactaatatatccatctcttctttgaaactatctaatcagactcatcgatcttgctatttgtcgagcagtcagatgtagctggagaagtccttaagcttctttcagatgacggaggtaaacatttgagtattcaaaccgtttcatttagtatgaacattcagaaattatataagtgaattgatatgaactcatgcttcgtgtgcaaacagactccgtaggttatggagatcctctggttgcagtcttgccatctttccacgacatcaacatccagtgatgatggtttcttcagcccaattccatagcaaatgaatagtctttcatccggagactgtactattcatcttctcctgtgtttgttcaatgaagatttgtaatctgtttagttgcaaagagtctactttgatcttgctctcatcatttgtcacgtaatgtggattttctgcaccagagaaaaaaaacaattgtggaatttttatagaaatgacgtggctatcttatcttctccgatcatcaaataaaatcaaggctcaaaaattcagaagaaaattgacgaatgtttttaacagtgaaggaaaatattaaaattcttctcttattcgtatcggtcttagcaatgtatgtaatacgctgacgtgtacaaacggagctctcttctcagctctggcctctgagaatg

SEQ ID NO: 34814 - DNA, 3003 bp, Unknown; identical to SEQ ID NO: 34813
  misc_feature (1)..( 3003): 2750-1469P.txt file - cDNA_ID_3082252; gDNA_ID_2926230; Annot_ID_203632

SEQ ID NO: 34815 - DNA, 3003 bp, Unknown
  misc_feature (1)..( 3003): 2750-1469P.txt file - cDNA_ID_3082256; gDNA_ID_2926230; Annot_ID_142624
gtatttttcgaattaccaggacgtttagaagagctagtgtttctgcatgctatcctttatggtctgtttgatacaatcttctcctgagatctttcatctaatgcttgtttagagtctttataaatttgtatgagaaaagttggtcccatttccttgtaactcttgttccttcgtctccgtcgtcaattggtttgtggtaccctggcatttgatagccccattatactggttaataccttaagcgagggaatccaactcataggttattcgtaaattgtcttttaagtgtttttgttttgttctatttaccttgataattgtttatataggtccttattctgtttatgtgatataaatccttctgatactgttctttcctcgcagaccaccttttgaagcagattctaccagatggattggatataccttcctcttttgaaactatagttaagtatttaatttctgtttgcttcgtggattcaacagcctagcatatagaaactctgtttgcatgagcttgcagcttttttgcatgtttgttttttcttgtctgcaaatttgtttaataagttttcaagcatcatgaagattgcctctctcatgagaaccaacatctctttgcttattatgtgcaggtcatattgcccacttaaatctacatgatgagctccttccattcaaagatgttatagcaaaggttatctacgacgtaagttttttaatgttcctttcatgaaagcattttttttataattgcatttcgtgtcctgacaacaaagacatctaacgttctagcgggtctgttatatttgtagaaaaattatccaaggatcaagacaattgttaataaagttgggactatcagtaatgagtttcgagttccaaagtttgaagtgttagctggagaaaatgggatggaaacagaagtaaagcaatatggggctagatttaagctggactatggcttggtttattggaattcaagattggaacatgagcacatgcggctttcatctttgtttaaacctggggaaaccgtatgtgatatgtttgctggtattgggccttttgctattccagctgcacagaaaggatgctttgtgtatgcaaatgatttaaatccagacagtgttcggtacttgaagatcaatgcaaagttcaataaggttgatgatttgatttgtgtgcacaacatggatgctcgtaaatttttctctcacttgatggcggtgtcaacttgcgaggataatttgcaatcagtggctgataatgataaaacaaaggaagcagccgtgagtcgaggaggtagttcttttggtttaaactatttttttgcattatagttggcatatttggttttacgagagacaaaaaataactttaccggtgggtttctgtttactttgcttaatcataggtgagactaattccagtggagaggaaatacgtgaatccaatgcaagcataaatgagcctcttggtgcaaataagaagccatctggtactacaaagacgggtaagaaatgcctcataaagatttctccaagacattgttttagttaatattgcctaatgcctggggatcctcaccagtatgttaattgagtgcagaaaatggggtaggaaaagactgcaagagtatagaaggacacgcaaataagagattgagacaaacgttgcttccaatcgcaaagccgtgggaacatatcgaccatgttattatgaaccttccagcatctgccttgcagtttcttggtatgctatcaatgattctttattatttttgttcaaaatttgggactagagtcttgcatatacttgcaaggcattagagtttcatcaactatcaactacattccgcatcagcaagttaattaggaccaggaccaatagaaataggagatgcatcatgtattaaggcttgtttgaagagttatgtgattggctcttcaatttcagttagaagtaagaaaggaagtcaggatttgtttttgtcacactactaatgcatataagctctgtaattgtttttgcagattcgttcagtaatgttattcaaaagaagtattggaaaggacctcttccattaattcattgctattgtttcatccgtgcaagcgaaaccacagagtttataattgcagtaagtatcaaccgctcccctcctgcttgtcccttctagttttgttgtcttcactatatcatatctttgtaccaaagatctggtagcgtttttctgcgagcctttaaatctgatatacagcttctgttgatatttttaaggaagctgaaactgctttgaagttccatatagaagatccagtcttccacaaggttagagatgttgctccaaacaaggtaagatcccactcgtctgtttttctttttgatatattatcaaaacatagcatctgtagttcctgagctagatttcttttgtactttgcaggctatgttttgcctaagctttagactacctgaagcatgcttgaagcaagaagagtaaaagacatttctaggaaagaaagaagaatcaaaaaacgcatttgaaatcttttctttttgcttttggtattgtttgtttgattccatggcacatagagtcagctactgcataagttgatagaaaatggggacacttaaatttgcttaatagtatttaacagaagctgaagacttttgataaaattaattgatgaaagcatataagagagataagaatatgcctttgttaataatactacattttcagaactaaattacgcctttttgttagtataccggcgcatgttagcaaaggaaagtgacggaccgtagtgtagtagtagatgcggcggacggagttaccaaagaagaaggccgctcaaaataattaaatttgttcaaccgtcatcttcttcaactgatcttagctcaactaacacactctttcttcttggcgtcaattcaatcaaccaaaacctttttctcctatctagctcacgctttcttcttcttccaatg

SEQ ID NO: 34816 - DNA, 3003 bp, Unknown; identical to SEQ ID NO: 34815
  misc_feature (1)..( 3003): 2750-1469P.txt file - cDNA_ID_3082256; gDNA_ID_2926230; Annot_ID_203631

SEQ ID NO: 34817 - DNA, 3003 bp, Unknown
  misc_feature (1)..( 3003): 2750-1469P.txt file - cDNA_ID_3082260; gDNA_ID_2926230; Annot_ID_142623
tgtttgtatgtgaggtcaacattatttaattttattccaaatctaaggaaagagatcaaagtattgttcttccgaataaagtaacaaataaagcagacaacataattttattttattcttgcagaccagcttcgtttaatgcgtcggagctgcctaatggacacgacacacgaacaacaaaccgctccgctccttcacttctcctcctaacggctatatttgtgggacctacaagccattggatcactagatcttgtaaagaagcccaaaggaaatgaacaagccattttatttatggttactgactaaaatgccctcgcaaatggaaagtaaataaagtagtacagtttcagaagaagcagacacacaactttgaaacttgaaagtgaaacttttcctggcttacaattaaacaaagaaaagaagggaagggttgtgccgtacgaggttattatgttgacgctgatctatctttgccctttttaacataaggctggtacacgtgtttaaagtgtttggatactagatgtggaggttttgaacttcaatttttttaaaaattcttgcatatacatttttcacttcaaacacattttctgaacatataccaaacctgaccatttctcttatgaacaagtcatctctataatgaagtctataatgacatatcactcctgtggttgcaagaacaaaattctggagacactcttaccttgaactcaaatggtatgtcatgtattgtaaatactatatcacaagattagtaattctcaagccataaggtttggaggaatcgaaacaagatggtttccgaaggcgaattttatcatgctgatgaagctgttgctaaagcaattagatattagccccgggaaaaataaagtccaaacaatctctcaaagttaaactgtactcaaaccatcaacctcgaaccccaaagcaaagcctaattttgtgaacaataaaccaactaacaatgccctacttttataatcggatcatcctcatgtccaccaaatctgttaataagttttatatttcacaaagtgggaactatgagcaaattagcagattgatactagttaggaaaggcaagacagtcatatatatgactatattccatccataaaagcatgaaagttacttacttcaaatcacaaaccaatgagaaaatataggagataaccacagttgagacttattaacactaaattagattaatatatactaactcgccactagaccatcaatgcaacagctatgaacactaacctaataaacgaaaaagattccatgtgcgttaacattgaaagtaacgtaaatctcaaatacgaagatgacaaaacaagggttaagagagttcaccagttataccccaaatcgatcttctctaagtgattggctactatcctttacaagccacaaataaatggatcatgaaaacaaagaacatgcaccaagaagtacatataaacatttaacagaaatcacctaccaataccatacatcattttgaaactactcaattttctagctaagtgcttccagatgaaactattatgtcactgaatctccattaaactactaaagaacactaaacgtaactagaacttaccatgatcagcccaattgcagtaatatccttattcattttggtgaagaatgctctgaaagtcaatgctactgataaaggaaaaaagagaacaaactgatttgaaggtagatgaaattttaaaagtgaatcccacaataggagaaacgatagagaaagatcaactttgagttttctacatctgaacataaaagtgtcgagccaccaaagagataaaacaacaagaagaagcagatactgcaaccaaaaattcgtagttctaaatctgtagagcttcgttacgaatctacattccatttcaacaacaacaaatcactaaaatcagtacggagttaccaaccacaattgacgagatctgaatcaaatccagctcttagactctccctgagacagctgcagcagctgaggtagcagaacctccaaggaatgagagtaatccagcattcgcaggctcttgctcgtccaagaagagatcatccggaaccacaaacgcaccgtgtacgcaaacgattgcaacaccaatcataagcgcggaggttaagagagatccaacgctcgtcataaacacgacgacgatcgtagacagcacaagagcaagcagagtctctcgatcagagaaagtgcgaccgaagacgaccagtggctgatctgagggacggaagaggtagagaaacatccaaccgcctaggagtccgatgaggacaaggagggagagaggatgagagaaaagcgaaaaggcgagtacgagggagacgatggcgacgtagttaaccttgaagtaagcgagattcttccttatccgggacaaggcatcggtgagagattcaggtctcgccatggaactacgatcgatgagctccgtccatggacgacgctgtgacaagccatcacggatcgaggtggagagacgtgagaagaaagtacgaaaagcaggtgtgttgattggaggctgagattgaacagcttgctgattggtgacaggtagcgtcggtggagttgccattgcggcggcgcgtgaggttagatgcggctgatttggctgagaagtttcgatccgttagtctgaaacgaaaaaaattcaagagctgaagttgctgaatcagagctccgtgtagattagatattctagggcctgagcctgaccataaaggttaaaccggcccaaaacctcaagtcgctggttcgattcctcctcgtgcttttaaacaatgttttatttttgtttttggattttttttttttttaatcaaaccctaaaataccgagagagcacgactaacgtcttcactgacgccacggtctgggtggttcattcttcttcttccgccgatttcttcacattttctctttctggtattcaaacattgtaaaacgacaccgttagcaccatg

SEQ ID NO: 34818 - DNA, 3003 bp, Unknown; identical to SEQ ID NO: 34817
  misc_feature (1)..( 3003): 2750-1469P.txt file - cDNA_ID_3082260; gDNA_ID_2926230; Annot_ID_203630

SEQ ID NO: 34819 - DNA, 3000 bp, Unknown
  misc_feature (1)..( 3000): 2750-1469P.txt file - cDNA_ID_3082271; gDNA_ID_2926230; Annot_ID_142619
aatgcttctcaaagctgcttctactttctctctattgaacattcatggagagaagaaagacatctctcctctcttctcctcctcctcctccatttcgtctccggtttcttctggaaaatccggcaatctctctttccctcttcgtgcttccaagagttcaaccactaccacaagcacgttgagcggcgttgtgttcgagcctttcgaagaggttaagaaagagatggatctagttccatctggtcaacagctttctcttgctcgtcatttgtactcccctgagtgcgaagccgccgtcaatgagcagatcaagtacgtttttccgtcttggattgaaacattttagtgattgttatcatggatttgaaaattgttattgtaaatctgttgattgagtcaatttttgcttgaatcctatatagatgagattggcttttattttgagtctctcatgaatctggattttcgtttgatgcagtgttgagtataacgtgtcgtatgtgtatcacgctttgtatgcatatttcgatcgtgacaacgttgccctcaagggtctcgccaagtgagtttttctctggtattgaaatctctgtgctgatattcgttctgtgtgatgatgaattatctgttgtttggtgttttttgctgaatcaggtttttcaaggaatcgagtgtggaagaacgagagcacgctgagctgttgatggagtatcaggtctttgactaatgatttcattttgttatcattcataagccttatgatcatttgagctaagtttgtaacatcttacatttttggttttcttgatctacagaacaaacgtggtgggagggtcaagttacagcccatggtgttgcctcagtctgagtttgatcatcctgagaaaggagatgctctctatggtaagcttcatttccatttctgagattttagataaagaattccagtacaaagtatctgtagtttcttaagacttcagagttgacatacatgtgatgttattagtgaagaggaggattgttgggtctcagtaggatctaatatagtgattgtgttgagttttaagattggaaagcttaatttcatgttgattgttgtttttgcagctatggagttggctctttcattggagaaactagtcaatgaaaagctcctaaacctgcacagtgtaagaccatctctctcattaggatccagttcttgtttatggtattcaagtcataatctagtttcttaatacaacttggtatttgaataatgtggtcaacaggtggcttccaagaacgatgatgtccagttggcagattttattgagagtgtgtttctgaacgaacaggtaaaacaaaagacctacacgttctatgttagtggcaaagatatggggttcttgatctgtcaaaaatggaatctaatgaagtttaattaacatcactttgcaggtggaagccattaagaaaatctcagaatatgtttctcaacttaggagacttggcaaaggacatggtaaccatttgtttattcaatttaaaactaataaaacacacctcaattcgtccacttcgtgtcttacactttgtttatttgtaatcaggaacatggcatttcgatcaggagcttcttggtgctgctgcttaatctgagttttagctgtaatctcgcagtttggttaacttttgagttattttgagtatgagatgtaacttttaaggtagatttgatcaatatcgattctgttgtgagagaaaacaagctattacgctccttggggttaactttctttgtgttttcagtattatggttttgtccacttcgtaatatcactttcctttagaacatttcaaatcagcagttgttttgaggtgtaatgtaatggtcactgatattttctattacccctgcatgaaagtagtatgttttatcaacaaagtggtaccaaaacattctctatccaagaaaactacaaactgagtgagtgtccatacttacaaagttttgagtcaatttatcattttctcatataccaatcaaaatctcacaattacaactactctttttttcttctttatacgatgatctttttttgacacaatatgatgatcatgaaagacaattgattatttattcacatgtatcaaatattctaaatactttgattttatattgtgcaaaaaacaaatatcaaaattaaaattttagtaaaattgtataaattgagaggtagaaaaaaaaagttatttgatcaacatggcatgctatgggtgaaggccccaattcatttgaaaactatgatcaacctttttgttaaaactcactaattatttgaagtcaccaaaaataaagaccatttacggttttggtaagattatagcttagacttggtgaaatcatacaacaagcccgtctagctcagttggtagagcgcaaggctcttaaccttgtggtcgtgggttcgagccccacggtgggcgatagttagttgttttatttttatacttcttttactttgccttgctttcaccataagtggatatgggcctatgttaagcaatttgttcacatgaagttatactgatccatgagagtaacattcaattttgatagcttttggtttcttcacttacaaagatcatcaattcttgttcatttgaacaattttcttaatctttttcgttctggattgcaacttcaaaaaaaatcactgagacaattgagaagactccaaaagcaaaagatacacttatgttattttccaactccttgtaatattctcatccactaacttggacatcaaactatacaatcataacgtcataaagatatgagattactttccatatctcacatcacgtcagagcaagtaatagcatgacacatgtcatatatattattgcccatcttgttttctatttttggctctttacacataacttcaatatctctctctcaaagatcgatcagagtaatctctctctgttgtgtggaaaaacgaagaaagaatg

SEQ ID NO: 34820 - DNA, 3000 bp, Unknown; identical to SEQ ID NO: 34819
  misc_feature (1)..( 3000): 2750-1469P.txt file - cDNA_ID_3082271; gDNA_ID_2926230; Annot_ID_203625

SEQ ID NO: 34821 - DNA, 3000 bp, Unknown
  misc_feature (1)..( 3000): 2750-1469P.txt file - cDNA_ID_3082280; gDNA_ID_2926231; Annot_ID_142669
ttggaggtgagaagatgtacgagaaggcaagaagaggagaaaccgtagagctttctccaagaagaatttcaattttccagtttgacattgaacgcagtttagatgacaggtttatccattttctgtatagtgcagaagcagtttgaatacaatgttttttggttaggcctcactaaacatctctcgtttctcttttgcagacaaaatctgatattccgggttatatgctctaagggtacatacataagatctctctgtgcagatcttgcgaaagctcttggaaggtgaaacaaagttttatcctttgattactaacagatccaaaaaaaggaatttactaatatatcattccttttgctgcagttgtgctcacctcactgctctccggcgagattcaattggtacgttcattcacaagtcagcttatcaattttgtttttcttcaaaatcattcaaagcttgattcactcttaatattttctttttggggttcaggtgaatattctgctaatgatgcttgggaattcaatgagttagaagcagcaatcactaaaaactacttctagaaggaaacaacttctggtttgctagacgcctccatagatgatagtagaagatccaccaactgtgaattctttgcgacaaacaactcaaaaaggttacacaggattgcatagatcattgattgttccttaaaacacttacattattgccctaagagtctaaggatcaaatctttatttcggttcatctagcgcttctactaaatctcactgtctataacaagctcgggttattggaactggagggtctgtgagcaaaccatttagagtacggtcagccacatgcttgtttgcagcttccgtatagtgaactccatcccagctcacagccattaccgggttgggacaagagccaccgtagatttcggtattgttcactttccctttgtttccacaccagatgtgatcatacttctcatggtagccgcaacataccttcaaggggtttgcaaatcctgcaaaaacaagtaatgagaacgctaaaactttctacagaataggtacttaacaacaaattgaattgcgatggaccagtttgtcgtatacctagtttcttgggattgctcatcatttcatatttcgcagtgtagacatcaacatatgtaatggctgcttgagtgagttcttttctgagattgattactgtttccttgagctttctgttgaactccatcgccatttcattttgagccttcacgcagccagatttgtccaagtagcccggtgcaggagtgcccatgtaaaacatgttcacgggtaaacaaccgaaaggacccgtgttgtgtacccaaaatgttcttcctccttgctgatatatgttctgtgaacaatatatagtgtagcaaaacttgtagtcagaagcaaatcaaaggcggggagaacatttcatgaactgcatcaaatctcacccggacagcagaagctaaatggttgacaatgtcgggtatcgtcgccttaagttgatcgacgctcattgtccgaaacccaacagagagatcattctgtccaatatcaaaagtatacaaagcctttgcaaactcttcctgtcttggaagcttctctctatcatatctactcttaactgtttttgcaaggcagaaaaaccaacagacttgttaaaatcatcatgacacagccaagttaaagatcaactaaaagacgtaactgactttgtgtgaagagtagtgcagatctggctttgaactgatcgaattgagcaatctgcatatcgagagagaatggactaatgccatattgaaagatagtttcgttctgtcttcttatggttgaaccacctgttgcaaagtttgctccatgtctgaagtttgatcctaacgagtttaagtatgcgctcaaatacggtaaccccagacgctcagctgcaaaccacagttcaagaatcaaagttttttttttttttttttggtttaatgttatttgaatcaaagtttttttattgaagctctgtttttctctgcaaatttcttaccaatgaaatcaatggtgagacggccatcggagtctcttccggtgggtctgtggaagaaaccttgaccgtaaggatccctaataggctcaaaagcggcggagatacctccagtgtcggaattagaatctccgaagttgtaaatcgccggaaaagtacacgtaggctgaactgaaacagatgttgtcactgcaaagagacacagaagaagccatgaaaacacagtagaagaaaccataagttttgctctttcaagattatccttcattgcgagtaacgaaacaaagagagtgatggtaatggcaattcacactctctgtctctctccaatgtcttgctcttatataagacttttgtttttagatctttctgaaaatgggtatataacaaaactgtattttcttctttgaaaattacagaaaaaaaaaaaaaaaaggatatcgtgtcttgagagttggaccggaccacagttcaacagtcatgagctgtgttcttattggaacccagaaaaaggcgctaacggttatcattgtcggtacctttcattcattgtaataattcacctaaaaagcatcaatttttctacgagtagataattcataaaaaagttaaccgaattttacaaaataaaacatggtccgtttttcacaaaattttatttctttctattttttctgatgtgctccagtcagttacattacatggtttcccttgagacggaacaaacaagaaatatttttgattgagctgagtgttctgatatcttatctttattgggctgatttatgatcataaaggcccatatattgtcagaactttgacaagccagaaaacttaaacgacgtgcagtttgatctcaattacactaaaacggcaagtcacaatcgtgtaactacttgcagacctccttcagtgaaacaacccaaattgctaagaaatagaacctcaatg

SEQ ID NO: 34822 - DNA, 3000 bp, Unknown; identical to SEQ ID NO: 28742
  misc_feature (1)..( 3000): 2750-1469P.txt file - cDNA_ID_3082312; gDNA_ID_2926253; Annot_ID_204433

SEQ ID NO: 34823 - DNA, 3000 bp, Unknown
  misc_feature (1)..( 3000): 2750-1469P.txt file - cDNA_ID_3082334; gDNA_ID_2926231; Annot_ID_142672
aaaaataaatgaatatcttattaaaaaggaataaaataatcatatccctcggatgttactataagtgggtctggttattgatcctacggtcagaatgcttttttaccttgctgatctgtcaataaacttatttgccaacacattgtgtgaagaaaaataaatttaaagttttataagcagtaagatgattagtgccgtatacaattggtgattaaaggttataagtgggaagaatttcaatcatatccaagtattttattaactttttaaaagattagattatatacaaatgtatatagtcaatatccaaatctatatataattattgaggtgataaagtttggacatttagataaataattaaaaacttttaagttcgagtaaaattatcacgcgtttttcaataacttttaaaaactaacatttgacttccaattatatcatatctttttattttattttattctggtgaaaatatcataacatttttcatactgctttctgataatctaccacgtaaaagtattatatgctactcggatatatcgaaaattttttatcttgatttgatttttattattttctggtgatgtaatatattaatgagattggacattggcatatatcgaaagaaaaaaaaatgtttgaatttggtcttttctattctagcaactagcaagtcaatattacatactcccggcaatgtagaatctttatttttcttaatattagatgaataaagctaagcctctgttctaaatttctaatatattaatttaacagcaatttgatgtccaactatgtcaaacaattataaatagtaattcgaactgggtcttcgtcttcgctattctctagctagtcaagatattacgtgttccaggggaccgagttgtactattatcggaacaaccctaattcttttaatttaattaaaactcagatctatagaagattacgattttcaaaacttgatggtatatatataaaggttaaactattaatctattatatgattaaatttcatcttaaataattaataggtggtgataatttaagtacgcatgagtttaagtgaatgaatatctaggtaacctaaacttgacaaaaaaataaatttagtttttctatgatataacttttgattgctcacagaatgttttgcatgttttaccaatctggcaatgttcaaaaattacgattttatcatgctatttcatcatctaataatataaacttaaaaagtcatcatcattcgattgctttttttttttttttaatttaagcttttttcaaattcttaccatacctttttcagaataattataagtttataacatttccatcttttgattaaataataagcatactcaagttgaaacctacggaaccggtctcactatgtaacccaaagcattggacttaggtttgtgagtttcacgaaacgaccagtatgttaacgcgaactgctttgacctattctttagttctatttattttcaaacacttttttttgttttttaaagaaaatatatgcttaattgaatatccaagtaattcgaatatacattttttttttgttttaatgaagcttgaatgctaaggaggaccatgttcacttttgcaactacttacatgaatggacttttgtatcttatctagctatctctttacattttcttatcctttttaattaccatcgaaattttataaatgtatgctatttatcaactagttagattttgttctttcaacaacacgaataatacgtttagcgagttgtgatatatataagaagaacattaatacaaaatgctctttaatttcttttttgaaaaagggttgttatggtctaactatttgattatataagtattggaaactagatgattatgcattgaaatttgattatatctcctttggttatttgactatattaaatacaacgtgttattgtttgtttcctgtttctttcaacccaaaatttgtcaacccaaataaatgaatatggaggaagaagaataaaaaggaagaaagattacatgaaacttcccagcaaatacggtacttattattaatctattaaatcatggatagaggaaaaatgaattatccaaaaacattgttagctagggttaaaaacaaaaagaactgtggatccaacaaccttggaccctgaactcgaatagagtgtttgttgacccaacaaagttagattaaatttccaacgctcttcatttagttaaatcatacgtatctataaaacacgcgtacacgaggagcaaaacctggttcatcagttttttaatttgttaacgatcacacccaccagttttgtaataacctgttttgtcccttttaaggtttttcaattcttttgtctgttgtgcttgctttttataactctcatatttgagttagagccaattggttgggaaatcatccaacttttgttcttttttctttctaacatgttttgaatcttaagatatagatgtgagaaatacttacttaatatatgtacatactatctctaatctctcaaggtattcaggttattggtttagattggagatttggttaaaagactaattggctattttaacctaatgtgaatagctcagtttgattaaattgaagatatgaagttgtcgatgaatttcggtttagttagttcatttggattattcgtgtccgagttgatgtccagcttttacacagtatttaaatttcgtcataaagacccatatatttgttacaggcccaattatcagtttaggcccaactaaattttgttgttgtttcttttggtcaacgagactctcaaattacagaactaccttaactgtttactgaacagacatcagacctgacgtcacacgaaaaaaacagacaccagacctgacgtgtaaatgtcatccgacgggtctaaagataagtttaaaatcagctataaattggcaaaagagtcttaagaaacattgtaaattcaaaaaaatg

SEQ ID NO: 34824 - DNA, 3000 bp, Unknown; identical to SEQ ID NO: 34823
  misc_feature (1)..( 3000): 2750-1469P.txt file - cDNA_ID_3082334; gDNA_ID_2926231; Annot_ID_203697

SEQ ID NO: 34825 - DNA, 3000 bp, Unknown; identical to SEQ ID NO: 34823
  misc_feature (1)..( 3000): 2750-1469P.txt file - cDNA_ID_3082334; gDNA_ID_2926253; Annot_ID_204427

SEQ ID NO: 34826 - DNA, 3000 bp, Unknown
  misc_feature (1)..( 3000): 2750-1469P.txt file - cDNA_ID_3082347; gDNA_ID_2926231; Annot_ID_142667
attaacgataaattgagtttcaatttcaactggtaatgaaggttccgatccaaacacggtatcaactccgagtgtctcgaatcacatatctgcacaggatcaaaatgagtacaaccactacatgagaaacctaaattcaacgagctaatctacacaaatcttaacttgaacactaaaaatctagacatctctactcaattcgaaacaaatgattcgattcacgaaccggaacacttttaggaacttcgaaacggctcactgcaagcacaatatctcgattcctcaaggatccgattccggtgcgaacgcggttattagatccatcgaactcatcggactttctggatccgggagcgaacgaagagccgtagtagaggcaagtcaagccgagtagagcgatgaaaccgacgagaacgtaggtgaagagcttcggagtcgcacggactcgctcagttctgaagtgtttcattctcagcgtctccggatccggatctagatctgacccgatactgaggacccggaaatctagctgccgatgaagagtggatagtgtgagagctacagtagattccctcgaggtcgaagacgacgaaatagaccagtgtcggattttacgtgcaagggaatatttggttagctgtgatcctctgtggcaaggactagggttgtttctatgctccttaactaaaacacgcggttaaaactaaatgggcctgtaggtagcatacatgtgcttttaaagaataatattgggctttatatagtttcttattgggctttatacttgtgttttcgatttttagtttttgtatcttatagttgtaacttttatatatttttatgaaacggtcaaacactcgaacacattcaattgtagaagataataaatcatcaatagatttctttgatttcaattcagttttaatgttcctatactattatggaaagtatatgaataagttgaccaaacaaaatggagagtacttattaattactaggttcagtgaatcttcttcaggtaacatttgttttaatttttttggtgtaaatgttaagaaaataaatacatttgttattcaaccatgaatatagtggtttgtgttacatttattatttatataatggatattaagaatgtcgtggcgttcactagtcagtattacacttatataatgcatattaacattcgttattctagtttactccagtccattagattcgaaatgcttttatgaactatatagaggaactaatacgattttattctataattatttggtttgaaagtgcagtccacgtatttcttgtttgctccttgaaggaactgtccaagaaagaaaaaaaagagtagcataaatcacgggtacgaagtttcatactttaatgtaagtccatttaagtttcacgtgttgtgtcttgctcaccgaaggaagcaaaaacttttatactgaaattaagacaactttagttaatcaataatttgcacacaagaagaaaaaaaggttaatcaattataagcatgagtgcatcatgagcgagaactctcgagcaaagaaaaaagaagacgaatggatgataatttaaaagtcaaactctcaatatttgtagtctacaaggtgcaatattcaacagtacctatcgagtaaatccgaaaagggaaaaaattgacgtagttaaggaacattgacaatttaaccgcacgacgaaggaaagatattgaagataggataggattgtcacgtggtcggaaacttctgataaccatccatttcatccccaaaggtatttattgcattgttattatactattagtatttgcccaaatcatacagaagaagttttttttgtttggcagtcctatttatatgatacatcatttctaaacttctgagttgcaattttttaaactaattattgattatgttttccttctttaagtattttttattcatataatttacatatgtataatacaatcctctagattaaaaatttggaattaaaaaatgttagtttagttattgactatttgtactttttaagaaatggtcaatttaagaatttcaagtaatcaaaagaaattgtcaattgataccatgttatgactttggatatcgataataatattatagggccaattgttggaagagagaataaaatgtggggtaaaattagaagaagtttccaccattagcgtgcttcacacttttttaaaaacagaaaagtgattagtctcctaatgatttcatagaaacaaaccaaatacaacaaacagaagaaaagtgaaattgctttcgaacaaaaggaggaaactttaaaggcgaactctttagtattcgatccgccattgaagctcctctgactctctctcaaagtacttctctgattcgtcattcctctgcttcgtttagtttaaaggtagacaacttttcctctcaatcgaattgggtcattttctgatgaatgtcgggagattcaatctcgaattaatgttatttttcgattttggggtagtctttggtttgatgaatcagagaatgtttcagttcaattcggcgaaattggaaagctcgtagatttgtcagaaactggtttttgtttgttttacttattgtgggttagagtgttggagtaggttttcgtaataggacttttatcttaatctagaagtcactaaatcgcgtattgttgtggaaaattacgtgacgtgattgaatctcctttctttatataaacatctctaccaaccttcgattttaaagagcggtgagataattcaacatctgtcaaagataaagctttcaccttttcttaacgaattaggtataggtaaattgcatcttctaataatgtcagaatcttaaacaaagtttctgctttttttttctggggtttcatgaatatactctaaaggctaaatctttgttttgcagggtacggaactgacctgagaggtttgatttgaatctaaaaaggtttagttttttgttaagtttgatg

SEQ ID NO: 34827 - DNA, 3000 bp, Unknown; identical to SEQ ID NO: 34826
  misc_feature (1)..( 3000): 2750-1469P.txt file - cDNA_ID_3082347; gDNA_ID_2926231; Annot_ID_203692

SEQ ID NO: 34828 - DNA, 3000 bp, Unknown
  misc_feature (1)..( 3000): 2750-1469P.txt file - cDNA_ID_3082355; gDNA_ID_2926231; Annot_ID_203687
tagaataagaaaaataaaacaaaaataaataaataaaaaatactgctttagcttttggagtatcctccttttaatctcaataaaaaaactattaaaacagaaaaaaaaatggcacgtcaatttgtcgttttggttctattgactttaactatcgccaccgctttcgccgccgacgctccctcagcttctcccaaaaaatctccatcacccactgccgcaccaaccaaggctccgactgccacaaccaaggctccttcagctccaaccaaggctccagccgccgcacctaaatcatcttcggcctcttctccaaaagcatcttctccggctgccgaaggacccgtccccgaggatgactactctgcctctagtcctagcgactctgctgaggcacctaccgtctcctccccaccggctcccacccccgacagcacttccgccgctgatggaccaagcgatggacccactgcagagtcacccaagagtggtgccgtgacaactgctaagttctctgttgtcggcacagtcgccaccgtcggcttcttcttcttttctttctaagttaagtcgtccacgttttggttggatggatcagagatttgtataatcttttgagttgaggccgtaaatttattttatatatacgtttataaatcgagattaattggagtaaatataaacctaaatgtcattttgaaatttggttagaacaaattttcatattttgtttaataaacttattttttttggaaatgcttatgatttgtgtggtctaatggtcttttagttcctattgtcatgtgttgtgaattagatatcatgaatgatataaatggatatttctacatttttattttaaaattttgttggctaatactaaattgtgtactatttataatattcatgataaaggctattacacatttttaatcaagttaataaatttaggatgctttaatgtactaacctcttttggtgccaaagtcagccaatgtgtaaatacaagcttagaaacatatttaaatatttcatagaaaatatttaaattttggaaatatttgtttgtgtgttttttgactgattattaaaaaaagttatgtaaaaatttaaattaatagataagttgtactccatccgtcttaatttagttgtcgttctagcactaaaatattgttttgtaataattgtcttttttttttttaaatgtaaatgtttggtacaaattttaattatatacttattatttaaatattttaactaataaaaaattagaaaatatattaagtagataaaattaaataaatatttttttataattgctgtgcaaaaactttagaggataattattttaaaacagagaatattataaactatttctattattatcttgtttcaaaaataaaaataaaaatttcgtagttaaattaaaacatcttagagagaatgtgaaatcaaataaatcagtatattatcgtatggcatttttacaattaaaaaataaagcaaaaaatattataataaaaaatataaaaagaacaaaaacgttaaaataatataattaatctttgagccgaaacaaaaaataattagtcaatggaggtaggacccgtaagaattgctctttttcccattcgctctgattggttccttctctctcccaaaccttttctttttttttttgtttcctcttcagcttttctttttggccaacgtcaggtttcttaaatgggctcattcgtaactccaaattttgcgtaggttttaagttttacctgtaaaatactagtcaaacctagcaattattaacacgaattcatagacaattgtcatgtccatttcttgttgttctatcaaaaatgtgaaaacccgtaatactagaatattctaatagatcacgtttaaacggcattagaatatcaacattgttttatttactacagaatccactttttgaagggtaaaaaatcgatccccttgtgcatatgaattttctaaagtaggctttttaaatctctcaaatttacacccatcaactttatgagaataaatgacgttgcaggccttgtagagaaaatgtacaagacaaagaaaatgtatagaactttatttttttggtttcacgtgaatgttatcacaaaagaaaatctatttccacgaaaagtgtcatcaaaagacagtaatagttcaggatgctactgtactatataccacttcatttgtcattgctgtcggtggtggtagccaatttacgataaacccaagttcaacagcattatttcccttacgaaattaataaatgaagtgggttcatttttttttgttcttgtcaatttatgaattggattcggattttaaaattttagagttcacaattcccttgcgtttgattacagcgtggaatacaaataatgcaaatgatatcttctcacggaggaatgtcaaaagatatttatatcactttagatataatattggatcaaaaaaatctcatgttaatctgttgatgcctaaagaaaaactgatcatgttaattacctttgcttaatgtcaacctcatgttaatttgaattaaaatatatttaaaatgtcaactttataaaaatgttggttactaatgcacatatcccaaaccttttttaaaaaatgtgaacattataaaaatgttggtatctaaaaagtagaaaaacaaggtgctttatgaaaagttgaaaataagaatggagttacccaatatataattaactaatcagaagtttaagacacagatgtaatgtagtaatctaatccaaccttattatctcctgcacatccaaacagaatccaagattacaatagctttatccaatgactgatagacacgtgtcaaaaggtaccatcactgtcagctttccctctcgctccacctacatacttctgagtgagcgagaaaatgagaacaaaacttagaaagcagagaagagttaaagtgttagagagagagagagacagagatcggagatg

SEQ ID NO: 34829 - DNA, 3000 bp, Unknown; identical to SEQ ID NO: 28896
  misc_feature (1)..( 3000): 2750-1469P.txt file - cDNA_ID_3082363; gDNA_ID_2926231; Annot_ID_203685

SEQ ID NO: 34830 - DNA, 3000 bp, Unknown; identical to SEQ ID NO: 28895
  misc_feature (1)..( 3000): 2750-1469P.txt file - cDNA_ID_3082374; gDNA_ID_2926231; Annot_ID_203681

SEQ ID NO: 34831 - DNA, 3003 bp, Unknown; identical to SEQ ID NO: 28893
  misc_feature (1)..( 3003): 2750-1469P.txt file - cDNA_ID_3082386; gDNA_ID_2926231; Annot_ID_203677

SEQ ID NO: 34832 - DNA, 3003 bp, Unknown; identical to SEQ ID NO: 28892
  misc_feature (1)..( 3003): 2750-1469P.txt file - cDNA_ID_3082390; gDNA_ID_2926231; Annot_ID_203676

SEQ ID NO: 34833 - DNA, 3003 bp, Unknown; identical to SEQ ID NO: 28891
  misc_feature (1)..( 3003): 2750-1469P.txt file - cDNA_ID_3082398; gDNA_ID_2926231; Annot_ID_203674

SEQ ID NO: 34834 - DNA, 3003 bp, Unknown
  misc_feature (1)..( 3003): 2750-1469P.txt file - cDNA_ID_3082401; gDNA_ID_2926231; Annot_ID_142648
ttagtcttgtttctatatatctttttcttaatggtgcttaatatatcgttactggtgtgatttggaatgatcaaccaaatcatgatacatggacaaaacaccaattatctacgaggaggctgacaaatgatatggcttcccaaacaattacgatgtgataggatctaacgtcctaattcccaaaagttgtttttctctatttttctttccgatttcttggttattttgattcgagcgtcaaattttgaccatggtactattcaaggcctccatagctatgcttggagacaaactgagctagaccacgacatgtaagaactaagaagcgatgttaagtttgcctccagtaacaacattcaataaacaaccaaatcctttcgaggtaaaataataattttaaaacgaaatatataaaacttacatctgaaaaattagttccgaccaaaagagttagcacctcttggttttgtacctgcatgctaacatatcaggttgaacaatatgcattaattgaaagtcaatctgaaaaaagaaaagaaatattatataatgggtgtattatcataataactatagaaatagttgtttttttcttttaatgttacaacatgtgagatgttataccttttattaattactaataaaaatacatatattccccatttatgttctactaatatgcagacaaaatggtatttattaccaaaataatgtatcatcaattaacaatatggattattttctatttaagctatgccattgcacccaagccagtgacactgtgacagtgtatcagcataactcacggttaaaaatgggacccacttattctcattaaattcaccaattttaaccattcatggttttttaaccgcggttaaacctgtaaaatcccgtttcaataaattctcacactcttcttcttctttccctggcgctcacttcttttcaagtctctctcttctctctcgagcctcgcgtctgtgtaaagagacaaaacatattctctaaagcggcgacgtttaagaacattcggtcaacgacttacggcggcgttggaatcaaaactccgacaatgacggttttctccggcagacaagtcgttccgatggattacgaaagccgaggtatcacaacggcttctagaagccatcctcgacggagatttcaaaacggcatcggattgcgtctccgatccactcgtcgacgttaatttcgtcggcgccgtcagcttaaaaacaaggaggagcgaagtcgtcctccgtgatgagtctcccagcgaagtccgcgtcgagtacgaagaattcaaaaccgatgtaacggcgttattcctcgccgttaatttcggaaacgcagctctcgtgaaggaattactggtaattatttttcttaatccgagtttagccgtttctttaacgttttttgctttaagattttgaaaccgataaacaaaatttgcattgatttaaatctgtgcaattaattatacaattcgacgttatttattaagcaaatcggtttctaataataatgcttttgatgtgaacaatatttgtaatttaatttttgtgctttgtttgaaacttttgcgttacgttccattaatggaagacgcaatctatggagaattggtttcctcgtgatttccattttgcgtttgtttttgcgcgtttctgcttagtggtgtgattcgtggtacctttttgtctcttgaattaaagaccccaaatatatgttctgtctgaagcttactttactttttcctctttttcgaaattcaaatttcgaacgaacgctgattattacttctctctgccttttctatgaaagaaattattcctgtaaaattttggtaaatttcaataaaattttcgatctaatgataattaatcagaatgagctaattcagtggcgtttactagcacttgtctatacttagctctagtcattttttgttttttaaaaaacgtggatcggattccgtgagagtttttaaaaattcataatctgttgactaactttaatcttaactggtggagtgttaggatccttccaagctgccaaaaatgttatactaataaattacatcttttagcgagtcaaatttgcatgtcaggcggggattattttccaattttgaagtcagtcacacaactttttcttttgcttgcatcgtcacagatttacttttattgagattctcattagcctttgctagaccatatatgctaatgatggatttgcgattagatttgaaatcaacagcgttagttatattaggctaagatctgggaaaaaaacatgtgcatttggattggtcttcgttgagggatattttgagacacaacagtgccaaaatgtcactattggtttgcagtgataattgaatgatttgatttgattctctcttgttttcctgaaaggaacttatgaatatttagtacgacaagaagtgttgatataacaccatgtaacttgtttgtgaaacagaacctgaggccccgccccattaggtgttgtcacttgtcattggctgcatctatagtagacgaatactatatttgcatacttccatctttccttttaagccatgctcctctgtgtcagggttgttccctaatgttcatgtagatccattttcaattattcactttgcattattgtacaactttactattatacacagtttcttttgtcttcttctgcctctggattttcacctcacgtggtgtccttcgcacttagcagtgtagtagcttaagaaaatattttctaattttataacactgatctgacttttcctgtaatatcatctcacagaacattggagctgatgtgaaccagaagctcttcaggggatttgcaacaactgttgctgtaagggaaggtcatttcgatgtctttgagattctactcaaagctggtgcttctcagcccgcttgtgaagaagctctagtaggggcgagctgtcacggacgctcgaggttcgttgagctgcttatg

SEQ ID NO: 34835 - DNA, 3003 bp, Unknown
  misc_feature (1)..( 3003): 2750-1469P.txt file - cDNA_ID_3082401; gDNA_ID_2926231; Annot_ID_203672
gacttgagaactaaaacaacataagtaccatggtgtttgctccttcatcccaaatcaaaccattttgcataacacttctcaacttcccacctactcttccatcagcttcaaacacagtcacattcaaacccctcgatttcaacttgtaagccgccgcaagtccacttaaaaaccatcaaaagaatcgacatatctgtgagcgaattcgtcacaattacacaaaattgacaacaacaacaaaaggatctcgacccaaaaacggaaagttgcagaagagtcataataatgcaggagatgattctctctgtgaaaatttaccttacacctgcacctacgactgcgactctttttcctgaaaccgcttcaatttctaaccaaaaagcaagcaaaaccaaattcaatgcaagatacaaatagtcccaaattctcaatgcgaaatctgaaaagtgaaattcgagataaaaccaaaattttcttacgatgatctgctactgctccagacgccattgctatctgcaacaattcagagtcaaaatctctgaccagtcgaaagcagtgacggaaataagtagaaaaaaacacagcggcaaaattccagcttatcccaaaacgacaataaagggtaccgtttttaatcaggcccattatcatcagtcttttgcctaacgggcctttgttttttcgtcaacggatccaaaccagatttatttgaatgacaaagtttcttgaggagagtgcatggttgacctttttctaccgaattgtttgaactcatgtgaaaactaaacttgttttctctctctctgcatgatgtactaatatatagtatatgttatctaattcgtttttagtttttgggcaactatatggttatctaattctcaaactcaaattagctcgtttaactagtatcttggatttgcgtttatacaattatacgtcttgtttgatagtaccattttttcagtttagtctctagtttgcagtttggcacattaaagttcgaacacaaactacacttgatgacctatttttcaattaggtcaatcaactctggtcaaatactccacagttttctaaagaaatctttaaaaaaaactattaacaatatcaggttcttatctcaatttgtattcccgaccaaaaagcattcgttattcataaggcgatttttattttattttaatgtaggtttgggaaactaaaggaatgcaaagtttgttggtagttatcgtggtagttaatctaatcgattaaatgaaaagtactttttcaagaagaacataattggttttattatgagaaaagtatgtaacattagtgtgaataattgctttttagagcataccatctttgaatattaacttaataaataaattcaaacaggaaaaaacaattataaacaaataattgtgctgagattacgagaacattacgtggcccatttgtacaataagatatttcgaatctacagtttaatagattttagcaatatcgcatggatgtgaaaaggaaaagtcattttgctttaaggtagactaaatttgaagattgaattagttatcatttatcagacatgatatttgcttgcgccatggaactttaaggatgaagcaaactaattaaatatttaatctctgccgccaaatatgaattcgaaatcatatagtatttgatttacacgtataatcatgtatgacttacttctataaagcttttcaaatttcaaaactgaaaaaagtaacaagttgttttccttttgccactttgattatattccatcggcattgtttgcttacactttcttcacgtcttaattaattaatcagaacaaagaaacgattcttaataaatattgtcgaggatttgaattttgaatattctataaactgcttgatctcgactctaggcgaatagtgaatccgactttggttttgagtgtttctagttttctcttttgttaataaaaattaatttagttttggtttgcactaatataaattcaaagaaattagtgattcatttagttgttggattggttgtgattttccaaaaatagacacaacaaaatcgtttgacaaaaacacaagtaatagaaccaaataaccgtttgaaggaaatttcaattatcttttcgatcacttcaactcaaacatccatacgcagtaagcacaagtaacaaaagaagagaataactatacgtttgcctttaagtagttagtaagatttgttgttcataaaatcattagactcataaatgttcagtaagtaagattaattagcagattaaggtagggcaattaggaggtggtccatgctttgtcctaattagtgattagaagggaaatgatcccaaacgcatagttttctaacttttttgggggggcatatatgttttttgggatggctcaagctggtgggcgttaatagctcttatttattttttgtttgttaacactactgttttattaccagaagttcataactaaaatcaataatatgcattcgaacggtttattattatgacacataaacaaaaataaccactaagctatgtactacagtagtagtcagataatttatgctttatcaacaaaaaaaaagtacataactaagtaatatatatgaccgacgacatgttttgtcaacaaaagaagttcgatatttaatcatataattaatattgtacgtattaaatggaatcaaacatgtaattttcatgtcgcaatctggatcacgagatctttccgcaacatgaatgtccaaactaggatccgatgaatcacgttctttgggtcaactcattttcatttaattaaaacaatatcctaagatagcgaattctatatttttgggctcatcatactcatgaagttagaattaattcgagcaaaaatgtatgtacgctcgatacatttttcttggtttttttttcttcctcacaagaagaacaaaacataaatccatgtttgaaaagactttgtatatgctttaaaatcaatg

SEQ ID NO: 34836 - DNA, 3000 bp, Unknown
  misc_feature (1)..( 3000): 2750-1469P.txt file - cDNA_ID_3082405; gDNA_ID_2926231; Annot_ID_142647
aaagtaaccaatagtgaggggtcataaaacatactcagatcttcacaattataactctctgtatttttgtcgtggacgatgtgtttcgagtagaatacagatcatagtgaagaaaaacggtgggcgattaaatggaaggaggaagaagtgatgtaagtgagatctttggatgatacaagaaagatcaaagtgtggtagagagagtatttgaagaagtcggtggaaatatgtacgtgaagaattatagatataaaataggataggaccataacttcgcaatcgtgcgtacggggaagacgaggactcgtcatgaggttgactcttcatcaaccattaacaactcattcgtggaatacgtctatgtagatatgactatttttggtttagatctatatatgtcccatctaattatttctgaattcacgtaaagtcatcaactaaggaaatagtgaaaaaaaatttagaaacaaatccgaattttttagcccaagaaccttcaaccattgattttaaagcatatacaaagtcttttcaaacatggatttatgttttgttcttcttgtgaggaagaaaaaaaaaccaagaaaaatgtatcgagcgtacatacatttttgctcgaattaattctaacttcatgagtatgatgagcccaaaaatatagaattcgctatcttaggatattgttttaattaaatgaaaatgagttgacccaaagaacgtgattcatcggatcctagtttggacattcatgttgcggaaagatctcgtgatccagattgcgacatgaaaattacatgtttgattccatttaatacgtacaatattaattatatgattaaatatcgaacttcttttgttgacaaaacatgtcgtcggtcatatatattacttagttatgtactttttttttgttgataaagcataaattatctgactactactgtagtacatagcttagtggttatttttgtttatgtgtcataataataaaccgttcgaatgcatattattgattttagttatgaacttctggtaataaaacagtagtgttaacaaacaaaaaataaataagagctattaacgcccaccagcttgagccatcccaaaaaacatatatgcccccccaaaaaagttagaaaactatgcgtttgggatcatttcccttctaatcactaattaggacaaagcatggaccacctcctaattgccctaccttaatctgctaattaatcttacttactgaacatttatgagtctaatgattttatgaacaacaaatcttactaactacttaaaggcaaacgtatagttattctcttcttttgttacttgtgcttactgcgtatggatgtttgagttgaagtgatcgaaaagataattgaaatttccttcaaacggttatttggttctattacttgtgtttttgtcaaacgattttgttgtgtctatttttggaaaatcacaaccaatccaacaactaaatgaatcactaatttctttgaatttatattagtgcaaaccaaaactaaattaatttttattaacaaaagagaaaactagaaacactcaaaaccaaagtcggattcactattcgcctagagtcgagatcaagcagtttatagaatattcaaaattcaaatcctcgacaatatttattaagaatcgtttctttgttctgattaattaattaagacgtgaagaaagtgtaagcaaacaatgccgatggaatataatcaaagtggcaaaaggaaaacaacttgttacttttttcagttttgaaatttgaaaagctttatagaagtaagtcatacatgattatacgtgtaaatcaaatactatatgatttcgaattcatatttggcggcagagattaaatatttaattagtttgcttcatccttaaagttccatggcgcaagcaaatatcatgtctgataaatgataactaattcaatcttcaaatttagtctaccttaaagcaaaatgacttttccttttcacatccatgcgatattgctaaaatctattaaactgtagattcgaaatatcttattgtacaaatgggccacgtaatgttctcgtaatctcagcacaattatttgtttataattgttttttcctgtttgaatttatttattaagttaatattcaaagatggtatgctctaaaaagcaattattcacactaatgttacatacttttctcataataaaaccaattatgttcttcttgaaaaagtacttttcatttaatcgattagattaactaccacgataactaccaacaaactttgcattcctttagtttcccaaacctacattaaaataaaataaaaatcgccttatgaataacgaatgctttttggtcgggaatacaaattgagataagaacctgatattgttaatagttttttttaaagatttctttagaaaactgtggagtatttgaccagagttgattgacctaattgaaaaataggtcatcaagtgtagtttgtgttcgaactttaatgtgccaaactgcaaactagagactaaactgaaaaaatggtactatcaaacaagacgtataattgtataaacgcaaatccaagatactagttaaacgagctaatttgagtttgagaattagataaccatatagttgcccaaaaactaaaaacgaattagataacatatactatatattagtacatcatgcagagagagagaaaacaagtttagttttcacatgagttcaaacaattcggtagaaaaaggtcaaccatgcactctcctcaagaaactttgtcattcaaataaatctggtttggatccgttgacgaaaaaacaaaggcccgttaggcaaaagactgatgataatgggcctgattaaaaacggtaccctttattgtcgttttgggataagctggaattttgccgctgtgtttttttctacttatttccgtcactgctttcgactggtcagagattttgactctgaattgttgcagatagcaatg

SEQ ID NO: 34837 - DNA, 3000 bp, Unknown; identical to SEQ ID NO: 34836
  misc_feature (1)..( 3000): 2750-1469P.txt file - cDNA_ID_3082405; gDNA_ID_2926231; Annot_ID_203671

SEQ ID NO: 34838 - DNA, 3003 bp, Unknown; identical to SEQ ID NO: 27465
  misc_feature (1)..( 3003): 2750-1469P.txt file - cDNA_ID_3082453; gDNA_ID_2926232; Annot_ID_203743

SEQ ID NO: 34839 - DNA, 3000 bp, Unknown
  misc_feature (1)..( 3000): 2750-1469P.txt file - cDNA_ID_3082487; gDNA_ID_2926232; Annot_ID_142683
attcaataaattataatgacaacatttattagataaaatatgttgaacaagactatttttttcttttttttagggttcatcgtccattggaaaacaccaaggctctgatttatcacgatttatacgataaatatagccttcaggaccgtaatcgcttaaatcccaaatgcattcttgacaaactggatatcttccggatggtttatcatctctggatactgtaaatatatcaaaccagtaattaaaaaatttcttattgcctgcataccaccaaaaatgacaacgaaattttgtagattttgatatgttaacaagaaatctgaaatcccaagtatgcccatgtttaagatggatatgccccaaattattttcactggatttgcaatgtatattcaactcttctccattttttacagtattgcgaattacaacatgctttttggctaaaggtaagaagccgtctggtgcttctgctgtaacatctgaaaattctagtgctaacgtaaaaataataaaagtagaagagattagaaacaacaatgtaagatgagaattggtaatggaagccatggtcatgtaaattaggctggaatggttaagtagaacttataagctcgctatttataaccccgaagaagagaggtgattagtttaggtaacgttaattagtgcattgaatttagtctgtgtaaataaattatgaataatatatattgacaagaacatacatatgaatatatattataaattatgaaaatatctattttttccttcaaagtatatgaatgaatatactaaatgaagaaagtttgaacaaaaattgtcattgttaaagaagtatgactaaacatacatatataacaagtcataaatttcatattcaaatattctgcaataataaaattcatatgtttggtaagaaatacaattcggagtatatattatatattaatttacagttttggaagtaaatcaatcttttaactgtcactttattagaagatttttaagccttattttgtaagttttgaaatgttgtttgttgaccattcactttgtgcgtatgtggtatgtatatatatatatatatattattggaatatttatttaaacgaaggaaggttgactaaacatatagacttactaatctaaaaaggatattgatataaccgtttacatatagttgaaagaaagactactttataaatagccataaatttaaataaattacgtaaataactatgatttttgttttgtgtgtataaaatatacgcctaataagactacctcaccagtcaccataccaaattaaataatcaaatggatctctaatcaaatggaaagattcgtacggagtatccagaaaacaaagaccaatcggtttatttttgttgttacatgacttatatctcacttctatacgacattgtaaattatactaatttaaaacgatccaaaaatataattttgatagttttttgcttttttagtttctggcaacattcgagtaataaaatgtttagttagaaatattcgatatatgttgtgttggatacaaaccaaaggttccacatcgaaagtttgaaaaaagagtttttgatatataaactaaattcaactccaactagtatgaggccttttggaaggagtccaataacaaatctttgcgggtttgaacatgtgagcccaaaaaggacaatatcatattaaatgagagttggaatggccttagaaaacccgttaaatggtatcagaatatatgtcgaaaaagtagatctatggcttggactatgatcggtgtgggaaaacctctcaagcatgacacgataagaaggtatctcaaaattttcacgaataagaaagtgccaaaattttgttgaagaggaggcattagttcgtggtctttagtttgaaaggaagattgttggatacaaaccaaaggtctctcatcggaagtttagaaaaaaagtttctaatatataactcaaatccaactccaactaatataaagcctattgaaaaaagttcaataacaaatttttgtggacttaaacatgtaaactcaaaaagaaaatatcatactaaatagaaattagaataggcttacaaaactcattatgttcttcttttttttgcaattgttattaactattcaactaaaccttgtttgtttttataattggttggtcaacggtaatttttagcaaaaacggtttacaaattttaatttgtaagagatttaacattataaaatttatattgttgaatcgttatcactacgaactacaaaattaacccgattcacggtaatcaaattgttcgcaactataaaatgaacatattcttaattgtgataatcagtgtggcagaaatttgcgaaacgaacgtgacaataatttatccaaaatggaatatatgcatctatagaccaatcaatgtagttttgtaaatgtgttaacataccgtcaaataataataatatctattcacaacaactcttaagcaaaaaaaccaaagaagttacctcttaaaatatttaaatcagtatcacgataacatactttattcagtagaaaattatctatgcgatcaaaagaagtttaacggaaacatttataaaaaagaataattaatatctcaccaaacaaatgaaatggagaaattccaatggactctcttggttttgagtttttggacttaagactgcgggaagatcacggaacactttttgtccgaaatctgacgtggcagattataacggctactttgatgactcactatttctttttaatattataaaaatcgaagagagacgttaagattcaaattttttgaagacagaacaaaaaacaacacaaacaattaaaacaatcagaatttttctcgaattcatggaccacaataattactattcttcttcttcttctctatgatctctgcttccttttttctgggtatctaaaaaaactcaatctttatttctttttgttagcgaaaatg

SEQ ID NO: 34840 - DNA, 3000 bp, Unknown; identical to SEQ ID NO: 34839
  misc_feature (1)..( 3000): 2750-1469P.txt file - cDNA_ID_3082487; gDNA_ID_2926232; Annot_ID_203730

SEQ ID NO: 34841 - DNA, 3003 bp, Unknown
  misc_feature (1)..( 3003): 2750-1469P.txt file - cDNA_ID_3082495; gDNA_ID_2926232; Annot_ID_203728
caagtagaaccacttcatagcattgatgcattggtcaaatttcatataatgtcatatctaatgtgagaaaaacaaaactgcagctacgtttccattggatctggtgagaagaaggaagcagctggaaggaataggcgggcgagcggtagtgtacaagacaggtttgttaggcacattaaagcgtattgttcaaacggaaggagcgagaggcctgtacagaggaattcttccagagtactacaaagtggtacctggtgtagggatttgcttcatgacctacgagacactcaagctttacttcaaggatctttcttcgaatctataacggtttaaaaggttggtagatttgtttaggtctatttttggtgagaggaaaaaaactgtaaaaaccaaacagcggaaaatgataatgtatacgaaatgtagaattatatatgtagttgttggatgtagcttatacgagattaacatttgtattggtacaatccttttccattgttacatggcttatacgaaatgtagaatcattatgtatatgtagtgttggttaatacgtatatcaattgagggcccaatatacgaagtgaacattgtacagtcctagttaatgacccatataaatggtggagaaatttcggatggtaatgggcttgagtatccgagaaagccttttaacaaggagcttcaacctcaagtatcccacatcggaaagctaagagactttgatagaggaattgatagtataaatacacttcactctgtagggagtttaaaatcacgcagccatgtggtaagcacaaagcgaactattctttcgccttttactaaagaataccgtgtgctctccacgctaagtggcatacgcctatttttggagggctctcactttacagtgggacccaacatctaccctagtgtaaactttttatgtgtggctaacggtctatcaatgggctcaaggcaccaaagctcataaaatgtggctatatatgtttggcaatatcttcttaatttcttaaatgtggctatgtttctctctccaatattttgagaattacccttatgttattatgtattaacgatctatcgaatgatatatccttttcttctttttatgtcgcgttgattccacaacttgcaaatcctttgtttcgttttttggctgttgtttcttttgaatcacaacttgcaagttgcgaagacaacctatagagtcaaccctttgttgttgatgaatattattagttattacatcaatatatggaatctatctttgaccttatcaatcttctggtccttcagatacttatattctccagttgaagtaaagcttataacaacagttacgttatagagatgtaatattcatcaataacggtatatatcgatccgctaattcgtttaagacttccatctaaaacgtttttgtttacatattaaaacgtcatttttggtgtttccttttctttcatgatttcataagctaaaaaagaaatgttgttgttggccatattataagtttctttatttttcatcgaagatcctgatttaattattcatatatctttctgccaatcaacttaaattgtttttcaactaatactagaggccttctataaaaatttatccccattcatataaaacaaaactatactaaaaaaagctattactttgaattataaatcttatctccaaatctaagctaattaatgtacaaggttgattactagtcctacaaactataatattatagaacatttatttgttaagatgaatgaatatattgattcctttgaaacaggacacggttatagaactatatataatgttctagaacgacaaaagttatttacaaatactttggaaagcattttgcatattatttgcctcataaaccttcgttgactttagtgtgggcacgaaattaggtcactcacgggaattgtttcgaggattctacttcatttgatacgatcaccacttttagtagcgtacgtaccgcgtaacgatttcgacaagttttctcctttttcatatataggaaaatatataaaattagtttggctttacaaaagacagaaaatgaaccatatgggcatatgtattcttattttaatatttttttatcgatatgggtattgcttgaagcctgaaactccttgcgagtttttgatgaattgatctttttttttttttccacttgatgatcaatagatcttattttaaaatttgaggatggtcgtctttggttgaaaccaaaactgagtaatgttgttgtcacatttggagccttgtcgattgagaaaaaaatgctatatatattaatttggtactgaccgttacattgctcagcggttcagccgtttatttattcctctaacatttttaaataagctatttataaagaaatttataggatcgggcaaggagacttctgctaaaatcgtcgaagatgttgaagaatttttagtgccatacaaatttagggttaacgaaactacactcaatccgaaaaacaagctatagaaccgatcttagaaaggatctccaactgttttcagattaaaaaacaaaaatgtctctaactatatcatagccaaaataattactttttaatctttccatatttcatatttttcttaaaaacaaaaacaaaacatatatattcatgcacatatgatagataatatcaagaaatttttaataaataaagtcagatataatagatgtgacaaataatctaaaagaccgatcacatgtagtcaaagttttcaactataaatatgcagagatgacagttataagagtcgcacaaaaaactgcaaatcttcacgtgtcttctcttttgtttcatcacatgttctctcctttcttcacctctctctacaaatttaatcctttctcttttcggcatccctaggcccctttggccttttcttaaatacatctctcagaaacaaaaagtttgtatacatacatttccacctacacatctttggcatg

SEQ ID NO: 34842 - DNA, 3003 bp, Unknown; identical to SEQ ID NO: 28598
  misc_feature (1)..( 3003): 2750-1469P.txt file - cDNA_ID_3082500; gDNA_ID_2926232; Annot_ID_203725

SEQ ID NO: 34843 - DNA, 3000 bp, Unknown; identical to SEQ ID NO: 28597
  misc_feature (1)..( 3000): 2750-1469P.txt file - cDNA_ID_3082504; gDNA_ID_2926232; Annot_ID_203723

SEQ ID NO: 34844 - DNA, 3000 bp, Unknown
  misc_feature (1)..( 3000): 2750-1469P.txt file - cDNA_ID_3082519; gDNA_ID_2926266; Annot_ID_143309
aatttccaacttagggtatatattttcaccatttaaaagtgattttttattttaaaattagtttgtgctattatatttgagttctctatttccaatttaggatatatatttccactatttaaaaaagtttttgattcaatttaatattaaaatagtgtttgctctcatttttatttggaggattgacacaaatggtagtaacaaactctattatttaattaatgagaatattacactctaaaacactttttaaaaaacattttcgtggttaggcactttctaaagagaacgcactttgaatggataatttgactcatttaccctctaaccacatatcgctttatctctctccttctcctatcctttctctctctttctctcttatcctttctctctctttctctcactttatcgaaaaataaacaaaaatcaagccaaaaaaatagatttcttactttttcttttcgccctcttcaacaaatcatcagcttttatgagaaagagagattgagattcagctttctaaattttccgcgtctgctttgatctgacttgaaggagaatttttcagaccatcaatttgagaatctggctaatttagttacatgactcgttgaatgcttgaattggatttgtggtttgcttttcgttttatgtttttgctgtttgttgtaaaattaatttgattacttgctctttgattctttgtcttgcttctccaattacatattcgagatttttctcttgaattgggattaaagccttgtagtggacttcgaatcgtttgatagcaatggtcgaatcactaattgatggaactcgttgcttagttcctgttatgtggatttgattcatgattatatttgggttgtatcttttcagaaaatctggttatcttatgtattcatcataaacggtttataagttttttgatggttgattcacttattgaagaaccttgttgctagttctggttctctgaaattgatggaggttttaccttaaatttgagactaattttcattcacagatgttagattgatttctggacacgttcttctttacattttggtgcaaaattgagaaaatcatcttcacagaattaaatgaacagacctctgtggacaacgatttctgtacatgtttttctttactttttttatctcaaaatccaatcgagaagatcatcttaacagagttaaatgaacaatacttatgtggacaaggacttgtggacacgttcttcccttgaatttgtaatcatttatgttatatctgagatgttttgtatataaaatcaaacttggacttgtattttaaaactttaaaatccaatcggaaagatcatcttaacagagttaaatgaacaaacctctatggacagcgatttctcgacacgttcttctttacctttttatctcattttacttgaacttgtctctaagttttttgctgttaaattctatggcttttgaaaagaaatgacattgttctttttgtaatcgctgcgttagtaatcagtcattttgaaaataataaagtttttttaataatatttgtgtcagtcccccaaactattttagattttattttagttttataatattgattcggaaattaatattaacaaaattaaaaatgattttgatttggtttaattcactttccttatcatctttctcatcattgctaagaaattttttatgaagagacattttatttcaactaagaaagaggtgttatttgagaaccacaaaaaaataacgtgaagaccaaaacagctggaagttatgaagatggccatgtggttgcttatctaaatcggtaagagaatggtggcttcattaattacatctatacctaaatttttatatcttcatatagtcacatttgttcactatgcttatgaaggaaaaaaatcatgttctgaaaaatgtagtaatatttcatatctgtcttatcatattcgtatcacatgtggtctctctttaatgcgttcaaacgctttccaacgtatcaactgcctactcaatagtcaatacacacaaaggtcggtaacacatggagatggaaattatatttaggctttaaaatagattttgatttactattttaaaaaatttattttttcgcttgttaaattttaatttctaagttaatgaaaaatgtacagtcaagttaattttagtctttcaaataaaatagaaaatgttaaagtattttatactaaaatctatattggacaatgaaatatttttgtataaagtaaaatccaaatactcatttaaaaattactatcattcatggtataatctacaaattcaactttctaaacatcaaataaatccacttcgaaccaaaatcaaacaaaaccaaaagttcatatatgttaaatattttttcaaaaacatttactctagatatgtttttcttcagagagatgttattttaaaataatttttcttgttatttatagtttttgttttttaattttttgttctactttagcaacaacaccattttgctcacatatataatcatcatatgatttattcccttgcatgtacggtttgttgttcgttactttaatttgatgtaaacataactattttaagagatggtacagattgtgaattctgatggttttcataatactatcacaaaaatcttataattttccaacatataatttcttactcagccaaaggaaaacataacacattatctattcgactgatttgatctcgccaccacagttcatttcatataccgcaacaaattaataagcattttatgtattttacaacttttttattagcttttgttttataataagaaacttttaaatacaggaaaataaaataagagggtaggtggaagttattaacacgcattaatggcaactaactaaaatcctttaatatagctttgtttccgctcacgagattatttatcttcacaattttttttcgtctctcaaaccaacgcaaaagaacaatg

SEQ ID NO: 34845 - DNA, 3000 bp, Unknown; identical to SEQ ID NO: 34844
  misc_feature (1)..( 3000): 2750-1469P.txt file - cDNA_ID_3082519; gDNA_ID_2926266; Annot_ID_204918

SEQ ID NO: 34846 - DNA, 3003 bp, Unknown
  misc_feature (1)..( 3003): 2750-1469P.txt file - cDNA_ID_3082564; gDNA_ID_2926233; Annot_ID_142703
atatactgatgttttattgtaagaagtttaactcatgtagtcataagtgaaaacataattttttttttgggaaatagcttataggatttgacttatcaattccttaatgagaagttagtgcattttgatttatttattttaactcatctagaattagtgtgtatgaggtaaattaacatacgaggttacgccatatagatttgatctgatataaattttattttaatatgaaattgttatcacttaagataatgtgtgtaaaataaaaatcaagtttatcatgatgaaatagaaagttaaactataatgcaaaatcgaatgtgtaagatagaaatttgtttttagttaaatcctaaattgaatatagaaaaagtgtgtaaactacaatttagaattcaaatattatcaatgagattgagtgtgtagaattaaaatgtataaggaataaaatgcataaaactagaatttggtttaaaaaaaaaattattaaattaaatatcctaaaactgtataaattactattttattattcaagattcaaatattatcgataaaaaattatatttatgtcttagacgtacctgaataggcgggctttacctagtatattatatatacgcattactttgatcatgaaaacgttgtaaggcccgtaactacttcagattgaaaggatgtttaatcagatcgtataattgttttagcatcttgcaacaaatcaaacagaatgaaaaaaaaaaaaaaaaactaaaggtgaggtgatcacttttatttcaaattatatagtcaataaaatacatattattaacataaaaaaagaataactacagctgttaatataattgattttgtgactaaaaccaaccttttgttttggtaagtaaacctcacagtttgaaaataataaaatcagtgataagaaggaatcaggtgagagttgtctagtccacattttcttttcccaatatagtaacattataaattatttccattagtcacactattactaaatttgtaagaaaactaaatactcatacagatttctccataaatagaattcatcataggcgtgtgttctccacacttcacatcctaggcgtgtgttcaccacacttcaattctcttctttcattttcactattttttttctcgtttaacaaaagaaaccaaaaccaaaaggtcctaaccatggaatcaaacaacaacaacttgaacctagacatggagaaagatcaagaaacgactttcgactactccaaacgagctcaatggctacgagccgccgtgctaggtgccaacgatggtcttgtctcaacggcttcacttatgatgggtattggtgcggtgaagcaagacgtcagaatcatgctcttaaccggttttgccggtttagtggccggagcttgtagcatggcgatcggagagtttatctccgtttactctcagtacgacatagaggtggctcagatgaagagagagagcggaggggagacaaagaaagagaagcttccaagtccaacgcaagcggctatcgcgtctgcattagcatttactctaggagcgattgtgccgctattggcggctgcgtttgtgaaagagtataaagttaggattggagtgattgtggcggcggttacattggcgttagtgatgtttggatggttaggggcggttttgggaaaagcaccagtggttaagtcgttggttcgggttttgattggaggatggttagctatggccattacgtttggttttacaaaactcgttgggtcacatggtctttgatatgtatgtgtgagtttacttacgtgaccaaacccttcttcatgtttcatgcttcaaaaactggaaaaaaaaatgtaataagtagaattaatttctaatgaattccctttacaatttttaatgatcatgaccatcaaagacagtttataaatttaaaatattagtcaaacaaataaattgatactttaaaaacttatatgagtactagataaggttcgcccaaatagacgggtatataaatgtaaacttttcttaatagtatttgaattttgaatatagtaatttattctttcttcttgatatttaatttaatattttttgttttaaaaatttcagttttatgcattctattttattatacattttaatactatacgctcaatcttattaatgatttttgaattctaaatttaatttagtatttagaaaacaaatttttatattacacattcaattttgtaatatagtataatacatcataatacactcgattgttttgctaaatttagttgactactaatacatgtaaaacaaatttgttatttttccttttggttaagaattttttttactagatacatgataaatctagttgaccaatacacatgtaaattattttggttaataaaaaaatagatataaatgtataaattagtatatataaatttgagtttttttttttataatgttttctaacttttttaagagaaaaaagttaaaaaaattctgatacatatcaacatttgttcgattgagttgatacgtgacacaatcttatgaattgctaactttaaaaaccatactttagataataagatatttaacagatttactttgttagaaaaatctaatattaaacaacattattcaacttgaatagacttttaaccatgtaaacatatattcaagtcacctaacaccaaatttggatatactcgattctttttatttggtcactacaaagttgtttatgtctctttcgatgtacactaataatgttttaaacaacactaaaaaatgtatctatagtccaaaaatactttaaaatttgcaagcaattgattgaagtaataaattaatgtggagaaaatagagtagctagggaccagtgaagatttcttgaagatataaatataatcaataatattagttgttgacaaaaaaaaaacaataatgttacttatcttctgatcttcccaaaaaaagcaactaacaatg

SEQ ID NO: 34847 - DNA, 3003 bp, Unknown; identical to SEQ ID NO: 34846
  misc_feature (1)..( 3003): 2750-1469P.txt file - cDNA_ID_3082564; gDNA_ID_2926233; Annot_ID_203769

SEQ ID NO: 34848 - DNA, 3003 bp, Unknown
  misc_feature (1)..( 3003): 2750-1469P.txt file - cDNA_ID_3082623; gDNA_ID_2926234; Annot_ID_203806
atgtgattggatttcagtttttttaggggacaatcccattaaaaaaaaatctaacaaaaccaacaaatcataattgcaacgaattattaacaaaatattctaactaattcatacatttctcatttaaacgtactcgtacctagtaatattatagtaaaccaataaattaccattgcaactataattagtctgtttgtttcgtcaccgtatgcgacaacggtaaattttaccacagattattgttcgtttcgtcgctgctgacgtataatttatttttgtttgatgatgctgacgccgactctgccgttgccgcagatgtttatgttaagggcaatgcaaatctaaatccaattaactccaatggttatataaagagtagagaacaacatatgatttaaagcaagtaagcattagtgatttagaaccatatagtgaaaaagaccgtaagtattagttccaaacattcagacccattatacagaaacagacatagaatttggaaatttagaataaacccaccaaactaagagtagctaaaaaaacacaaatcaaaaagaaactcaaaattcccaagagatttgaatcagtgaataacaaaagtacctcggaatagatatttaacgtcgtatcagaagtaactaacgacgggagatctaattgagctaaaatcaccgaaaaagcgagattgagacggcggagagagattagtttcaaagaacttgagatcgatgactataagaaagaaatgatgaaagaagaagaaaaaataaggttaggtttgtttgtagtttcccaaacatagtaaggatagtcttgtcatttaccacatataacgcagcttttaatcgtttaacgctgattttaattagcgataataatttttagccgcaacgacttacgtttactgcatcggcatgcatccaccaaacgaacatcaccatttgtgtctgccgctgcaacttacgacgaccaaacgaacacactaaatttatcaagttataaaatacaacacctaagattctctgttctagattgatagttcgtagaggtggcaatgacttgctagctctcttttgttttccaaaattatttaccacctcaaaatcttgaaaacttttaaaccacaagatgtatgtataagaagtgtctctaagtttagcaagtggtatgaatgattaagtatccttttactcaacgcttacattttttttttcgttttttttttccttttttctgtttccaaaacttttaatggtatatcttaaactaagttttttcgtaatttatggtacttttttcgttgattttacattttaaaaaaaaaacagaactttcaatactaaataataatatttgagattttaaaaatgataaatgtatgagttgacctataatgctaaaaacctacaagtctacaaaaacacatgaatcaatatgcataagctataaaacctatatggacttgaccttaaaacctatatatcttgaccctatcctaaaatttaggtttcaatcaccatatgacatatctatcacatttcgagcagaatctaaaaaacatatcctatttatatgattttgatttttggccttaaaacccaaacacatcctaaactttaggtttcaatcaccattgacatatctacaatgttctatcgcatttcgagaagaatctaaaaagaaaaaactgatttgaagctttaatttattatacaattaaataatttgttagacttttaaaggatttagtcacgttgagggatcggccacgtcatttataagaataaaataatatcaaatcattatagttattattagtaacagtggtatagagggacaaggagataagcaggtatcgtttccattaaaacagctggatttgtcggcactcattcccattattgtatttatttcaccatatctgtcttatgaccaaaactacaataaacatataaataaaataatacgcaaataaaacaaataatcctcaacattttctgatttttaacaaaatctgtcttaaattataatttattttaaaatgttgatcacactcaatttaaaagtattacaattttcacaattggaaaattgttattagtgaaagtactacattatataaaataccccaattacgtcttgaataacctaaaagaatacaacaaaaaatagtttgaagaaactcattattgtttttaattaaaaaattgaaaacttgcttacaacagatttgatttgaaaatgtcacataaattttatgttcactttgtttataagcaaatgtattataatcaaattaatatggaaactctttaaactatatctgattagctatcttattatatactaataaataaatttaattagtaataaaaacacgttgcataattactttaacagaattttgtataaagttctcatttatattaatggtacttaaagaggtattttataaaaacaattatagggaaaatctttaaattgattatattgaataaattgaattattaagaaaacacgttgattaattagtttaactacacaaaaacttaaattgacttaaaactactctcctaatctttgttaaaccaaacaacccaaataatttactctgaatctttttttgccgtctagattcgtactctgcaacaagtgaactaaacacagaagaagaagaagaagaagacgagacgacgaatccagaaacagagagagagggagagagctttgaatatcttattgtacacaatcttcttcgcatggaagatttctgtttctcgtcactctgatatccaaaaatgtctggatctgattttgatttcgcggcgtttcgagttcaatgctaaaacatcgaagcggtttcgaatctctgagaatcgaaggaaaacgaagcgtgtaggttagggaacttaagattacgttgaagagaagcaagttctcttaaatcgcaactttggagaagtttcgttgttggtttttggtaaagcgatggagtcacgaatg

SEQ ID NO: 34849 - DNA, 3000 bp, Unknown
  misc_feature (1)..( 3000): 2750-1469P.txt file - cDNA_ID_3082635; gDNA_ID_2926234; Annot_ID_203802
gaggagaaagatgacaaaatttgtaactagggttttgtgattcatcctcattatgtttttttttttccaattattatttgttctacataaattatcttcgatgttacaactttttgggatttattatatataaatatttttttggaaactgtttttctcgttaatacgtttctgttaacttagttggtgcactaaatagagggaaaacagctataacggacggtgctcctttactcatatatatacaatctcttcatttgtttctttcgtctgtttctttcccttcctggttggtactaaagaggtataaacaatctactaaaaatagaaatatggtttatgtacatgtgcttctagaaattatacgtctacttagctatatataaacaccagctactagcagtgagcacggaactctatgaattactttgattcaccggatttcataaaaaataatgcttttacaatcttttgcgggacattcccacatcttttcttctctccctccattcctaattaaggtctctctcttttaatttttttccgttttgacaccatttgggtttacaacccataaccaatcccaacaacgtctctctgtttttattttatttttaatcaaccacacattaattaaaatataatttcatgaccagaatcgttcaaaacattttaagtttcatgtacaaacttaaaaggaaattggccctcaaacttagtcaaattctgttttgaccatcaaatttatacaaatatttatttatggccctcaaatttactcaaattttttattttgggcctcaaatttactcaaatactttttagaccctgcatatttactctagttgcacatcccaaaaactgttcatgctccattattggttgcccaatttgaaagataagagtttacacaagttacttcagaaaataataatttagaaaactgtgttaaacaatccaccttagtattactcaatcgaaaaatagaaaagatcaaaaaaggaaaataagcatagagcaaaccaaactcatctaaaagattagagaaagcaagacattctttaggtgactgcaccatcgaagttagccttgtgcaatcaatttcgaatgtttgagagtcgatccttcttgaaaaaatattcttcataccccaaattaaagctttcagctccaagtaaagaggggaaagacacatgcggagacactttgcaccacgaagtaccgtctctctggctttttacaaactgaattaggttttatttttcctatgtatatttttatagttttccatattgtggctccactagtaacacatgttattaacgttgaatcccactcaatgttgtaatttgatgtgaattatattaaaatatgtggtataaaatgcatattgatgtaatgacggttattgttttccgtttatttcgttttaacgcaatcttcttttaaaatattaacggttatttttgggttgtgtctttttattgtataatttggttaaaatatttacggttattttgtttcgttgtatctttttattgtaactttccgttcatatattgacggttattgttttttttgtgtcattttatcgtaactttttgttgaaatacagacagttatttttttaggttatgtctttttatcaaaatttctgttaaaatattgatggttatttttcccaattgtttcttttcatcgcatcttttcgttgaaatatttaaggttattgttttaacttattttgtttggttatgtattttttattgcaagtttttatttatatattgacggttattttttttcttttactttatcgtaacttttccgtttaaatactaatgattactttttctagttgtacttttgtatcgtaatttttcgtcaaaatattgatgatttattttttccctgttgtatatttttaatcgcatctttttttaaaaatatttacggttatttttccaataattatattgttcaattatagttgtattttttactttatggttgtgtatttatagttgcatctattcatttaatgttacgtctctttactatatttctttcatttttacatcacaatttttgtatattcaaatattgaatatatcatcataataatttaatatataaacacaatcaaatttttgtttttgtaatttaatccataaatacaaaaatttgttgaaaataagttctcccgcgatattgctgggttcattacctagtaactatagtaatatttattaaaagtttatgaattatcttaaataatataagaaagtaatactaacttaaacatatctaaaatttcagcatttttttaaacaaaaaaaaaatcagcattttcatatatgtctacaaataggatttgattttaaccaaaatagaaaacataaattcaaaaattcaaaaatgttacaaatatataagacattataaactattttttatgatatgttattgaataaaattcagataataacaacattttttctcccattattatttttttttttcgtcaacaatttttctcccattattcaaattgatttaagacaaagaaaatattcttcttagaagttgcatgtgtttttttggttaagttttaacttaacaattttacaaaaatataactcaaaaagataagcgaatcataactcatcagacctcaatctcaaacagctaaactcaagttttaaaaaacaaatgatgatgattagtaatatttttcataactcatggtaatgtgtttttgacagttgtagatcaggcccacgtggataaaagcccaaaaaggaataaagacgaaagagataaaacataaacccaaacttgctttcttctctaaaaatatccaaagcatcaaatccttaacctctctgctaattcattcactcctgaagaagaagaaagaagaaataagtaaataaaaattcctcctttttctggtcattgcttgtctaatgccaattcctaaattgggttctcttcatg

SEQ ID NO: 34850 - DNA, 41 bp, Unknown
  misc_feature (1)..( 41): 2750-1469P.txt file - cDNA_ID_3082681; gDNA_ID_2926234; Annot_ID_203785
gaattctcatcttctctcatcacccaaccaaatcaagcatg

SEQ ID NO: 34851 - DNA, 3000 bp, Unknown
  misc_feature (1)..( 3000): 2750-1469P.txt file - cDNA_ID_3082685; gDNA_ID_2926235; Annot_ID_203845
gcaccaggacagaaaacccaaacaacactaattaaggtgatatttagaacactgaattttgctaataatgcgagtgtctgtcgcagccacattcaccggatattgaaactatcttataagcttgcaggtctttgacaagtccattcaagaaactgtatggaattggaacttgaagatcaatacactgactctccggttcgatcctatttagttggctgaacccgtggatggttcttcttttctatagaccacacttttggtcttgtctctctgtagtcatcatgtacacacaaagtccctcgaacccgaaaccgtatttgcatcaatgcttattactgtataatgttatttacaagatagagatagtcatagaaaaattaaaacatcaaaactgatttttaataaagtgtatgttaatagccatgctgtttcttaggaaagccagtttattcacgaatccaccatttttctacttcaaaatttataaatgtatttcactctttttgatatgattctttttgttctatatgcttttttgaatactaaaagctatcagatcgttcgttgtgtaatttttttctataaaaaatatcgttgatttaataaaaaaatatagaaagtaagatataaagatcatgaatatataattttcttgacgaaaaattattttcttgatattcagaaaatctatattgagagagcaatacgtgtccaaaaacgtaattttctcatctgggcttctgaggaaaaaaaatatttgtatcatttgggcttcagtgtctttataaatagtgaaaacacaaaaccctaagagtcgctcttgctctcagccgtctgtcttacctccagaagtcgacgacaacaatggtacgccgcttttacaccattttgcagctttcattgccactttcgtttgtttaggatctgtattagctctttgtttcctcgaatttgagcttctttcgtcaaatctatattggaatctggcttatacttatgtccctgaggattctggctttgtttgatttcgtagtttgtatagtgaatgcatcgatgctatggtgatatgtgactcttgtttctgatgcttatcgccgtttgttgttgattcataggcaccgaagaagggagttaaagtggcttcaaagaagaagccggtatgctctcttagcttttcctttaagcattgtttgtttttctctgagtattattattagtcttggtggagtttctcattagatttgttgttgtgtgtattttaggagaaagttaccaacccattgtttgagagacgcccaaagcaattcggtattggtggcgctttgcctcctaagaaggatctttctcgttacatcaaatggcctaagtcaatccgtcttcaaaggcagaagcgtatccttaagcagaggttgaaggttcctccagctcttaaccagttcaccaagacccttgataagaatctcggttagtctctttttcttatggttattcagaaatctatatgtttgtatgatcagttgcttaatgtgtgtcatgtaattgcagccaccagcctcttcaagattcttctgaagtataggccagaggacaaagccgcaaagaaggaacgccttttgaacaaggctcaagctgaggcagaaggaaagcctgctgaatccaagaagcccattgttgttaagtatggtctcaaccatgtgacttacctcatcgagcagaacaaggcacagcttgtggtcattgcacacgatgttgaccctatcgagttggtggtctggttacctgcactctgcaggaaaatggaagtcccttactgcattgttaagggaaaatctcgtcttggagcggtaaataattcaccactccatggatgtaaacttccattaagagtttttcttactttaatgttttcaccctaatttatgttcatttcctgcttctactctccaggtcgttcaccagaagactgctgctgccttgtgcttgaccactgtcaagaacgaggacaagcttgagttcagcaaaatcctcgaggccatcaaggtaattagctgaatcagcttttgacaatggaatagttttgaaatgatactctcatgtagtcttcaaaccatactcttaacgtgtttttttgttggtgtgaataggctaacttcaacgacaagtacgaggagtacaggaagaagtggggaggtggcataatgggatccaagtctcaagccaagaccaaagctaaggagagggttattgctaaggaggctgcccagagaatgaactaggcatcataccttatgttctctgctatgaaacatatgataatggttttgttgtttagcgatattttgaaaccttgttttattttaatttctatgctctttcggatgttaccaccctcttcagaattttatgcagttttgttatcaatttcacatataaacttttatttgcaaaataaatccttactttattgtggtttttacgttacaaccgatataatctggcctgatgaataatgtgtaaacatcagaggtggatcagctttttgaaatgaacatttagtgatggtattgcccaaacgcggggactattacatgcgtcaaaaatggaatcctgcaaattgagcttttctagagattgatatttgcatatgataggaaattatacagcgaatagaaaatggagagtcgagcataaaaggctggctttaggataatggtagattgggttgtattgtaccaatgaataatgggcttcgaattcacacgcccagtatgacgtcatgtcaaaacgtttttctattttgggatcatttttcaattacgattaaaactccattttattattattccaaataaaatataaaagaaaaataagaaagagagaaaaaataagtgtctcattctacaaatatatataacaacagccttcaatcttccatatctatctctctccctctgctcggcgagaataatcacttaatcagacatcagaagcagcatgatg

SEQ ID NO: 34852 - DNA, 2473 bp, Unknown; identical to SEQ ID NO: 28621
  misc_feature (1)..( 2473): 2750-1469P.txt file - cDNA_ID_3082718; gDNA_ID_2926235; Annot_ID_203849

SEQ ID NO: 34853 - DNA, 3003 bp, Unknown; identical to SEQ ID NO: 28620
  misc_feature (1)..( 3003): 2750-1469P.txt file - cDNA_ID_3082722; gDNA_ID_2926235; Annot_ID_203848

SEQ ID NO: 34854 - DNA, 3000 bp, Unknown
  misc_feature (1)..( 3000): 2750-1469P.txt file - cDNA_ID_3082726; gDNA_ID_2926235; Annot_ID_203847
tctaattatccaagaaacatgtatggattatacagagcaaccaagatgtaacttctggtaccggaatttctatttctcgatcccgtgacagtgacagatagtcccccagtatcaggtcagtaattgatacatcaatttcaatatctttttgtttcaacaagctcttgttttgtctgtgctaacctactttgaatgtgtgtctgcagattctaaactgttctcattcaaaataagccatttagggtattacaaagaaaatatataataatattacaagatttggagttatagtagcttttcctgtagtggtgataggctttctaagttttaggaggtaagaaaaagttgcatctattcttttgcaattttaatttgttgaagttatcttatatttactcaaactcaactctgatgtccttttgttgctctttctcttggcagtgttgtcttttttgtagataagaaagtaaaagttacaaatagagttttgccgtcttgctttgccggaggagctttcttagtcactggtaacttctcgatctgattttcaggtgcagtcttccggcaaagttcttaattaggctttggttcgtgtaagctaaaacaatatgttatgtttttgactggaaattctcgactgagtctatatgtatatatgtatgccgcctctgatttcaagggccttctaaatgtataaactgtgcattgtccatcaaaaatgatggatattatctttaatacaaaaaacatatatgagtgagagaattttactgtcctctgatcagacactatatatatggctattttagttcttttattattttattcttttatttcaaaacctccaaaattcagtaatgtgtttattcaatccaacacaaacattgctgcaattgttatcaccaaaaatctctgcaagagcaagacccgtctctaaaatggtgaaatctattacaatctctcacaacaatttctctactaaaaagcttcgagatcatcttcattacaagatgacaatctccacagattctgaggttcttgatgattctcactggagttccaggccttgtcttcatcaaacagaacgcaatagccagtttctcactgtggtaagacaaagctatctctttatctttctcgttaagatcaagtaaaacctccttagtgtctgtaacatatccagcttctctcagcctctgcattatctcatcgagcatagcatagatcctttcgctctcttgttgagattcgtctcctacaacaaactcgtgaaccactccctctacttcaacatagctacatcccggaactttattaatgccctttacctgtagagagaatctgtatttacttcagaaactgtgcaacagttaagaaaagagttggaaaagagggaaatagttttgcattgcctccatttcgtgtctgatacacttgacttccatccacctccctgttttggcatagacgttagagagaagcacatatgctccactgttcataggatctagctcgatgagtcgcttgagggcaccttcacaagtcttgatatccccaagcattcttgatccgcttaagagagacccccaaataagtacatcaggctccataggcatagatgctataaagctctctgcttctttgatcaaaccagatcttccgtagagatcaaccatacaaccataatgctggattgatggcgtgataccaaattcctcaatcatcattttaaagtaagattttccttcgtttattagacctcgatgtacacaagcaccgagaatgcccacaaatgtcacagagtttgggtttatgttgtcactcgtggtcatctcagagaacagttggaagcactcatctgtgagaccgtacattgctaagcaacatatcatagcactgtaagctttgacatctttcttggatcccaaggcattgaaaacccttttcgccctctcgaggctcccacatttggcgtacatatcaatgagagctgtgcctaagacaatgtcaatctcaacgtggtacttatcgatgtaagcgtgaacccatttcccttgctcgagcgcacccaatcgcccacaagccgagagtacagtcgacattgtaaactcgttgggtctgacgaatgcttcgtttggtttaggtaattgcatctcccggaacaaatcaagcgcttctttgtatttcccacacataacgtagccgttaatcaagcagctccaggaaatcacgtttctttcaggcatttcgtcgaacagtttccgcgcatcatcgatcaacccagctttggcataagcattgaccacagagttccaggccggtaaatccttcgagcccgagtcatcgaaaactcgctgagctgatctcaagtcgccacaggaagaatacatgttgagcagtgaagttcggacaaatgggtctttgtcaagtccaaaaagaagaatctgagcatgagttcgttgcccaagaggaagatgaagcggattgtggaaagaagggagaagaaacggaaaggtatgaaaatcgggagagacgcgatggttgcgcatacggaggtagactgagatcggagaatgtcgttgaggcgacgaaacattgtgaacaatggcacgaatgatgatgttccacaagaaagattcaagctttagatgtcgaatatgaaagatgggatttgcataagctattattgccgcccccttgctcattgtctcaatctaacaagtgtatcagaaatcgattttaaatatcaagtacggttttgacaaaaccgaattgaaccggtatttaaatgaatatttggtttcttaatcaatgtacggacggagaggtaacaaaacaaaagggttttgtcctaattcaattttgcagagatggaggaagaattgctctccgccgtgccgtgctcttccctaaccgtcgagtcagttctccgtgtcgcgacggtaatcactagtatccaattgaaattcatgtttgtgttagtgtgtgtatagatagatg

SEQ ID NO: 34855 - DNA, 3000 bp, Unknown; identical to SEQ ID NO: 28613
  misc_feature (1)..( 3000): 2750-1469P.txt file - cDNA_ID_3082737; gDNA_ID_2926235; Annot_ID_203838

SEQ ID NO: 34856 - DNA, 3003 bp, Unknown; identical to SEQ ID NO: 28612
  misc_feature (1)..( 3003): 2750-1469P.txt file - cDNA_ID_3082745; gDNA_ID_2926235; Annot_ID_203836

SEQ ID NO: 34857 - DNA, 3003 bp, Unknown; identical to SEQ ID NO: 28611
  misc_feature (1)..( 3003): 2750-1469P.txt file - cDNA_ID_3082749; gDNA_ID_2926235; Annot_ID_203835

SEQ ID NO: 34858 - DNA, 3000 bp, Unknown
  misc_feature (1)..( 3000): 2750-1469P.txt file - cDNA_ID_3082761; gDNA_ID_2926235; Annot_ID_142736
cacaaataagatattattttagtgagcctacatatatttgaagagaaaaaatatttttgcaaaccacttaataaataaactattgtgtcatatactcctgtgactcatgtttgattatagataatagtgacaaattatcgtcgtgcattccacaaaggaggcggtgttggagttatacacgtgatttaaatgtaatctccaaaagaaacttcagagtaaaaaaactacgaacgcaataattcaccaaaagaaattatctctgaagtgttttgattcgtttgtctaaaggaaattatcccaattaaaccattgatcactatgtacactccacattacaacgcaacgacgtttcaaacttttcaactaatattctatgcatatgcatatgctataatgttaataagaggaacgtacgtaaaaccaaagagtatagggtgtacaagactaatattctgaaaattacaggtaaaattgtaattgttgaaaaatctttagcacacacaacacaagcatagctaaaggctaaaccaaaagtcacgggaacaaaggtagtaaatatcctaaagttacaaaaactcatatacatgtagtatgtctgtcttaagagagtctacaaggaaatcatatccaaaagtgattgtgatgaatttttatttgttatgctaaagagattatgatgaaataacgtctacaataaatcattaaatactccatacacgactccaccatgaatgggagatcaaaacaattaagtaaactacaaacaaataaaattgaataaaacaaataaacgtgtgtcccctaaacgcaaaattaaaagatacaaaacaatatatcctctcactcactcacgtcgtcgtcgtactaagcttggccgctttgaacggcggatgaagcagcccaaactcgtccttggcatcgagcggcctatccgtctgattgcgcgtgggtttcacgcgccggctcccaagcgatttatgcgtgaaaccatacatttgaaggatctgattgtctccgaaattaaacgctctatccatctgccgtagacaccgttccaccggataatctccaaatttcccgcacggtttacacccgacgaaatgcgtaaccaatggccaccgatggtctccaaaacccggtttatgattctcaatcatctcctcgtaccggtctaccaaaatcccccaataaccgtgcaagtaataaccactctctagataaactttgcctccccatttctctctctccgtcgccagcagataaaccatcgccgattgatcgtcagcttcgaaagcgggtcggtctttaagttcccgggtcaagactttacccgcttcttctcggatcttcccttttgggcccataggagcccaagcgtcaagaagatcaagcgaccactgtgagttcctgagcaagaaacttcccgtgttgagaccaatccaattcttctggtcataaaccatctcgttccaaccatgcatcaccaagttgtaatctttgtacctctcccatggaagctcgaacaccatgtccgtgaacatggcatcactatccatccaccatagaaactcaatctcaggatgtgacaagagtaacttcctaatcaacggaagcttagcccagaatccagccatctcagcatcgagcaacgccatgttgtagaagatctcgattccgtgtattctacagtaatcgattttgttcttaatcgatttcaagaggtaatggtctcctacaggattctcacacggtttaggagctgaacctgtgacaagaagaaccctaggcttgtttggcgccacgaaattagggaagctagggttttgtttgagccaatcacgtctctgctcatcccaatcagagatcttgggaccaagagaataaggtttattagtccggtctcgagatttctcttcgtctccttcatcaacgaatagcttgttgatatcgaaggtctcgtagctgttaccaccatttcctccgtcttcggacgacgtcgttttggaagagacctcgacgaggacacggtgaggctcgccgcgtttacgcgtgtagaagaaatgctcacggatctcctcgatatctttctccggcgtaccaaacttaccggctccgattgtgccacgtaagacgatgacggtgagaacgagacaaagaatcgtcactttcccttgacgcatgaatctctgtaatctccgaaaccgatgcgctcctatacacttctctatcatcttcacgcagatctggtctcgattcgaaatctaaaagagaggatcagagggaaatctaaataaaaatgtcttctttttattgtaatttgtaatgacgacaagattattacgcgttttggaatttctacctcgttaatggaaaggaaggatcaacgaagagatttattagataaagcttcagaaaaagcattcaatgaagatttaaatttggattaaacaagtaaacaaaatatatttatttaataaaaatatttgaatttttggaaatgtcagacagaacatgcctgcctgtctgtctgggacgcgttaaaacttggtgcggcggatcagtgtagtgaaaaaaacactagtggtaaaacactcttcagatataaattgggccttaataatctaagcccatttgtttggttgataacaatctaagcccaattaaaatgtcggcctaaatcacgggtaatttttgttttccgttaacagaaagcggtaagttgttaaacagaaaacgactggcttggagctcacacaactgtccggattaaattagttatgtttccgtttttgtctgttgtaaatttagtgcgccaaccgattatagacgctagatatttttaccgttggagattaattaacggcctttcgtaagtaaaaaaacaaactgtatatgatctgttcttgtttatttttcaattcaggatttagaaagatcattatatctttttaatcaatattctgaattctccctggttaaggaggagggtctccgttaatg

SEQ ID NO: 34859 - DNA, 3000 bp, Unknown; identical to SEQ ID NO: 34858
  misc_feature (1)..( 3000): 2750-1469P.txt file - cDNA_ID_3082761; gDNA_ID_2926235; Annot_ID_203831

SEQ ID NO: 34860 - DNA, 3003 bp, Unknown
  misc_feature (1)..( 3003): 2750-1469P.txt file - cDNA_ID_3082773; gDNA_ID_2926235; Annot_ID_203821
ataaattaaaactgataaaaatcaagagagtcggctttctggagagagttttgagaatttgagagaaccgtcgatgtggcaacatgtgattgggttttcaatttcaacaaaaaaataaatgtgtgcgcgttctgttctatcttctttctcctctctgcccaaacgaaattgaccaaaagatgcaaagcccaatcatcgtttcttctgaaaacttttcgcatttgatatcttttctttgaaactgaaatcaagatacacaaactgaaaccaatttgttcaccaaaagaaaataaaaatgcgtgggtttcgatttcaaagatattcaggaaaagatctccgatagctttcgtctatggcaacactcttttcaattctgggttcgagcttcgtggttttaaaagcttgtaatttcgtgtgatcaagctcctgcgacgccgtttgatgcgattcaactttgaaaatttgatgaaaagcctcttggttatgcttctattgctcaggtattatagattatggtggaaacttaacaattaagtaaacatgattgagttagagtatttaggagcttgtaaagcagaaggtcttggtgatggacccataatgaagctgtatatttatgttgtaattgaggaagataatctggtcataatgctttctagaattagctactcttgccgtagaattattatctcttgacgtggaattgtagcaacattgtcaaactctggttatgtttatactaagacaatatcatttatttgctttcttaggttcacagaggaagtataaagggtaacaagatgaatgttgttgtaaaggtgaacattatcggaagttctagatggggctgaagcctctgctcgagctatgacagaggtcgaccccaaaggaattttcaagtccacgggtctgttttccttttactgatcactctgttttttttcctttaacttatctatggagtaaatgtgaagccatactagtctcatttgagccctctaaaatgcaggctatggtaactatttgtttatgcttgctccgtcaaccaatgaatcattcagacaaatggtcatttccgatgcagtctctgttttgatgccgaggtaactgagattacttatggtaactctatggttcttgatcatggttggattgacactttgaacaagaaatgggatttggttcattgcattgaggttagcttaggtttggcttttaataaagtttctatttgagtggaattgtaaaatagaattgatgtctagtacgtgtttgatgaaattcctctaagagtgaaccttaaatcgtgtgtattaagctttgtttcttgataaacaactaatgatttagagttctcttcacgttattgtgatggaagttttatgttcatacactcaaatgttcttttatgttcgaactctttgctatatatttgttgtaaccaaattttaaccataacacttaaacacataatcacaaattttcaaaactttatctacaagtttaagaagcaaaacactttaaccataagtttaagaaccaaaatacataaccacaagtttaaagaaccaaaaaacacttaaatttttgttcttttttcaaatctattttaaaatgtttgaaaaatgaaaacaatgtatatttaatattttatgatttgcaataattattaagttttagtaaataaaataattttaaaagaatagtttttttcagagaaccccattagagagaatctgtcattggaatatgaaaaactaaaaaaaaaataagcaaaagttctcttgtaatttttgttgaaatttaatcaaaaaaaattgagaaaacctctccatgagctctctccattggagatgctctaaaagcttaataggagccttgccagttgccacaacttatacgactaattcagactctctcgtttcttttaaaaggatgatattgttcctaagcgtagagtagacgttttagtaaatagtaattgaggaagaaacaaaaacacataacgagggtcgctatctttcgcttagaagtacgatttggtccattgtcattgtcacttttgtaatgcctcacgtgatgccatgcacttttgtctctcttatttatttcccctttttttaccgggtgactaaatgatacttcaatacttatttacatagaataaaatcttattaagttcatgggaccgatggaccatttctacgaattaaccgcaaactatcggacgcatttcatatgccgacatggtactatagtagaagaaagaaaaacaattgtaatacaaaattatgtacatcatatacagaactataaaacgcagaaaaaataaataatacaaaattgtttacatcatgtaaatgcagaaaatgtaaagctctctagtacaaacaaattattgatgataatgttaaattcctattggttaactcatgagttagattaatagaaagttagaaacggtaactgtatatatacccaaaataatgaaatatatcaatagaagcagtaatacgattagcggctaacaaaaaaaagaatggtattaatatatatatattttttttgtcggcaatggtattaaaatggaatttattgtactatcattttaaagggcccaaaaatggcctataaaccaaccagacaattgcacacatttgtcggtaagagagcacaataaatcgttttaacaatgggtacgaagaagcctctaggcccaataaaacagacctagtaagataaacaggccatcaatacggcgtcgtttgataatattcaatcggcgttagaccaacttcttctcctctctttcttcccggcggagcgactacgatgtttgcggcggtgagtgtacgagcttctctcaaaactttgttccatggaagacacagctcatcttacagccgatattgtacgttattcgttaatttcttgtatcaatccttgctctttcgagagattttcagatatttgaatatctggaaaatgacacttttcgcaatg

SEQ ID NO: 34861 - DNA, 3003 bp, Unknown
  misc_feature (1)..( 3003): 2750-1469P.txt file - cDNA_ID_3082780; gDNA_ID_2926235; Annot_ID_142726
aagagctactatgaaacgtagtttcgattgattttacaatgagggtagtagaagttcgatacttacttctccatctttcattcctttctcgatatcaactgtcacaaagtatccctcccgttcgtatttgacattagggcatttgtcacagacctgaggggaagaagaggatacgtcgttaaacagtaattaggttggaacaagaccatctgtgacaattgaacatatccgtcctttacctgctctgtcatctgttggaacattccaggaccaatttgtctgtgatagacctcgttcctgcagttacactttctctttccaggagctggttttatcacattcttttccctccatacctgatagttcaatgtggaacattctcactgagaacttaatgcaatttcttttatttgcattaatgtaaaaaaaaaaactgtctactctaaccaaaacatcgcctgaactgaacctaaagaatgtctgaatgacactatgaaatctagtttacaaatttctattgattctagtacatttggatcaaagtaacatttcccagatgagtaacatgtattagtgatgacaataacatcctgacacggagcttaacataccttcatagagcctcccatgtacaaatcttctagagttgcctcaagttccacaattacgtcatcccccttgacaaccttctcttcttcctccatcgaacctccaccaaaaaacctattaaacacatcaataatctctgcaaattagcaatctgcaccctttaaacacaaatgtaaaacattatccaaatttaggaactattcacgctacagagtaaagtcccttctttaaacacaaatgtaaaacgttatccaaatttaggaactattcacgctacagagtaaagtcccttaacattaccaaattcaattgtatccactatcaataaataaaactcacacgaattctatgttaagatgggttcaacaggatagaagatcagacagatcctagtgaccctgtatcttgtacctctagttggatcctaaagagttaccatttgcagaaaacttacgagctgaagatgtcctgcatattcatgccgcctcctcctcctcctcttcctccatttgcagaaaactgtttaagtccctcttcaccatacttgttatatatctccctcttctcctcatccgataacacttcataagctattacatcaaacaccaatacgtcaattctcaaaactaaaaacgggtgagttaacaaagagagcagaatcacacaagttgcaaaacgaaaataccattgttgatctcagcgaatttgcgagtcgcttcctcatttccttgattcttatcgggatgatacttcaaagctagtttcctataagctctcttgatctgttcatcagatgcacctttcgggacttgcaacacatcgtagtaactcttcctaaatccacaacacagattttctaagcattcacattttccacacatttctgaaggaatcgaaagatgttcttacccggcaaggacgcagatggcgtaggaaagagcgaacagtacgatacacagctccgaccaccgaatcgccatggaaacggaaatcggatctctcccaaggattactccaacctgagattcgtttcgattttaacaatgaaacctcacagaatgaacaagaacgaagatcttcttcgctgatttttatgattggaaaactcgaatcactctctctacttgttttcgtggaaacgattccaaaactcgagcctcgtggtcgggttacgtgtacactgcaatgcttaaccaatcaggattaagtctctgacgatcgtaaccaataaatattagccacgtggataaaccaacgtcgaatcgctgactgttcttttcgtcgactttaatgagtacgacgtcgttatactcatataatctatacaaggcgcattaataatgaagcgggcctgtaactcccctacgattgttattcaataaatgtggcctaacccgattaaaaaccctaggttactgggcccatacaaaatcgagattgttttatgtaaaccgatctggggaggccagatccaaactagttttgcatatttatgcattatggattttgtacctaccatattaaacttgttaatataatgacaaaaccgctgctatgagaaaatttatttctttaatctttatataatctagactatcttagtcacacattacgttgtgcattggttaaacactactggagtataaaacaaaaaaaggtggttaagtaataaatacatattttgttgcttattaattacatgcaaagaaacatagactggtttggacaatcatgtcatatgtcaggtctcttgattcttcgcatcttcgacgaaacattatttactagacatacaataataactagacatctcacacgagtggtcccgatcccccactaataccattttactgtccattgaaaaataaagaaacgttgctgacaatagtaaactaaataaaattggtgtttacatattttccacgatacgaagtaaaatattgagaaagtattacgcttatgattttattaattgttagatgattaactgaatccgaattgagcagtatgattagaaacaagtcagaaataataaatgtataactagtatttaaaaaaaaaaaaaatgtataactagtatttaaaaactatagttagcatctaattagagacactaggacgacccagctggacagctggttagtagctctcgacctatgatgagcgcctacgacttttgtttcaacatagacaaacgtggctcgttctatcacctgaatatataacccactcctctctattcttgcatgtcactcctataaatatttaatactaaaccaatcactttttgttgtgtcgtcactttacttctctttaaataatctctttctctagtgattgactttaggaacaagtgaagtgagtgatttttaataatcgccggccgagagaatg

SEQ ID NO: 34862 - DNA, 3003 bp, Unknown; identical to SEQ ID NO: 34861
  misc_feature (1)..( 3003): 2750-1469P.txt file - cDNA_ID_3082780; gDNA_ID_2926235; Annot_ID_203819

SEQ ID NO: 34863 - DNA, 3003 bp, Unknown
  misc_feature (1)..( 3003): 2750-1469P.txt file - cDNA_ID_3082823; gDNA_ID_2926236; Annot_ID_203885
tgttcagcgccgccgtatacttgcggcattggtgaaggttgttgatgatgccgtctcatcgaattacttctcaccgtagatccaaactcggagcgtgtcccgacctcggaaattgattctctatcatcatcttcttcctcttcctccgctgcgtccgaggagctcgtggtgctgtaatgatcgtgatcctcccattcactacactgtacttcctctctctccgtctccgtctcttcctccacctgatttctcattgattcgaactgcttctgcttttgcttcctcgtgtcgaagaaatcatactctgacctcactgtttccgtatcctcgtcgttgaatcgattatcggagttatgtttcttctcttgagccttcctgttgaagaattcggaatcgggaggagaaggagggtagaaattctcccagttccagacggaggaggcatgagaaggagtagcggagtaagtagagttctgataagcactgggatacaaattgggcatgaaattggatctctcacttctcggagaagaagaaggacttgactccgagagaatatgaggcagtctaggttttggttgctgtttccggcgtcgattggaagaggtggacatgactgaaggctgcttagaactggcgacggaaggagacgtcgaaggaggataaacagaagaaggagcaggcgacggcgaaaaacgtggagggacaaatttagccggagattgttcagaaagcggaggagggggagtatggaggaaaacagccggagtttgatcagatacagagagaggctcaccggaggcgaatgaggaaagagcagatccagtgatacgaagcgatcggcagtaatcggcgtgagcggcggcgagatgatgacgagcgtagacagcttctttcatcagacggcggcgatccttacaacgccgtacagcatcttcgttatcgagcttggacgccgcacatcccatggcttatttttctccttcaggtttgttcttcgttacggtggcgcctgagctcacggcggctctgcattattcacaacagaatcatagagaaaagggaaaaagttagatacagctgtttccagactttcccactacactatactacttcactgtactctcaattttctcatatttatcggaaaaacaaaattataaccgacaacaaaaaaaagttaaataatcattttcaaatggtggcattaacctcgattaattttacctttcggtttctttttcagtttgttttttagtaaaaacaaattagaatttaaaaaaaaagagacattttctgacacaattattaacggttaccagaaccaacattacaataatacggttaatcacaatattaaatagttgatcaaaagaaccctagtcattaacgttttaaaaagtcattttttagttactagtagctctttaattaattaaatgaaatattgtgaaataagtaatgcgaagcaaaaaaaaaaaaatgggtcgtggtcctcgtggctcgtggatctgaggcttacgagctaaggtagaagatgaaaaaagcaccgatagagaggaaaacggcaagatggtgaaaagctgaagctgaaaacggtgaaaagttttactttcctctttggaaaaagtctttattagtgaatagaacaaaaggaaaccacatgcattcttccttttttttgagctttctagtttctttaccaatcactttgttccaaaagactcatcatcaccgccctgtcaaaaacaacaccaaaatctagatgctttttattaatcagatattctctggtggagaccctgcttattatataactataagtaccaaagagcatctacgattatgtgtattcatttcacttcactacatgtggcttttttgttttatgagtatattgagttataaagaacaaatgaatagcaatggtttactttgtaagtgcacaaaaatgttgcaatatatattacaactagctaggcaaaacaggaaataaagttattagttggggtcctggtggccgtaaaatgatttgactgagtccaagaagtggaggcctcaccacttaagaaaatgactcattctttgaagtagtcatattttggttgagaaaaatatatcgcatgactcttatatagttttattatatgtacgtaatatatagagtggatcacaacttggttaccagtaccgacagaaataatctccacccatgttttaacttctcttttttttcatgtgtaaagaaattttttgtgtgttttctatctttcatttggcatgttttgtagataaatatagccaaaaagaaagaaagatataagtgttatattgacaatacaagataatctcgtaatgtaatagctccaattgttgaaaagaaaaaacaaaaaatataaagagcagtttgccatatatatcaattggaaactattcagttttaattccattttcatagaattttttataacaatctcaaatccaaaagctggaataaagataagtgaattgggcaagtgaccgtgacgtgacgaccaacatgaacaatttttttttttttcctttacacttccattaaaacgaaaattacaagccttaaaagcccatgacggccacatagcccaataaaaagcaacaaaatacattcatctgaagtatataaacggcttcctgaaaactttgaagtagctaagcaataggacgtgaaacacttatatttgaagattaaactggattgttactttaagtttcaatccaatttcgtaatgaccaagttcgtttttaagtgtagtctcattattcgaacatctcgcagaacatgtttacttgacttgcgcaccagttgttcgtcaaaatgtccacatgaacttctcaaaacaccagtgtttcaatgaacttcatgcttacatcttcaaatgatttttgctgattttagtttcttttatttatttatatactatgagttcgagaaactcttggagtcttagaaagtagagtgaaatg

SEQ ID NO: 34864 - DNA, 3000 bp, Unknown
  misc_feature (1)..( 3000): 2750-1469P.txt file - cDNA_ID_3082827; gDNA_ID_2926236; Annot_ID_203884
gtaattaaaataaggatgaaaaaaaaagatctgagaaaacagatattcctttaccaatgtacatttgaagacgtagaaaattgtagcccctctcagcatctaatggcattagggtagtaagaaatctaaactaaactgcattaggtttcttcttttgactaacattttacctccgtaagaatcctagattaattgtaactcctaatcctagtaatcaggagaagaaaattcacaaaagtcaaaaaacaaatctgactaagttgttaatgtctaaggtcgagctaatcaaagcattgacctctgtttttgtctattgaaaaggttagagggacaaacaaaacaaaaaaaaacaattggcacacgcgtcaaataattcgatcaaaattctcccttaatcgcattatttagcacggtcctattcttagaacgtgaaagaaagaaaactctcagaaaatgtaaaaaatctataataaacaattcaagatagtggtgatccataatgttgggatttttatattttctacgctaatcaggatattccgagattcttgagagcttaacaccgtccattatagcaaaatcaataattaaaaatatgtatgacaagtttatgaccatataaatcttcagaagacaaaagaaccatttagtggacaacaacaatttagccggacgtcttttcgacgacaagtttcttgccttgtttaattctgttttcttattgtttaatgagagcaagatccatgcccgtaccaattacggaagataataaaataagggtgaaatttgtggtaccttgttggatgtgacatcatgcaactggtcaagaagtatccataggcatcaaagtgcatcttcagattgcgaaagcctgtaaaaataaagcttccatggtcctgtagttttctccattgaaatctacagcttctggttttggcattacaactcaaggaaaacataggcatttcactctactttctaagactccaagagtttctcgaactcatagtatataaataaataaaagaaactaaaatcagcaaaaatcatttgaagatgtaagcatgaagttcattgaaacactggtgttttgagaagttcatgtggacattttgacgaacaactggtgcgcaagtcaagtaaacatgttctgcgagatgttcgaataatgagactacacttaaaaacgaacttggtcattacgaaattggattgaaacttaaagtaacaatccagtttaatcttcaaatataagtgtttcacgtcctattgcttagctacttcaaagttttcaggaagccgtttatatacttcagatgaatgtattttgttgctttttattgggctatgtggccgtcatgggcttttaaggcttgtaattttcgttttaatggaagtgtaaaggaaaaaaaaaaaaattgttcatgttggtcgtcacgtcacggtcacttgcccaattcacttatctttattccagcttttggatttgagattgttataaaaaattctatgaaaatggaattaaaactgaatagtttccaattgatatatatggcaaactgctctttatattttttgttttttcttttcaacaattggagctattacattacgagattatcttgtattgtcaatataacacttatatctttctttctttttggctatatttatctacaaaacatgccaaatgaaagatagaaaacacacaaaaaatttctttacacatgaaaaaaaagagaagttaaaacatgggtggagattatttctgtcggtactggtaaccaagttgtgatccactctatatattacgtacatataataaaactatataagagtcatgcgatatatttttctcaaccaaaatatgactacttcaaagaatgagtcattttcttaagtggtgaggcctccacttcttggactcagtcaaatcattttacggccaccaggaccccaactaataactttatttcctgttttgcctagctagttgtaatatatattgcaacatttttgtgcacttacaaagtaaaccattgctattcatttgttctttataactcaatatactcataaaacaaaaaagccacatgtagtgaagtgaaatgaatacacataatcgtagatgctctttggtacttatagttatataataagcagggtctccaccagagaatatctgattaataaaaagcatctagattttggtgttgtttttgacagggcggtgatgatgagtcttttggaacaaagtgattggtaaagaaactagaaagctcaaaaaaaaggaagaatgcatgtggtttccttttgttctattcactaataaagactttttccaaagaggaaagtaaaacttttcaccgttttcagcttcagcttttcaccatcttgccgttttcctctctatcggtgcttttttcatcttctaccttagctcgtaagcctcagatccacgagccacgaggaccacgacccatttttttttttttgcttcgcattacttatttcacaatatttcatttaattaattaaagagctactagtaactaaaaaatgactttttaaaacgttaatgactagggttcttttgatcaactatttaatattgtgattaaccgtattattgtaatgttggttctggtaaccgttaataattgtgtcagaaaatgtctctttttttttaaattctaatttgtttttactaaaaaacaaactgaaaaagaaaccgaaaggtaaaattaatcgaggttaatgccaccatttgaaaatgattatttaacttttttttgttgtcggttataattttgtttttccgataaatatgagaaaattgagagtacagtgaagtagtatagtgtagtgggaaagtctggaaacagctgtatctaactttttcccttttctctatgattctgttgtgaataatgcagagccgccgtgagctcaggcgccaccgtaacgaagaacaaacctgaaggagaaaaataagccatg

SEQ ID NO: 34865 - DNA, 3003 bp, Unknown; identical to SEQ ID NO: 28623
  misc_feature (1)..( 3003): 2750-1469P.txt file - cDNA_ID_3082835; gDNA_ID_2926236; Annot_ID_203882

SEQ ID NO: 34866 - DNA, 3003 bp, Unknown
  misc_feature (1)..( 3003): 2750-1469P.txt file - cDNA_ID_3082848; gDNA_ID_2926236; Annot_ID_203875
ctttgtggtgaccagaatgtacatatgtggatactcgcagtatgaaccgttagtttccaaacccacccacatttacttctttttttctatagagtatcaaaataaacttagaggagtccttaaacttaatctccaagttcaggttttttttcttattttcctgagcttagctaatcacatcacaaattcagcaaatgaggtagatgaaataagagctgagagtgtaaaatataccttaaaccccgtcaaggtgccttgtcaaattccaaggttttgcaaaattgcaaattctgaatttgtactttatgtcttaaatgggctgaagactgacgcccatctctatttgggccgccaacataatgaaatataaatatgtattagaaaaaacaggctttactcttctgtcaaaaaatttaattgcatgcaagacgcgagtctcgactctggcggctttccgttgctgcaaggctgccacgtatcatagtctatgaccttagctggcgcacgagggaatataaccggtcgtgcttgtgccacacgcatagtttgattgtgcgatcggggaagcgaaggtagctgttatgggcccttaagggacaactgaattggagaattgggccttggttttacgtacaggtacaggtacttcttcgttgcttgcgatccaaacaactaaacgaatcggtcatcagaatcaattttctgatctgatttctgaaaatctggagacagctatataaacaaagaacttaccattgggtacaacttttttttcttcgaataaagctttagatatttattttcttatcgatatcttgctccaatatatgcagaggggacatggcattctgtagccaagagtgtaggcaagaacagattgagtctgatgaaacataatccaagaggtggagaaaaacgtcgatttccagatcataatctctccggaaatcgcctgattcgaaatattccgtcgccatcaaaactgtacggacgaagactcttgtcatggcttagtagtttctaaattggatgtggcggttaataaacaaagagagagagacagagaacagagaagccaattgttggttgtgaagtttttgttttctctacctatatttttgattatggtcttttaccacgagaaaatggataaactctgtttgtgtttcttgattcggtttcatgagaagaaaacaatgaaaaatattctgttcttttacaattcaaatggggttcttcttaaatacttgagcccaatatcgccctttgtggcccatttaccaaatcccaaacattgacccgtttgtcgaacgtcccctcggacaacaaatgtccagttcatttgtctgtagctggtgacttaaattagtgacaatcatcggcgagtagcaaccacaattttcagtcgctaaactttttagcgatcagtcgctgaatcaatcgataagtaaacgaataatttaacgatcataaatataaattactaatgattaaaataaaataaaataaattatttaaattaaacttaattaaataaatctgaattaaattcaaataaatcttataaaattaagttaaaataaaataaaatataataaaattaaatgaaatcttatttaattaaatgaaaataattcaaataaatcaaaataagtatagtcaaattaaatttgaaaaaaattaaagtaaataaatgtattaattttcttttgatggtgtataatatatataatttacatttttagtttaaattataaattatcataaaaaataatttaaaatttaaaaaatatagcgatttagagcgacagtcaaacgaacaatacaacaattactagcgacagttgttgttgcaattagttgctgaatccaacgacaaccaaacgaagaatacatattgtcgttggtcgaggatcgttgtcgctggattcaactacatacaaacgaacatgacctaatatttacgagagacatggaaatgtgttgttcaacttctctttttaataggtacaataattaagtaattcagttaatacttcccctccaaaaagtaaaccacctaattgatcacataagagatcacctaactttctactactaagagcaagctttattatatacacaatgaatctagtaattctctcataactaaatacaaaaatcacctaacttttgacaatataatgcgtatatgttcagttcaaaatgtatgattcgacgtatcaacttaaaattgaaatcacacattgtaagtcttttttttttataaaccttataccaatatatttgacaatttttaaaatttttgttactcgtgatgtgatgtctataaatcagtgaagactattttcacactttacattcaataaacaacaaagttttttttgtatccatatttcatgtactaagtctccacaaattatagccaaattcacacgtgttaatattttatcaatgaagttaatttaaatttacatttatttggtttttagtgcggaaaattcagctttttgttattgttttgtcaacgcattatgttttatctcttcaaatgatagtaaaaaataatattttaattaaaattaaaattaaaaatttggcttaaaaaagtttgttgagttttttggggtgaccacctgaaacctctctttgcacattgaccggaaaaaaagttttttgattgagtaacgagataaacttaatgagttgtcgaatttacccctaagacatagcgtaatttactaatcaagtactttaaccagactctttcactaatacaaaatctctatattttttttttctttctttaatttccaatttattttttgattacacatagtttctcttcattcatctctttctctccccgtcttttcttgttcctataatcatgtccgtccaataaaaccctaattttatctttccttgcgtcgtttcactccattacagagttgtagaatttagcttgccaaaaagtgtgaagattagggtttgttctagatg

SEQ ID NO: 34867 - DNA, 3000 bp, Unknown; identical to SEQ ID NO: 14489
  misc_feature (1)..( 3000): 2750-1469P.txt file - cDNA_ID_3082857; gDNA_ID_2684122; Annot_ID_191025

SEQ ID NO: 34868 - DNA, 3000 bp, Unknown; identical to SEQ ID NO: 14489
  misc_feature (1)..( 3000): 2750-1469P.txt file - cDNA_ID_3082857; gDNA_ID_2926236; Annot_ID_203870

SEQ ID NO: 34869 - DNA, 3000 bp, Unknown
  misc_feature (1)..( 3000): 2750-1469P.txt file - cDNA_ID_3082878; gDNA_ID_2926237; Annot_ID_203925
tgattagtagtataaagatagtttgaacgtcaaatattatactacatactgtttagtgctgactcttgtccaccttataaacatctgaagtcaaaaggatgctgaagtcattagagtaaatattgagaggaagaagtcttatcgtcgccccatttcacttatcattgggtgagatcggtcttgaagaaagagagttagagaggaaaaagaagaatcttattagctctataatatctgatattgcttctcatttagtttttcactttttacattaagattggttgtttgtaacattatggagtggttaatagtataaagataatctgaatattataatatataatgtagagtcttgtccacctaataaccatctcttcaaaagcattgttctatgatctgatttttcggaaagactctgcacttctgttgcacttctgttgttggacactttctctttgctaataaaccactaacacaagtccaagcgaccagagaatccatttcttcttgttttattagagcattcataataaggccaagattataaatcatccgaaaagcccaagtgtcctatgtaatttattttccaaagctcatttaattagatctaagcaactaggttcatatatatatagtctcttgtaatgaacatcaaatagttaactttgaaagcaatctcaaaacattgagatttatgttgttaaagagcttattaagatagcaacacgagattgaaattagatagcttattaaagctttaattagctcacacgaaccaatgtgaaatggggtttgttgttgggtccaagtccaacgaaacgattatatttcttggatggtagttttaataatgggcctgaatcatatgggctttttgatgagactgtgacggtaagaaaataaaaaagggcaaaaccgagaaaacagatctctctgtctcaactcaaacaatcaaaagccctagtaaaaccctagcccccaaagcccttgtgccattgagccgttatataaatccttcactcgctccttgagaagacgaatttgagattgcctctgcaaaggtacttcatttcggtgaacccaattcatgttttcgatgatttttgcttctctatttcttcgattttgcgttttatcgcgttaaaagcacatatcgaaggcttgcagataacgtataataaaaaacgcctgcgagctcaatatttgtgcaatatcctaaaaccatccatttgaggtttcgataaatctctgtgttataagaatttatcttttcttatcgacaatttcgatggatgggacatttattaatcggttttatgatttttaacattgtatgagaaaatctgagtcagatctgaataattgaatccttattcgtctgcattgatcggaaaatagtaccacttgggttttatctagtttactttaaggtgctcatagagtggtaatctcacaattgttgttgtttgaacaatttgggacctttgtttgcatgatttagtctcttatataccaattagaatttgggaccatctgctgattcatatctttgtaattgacagagtaaaatggcgaatcctaaagtcttcttcgacatcttgattggtaagatgaaggcagggcgtgttgtaatggagttatttgcagatgtgactccgagaacagctaataatttccgtgctttgtgcactggggagaatggtattgggaaagcagggaaggctttacactacaaaggctcagcctttcaccgtataatcccagggttcatgtgtcaaggtggagatttcactcgtgggaatggaactggaggagaatctatttacgggtctaaatttgaagatgagaacttcaagttgaagcacactggtccagggattttgtctatggctaactctggtcccaacactaatggttctcagttcttcatctgcacagagaagacttcgtggcttgatgggaaacatgttgttttcgggaaagttgttgatggatacaatgtggtcaaggcaatggaggatgttggctctgacatgggaaatccttctgaacgagttgtgattgaagattgtggtgagctcaagaacccaagttcataagttcttaaaacattgggtgggttgatcttgacaggttattctatcatatgctgtgaagcagagacagcatcttagcgttaaggtcaatctagtctgtgatgcactactttggttttgactatatcatatgaaccttaggaagtggtccatccttgtaagttgttttcttaaaactcttgtgtgagaataggatggatgataataatggttagtttctttatgaagacatttggttttgtagctttcttattttggtgtagttaatatgaatgaaccaaactcttcttaggactcatttgcgaatatgtatccaaaattgctgacttttcgaattgggcagatttcacttcatatgcagaacaagataaactttctgatcatgtgatgataaatattgtttagccaacgcatcacacatttctttgagtagtttctacttatggttaagtttcagcatcaatagtcaatagccaacaatatttggacagtcttctttaaatactccaacaactagtttgccttggcaattaatgtaacttaaagtctagccaactctttggtattagcttcgttattttatacatttcttaaaaccattttattcacatttcttgaccacttggattccaacatagtggccagccatgctgcaccacctcgtcaaaattaccacaataatttgatttggtcaaatcatcatttttttggaaaacaacaacaaaaaaacttaaactttgtataataaggaccctggggttaaaagtataattattactatgtaacaaatcaaagtctaagatggaaaatactataatccgttgacttaaatgtgctagaaaaaataaagaggtcgaagccaggttatcatcgaataagacttttgccgcaaccgtgagagatg

SEQ ID NO: 34870 - DNA, 3000 bp, Unknown; identical to SEQ ID NO: 28632
  misc_feature (1)..( 3000): 2750-1469P.txt file - cDNA_ID_3082882; gDNA_ID_2926230; Annot_ID_203621

SEQ ID NO: 34871 - DNA, 3000 bp, Unknown; identical to SEQ ID NO: 28632
  misc_feature (1)..( 3000): 2750-1469P.txt file - cDNA_ID_3082882; gDNA_ID_2926237; Annot_ID_203923

SEQ ID NO: 34872 - DNA, 3003 bp, Unknown
  misc_feature (1)..( 3003): 2750-1469P.txt file - cDNA_ID_3082895; gDNA_ID_2926237; Annot_ID_203918
aatagtgggcgtcttttttggttattcgtatagtagtggtttttgagtcattttcgataactaggtcaagattcaatatccaaactatataaaataagacaatttggttctaatttcctaagtcattgcgtcatgtcggccaacttcgttttattgctttcatgtctcttcttctttcttgacatccatgctctctttttacatcaagagttcacatacgacaaaaaataaggagcaagagctcgaataatttaaaaactagtcgattactgctgcaacaacttaacttgttgtctaatatttggtccttatcaaacagagagttcaattattatttttacaaaaagttagaaggtttggattcgaactcgtcatactgtaaaagaaagtatatgaatttaaccactttattactacaactgttttccctaatatgatgtccctaaatgcttccacagaactttgatgcttaaattctttgctttagaggttttagtccagggccagacctgcttacaagttacacctatgtgtttataactggttatactataccaatcatagttttaggtttcgattagtgtcataaacataatgatgtcgaatgaagtttttggaccatagaaaagatgatagttcataggaattaaaaaaaggaggataaagtaaaattagagaaggaaggccacacctgattacagaacaaatggtacaattctcatcacccaacaaaaatcagagcctagtatgcagatcacgtacgatcagtccaagtacagataaagtggacgcctataaaaacctagggcttcaatcactagcccacaaatctgtggaagaatcttatactgggccttttctttactaaataaaaagtaatttataacgttctggactttatttgagtataggtttctttctgcagttattaaatttactgggttaagagttcatacgtgttatgtgcatttcgctttaaaaagtcttagctcctgagatgatcgacaaatgagttgcggccaatattgggtcattagaaactattgggctataactttgggtccattgggccgaagtagcagctagaagctagtttctgttttctctaaaattaggcctaattcaggttactcaaaaatctagaataaccttatattactgtaaaatttgagaaatctggttgcataattctttatcatagtttctgtagagaacagaagcccacatgttatataaaactaggggttcaatggttacgacttacgatgtacgtggttctcaggcgtgagacccagcaagagcaaaggagatcgaaattattagttattagatgaaatttaaagtaatgagtttcaacttccctttacattgggaggcatttgtctcccgatccattaccaaaaaaaaaaaaaacttccctttacattttatcttaacctccttttgaactgttgtttagttagactcaaaacggtgtaatctatcaattatttttccattataatgactgtactttatccatttaattagtcttttttatttacccaagtggaaataagaaataacctaaaaaattcgattagtgcatggggatacagcaactttgaaaggtccaacaaaactgacctttgttgatcatattgatattccggtcataatattatttggtctttctaaggacatctcaatcatattaattgtgttttttttttggcagtccaaaatttgacttaatgaaaaaactcttgtggaaaaatcatagaggaaaaccccaataattcgaagatttgcattagataaattagaataatgcttttgaccccaagatgcagtatttattgctccaagttttgactcttcaaccaacttatatacgtatgacaatatgaccccaactcccaagttgcccaaagtccatagattctcccccacaaagtaataaagatcgcattaacaaatgaaaagaacaaaagaaaaataacaatcatgttttgtgtgatcgattactattaaaaattaaaaaaagatgaagaaagatttgggttgtataataatggcaaataaagtgaagccaaagagaagacattttttttttttttgtcgcacacccaaagggaacgaagattagagaacgcgtcattcactctctcgtcacgcacctctcacacaacatgactctcctccttggtttagcctaatttgctttgttttatttttcctgattctatttgtattttatttattaaatttgtattttgtaatgtcaaatttttattatgcttctcttttccctttttcacagaagttgatcgtttactgttttatgattttctaaaatttctcacaacatcaatacttttttttaatctcctaatggtatggtatttgcttgataatctttctgcctccattaattttgagtttggctaggatttttgatggaaatagacagcttaattaaaatcatgtaaacaaaataaaaacaggcgaagcaagcaagtggtaaagttgactggtaaaagtctctttcacgtgctcttgaaaagcgcgtgctagttgtgtgtgggtggatcacgcacacgcgtattgaagtgttaccgtcttaatcggtcagaattttgagtcgagaaattaaaagtggtgaattcttcttttaactccccccaactacaaaatttaccatttccacccccaactatttccataatcgaattattagacttcaaacctaataatttaaaacgaacaaacatattttcttaaatgaaaggagaatttaatagcataatcaattgtttgaccaaaaaaagagaagcataatcagctgttttccttgtatacgagtagaagagtcagcacaagagcgacaatggctcacctttgaaagtttggtttcaaccttttgacttttgacctaaaacatatccatattcgtcaagaagaacaaagaaagtattccaaaaaaaatataataaaaaaaaaaagaccaagaaaaataaaatg

SEQ ID NO: 34873 - DNA, 3000 bp, Unknown
  misc_feature (1)..( 3000): 2750-1469P.txt file - cDNA_ID_3082904; gDNA_ID_2926237; Annot_ID_203914
agtagaacctaaaagcccataactatttatcaggccaaaacgtttcaatggtcaggcatttgttattcttttggtcttttgggttggttacaaattaaatagaagtagaaactgggctctagtagggagataaacgaaaagtctatatcaatgaaatgagactaattcgcatccctcatacttattttagagtatatttcttaatattaaaaagtgacagatgatgaaaactcgtaaattttattaagatttaagaggtacatgcaacattagtttgttgaaacatacttgcctctatccataattgtatattgttgaagccgaaccacgcaaatatatctaacacttgaaaattaatgtgagacaaatctaaaggtgagtcggggcatgaattatgttacacttatccgaaatcgttaattgatagtataatattagagataagacaaatatgtcttcttctaatatcacttgatgattgtcgattttgggattagagagagcgacctggccatttaaagttgctagcatgtgctcgtgtgtgtgtggacgtgtgtctcgacttctcctagcaatgagtggttcatattaattaattatgcatttacgatcaaatacaaaacaaaaacattgtgattacgtggatggtttgaatgagtcaagttttcactaattggaatcgtcgagaagattattgcgaaatgatttagagatagactgattaatgattatgaataaagataatcaaaatgagagttgaaccgagtccaatatcaaaccaaaccgagataaagtccggttaaaaaagatgtattttcctattagtcgaaaaggtaaaatgcaaaaatacacgaatgagtaaagaatctgtattttcctattggctctattttccttcttcttcttttttaactcccacactcatgtttctgacgcgtgtgtttcacgtcccattcctgttaacgaatatatattttatatttttgcaaataaaaataaacatataagtgggtttgagactttgagtgacctttgaaactttgagcagcttataaaaaaatgatgaaccaagcttagagtattcattatttactagtatctccaattcatccatatttttttccttaaactctatttttgcctctatttcactctaacacatatctattctcatcactattatagagatttctattttttcctctaaatatagagataaaaaataggggtttatattttttcctctatttttccttctaccaaatagagatctctatttttgaagaaccattgaagtgaaaatagagacaactattaaaaacggtcttatatacactttaattatatatttgctattagtcatggtttttgattaaaaataactaaataattcttgattccgtcttaacatgattcgtcattgatattaggacattacaatgaaattatattatgaaattatgttatcctaattcttatcaatataaaatttttgcataaaatttattttttaattgataatattttatttagtggttggttaacaaagatgttaacgactattgtgagaaattaattccacgaattacgtcctaattttaagtaattaaaggtataaagcaaaaatcaaaatatccatactgatgtacgactttctcacacgacttttacggcgttcgcttacactatatatccagccggtatcttaatcagtgtttatacgggcaagtggcttctcacatcaaagagaaaaagatttgaaaagatgtaactggtaagaatgacgaagaatcagagaatatacgatatgtacactttctcatctataatgtaactcttaacgaatacattcaactaaaaaaactagttataagtctttcagatcatgtaaacacaatctccaaagaaactacataagaagaatcatttgtgaaaggagcaccatccattaatctatgtagtagtggatcttataaactttttttatgttaaatcggttatgtgaaatcaaatagtttttgaaaatattgaatattttgttaaaatgaatatggagaatgagacactagacattggtcttcaaatttttttttttttttttttttttttaaattagaaaagatgtcaacgactttgatatagtttggtcacttttgctatgattaaaaacgttgtccgccagatttaaggaatgatattgtatattacgcccataaataaatcatactaacaaaatcgtcttaaccccacattttcctaattctttttggcatcatctagttggcagcctttgaacattcatttacttttctttacccaaaaataataatatcattccttaaatcttatttcaataacatacaactaaaataaaaatattccaaaatacaacaagtggagcgcgtgaggatcaaaattcataaatgtcattctcaaaaagagacttcatcgaaccatcgccaccatagcttcttcctttcttcacaataacacctctctctctctctctctctctctctctctctctctctctctctctctctctctctctctctctctctctctctctctctctctctctctctctctctaattcattttaaattacaaatttattcatttttgattgctttctttttcttcctcaagtctcttcttcttcttcttcttctaaatctcaccttttttcagattctgaaaattttggtttcattcttctccgagactctcttatggccgagttgactcaggccgatgttgtatactctcctcgttcgtttcaagtgtggaagactttggtgaactggctcgcttttttctatcagatctttcttcagatccttcgtgccgttggttatcatcctcttctctcttcttctgctaaagcctccgctgatggttttaaacctttgccggctattgagttgcttgatagggcttccgaatctcccaccaccgttgaaatcgcagccacgacgacttctgattcctgcagcgatg

SEQ ID NO: 34874 - DNA, 3003 bp, Unknown
  misc_feature (1)..( 3003): 2750-1469P.txt file - cDNA_ID_3082910; gDNA_ID_2926237; Annot_ID_142779
acaatgcaatgagttatgtgcacacctgattgagcttagcatcaagaatcttctcattgacactaggatctgcaacatcagtcaatttgatctacaagaagccaaaattgaacattgaagccacaaacgtaagccatgtagcagacccagatcgagaaactagaaacagaattcaaattaacctgaatgagagcaagtgtgacgaagaggacgacaatccataagagagtcagtgagaccaatctagtcgccgtaattgccattactccttcgtctttgtaatttgggaaatgggtcaatgaatctgcagaaactatcaaagatttaacagagtagcagaaatttagaaaggtaccctcatattatcaaaatctttcaacttaaaacttataaaacaataattttcatgttagacccaaacatttcgacgttaaccaataagcagactacttgcaactttgtcaacgaatcattatttataaattataactttcagaatttgaaatataggtttcgaattttattgtttggtcagagcaagacaaaaacttaatcactcaagaaaagaacttaatgaatagtagtaccagagacattagtaattgagagcaagatcccaatagtgagcaacaccagcatcattgaaaactttcttggcatcggatttggtcaagcactcttgtacatgaaacctatgaaaactcggtttctcaacacttccttgccaaaccaaacaacacttgtttccaccattctcttcttcatcttccttcttctctgcttcttcccagtttatacgcttcagcatcagcttctcgtacctatttattgcttttctcttaccctcaaccacaacaacactcattccatccatcatcacactaaaccctgttaatatgttctgttttgcattcatcctcactttgaatcttgttttcggatccgatagcttcttgttgatcttgtacaccgacacaatcgtctcaacaactgtcgttggatcaccaaaaagcttcctttctttcttctcacgtttctctgcaggagttagcttcctcgctacgttcctatccatgtgagcttgttcacgctcagcagcttctgtgcggatctctttttcaagcttggttgggttttgcgttgcttcagacgcacgaaccttcattaggttgctcattttcacctttgatttttgtggttcaacccttccttgactaatcatctcccgtttctccatttcttttgccacacgccttagagttcgcagtttcttccgttcctcctttgtcattttaagaggttggggaggtggagacgcagcctctgcaggtggctctatgggaaatggatgctcaatatgacaattaaaaactttcatattcagatggttctcagtaatggtgtccatgatgaggatgtttggatcacacgacaactcattaatggtgtcatcggtgaggatctttgcatcccaccactctacaaaatcagggattggctcttcttctcttgtgacacgtttgtattcatatcagcatcctctgccttttttcagatgcgattgcttctccttgaaactcatacgtttaggtggagaggcccatatcttatatataccaagtattaggccggaccgatgtggatcgggttgagtatgtgcggatcggactctgataccatattagactgtgggcttccaacctaaaaccaattggcaataggtggagagacccatatcttatatataccacttaagatcttactcaacttccgatgtgggacattgtccctaatattaaccatcaaagtactatgattgatcggtttagtgacgctaatcacatttccgtgttcatcgatttctcttccaagtgcatccacacgcagaacaaagcccttggtctgtttatgtgccaagtcctgaaatcgcttaacagctacaataatttgaccagaagtagtttccgatgcaatagaacaagtatacggcctattctcaaacctagccacatcttcaaacctagatttcttgtttgttgccctagccgtcccattctcttcttctctatctttcctcttactaccttcgtgagacctctcatgatgatgcttagtcctatctctctcatcacgatcgccccggatgctcttggagtatctctccttcctgttatccatgacgagacaaatttaggggaagtatgaaacgaacgtgagaagaaagaaagaaacacaaaggtattttttttattgatcctatcaatattcctaattcagccaagaataggaaactttataccgttttcctttatcgtaaaacgacacaccacgtttttactcgaaagtcgaaacttattgacagaaaaagatatttcccaaatttaagactttatgtaaacgaatgccctcaaactattcaatgttttattttgaggcttatagttcacaagttagagctcaaaagtcgaatctccgtaccccaatgggcgaacgacgtgaactacactactctgactctcagtgatattttgacgaattattattttctatacaaacaaaatattcagtatatatttattgttatttaacttctttatcatttatttttgtatatcttttttttttttgtcacaatttttatatatcttttccacattaaaatataggcttcgaattaattcctacttttcaaaaagaaaaagaacttatctagttaattaatttaaaagtattaaaaagaagtaaaaaacacttaatgacaaaaaaaaagctgccgacataaagaaaaaatccacgtggataaatgtgtcataacacgtaatgcaaactcatttctgcacatcccaagttttatggaaagtcactattaacaatcaaaccgccaacgagaaaacaaactaaaaaatttcaagtccgatcaaaaagacaaatccctaaacattgcagagatcatttcttcttcttcttcaatcatcaaattacacttgaggaattgttcaaatg

SEQ ID NO: 34875 - DNA, 3003 bp, Unknown; identical to SEQ ID NO: 34874
  misc_feature (1)..( 3003): 2750-1469P.txt file - cDNA_ID_3082910; gDNA_ID_2926237; Annot_ID_203912

SEQ ID NO: 34876 - DNA, 3000 bp, Unknown
  misc_feature (1)..( 3000): 2750-1469P.txt file - cDNA_ID_3082918; gDNA_ID_2926237; Annot_ID_142777
tatttgaagaaagcatcaaggtggagaccattacgatgaagaagagaagaagaagcattgacgatatcttgagcttcttctttcgtggctttgtcttgtttctgaacatcgattaggaatctgaggaggagatcggtagtcatgagacctttgtcggagtaattgtcgaaaagtgttttgatctcagcaggagctacggacacagtgtgtcggtacctccgacggaaacagaaacagactttgtatgtttgcttcgacatttgaacaattcctcaagtgtaatttgatgattgaagaagaagaagaaatgatctctgcaatgtttagggatttgtctttttgatcggacttgaaattttttagtttgttttctcgttggcggtttgattgttaatagtgactttccataaaacttgggatgtgcagaaatgagtttgcattacgtgttatgacacatttatccacgtggattttttctttatgtcggcagctttttttttgtcattaagtgttttttacttctttttaatacttttaaattaattaactagataagttctttttctttttgaaaagtaggaattaattcgaagcctatattttaatgtggaaaagatatataaaaattgtgacaaaaaaaaaaaagatatacaaaaataaatgataaagaagttaaataacaataaatatatactgaatattttgtttgtatagaaaataataattcgtcaaaatatcactgagagtcagagtagtgtagttcacgtcgttcgcccattggggtacggagattcgacttttgagctctaacttgtgaactataagcctcaaaataaaacattgaatagtttgagggcattcgtttacataaagtcttaaatttgggaaatatctttttctgtcaataagtttcgactttcgagtaaaaacgtggtgtgtcgttttacgataaaggaaaacggtataaagtttcctattcttggctgaattaggaatattgataggatcaataaaaaaaatacctttgtgtttctttctttcttctcacgttcgtttcatacttcccctaaatttgtctcgtcatggataacaggaaggagagatactccaagagcatccggggcgatcgtgatgagagagataggactaagcatcatcatgagaggtctcacgaaggtagtaagaggaaagatagagaagaagagaatgggacggctagggcaacaaacaagaaatctaggtttgaagatgtggctaggtttgagaataggccgtatacttgttctattgcatcggaaactacttctggtcaaattattgtagctgttaagcgatttcaggacttggcacataaacagaccaagggctttgttctgcgtgtggatgcacttggaagagaaatcgatgaacacggaaatgtgattagcgtcactaaaccgatcaatcatagtactttgatggttaatattagggacaatgtcccacatcggaagttgagtaagatcttaagtggtatatataagatatgggtctctccacctattgccaattggttttaggttggaagcccacagtctaatatggtatcagagtccgatccgcacatactcaacccgatccacatcggtccggcctaatacttggtatatataagatatgggcctctccacctaaacgtatgagtttcaaggagaagcaatcgcatctgaaaaaaggcagaggatgctgatatgaatacaaacgtgtcacaagagaagaagagccaatccctgattttgtagagtggtgggatgcaaagatcctcaccgatgacaccattaatgagttgtcgtgtgatccaaacatcctcatcatggacaccattactgagaaccatctgaatatgaaagtttttaattgtcatattgagcatccatttcccatagagccacctgcagaggctgcgtctccacctccccaacctcttaaaatgacaaaggaggaacggaagaaactgcgaactctaaggcgtgtggcaaaagaaatggagaaacgggagatgattagtcaaggaagggttgaaccacaaaaatcaaaggtgaaaatgagcaacctaatgaaggttcgtgcgtctgaagcaacgcaaaacccaaccaagcttgaaaaagagatccgcacagaagctgctgagcgtgaacaagctcacatggataggaacgtagcgaggaagctaactcctgcagagaaacgtgagaagaaagaaaggaagctttttggtgatccaacgacagttgttgagacgattgtgtcggtgtacaagatcaacaagaagctatcggatccgaaaacaagattcaaagtgaggatgaatgcaaaacagaacatattaacagggtttagtgtgatgatggatggaatgagtgttgttgtggttgagggtaagagaaaagcaataaataggtacgagaagctgatgctgaagcgtataaactgggaagaagcagagaagaaggaagatgaagaagagaatggtggaaacaagtgttgtttggtttggcaaggaagtgttgagaaaccgagttttcataggtttcatgtacaagagtgcttgaccaaatccgatgccaagaaagttttcaatgatgctggtgttgctcactattgggatcttgctctcaattactaatgtctctggtactactattcattaagttcttttcttgagtgattaagtttttgtcttgctctgaccaaacaataaaattcgaaacctatatttcaaattctgaaagttataatttataaataatgattcgttgacaaagttgcaagtagtctgcttattggttaacgtcgaaatgtttgggtctaacatgaaaattattgttttataagttttaagttgaaagattttgataatatgagggtacctttctaaatttctgctactctgttaaatctttgatagtttctgcagattcattgacccatttcccaaattacaaagacgaaggagtaatg

SEQ ID NO: 34877 - DNA, 3000 bp, Unknown; identical to SEQ ID NO: 34876
  misc_feature (1)..( 3000): 2750-1469P.txt file - cDNA_ID_3082918; gDNA_ID_2926237; Annot_ID_203910

SEQ ID NO: 34878 - DNA, 3000 bp, Unknown; identical to SEQ ID NO: 2978
  misc_feature (1)..( 3000): 2750-1469P.txt file - cDNA_ID_3082954; gDNA_ID_1620619; Annot_ID_162183

SEQ ID NO: 34879 - DNA, 1917 bp, Unknown
  misc_feature (1)..( 1917): 2750-1469P.txt file - cDNA_ID_3082954; gDNA_ID_2926238; Annot_ID_142812
attctccactcgtagctcttcgttctgccagagttgaagttgcttctgagctcatctacaagcaaagctgcttcttttccactaaagtctgatgcttgctcctttaccacagcagatagtgttgcataacaagtactgattcaagacaccaaaaccgcaatgtgagagactttaagactaaaaatcatggataagactaaaaaaacatggataagtatcaactgttctcacgattatttattcataccactgtacttaaacttaaaacccactatactaaatagaaaggtaatcatcaaaaaatcagtatgtaaaaaccacttttgtgaataaaatatgtaaaatgggtgaataaagaaatgtgcttacaatttcaaccgataagggatacaagcattgctgcaatatccaccaccaccacgacgagatatccgaaaaggtgaagttgcaacatttaatctgcaacaaaagaggccattcattaaaatggtactaattagatctaatcatatcatattgaatgaccaaatcattcacagaagcatccattgctccaattaacattctagaccaaattcaacttaaaggtaactcttttatacaggaaaccgagaaaccgaaaacgcaattcacataaaaaggaaggcttgtttggagaagcagaatcgaacaagtcaatctcaaaccctgatgagcaggtttttcaagttacctggcaggagaaaaacccttggcaaaacaaagggtttgaatatgattaatctctagaagcttcgtcatgacttgggttcagttaaaaatctcaaattggagacattattggtgtttatatatttgagagagagagccagagaggagacgttgaattgaatgaagggtgtggtcggaagagaagacgtgtagaagagacgagacaagtaaatttaagcattggccccatttacagccacaagtccgctacaacaaattatttccaagaaactctgagataacgtcgtgatgaaacggctcatgctgctgttgtgattcgtgaattagaggtttatcttttgggtttttgaatgttacttaattggacggtcgatttttcaaactgggtgtgaaatgtgaatgggtcattcataatgggcttttgttttaatgtgaagccattcacacactctttgtccttcttttctattattcataactgtcactctttgttcttcgaaatagtaaagagcaaatcgattctttgttgatctgggccgtaaaatttccatggttgtgggaagtattctcgcagctgatctgggccgtcaatgctacagtttcatgtcagagagaggtcaagaatcaacacgtggccaaccatgattttaaaccaaagcaaacacacgattagaccccacattgtttgttcaccaacccccgtggaccctcctttagccgacgtgtccacgtcaatagtggtttttcttcctttcaaagtacacaaattccattctttctcattttactttttggattacgttgttgttataaactggtaaaatgaattatgaatgcaaataaatttcatttaagttttgttggcttctaatatttttttcacctaaaattctaataaactacacagccatgagccatcgtatgaaaagaagaagaaaaaaaatgtctttttctagaaggatctttcaacgactaaaaaagattttaagcttttgactaattttgtcaataatatacacaaatttacactcaattatagccatcaaatgtgtgctatgcagaaacaccaattatttcatcacacatacgcatacgttacgtttccaactttctctatatatatatatagtaatacacacacataaacagcaaaagcgtgaaagcagcagatcaagataagaaagaagaaagaatcatcaaaaaatg

SEQ ID NO: 34880 - DNA, 3000 bp, Unknown
  misc_feature (1)..( 3000): 2750-1469P.txt file - cDNA_ID_3082954; gDNA_ID_2926207; Annot_ID_141772
cactgttacaagcccatttccctgcaatgatcctcctagcagccaccttcaaccacaacaccacaattagagtatgagacctgaatttaactattttatgctttagaagcagagaaagatcttaacttgtagattaacatctgaatcaacaagagctgggcacttcccaccaagttcgagaaccactggagtaagatttctcgcagccgcagccattataatgcgagcaactcttgctccacctaaagaaatactttaaactatttaaaataatgttttcctgagatcctaatcaacatttcaaagattcttgaaagaaaaggagagaggacaaaccagtgaaaaagatcttgtcccatttttgatccagtagtgccgttgtttcagggactcctccctcgataactctgattgttgtattgtccaagtattcactaaacaactttgctaaaagagaagatgctgctggagcaatttcagaaggttttagcacaaccgcattaccagctgcaatagctccaatgactggctcgacagacaatactaaggaaaaaaacaaagcaccatgaagacatataaactttaatagtttagaaattgagacaaaattgtcaataaataaaattgagcttacagaaagggaaattccaggctgaaataaccaaaacaactccaagcggttctgagactatttgtgcagacgagggaaatgttgtcacagaagttttgacctgaaaggtccaagcatagaaaaagcaagtggttttagaaaggacacatatcaatgaagcagcaaagcttgaacggtctagttaccgtttctggagccatccagttctttaactctttgattgcaagcatacaggatgattttgtattcgaaatctaaaaaacgagaaaaataccaaagagattcaacagtggataagtggaatgcagtgaagaaacgggacattgaaattatataaaaaacctcagctagaaaagcttcaagctcaggcttagaaagatcttgatacaaagcttcggtgatgcatttctccttctcatcaatcatcctagcaatgttttgaagctgagaaattctccactcgtagctcttcgttctgccagagttgaagttgcttctgagctcatctacaagcaaagctgcttcttttccactaaagtctgatgcttgctcctttaccacagcagatagtgttgcataacaagtactgattcaagacaccaaaaccgcaatgtgagagactttaagactaaaaatcatggataagactaaaaaaacatggataagtatcaactgttctcacgattatttattcataccactgtacttaaacttaaaacccactatactaaatagaaaggtaatcatcaaaaaatcagtatgtaaaaaccacttttgtgaataaaatatgtaaaatgggtgaataaagaaatgtgcttacaatttcaaccgataagggatacaagcattgctgcaatatccaccaccaccacgacgagatatccgaaaaggtgaagttgcaacatttaatctgcaacaaaagaggccattcattaaaatggtactaattagatctaatcatatcatattgaatgaccaaatcattcacagaagcatccattgctccaattaacattctagaccaaattcaacttaaaggtaactcttttatacaggaaaccgagaaaccgaaaacgcaattcacataaaaaggaaggcttgtttggagaagcagaatcgaacaagtcaatctcaaaccctgatgagcaggtttttcaagttacctggcaggagaaaaacccttggcaaaacaaagggtttgaatatgattaatctctagaagcttcgtcatgacttgggttcagttaaaaatctcaaattggagacattattggtgtttatatatttgagagagagagccagagaggagacgttgaattgaatgaagggtgtggtcggaagagaagacgtgtagaagagacgagacaagtaaatttaagcattggccccatttacagccacaagtccgctacaacaaattatttccaagaaactctgagataacgtcgtgatgaaacggctcatgctgctgttgtgattcgtgaattagaggtttatcttttgggtttttgaatgttacttaattggacggtcgatttttcaaactgggtgtgaaatgtgaatgggtcattcataatgggcttttgttttaatgtgaagccattcacacactctttgtccttcttttctattattcataactgtcactctttgttcttcgaaatagtaaagagcaaatcgattctttgttgatctgggccgtaaaatttccatggttgtgggaagtattctcgcagctgatctgggccgtcaatgctacagtttcatgtcagagagaggtcaagaatcaacacgtggccaaccatgattttaaaccaaagcaaacacacgattagaccccacattgtttgttcaccaacccccgtggaccctcctttagccgacgtgtccacgtcaatagtggtttttcttcctttcaaagtacacaaattccattctttctcattttactttttggattacgttgttgttataaactggtaaaatgaattatgaatgcaaataaatttcatttaagttttgttggcttctaatatttttttcacctaaaattctaataaactacacagccatgagccatcgtatgaaaagaagaagaaaaaaaatgtctttttctagaaggatctttcaacgactaaaaaagattttaagcttttgactaattttgtcaataatatacacaaatttacactcaattatagccatcaaatgtgtgctatgcagaaacaccaattatttcatcacacatacgcatacgttacgtttccaactttctctatatatatatatagtaatacacacacataaacagcaaaagcgtgaaagcagcagatcaagataagaaagaagaaagaatcatcaaaaaaatg

SEQ ID NO: 34881 - DNA, 3000 bp, Unknown; identical to SEQ ID NO: 34880
  misc_feature (1)..( 3000): 2750-1469P.txt file - cDNA_ID_3082954; gDNA_ID_2926207; Annot_ID_202286

SEQ ID NO: 34882 - DNA, 1917 bp, Unknown; identical to SEQ ID NO: 34879
  misc_feature (1)..( 1917): 2750-1469P.txt file - cDNA_ID_3082954; gDNA_ID_2926238; Annot_ID_203964

SEQ ID NO: 34883 - DNA, 3003 bp, Unknown; identical to SEQ ID NO: 18706
  misc_feature (1)..( 3003): 2750-1469P.txt file - cDNA_ID_3082977; gDNA_ID_1620619; Annot_ID_162184

SEQ ID NO: 34884 - DNA, 3003 bp, Unknown; identical to SEQ ID NO: 18707
  misc_feature (1)..( 3003): 2750-1469P.txt file - cDNA_ID_3082977; gDNA_ID_2926207; Annot_ID_202287

SEQ ID NO: 34885 - DNA, 3003 bp, Unknown; identical to SEQ ID NO: 18706
  misc_feature (1)..( 3003): 2750-1469P.txt file - cDNA_ID_3082977; gDNA_ID_2926238; Annot_ID_203965

SEQ ID NO: 34886 - DNA, 3000 bp, Unknown; identical to SEQ ID NO: 2979
  misc_feature (1)..( 3000): 2750-1469P.txt file - cDNA_ID_3082981; gDNA_ID_2926207; Annot_ID_202285

SEQ ID NO: 34887 - DNA, 3000 bp, Unknown; identical to SEQ ID NO: 2979
  misc_feature (1)..( 3000): 2750-1469P.txt file - cDNA_ID_3082981; gDNA_ID_2926238; Annot_ID_203963

SEQ ID NO: 34888 - DNA, 3003 bp, Unknown
  misc_feature (1)..( 3003): 2750-1469P.txt file - cDNA_ID_3082989; gDNA_ID_2926238; Annot_ID_142805
gttatttcatcatcaatcaaagtcgccattttatttttatttaaagtctcacgtcacggaattatctctctgaattcatcatcttcatcattaccttctttttctcaatctcgattgttttcttccaaattcatgtcgatgatggcgggtatacaaggccagattctcgaggtcactggttcgtacctttctcacatccccaattctattatgttcttcaaccttatctatgatccgttgaaatgttaacttttaaaatttctgggattcttttgatttgtcagttgttgggtgccagaaattgaaagacacggaatggttttcaagacaagatccatacgtcgtccttgagtatggtggcagaagtcaccgtaccagaacctgcacaggttatttttaataccacctcttttattcataatttgttcagatccagaaaaaattgaacaaagttaagatctttcaatgaatttgattgatgggtttgttttttcagatggtggaaagaacgctgttttccaagagaagtttatcttcactttgattgaagggcttagggatcttaaggttgctgtctggaatagcaacactctctccactgatgacttcattggcaatgcaacgtatgtgtcacttcttatcattgccttgttatgctttttaatacccgctttggatttggaattgagtcttttgttgtttggttgttattaggattcaattgcagaaagttctttctcaggaatacgacgactgtacctggactttgcagagtaaaactgggaggtaattacattggctttactagtttttgttccttttccattaagtatcatgtttggtaatctcgattattgcatggttcacatttgtctagctgattttggtgcaactttttgatgtggtttctactatatagtgcttgaatatatagtttcgccagttgctttgctttgctttgctttgttcttgtcatttacttacagtgctgacatggttttgctcactgatcagagtcgttatgtgtgtttttgtgtcctaaattgttaatctgtgtgaactacttgttcgaatgttctgtttctacattgagcacactcacaattgatgtagcattttgattaggtttctctggaacttatgaaagataactagacattttgacataaatggagcttctattgtctgttgttaggttacctcagtaaagagatgtgaagttgcgtttaaacattgtagcatcaaattagaatttcttaaaactggtctcttgaggtattccatttttgtttttgaaaaagagaaagttatgtgttttttaatccatggctatgtgttttgttttcttaaattcctggaaaatcggttacaatgtgccaagattttggtagcttgtcctcagcgattgctccttgtaaaagattacttttttgattaaaagccttgtgaaaaacatcaacctttctgtcttgtagattcgctggagaagtacaactcctactgcattatgcgggagcaaaggtaagtcgagcctcaattagcaacattggttaacatgttccattataaacaaaaggctaaacacacaatccactcttgtatgcagaaacataattacgggtctgcgccatcagcaccgtatgcacctcacgtacctcaatactcagcaccgccttctgcatctccgtattcaacagcaccaccatactctggaccatctctatacccacaagtacaacaataccctcagccatcaggataccctccagcttcagggtatcctcctcagccatctgcctatccacctccctcaacctcgggctaccctccgatcccttcagcttacccacctcctccgccatcctcagcttaccctcctcaaccataccctccgcaaccatcatattacccacaaggtaccttcctttctttcctgttctatgctgcaattgatcgcatttgcttgtctctaactatagtcagtggtggttgatcttttttcttcttgtttccaggtccatatccaggacaatacccacctcctccatactagagcgtttggcgtttagaatttgacgggaagtggtcatgatgtatagattatagttatggtgttttctagaatttggcagacgaatttctttgttttgttttttttatatcatcttccttgtgctattgctagcgtgatggttaatttttgagttggtcagtgaaacttattgagaagtttggatcttttcatgtttaaccagatcgcagattatattgaattattactctaaatccttggttttgtgtgttcatcatcctcttgagttaaaattatgttaaaaacaaaaaaaggttttggttctgtctttaactttaagaaacggaacttatcggcgtataatcatcgcacttgtgatcagatgcaattagaaaaaggttatttggtcaatgtatagcaatatctttaggttctaacaaaaacattattgttgacaaatagcccaaaagtagtagaatttagccgacagattttactgcactttggtttctcgatctctactccaaatgagtaaaaagtgggtaaagcgggaaacagcaaaagaaatcacacatttaataaaaaataaagaaaaagaaattccacattaaataatcacaacaagaaaaacaaataatatattagtaaaagacaaacgtaaaaaccatctctcggccttctctcataaatcaatctctcttcttatcactctccgaaacccacttccagctttttcctctctctttctctctctagtctctcttttgtagctctcccctgctaagctaaccactgcacgtttccatagagaggaaagatgagtctctctccgagagattttctctctatcatcttatcttcttccgtgtaatgctctgagccaaaacccaataactaaatcaacaacaatatagaagagaagagaaagatcttatctttcttctcattcttgagtttagtcccccacaatg

SEQ ID NO: 34889 - DNA, 3003 bp, Unknown; identical to SEQ ID NO: 34888
  misc_feature (1)..( 3003): 2750-1469P.txt file - cDNA_ID_3082989; gDNA_ID_2926206; Annot_ID_141765

SEQ ID NO: 34890 - DNA, 3003 bp, Unknown; identical to SEQ ID NO: 34888
  misc_feature (1)..( 3003): 2750-1469P.txt file - cDNA_ID_3082989; gDNA_ID_2926206; Annot_ID_202245

SEQ ID NO: 34891 - DNA, 3003 bp, Unknown; identical to SEQ ID NO: 34888
  misc_feature (1)..( 3003): 2750-1469P.txt file - cDNA_ID_3082989; gDNA_ID_2926207; Annot_ID_202277

SEQ ID NO: 34892 - DNA, 3003 bp, Unknown; identical to SEQ ID NO: 34888
  misc_feature (1)..( 3003): 2750-1469P.txt file - cDNA_ID_3082989; gDNA_ID_2926238; Annot_ID_203955

SEQ ID NO: 34893 - DNA, 3000 bp, Unknown; identical to SEQ ID NO: 28643
  misc_feature (1)..( 3000): 2750-1469P.txt file - cDNA_ID_3082997; gDNA_ID_2926206; Annot_ID_202242

SEQ ID NO: 34894 - DNA, 3000 bp, Unknown; identical to SEQ ID NO: 28643
  misc_feature (1)..( 3000): 2750-1469P.txt file - cDNA_ID_3082997; gDNA_ID_2926238; Annot_ID_203952

SEQ ID NO: 34895 - DNA, 3000 bp, Unknown
  misc_feature (1)..( 3000): 2750-1469P.txt file - cDNA_ID_3083001; gDNA_ID_2926206; Annot_ID_202241
tatactgtatatataaagcaagcgttatctcccaaacttcactctcttaccttgcctcttgcttcaacctcctaagcacattcttatctctttctgaaacgagttcccaaattagctctacaaaaaccaggatcttgatttctcatcagttaaacatgggaactcctgtcgaagtctctaagctccatttcttgctcttccctttcatggctcatggccatatgataccaactctagacatggctaagctctttgccaccaaaggagctaaatccactatcctcactacacctctcaatgccaagctcttcttcgagaaacccatcaaatcattcaaccaagacaacccgggactcgaagacatcaccatccagatccttaatttcccttgcacagagcttggtttgcctgatggctgtgagaatactgatttcatcttctccacacctgacctaaacgtaggtgacttgagtcaaaagtttttactcgcaatgaaatatttcgaagagccactagaggagctcctcgtgacaatgagaccagactgtcttgtcggtaacatgttcttcccttggtccactaaagttgctgagaagttcggagtaccgagacttgtgttccacggcacaggctacttctctttatgtgcttctcattgcataaggctccctaagaatgtggcaacaagttctgagccctttgtgattcctgatctcccgggagacattttgattacagaggaacaggtcatggagacagaagaagagtctgtaatggggaggtttatgaaggcaataagagactcagagagagatagctttggcgtgttggtgaacagcttctacgagcttgaacaggcttactcagattatttcaagagctttgtggcgaaaagagcgtggcatatcggtccgctttccttaggaaatagaaagttcgaggagaaagcagaaagaggcaaaaaggcaagcattgatgagcatgaatgtttgaaatggctcgactccaagaaatgtgattcagtgatttacatggcctttggaaccatgtctagctttaaaaacgagcagctgatagagattgcagctggtttagatatgtcaggacatgattttgtctgggtggttaacagaaaaggcagccaaggtaccatagacatcactctctttgcagcaaaatcctctgtttttgttttagagaaaaaccaatgatctaattaggattctactgtttcaaactctaacttttgcgtttgcattacatataaatagttgagaaggaagattggttaccagaggggtttgaagagaagaccaagggaaaaggattgataatccgagggtgggcgccacaagtgctgatacttgagcacaaagcaattggcggatttttgacgcattgtggatggaactcgttattagaaggggtggcagcgggcctgccaatggtgacatggcccgtgggagccgagcagttctacaacgagaaattggtgacacaagtgttgaaaacaggagtgagtgtgggagtgaagaagatgatgcaagtagttggagacttcattagcagagagaaagtggagggagcggtgagggaagtgatggttggagaagagaggaggaaacgggccaaggagttagcagaaatggcgaaaaatgcggtgaaagaaggaggatcttcagatctagaggtagataggttgatggaagagcttacgttagttaaactgcaaaaagagaaggtataaagaagttgaatgtattgcaagttatggaacaataatgtttttgtaattctgatggtttgagttacaacagtaaaagattgtatttgttcattcaaatttacaatggatgatcttttagtttgtagtattggtaagtgaatgtgaagttaggttcttgagccatcaggacgcaaacccaacattagttccgtttagatttgttcgttctgttaaaagaaagaacaaaaaccataaaagtctactaagatttggtacacaccaatatcaaatacctaacctttaattctttctaaaaagtaaaataattttaaaagaaatttaaattacaagacattttatttgattagcatcgtcaaactatttctagaagaaacatatctgttgggtgactccatgatattatataacatcacttttatgcttatcgacttcagtttttcttctaacaacttgtcttatttatgtattacaactccattaagagtttttttggtttgttctttcgatcagtcacatcgatatatacggctaaaaattcatctttttaaaagtccaaaaggcgaatggctatatacgttcttctaagtcctgctaaaccggtggaccatataacctcacttttctctattgcaatgacccaaattgatcaagacaagtaacccaatgcattgaccaagtcaagtaacccattgctttgtattgatgttatcggtgtgtatgtgtatgtgttgtgtcatgattaaaaaagtcaggaaaacaaaataattgttataattaatacaataatattaatccggccgtgatttttttttatattggtcaattaaccacactttgttttggattaacttgattgtatatataccttatgttttttctcttctccctttttcttttcataataaattaaacatgatttattaatctggaaattagtttacaagttacaaggttttggttccaaaagaccttgaaaactgacactactctggcacgttaagagagaaagtaccaaagaaaccaaaactagagacgtatgcaacgacgtcagtatccgttacccattaatcatctaaacccaaattttggtgctttatacgttatatatactccacactcttgcaaccattattatatatacaacgaggaaaaatagtactattttctacgaacttcagaatctttcgtctctcttaattatttttctcaaatttctcgaaacatctagttttcttttcaaccagccaatcatg

SEQ ID NO: 34896 - DNA, 3000 bp, Unknown; identical to SEQ ID NO: 34895
  misc_feature (1)..( 3000): 2750-1469P.txt file - cDNA_ID_3083001; gDNA_ID_2926238; Annot_ID_203951

SEQ ID NO: 34897 - DNA, 3003 bp, Unknown; identical to SEQ ID NO: 28901
  misc_feature (1)..( 3003): 2750-1469P.txt file - cDNA_ID_3083009; gDNA_ID_2926206; Annot_ID_202238

SEQ ID NO: 34898 - DNA, 3003 bp, Unknown; identical to SEQ ID NO: 28901
  misc_feature (1)..( 3003): 2750-1469P.txt file - cDNA_ID_3083009; gDNA_ID_2926238; Annot_ID_203948

SEQ ID NO: 34899 - DNA, 3003 bp, Unknown
  misc_feature (1)..( 3003): 2750-1469P.txt file - cDNA_ID_3083017; gDNA_ID_2926206; Annot_ID_202235
aaccagaaacggcttaagcttgagaagaatcttaagttaagaggaatgtctacaaaccaaggttctggtggagatggaaatttacagtttcctgacttgactactgaactctttgtatctacttacgaagctgctgctaaagttgtgcatgatttctccaagccgctaatcaacatgatgaaagcagcaggatgggatcttgatactgcagccaattctattgagcctgatgttgtttacgccaagaggcctcacaaggaatatgcatttgaatcatacatatgccaaaggatgttcagtgggtttcagcagaagaacttctcagtaaactcagagagtgctacggttatggccgatgatgacacagacacctttttccgccagtttcttgctctcaaggacatggatccactagatgctctaggtacaaaccctgattccaactttggtatattctgcaggagcaagtagctcctcttagtccacccaaagatggaagcttctttctttggaaatctagaccagcgtgactacgtgacaggaggtggccacccgaggactgcattttaccaggccttcttaaaacttgcaaagtcgatatggatcttgcacaagcttgcttactcttttgatccagctgcaaagatcttccaagtgaaaaagggtagtgagttctctgattcatacatggaaagtgttgtgaagaacatacattaatatggattcaatctgtgtacaaaacgaaattagagatatggtgtaatccagcttcctcataacatttagcaatatggtttaaagattcggaccaagttccttcgatagaagccaaatccaagagaaaagccgcaacatccaacgcaacttggattggagctttgcctttatgcaaatcttcaaaacgaccttcatcactcactttttcccttatgaattcgatctgctcgtcttcccattgtgctatactagcaacctcctgcatgttttcaagataccatgaccatgaatatgtctctatgctttaaaactcagtacaaccgaaaaagaagaacaaaaaaacttttgtcatacctcatacggacatcctaatgtccaccacggtgatctcaatgctaccctagccgcatcttttgcttctacattccgccctaccctgcgaataagaatctgaagataagtggctacatctttctctacgaaaataaaatggagatatgttttaggtatgtaaagtttacaaacttctgtagtatgtttgcataatatacaaaaggtcgtccaaatcctggaaagaggtctttctttgtgtaaaattctcctgtcaccatagctgaaaccttccatagacaaaaagaagaaaatgtcctgaaaaagtgtcacagaagagagattcatgataatagaatgtcatatcatatgcgtcaaatgtcttacatgatctccttcatcaaaatgccgtaatactttccgctccaacaaatctggaaacagtccaacctagacgatacaaaacaaaagcaaatactgtttattgtggtgtacataaccttttatctataagtcatgagtttttcagtcttgcctttttcaaaacatagacatcgagattgtcaatttcagattcagcaaaagcacccttttcgtaaagtttttcacctgcctctcccgaagcacgatatagttctgtcaactcttgtgcatcttcttcaactagaatccggtgaatgtattcatctacctgaatatcaaaaaatgtaagattgtttcttggtaacacaaaaaagacataaatcctcttaaaaggataagctacgtataaacagaatgagaagtctttacatttctagctataagcctgactccactcctccaaacttccacaaccggcatatccattctgttctcgaatacaaaaaagttaaaaaccaagaataacccaacaacatatttttactactgcaagagttaccaagaaagagatccaaatctcttaccctggtggagcagtaggccatctcaaaagcgcagtaacagagcctacttagacaaaaaaaaaaaccagaaaaacaaaactaaagacaagctcctggaaaaagctaatggattctatcgaaagtgtggtcttacctgacgaattcttcgaaagcggaatagcaagagggatcagtccctgcttagctccaggagatatgattgtctcacctgcagaagatatatgaagcaactgagactttaagaaccataagtttccctttctccattattacaaatccagaataagtgatgaaaagaaacgaatacataagtttggacataaatgaggaacaaaattgagcattattttacctcttgtttgaagcactttgagtaagtgatgaagatgcattggaggttcagtggcagcaacatctttgataaatgatacatgccctacacaacaacgctaatcttaagtcaatcccaatgtgtctctttggaagaattattacacattcttttgttaatttgttgtctccaccaagaataatcaaaaagacagtcatagtcactgcattttcctacaaaagattgttctaaaatactcaacaaagatataagctcaagcattttctcgatttgaaaagccatcaaacaatcgacaattactataattcgacaatcacatgcaattctcacaaacggaggaaaaacgaaattaccagaagagcaacaagagactctagctctgaaatggcgtatagggagagcagtagagggagttatgtgcatcgaaatcgaacccatggcttcttcttatctctctatctttctcttcactctgcttcctcaacctcacagaattttcgtaattcagcagtagcagcaaaagatagccattgattttgtttctgattcagcaaaaaaaaaagaaaaaaaaatgagatgggcttagtctgttacaatttaaggcccaaacccaacaaagactaaagacgcgtaaccgacaaaaaccgtcattaaatg

SEQ ID NO: 34900 - DNA, 3003 bp, Unknown; identical to SEQ ID NO: 34899
  misc_feature (1)..( 3003): 2750-1469P.txt file - cDNA_ID_3083017; gDNA_ID_2926238; Annot_ID_203945

SEQ ID NO: 34901 - DNA, 3003 bp, Unknown
  misc_feature (1)..( 3003): 2750-1469P.txt file - cDNA_ID_3083025; gDNA_ID_2926238; Annot_ID_142797
ttctgaagtcttcaaaagacattcctttttcagaaccatcatcagattttgagaaagtagcggcatcgagtagcgcatctaccatctccttgtaatcacttgattccgcatcagaactctcagtggagaacacactcttcaaaatcaccaccaggaacgactctaaatcagacctgaagacatactagaatgtgtcacattcagagaataaccccatctaatctaacaatctcaattcattttctatccaaatatgttaagtggatcaagagaccagtaatggacatacaacaaaacaggtaatgaaacttggataacagaagcaacttgaagccacaagatggataccttctcaagaccccattgccattaacatccaaagtctggtaaataaactcagcaatctcatcatcagttcctttctcgtatgttgcctaaaaagcaacaggaattgagttgaacacaatcgaatctctcaaattctatatcgagtcctagaactgctaatcctattgaactctgcattttaagatcttcaaaagctcagaagaagaaaccaaatgattaagaggataaaaagacttgagtataccttagcaataacaagatcttcaaaagtcattttatcatctttcctgtgttgagtaaccatatcaaagatcctttctcctaaagaaccactcagaccaaaatactcctgtgaaaatcgaaatccgacacacatcgtgtaaggcttaattcaaaattatcaaccacaaaaaccagatgacaacagaacacaattttttttttgtcaaaacctggaaaacagggtacgagacgtattggtcattgctctgagacttggaagcgagggaaaaaaagagagatttgagatcagcgagcttcttctgagtaaaagctctgcaataaaacacaaacacacaattgataagatcgattttcaatttagaaattagagagtgaaagtgagattggttccgatgaagacctggaagcagaagtgaagcaatgatcaacagaagacgaattcgaatttccctttttcgccgggtttttttctcccctcagttctccggcaggtttcgtcgtctctgttcttctattatttttgattgatcttccacttcttcaaaattacaacttcaaccccttaaaatcgaaatattcttaatgtactccattacttttaatgcgttgatctcgaagcagcagagtaaaatataaaagttgtgagttgaaatcacacaaagaacagaaaataaaggggggcaaacacgaagagctcacaactagattcatgcttttagatttccactggtgagtctaatctgtttaattattgcaattcgttcttgttcttgtcgaatatacagttctgttttagtatctttttttatgtgttcatgtctgttttgactttgttgccgagaaattttactgaaactagtaaagctaagctctctgaatcgtttttcatgtttaattgaagcagtagattgttcttcttcctctattggatgccatggaagtagaaatcttcaggattcttcttggctttgattctgagattttgcaatttgaaagtttaatcaaaggctactgtgatttttttggatatttttctatgatttatgattttgagttgtggtgttttctcttttttccgttgttgagatgttgataaattttctgtccagaattgttgcctcacactatttgctgattcggtttggtttgtattggttttgaaattaaaactgatttcggttcggtttcattggttttgttgaaaataactaaaagagtcacgcgatggagaatttggagagatgtgcgtcgattaaaaaagtcatgaattggaaaggggtttacccacagaatcgccctcactcgctcaacgcgctctttctgcgagtgggtacgaaatatagccttctgattggcttaaaaactcaaaaaaagtgcaatagtatacttgttgctagctcttattatttgataaagttttgtacttgcatcttttttttcagtcaccgaaagttggaatttcctttgtgataagatctaaacaaatatcaaagtctacaaatgctggattaagcaagttaaagcctttgtgattcccttgtattttcaacaacctcgtcttcaaaactttatccaaagacatatgtggatagccatagcaagccacagttacattatacaggaaaggtaccaccttaaggctctgcattccaaagaaaatgtcatagtcactttgtttgatatgtttgttctgtggattgttaacattggtttatgcttgagtgaggtcccagacaggaaatcaaactcacattatgcatgtagctagtgtcgttctgttgaccctataaagcctttacttttactgtagttagcttatagttgcattctttaggttagttctctgctttacacactttgcaacctagtagaacttttctcttatgacacccatggtcaatacattggttgacaataatgaaagtggagctgctataacatcttttctttttatcaagtgattttatgttcggtaatagcttactgtttcattaactctgacaaactgtttattattgcactgtctgaacacttaaagatgaacaacggaccataatttcactttcacatatatctgcagaacctcattgacctggcaggttctgaaagctcaaaggctgaaaccagtggtttaaggcgcaaggaaaggtcttatataaataaagctttgctgactttagggactatgagttcttggttatcattgttttcccccaagcgacaatagtttttcgaatttaagaaccttttttgcaagttggatcgttcttttgcaaatttgtaggtacttgttatagtatttgatactcttatttactttctgttggtgacatgcataatgctgatttcactgtctcttatatttttatgatccaaacatgaaacacatacataatccatcctcaaccaatg

SEQ ID NO: 34902 - DNA, 3003 bp, Unknown; identical to SEQ ID NO: 34901
  misc_feature (1)..( 3003): 2750-1469P.txt file - cDNA_ID_3083025; gDNA_ID_2926206; Annot_ID_141757

SEQ ID NO: 34903 - DNA, 3003 bp, Unknown; identical to SEQ ID NO: 34901
  misc_feature (1)..( 3003): 2750-1469P.txt file - cDNA_ID_3083025; gDNA_ID_2926206; Annot_ID_202233

SEQ ID NO: 34904 - DNA, 3003 bp, Unknown; identical to SEQ ID NO: 34901
  misc_feature (1)..( 3003): 2750-1469P.txt file - cDNA_ID_3083025; gDNA_ID_2926238; Annot_ID_203943

SEQ ID NO: 34905 - DNA, 3000 bp, Unknown
  misc_feature (1)..( 3000): 2750-1469P.txt file - cDNA_ID_3083029; gDNA_ID_2926206; Annot_ID_202232
cgaatctttaaaccatattgctaaatgttatgaggaagctggattacaccatatctctaatttcgttttgtacacagattgaatccatattaatgtatgttcttcacaacactttccatgtatgaatcagagaactcactaccctttttcacttggaagatctttgcagctggatcaaaagagtaagcaagcttgtgcaagatccatatcgactttgcaagttttaagaaggcctggtaaaatgcagtcctcgggtggccacctcctgtcacgtagtcacgctggtctagatttccaaagaaagaagcttccatctttgggtggactaagaggagctacttgctcctgcagaatataccaaagttggaatcagggtttgtacctagagcatctagtggatccatgtccttgagagcaagaaactggcggaaaaaggtgtctgtgtcatcatcggccataaccgtagcactctctgagtttactgagaagttcttctgctgaaacccactgaacatcctttggcatatgtatgattcaaatgcatattccttgtgaggcctcttggcgtaaacaacatcaggctcaatagaattggctgcagtatcaagatcccatcctgctgctttcatcatgttgattagcggcttggagaaatcatgcacaactttagcagcagcttcgtaagtagatacaaagagttcagtagtcaagtcaggaaactgtaaatttccatctccaccagaaccttggtttgtagacattcctcttaacttaagattcttctcaagcttaagccgtttctggtttgcttcctcaatcttctgcagcatctgcgtgatctcggaatccttgttctgaatctcagactgaaacttcttcaccatgacctcataagtcttcaacaaactctgctgctcttgaatctctgcagctaaacgagagtcttgtggagagacacatacaggcttggggttattctctctgtaaaaatgcttcatttcggaaagattcttgagttcagaaatgacaactttgtccgctgcctgaatcttctcgggatcgtaaggagtatgagcactttgaagctcgatataagcagatttcaaagacgagatgtttccaaagagattggagataagtgcttccatagcttcaggattttgattgatagactcttccattggttgaggatggattatgtatgtgtttcatgtttggatcataaaaatataagagacagtgaaatcagcattatgcatgtcaccaacagaaagtaaataagagtatcaaatactataacaagtacctacaaatttgcaaaagaacgatccaacttgcaaaaaaggttcttaaattcgaaaaactattgtcgcttgggggaaaacaatgataaccaagaactcatagtccctaaagtcagcaaagctttatttatataagacctttccttgcgccttaaaccactggtttcagcctttgagctttcagaacctgccaggtcaatgaggttctgcagatatatgtgaaagtgaaattatggtccgttgttcatctttaagtgttcagacagtgcaataataaacagtttgtcagagttaatgaaacagtaagctattaccgaacataaaatcacttgataaaaagaaaagatgttatagcagctccactttcattattgtcaaccaatgtattgaccatgggtgtcataagagaaaagttctactaggttgcaaagtgtgtaaagcagagaactaacctaaagaatgcaactataagctaactacagtaaaagtaaaggctttatagggtcaacagaacgacactagctacatgcataatgtgagtttgatttcctgtctgggacctcactcaagcataaaccaatgttaacaatccacagaacaaacatatcaaacaaagtgactatgacattttctttggaatgcagagccttaaggtggtacctttcctgtataatgtaactgtggcttgctatggctatccacatatgtctttggataaagttttgaagacgaggttgttgaaaatacaagggaatcacaaaggctttaacttgcttaatccagcatttgtagactttgatatttgtttagatcttatcacaaaggaaattccaactttcggtgactgaaaaaaaagatgcaagtacaaaactttatcaaataataagagctagcaacaagtatactattgcactttttttgagtttttaagccaatcagaaggctatatttcgtacccactcgcagaaagagcgcgttgagcgagtgagggcgattctgtgggtaaacccctttccaattcatgacttttttaatcgacgcacatctctccaaattctccatcgcgtgactcttttagttattttcaacaaaaccaatgaaaccgaaccgaaatcagttttaatttcaaaaccaatacaaaccaaaccgaatcagcaaatagtgtgaggcaacaattctggacagaaaatttatcaacatctcaacaacggaaaaaagagaaaacaccacaactcaaaatcataaatcatagaaaaatatccaaaaaaatcacagtagcctttgattaaactttcaaattgcaaaatctcagaatcaaagccaagaagaatcctgaagatttctacttccatggcatccaatagaggaagaagaacaatctactgcttcaattaaacatgaaaaacgattcagagagcttagctttactagtttcagtaaaatttctcggcaacaaagtcaaaacagacatgaacacataaaaaaagatactaaaacagaactgtatattcgacaagaacaagaacgaattgcaataattaaacagattagactcaccagtggaaatctaaaagcatgaatctagttgtgagctcttcgtgtttgcccccctttattttctgttctttgtgtgatttcaactcacaacttttatattttactctgctgcttcgagatcaacgcattaaaagtaatg

SEQ ID NO: 34906 - DNA, 3000 bp, Unknown; identical to SEQ ID NO: 34905
  misc_feature (1)..( 3000): 2750-1469P.txt file - cDNA_ID_3083029; gDNA_ID_2926238; Annot_ID_203942

SEQ ID NO: 34907 - DNA, 3003 bp, Unknown; identical to SEQ ID NO: 28635
  misc_feature (1)..( 3003): 2750-1469P.txt file - cDNA_ID_3083036; gDNA_ID_2926206; Annot_ID_202230

SEQ ID NO: 34908 - DNA, 3003 bp, Unknown; identical to SEQ ID NO: 28635
  misc_feature (1)..( 3003): 2750-1469P.txt file - cDNA_ID_3083036; gDNA_ID_2926238; Annot_ID_203940

SEQ ID NO: 34909 - DNA, 3000 bp, Unknown; identical to SEQ ID NO: 28633
  misc_feature (1)..( 3000): 2750-1469P.txt file - cDNA_ID_3083040; gDNA_ID_2926206; Annot_ID_202228

SEQ ID NO: 34910 - DNA, 3000 bp, Unknown; identical to SEQ ID NO: 28633
  misc_feature (1)..( 3000): 2750-1469P.txt file - cDNA_ID_3083040; gDNA_ID_2926238; Annot_ID_203938

SEQ ID NO: 34911 - DNA, 1318 bp, Unknown
  misc_feature (1)..( 1318): 2750-1469P.txt file - cDNA_ID_3083044; gDNA_ID_1620634; Annot_ID_162834
ttccatcagatgacataaccgattcgttgtagaaaaccctaccaaaattctccttgtcagggaaaacctcagcctgttttggaaggtaagcaccaccactatcaacaagatatatgcaaggaagtctgcaccgagcagcaatctcttgtgctctgagatgtttcttgatagtaatgggataatacgtccctcctttaactgtaggatcatttgccataaacatacaaatacgtccatggattggtcctatccctgtgattatcccacctgaaggcaaaggctcctcatacaattcatgtcctgcaagctgcaaacatattcatatccagtaagcagcaacatcaaacaagtttttaatcaatgccaattccctaatcttcttttgttttcctaacttatgcaagtactaatcaacaataaactctagattgcaaatgtgcattaaatccaaacaaagaaacaaaacaaaacctgagagagctccaaaaaggaagaaccaggatcaagtagccgatcaatcctttctctaggcaaaagcttgtttctgcttctgttcctcttaaccgcttcctctccacctccggccaatacctacaaatctccaccgagatacacttatatcattcatctgcaaacaattaagacatcaatcgataaatgagatggctttacctttttgatatgggaacgaagctccgataagatcccttccatggcgatcgaattgctagaaaaagcctccgaatttctgtcgactccgtccggtaaaatgcccacgcagaaacccttttgtagtccccggaaagttcgaaaaggatcgggacgagaatcggttcctggtcggatccgccattgttgaatactagtaagctctttcgaagctgaaacaactcttctccccaaaatccttaacattttcgtctcactgtctctcgaaaccgatttcacttaaaagacatatttatacacactgttgtgactgactacttgattgtctgtaattcatatctcaaaccaaagagaaaagaggagataagctcaaggaaacaaaaatactatttttataaatcgttttcaaaattcgtctcatttctttagagaatcgtgtgtgacaatctcacagtggaaagcaaaaaaaatgttacattttcgacaaaaattggaggaaaaaattgaagctttatccaatcaagcaataagacaacgatacgacgacgtttttagctttcttcaagaagtgtatactagtagataagacgcaactcactctccgtctagcggcgggattatcagactgctgcattagctatcgtcaatg

SEQ ID NO: 34912 - DNA, 3000 bp, Unknown
  misc_feature (1)..( 3000): 2750-1469P.txt file - cDNA_ID_3083044; gDNA_ID_2926206; Annot_ID_202226
gagagacaaagtcccaaaacctttctggtatcacaaggatcaatcactccatcatcccaaagtctcgccgtcgagtagtaaggatttgcctctctctcatacgcatccaccgttttcttcttgaacgcttcttcctcttcctcagtccactgcatcacaaagaaaaacgcaaattcatcaatgttgaacaaacagagttgaaatcggtttagagaatgttttattcagtaccttgattccttgtctcttcttggtagccctttcaatctgagttaaaacacctgcagcctgcaaagttttcgccaagccaataacaacgtcaaacaaaaccaaactgaattttgttctgctacactaagattataaacacattttgattcagtttggtttcggtttaaacatttcggtgcattctggtttacctgagcgcctcccatgatgccaattctggcgtttggccaaatgaacataaaatctggactgtatgcacgcccacacattgcatagtttccagcaccaaagcttgcacccgttatgattgtaatctttggtacctgaatgaagacccgagcttagaatctggcttatcctaatcaaatctctcagactcttaaccaagaattaaacataccttagcacaggatactgccatcaccattttcgctccagcttttgcaatgccgttggcctcagctctagaacccacctataagcaaaaacggagcaagtaagatagatagagacactcttatatagccaaatgtgagaacacaacacaaacactacaattaccataaagcctgtgatgttttggaggaaaacaagaggaattttacgttgagaacataattcgatgaagtgagctccttttagtgcagattcattgaacagtatgccattgttcccgataatacccaccgtctgaccataaattctagcaaaaccagtcacaagcgtctgccaaaaagaagttccacataagaaagtaaaaaggtaacatttggatacaaaataaggcgaataacattatctcacagtgccgtattgtttcttgaactcgtcaaattcacttccatcaacaatccgggcaataatagaccgcacatcaaattgctgtttgtgatctactggagcaatggagcgaagctcgtttatgtcatagagcggttccttgtatacaagatttttgcttccaaatgttccttccatcccttgttttgcagccatgtgcaaattcttgacaatgtttcttccaatagcgaggccatgtagctcgtctgcaagcttagagcatcttaaggtctaaactctaaaacacgattattgttttcatattaaattgcagaaagagatgaatatatgtaccttgagcaaaataatctgacacaccggacacagtacagtgaacagtggcgcctcctaaatcctcagctgaaacttcttctcctgtagcagcctgttcaaaagctttttcatttagcgttagattctcaagaaactacttaagactagaacgagagagagagagagagaaagtaacttgagaaaattgaccttgacaagtggcggtcctgctaaaaatatggtaccattccctttgaccattacactttcatcagccatggcaggaatgtaggcaccaccagcagtgcaggagcctaaaacaatggcgatttgtggaattccatcagatgacataaccgattcgttgtagaaaaccctaccaaaattctccttgtcagggaaaacctcagcctgttttggaaggtaagcaccaccactatcaacaagatatatgcaaggaagtctgcaccgagcagcaatctcttgtgctctgagatgtttcttgatagtaatgggataatacgtccctcctttaactgtaggatcatttgccataaacatacaaatacgtccatggattggtcctatccctgtgattatcccacctgaaggcaaaggctcctcatacaattcatgtcctgcaagctgcaaacatattcatatccagtaagcagcaacatcaaacaagtttttaatcaatgccaattccctaatcttcttttgttttcctaacttatgcaagtactaatcaacaataaactctagattgcaaatgtgcattaaatccaaacaaagaaacaaaacaaaacctgagagagctccaaaaaggaagaaccaggatcaagtagccgatcaatcctttctctaggcaaaagcttgtttctgcttctgttcctcttaaccgcttcctctccacctccggccaatacctacaaatctccaccgagatacacttatatcattcatctgcaaacaattaagacatcaatcgataaatgagatggctttacctttttgatatgggaacgaagctccgataagatcccttccatggcgatcgaattgctagaaaaagcctccgaatttctgtcgactccgtccggtaaaatgcccacgcagaaacccttttgtagtccccggaaagttcgaaaaggatcgggacgagaatcggttcctggtcggatccgccattgttgaatactagtaagctctttcgaagctgaaacaactcttctccccaaaatccttaacattttcgtctcactgtctctcgaaaccgatttcacttaaaagacatatttatacacactgttgtgactgactacttgattgtctgtaattcatatctcaaaccaaagagaaaagaggagataagctcaaggaaacaaaaatactatttttataaatcgttttcaaaattcgtctcatttctttagagaatcgtgtgtgacaatctcacagtggaaagcaaaaaaaatgttacattttcgacaaaaattggaggaaaaaattgaagctttatccaatcaagcaataagacaacgatacgacgacgtttttagctttcttcaagaagtgtatactagtagataagacgcaactcactctccgtctagcggcgggattatcagactgctgcattagctatcgtcaatg

SEQ ID NO: 34913 - DNA, 3000 bp, Unknown; identical to SEQ ID NO: 34912
  misc_feature (1)..( 3000): 2750-1469P.txt file - cDNA_ID_3083044; gDNA_ID_2926238; Annot_ID_203936

SEQ ID NO: 34914 - DNA, 3000 bp, Unknown; identical to SEQ ID NO: 9651
  misc_feature (1)..( 3000): 2750-1469P.txt file - cDNA_ID_3083090; gDNA_ID_1972165; Annot_ID_179728

SEQ ID NO: 34915 - DNA, 1599 bp, Unknown
  misc_feature (1)..( 1599): 2750-1469P.txt file - cDNA_ID_3083090; gDNA_ID_2926239; Annot_ID_142846
agaggatcggatattcggattgtgaggtggacgaaggattcgattcatgtgggttccacttatcttgtgttatgacacgtggctttgctcttacggacctaaacaaaaagataagcattaagccattaagcataggccagttttgttttgttaatggcaggtcaaagataataaagagttgggcctgatgtaaatttttgttttaagcaaacccaaaggaaattggccatataaagtataaaccaaactaaaccgaagaaattgaccagcttcctacaagtaggtgttggataagtttcttgctctagaattaaaaacaagtacattgtagaattgatgaatgcaatcctagaaaaaagtcaaagaatgttggcttttgatcgatgaaatgcatgtactacaccactaggaaatttattattctggctgatgtgctctgcatcaaaacattagttattcgtttacgttagaagttagataaccagctagtggcagatgttaatctgactttttttatttattactgatttataattagacttgtcagatataatgtatttaggatgaatttcttgagtttccaagttactagttcaaccgaaactataccaatttgtataattttgaagtacaacaagtcatagagctcgtgtgtaaaaacaataatagtaacgcgttgagacaaatacggacgtgaagacatgtattgtaagcacgtcgctttgtttccaagtaacaccctcacccgaaaagtctaataatataatgaaaaagataatccaactaaatcttttacaatatatctaaaacttttgattacgtttgaccaaacattaaaagattaattaagtagtatcatgtagacgatttcaaagaatctgagcaaaagtctcctgtgaccaaaatactaataagctctgaatagtaaaaaaaagtaaataaaaaaaagtttgaaaatacataatgactcatgttaatatcatttaaagtattttaatctggattaaaaagctctagttcattgaatcgttgattaaccatagcagcaactcgacaatatataaatcatctttcgtatgcaaatttttgtcaacctttgaacacactagaattaggtttattttattaacaaaatgagaattttttggaatcccacgtccaagttgatgacttttttgtgatttccacaaaatatgcatataaatatcaattagattacaaagacattaaaatagaaaaattacagaacacaagaatttttttttgcaattactatacaaaatgtaatctttactgttgacaaaagaaaatacaattcttactattatagtaacaccatagatagagaatgtcataaagcaaaaaaattaaatagtaaatacaaatcattcttttttcaaatatttttaacaaatcattcttgtatatatgtacacacacaccccacaacatcccttcaacatatacgcgtcctatttccacgttctctctatattacatttttccttgaaaacatctcgaggttcaaaatctttaacccctacaaatcaagaaaaggagacagaggagaagagagaaaagaaaaacgcagaaacaatg

SEQ ID NO: 34916 - DNA, 1599 bp, Unknown; identical to SEQ ID NO: 34915
  misc_feature (1)..( 1599): 2750-1469P.txt file - cDNA_ID_3083090; gDNA_ID_2926239; Annot_ID_204017

SEQ ID NO: 34917 - DNA, 3003 bp, Unknown
  misc_feature (1)..( 3003): 2750-1469P.txt file - cDNA_ID_3083093; gDNA_ID_2926239; Annot_ID_142845
tggcttttagggatttcacaatttgacaaaggataacatgactaaaaacagaaacataaccattttaggttaacatcaaacgttcgcttagctatacaatcaactgcccaattgggacgatgacttttttctgtttattctagtcataaattcatcccaaatcagaatttattagtgtacgtgtttttttggtttgtctataattatgaaaccgcctacaaagatcttaatctcaccgtctaaattttagttaacaatccaaacctatatatacaaaaagagatagttagggggtgaagtttgaacaaacagaaacaataggggtgaaaaatgggaagaaaatgaaaatgagaatgagaaaggaggtgggaaagagggaacgtggagtatgtcggtaaggaatgtggtcaaaggcacataccatgtgggctcacatgtttcactatactttgtcatccaaaatctctctgtctctttcacgttttttcggtgctcgtacaatttttagttagtccctaaaatccatctagccaaatgtgtattctcggatattttgactaccttcatgatataaaagtaatccgattctaatttagaagttctaaccgtttcgtatgttactaattgaatttgaaatgaagtcgtaaccgataccgatgtttattaatgtatgtgtgacaacttcaaaatacaacatgctaattgaatatattcaaaaaaacaaatgtaggatagaacatgctaaatgatagtccaacatatcacttgtgtttacaaatactctgatattttggtaatatagatcactagaaatgttataaaattctcttaatagcttttctagttactctaccgatcgaataatatttcggacccactgcttgaatgcatatatatttgaatttgataaagttgtcttctttctgttgtaggtggatagtgtttcttaggtttcggtgtcacattctcaaagattatgtggcgcttgacaattggcttgaagatacaaacacactgacatagagatgtatataataaacatgtatggttggtatgcatgcaatgataatgatcgttaattaattgttctatgtttcacaaacgagtgatttcattttcatgagtcatgatgccctttctttttggctggaaaatatttttctttctttttcactttttctttgtggaattcttctaattattgttgtagtattcgagtgattatgataaagagggtcctttggtgtgtcatatatgggtagtaaaatcattaattcaaaatgcagaaagaaaaagacattatcattataacaactgtctggatatggtgttgttttatgaagttcttgattttcaacctttattatcaccactttaattaatgagctatatttatcactcacgtttggacaaagcatggccatgggggctctacatatatcagagaccaatcgaacttaagaagtttaacgtggaaaagttatttaacggccactttacccacacacacatgcagtaataaggtcgagatattgtggcctcaagacaattttcaattatgtgtttttgttcaaactatatatacgtccttttcaaaaaaacatcttaaatcatttccaaaattcagaaatgaagattacgtgtatatgtaaaacatttcttcacgaaaacgacaacttttgaatcagtgaaagttgttcgcaacaataatggaaccaagttcatgtatatgaatatattttttcttcgtaaaaagttgttcatgagatttgatatatatgtatgaaccaagttcacatgtaaatatgtaatatatatgctcttcatatcatatacatctccaaggtttgatcatttgcaagtttggtgggtattttgcttgatctacaatcagaatcaggatggagatcttctttatattcgttagcccaaacaatgttagacacaacaacaatgtcttttttgagatcgtacatattaaattatagtgcttgaagagaacggaaagaatatatataatgtcagccattagagtttttagttcatcgttatacatccgttaatcgtttgctcaacaaccttaacatatatatgcttttataatagacactacttttataaaaatctattttcataaaaaagtctcaatttttaggacaagaatagcactatgcaacttaataataggtgagttttcctagttgaaatatttaatataagatttgtgatatttttaatttcattacaaagtatgaattcataacttcataatactccaaaagtcagccagaaatataataattataaaatcaatcgccaacaacaaatggtctaatgatgaagttcacgcggtttcaactttcaaacatgaaaaaagtgtttctgctttttaagccttatttcaacggttaaatagtaaaagagcttcactattacaatttcaccctatggtttgattttagctcttttataaaataatttttttctcatgtctaacattttttcttcatttttaagcttgtaattcaataaaactcgaaaagtatacaataaggaaaaaggacttcttggggttaaaatcccgctagcttagtttttgggggttaaagttccgccggctttagtattttaccatgtattcctcccttgtatttcacctttggatcaatcttatgaattattcagaggaaaaagaaaaaaaaaaaaaagaatttaaaaattgccaaagttttgtggaaaaacaactttcggataaaaaacatttaaatattaatttagaaaagaaaaaaacaattctctttgtagagggaagtctgaaaacgccgagaagaagacgaagaagaagaagaagaagaaagcttgagactttctctctgtgtgcaatttcgaaatcgataaagacttcaactttcggttctaacaatgacaatttccgtatagtttgattttgtccacctctttcaccgattacctgatttcatcgctggcgttagtcatcaaatg

SEQ ID NO: 34918 - DNA, 3003 bp, Unknown; identical to SEQ ID NO: 34917
  misc_feature (1)..( 3003): 2750-1469P.txt file - cDNA_ID_3083093; gDNA_ID_2926239; Annot_ID_204016

SEQ ID NO: 34919 - DNA, 3003 bp, Unknown
  misc_feature (1)..( 3003): 2750-1469P.txt file - cDNA_ID_3083099; gDNA_ID_2926239; Annot_ID_142843
ttatcaccagttggtttaatttttttgttaatttatgtagatgtgtcgtggagacagaggagcaacaatggtgggttctcgagccagatggtcggtggcgtgagggcggagcagtcagtgcaagagcctcggttaccatcggagtgggcttattgactgattttatgttcgtaacttttgggtgtgtttagggggaagattttatgatgggtttggtttgaagaaagattagagttgatgacaggtagtgaaatagtggaaaaaaggttagggttaatgtagagatagtggaagatttggaagaagaataaagaaagttggaagtgtggagaggacgaggttttggatcgtttaaccaccattgatggcttgatagatgaagaaaagagctttgagacagacagagataggtgactctcttttctttttttttgggtttttcttttttacttttttactgggaaatgaaatgtcagtctgtcacggggctgttcctttagtgtcatccctctctgcctctcttttgttcacacaactcttaagcaatggataagtaagtaattagtaaaagaaaagtttgttatatgattttgattcccacatcaggtggatatatatttcctaaaatctttgcatgcgaaatcatattttgatgaaaaaatcaatactaagaaaacatgtactctttttttttttttattgacagaatttgacaatctaattttagaaaagaaattctcacaaaccgagagataacagtaataagtaacaacaacccataactgggtaacacaaattgacgtcaaaaggcaaaaaaaaaaaaggggggtaaatctgaggaaagaacatcctaaattcctaatcaatttggtgtcaaaacacaaattagtttcacaagtatgtattatcatacactataatttcgataaatattagtatattacttactaaatccactaaaaaaatttactatgttcttaagaaaacttaccattgagactactactgacagtctgacagaagtaaccaatacaaaaagataaaaaggtgatatgtactatatacccaaaacctaatgagccttgttattagcaacaaaactcaggtcatatagtagtatttaaacaagtgaaatggtaaaatcgtatagaaaggaatttggcaacctattaattaatggatcattaaatatttagaagcacacgagcacttaaataactcgatttttgattaaatgctgaaatgctggtcttctttgtggatcaacgtgcagagtttgtcctatgccatttgttactccagattaataaatattgacaacttctattagtattgaaatttgagttgtggcagctgtttttagttgtattggttttctcggtgtttgtttccaacaactagtaccaaatcatcatgtccagtttttttattattactagtagtattttctttcgtcgacctatattattgtttcaagttttgtaaccacataatctaattagcacagtaatgtagtcatcaaataacaattcgtcttgctcgagtcctgaatccaataccctgatctaaaccattttctatgggagtatgggaatgggactcacattttcatgtgggtgtttttgtatgttgactgcttcacgcggttcgtatcgttctactaaattattggtaattgttcggatatataacatttatgaaaaccatttgcactttcacatgactcgcattaatgccactttcctcattttccatagttcacataagaacaacatagtacatatactataaactatgtgattgattactattttgaagaaaataaagcttgcatacatacaggtttctgtattcacatttagattttcggattcacaagctcgaagtattcatatttgtattttcaagttattttctctgtgttatactcggaaaccacattggcctatctaattaacaaaacatatgatatgcttaaatggcattaaatgctaatatgaaaaacatgtcctatggattattggtaagtgcgagatttaatgaaagttacaatgcttgatttcttaaaggttacaatttcgtactattgaagacaaactatatttgcaagagaagaaattagctaccaaaattaatacagtatagtattccctcttctgtcactatctgttcactgcttctgcaaaccaatattaaaacaagttgacctatttgcaactatctgtctccaattatgtttcaatttttgtgtattttggattttctttgctcggcctttttccttatatggattctgaatgctaggaaaaaacagaatagagtgaattggttctcacatgcatagaagaattttcaagagaaacatatttgctcaactaacaactaccaacccatcaccaaattttcgtttcatttgttgtacaaattatagacccaaaaatgttcatccacaatcgattgaggtacctcatgtacacctatattaaacatacaacataattccaaaatggtttggatccggtctggttttttactttgaggcaaataacattagattatttaagattgaaagctcacaactagccttcttttagggcaaagtacacgtaaccaattttttaattttcatatcgaacttaacaaattgtaaccatttgcaaaaatgaagcaaacaaaaagtacaaaacagattacatggactattatataattggaagcccgtttggccttaaagcccgttaaaaaaacatatgtgtattttttagcaatatgtctgataaaaaaatttaaaaactaatcttgtttaattcagtaagacatttactagacttttcacaattcaacacagttgttgttggttgagctacccagccagtatcaagagaggaaggtagagaggagtgagagagagctttgggatcgatttcatgtcgtagatctttcactctgggtttgcgttccacaaaatcctaattcgcggaactctggatttgatcggcgatg

SEQ ID NO: 34920 - DNA, 3003 bp, Unknown; identical to SEQ ID NO: 34919
  misc_feature (1)..( 3003): 2750-1469P.txt file - cDNA_ID_3083099; gDNA_ID_2926239; Annot_ID_204014

SEQ ID NO: 34921 - DNA, 3003 bp, Unknown; identical to SEQ ID NO: 28656
  misc_feature (1)..( 3003): 2750-1469P.txt file - cDNA_ID_3083103; gDNA_ID_2926239; Annot_ID_204013

SEQ ID NO: 34922 - DNA, 3000 bp, Unknown
  misc_feature (1)..( 3000): 2750-1469P.txt file - cDNA_ID_3083111; gDNA_ID_2926239; Annot_ID_142838
caacggtggtcctatcgttagggaaaaaggacatgaaacaagatgcttgattttaacccacgaatgataattagctttacgattcccaaagtagttcttgcaaattaccaatcgtgattgattattcccacctatttatgtcatttgttaatcttgtgaaatttagctttttttttggtaagccttgtgaaatttagcttaaatagtctatattacaatcaaaagaaataaaacattccataattattaaggtaaataaagttataagaaataaaaaaaaatagagagagaggaagcattggggggggggggggggacttcacttggttttgtaaacatttgtttatgtacgtacatgttcatttgatagccgagtacatgtagcttgattatttgtattgttgtcgttgttgtgtaccatccatattcaaatcagtatgtatgttgttgacatcaaataataattccatttaacaaaataatttaaactatgtatgctatatgcctatattataaatcatcttcatttttagtctaattaaaattttaaaattaaaaactaccaatgaaatcatccacgatctgattcaatttcgttgcttaagggtcagtcaaatggtggtagcagcactatgggaaaaggtaatccactttcctcaaccatagccattagttcagacatgataagagttgactcataatctaaaacattaattgtttctttaattagtgttggatccttattaaatagaaaagatttggaaatgatgattttggttttggtagcaaatccactaagtattcacaactttctcctggcaataatcacttaaaacacatttaataaaacttgattggtctcatgactccctaaccacacatccacgagaaattctttgctacttgatttttttttttttttttttggcagtattgatcactctagaactagatgataatgatcgtttaaggcattaatttcgatggtggttacagtattaagcataaatcgatcccttaatgcaaatgtgaatcatgtgattataattactgttaaacttggagacttatatgattatgtttaagtgtgtttcttcctttttacccttttctcgtgagtgattatattggtgctagaatgcaatatattaatcgtttaatatactgtggtagtgtttaaaaacatgattaatagatgatgatatcatattagtatgatcttagaaaacaaatttcaaatgtggcggcgcaataatatttttgtcaatagtgaattttaggtaagatccgaagaagatacgtacgggagttcagaaatggttctacatcattcggtaatcttacctatttttgggtaatattacctaattaaggagttgtgtttttaacgaatatggtaaatagaccaaggttttcaaaaaatgaaaaccatatccggaaaagttgttgttttattgaattgaagttaatttaagaggctatatataagagtttatttaatacttctacactaggttcataattcaattttttttaaaatatgtatattaaaacacgtcaaatttaccataaatttcagcatggtgtatgttagtacgtagaatcgttcgtcgtacgtagtgtcatatactcatatgttaatatgtacatcataaacatgatgcaagcacaactggctatcgtggatatttgtggtgcaaatattttcattgtttggtatagagttattcgtatataatttttttggtttaatgttaagagtacgtcttatatttttttttggtttaatgttaagagtacgtcgtgtttttaagtgtggcaaatatgtaaacgaatgataaaatcatcatttgtaataggattgtaaattaaaaacatatcctctagaaataaaatgtggtatatatgacaaaaagaaaagaaaaaaatcttttaagaatttgttgatagcgaggatcagatcctagaaggctacacagagggtttatccagaatcttgaaaaaaaaatttggacaaaaaaaactttggtactttggaataatttgaataagaggtttttgtcacttggctcaggcattagtattaatgttttgggttttggctgtagccaagagggagatatctccaaaaagacccaaagagagaatctttactctattggcatcaaatcaaacgcatatgatataaaggttttactctataagattctaataaaaatatttgttcaacgaaatatgcatgctaaggttttttaagctatgggtataactttatatttggtttcactttcggttgaggtgtaaattcatttttggcttcataaatagctcaaagttgttgaacaagaataaaacttggtcatcacatttctactttaataaaatttcttaactcatggggaaattcatgcatgaaatctttttaattcgtagaaaacttcgaacaaatttgaggtttcttctgtctccatctctatttgatttggcaaatccgtttgactctcttttaatcataagagttcagggaattttcaactttatttatgtctctttttaggtccacaaagccacacaagttattatctgaaaatgaccgaatggaaaaaaaaatgactaccactataccgagatttgtacttatcttagatcaaagcttcactatcattttcttccctgtattattatatagactttataataatcatcaaatagaaagtcgtgtgaaattaaatggtagctttttatgtcatatatatttacaaataaatcgaaatggaagttgagaagttcgtaattatgtgtcttctatttgtaaacctaacgtgtcgtcctttttttaaagaatcttggaagcactatggaggaagagtcaaacatagtgaatgttatccattatataagaggaccaagcttctccacaaacacatcacacacttactcagcaacaatcctctttctctctctctctctctttcccaatcattaacacaaaaaattatg

SEQ ID NO: 34923 - DNA, 3000 bp, Unknown; identical to SEQ ID NO: 34922
  misc_feature (1)..( 3000): 2750-1469P.txt file - cDNA_ID_3083111; gDNA_ID_2926239; Annot_ID_204009

SEQ ID NO: 34924 - DNA, 232 bp, Unknown
  misc_feature (1)..( 232): 2750-1469P.txt file - cDNA_ID_3083122; gDNA_ID_1591517; Annot_ID_151099
tcatagagcagaaaccaataatttcaagtttgagggccatagattatcagatagaagccaattcaaaccgtcaagcttacctgattccagatcatttagtacccaaggaagaggtaatcaaatttctataatttgcttagcccataaaactaaaattgtctttggaaaagatgcctcgcgcagtttctaatatatgttggttccggaagtaggggattctccagactcaatg

SEQ ID NO: 34925 - DNA, 3003 bp, Unknown; identical to SEQ ID NO: 28655
  misc_feature (1)..( 3003): 2750-1469P.txt file - cDNA_ID_3083122; gDNA_ID_2926239; Annot_ID_204006

SEQ ID NO: 34926 - DNA, 3000 bp, Unknown; identical to SEQ ID NO: 16190
  misc_feature (1)..( 3000): 2750-1469P.txt file - cDNA_ID_3083130; gDNA_ID_2926239; Annot_ID_204002

SEQ ID NO: 34927 - DNA, 3000 bp, Unknown
  misc_feature (1)..( 3000): 2750-1469P.txt file - cDNA_ID_3083154; gDNA_ID_2926239; Annot_ID_203992
tagaaatgagtttatacaaaaataaggatttatggttttgattgtgtacctaagtcgtgttctcggggaaacagtggtaaacgttgttattgttgttgtttctgatttttgcggttctagcatgaatcccaaagaaccgaggttttcgtcatcgtcatcatcgtatgggatcccaatctgaagaagcgttttggagtcatcaacgatggttttaccttgaaagagcactccaatgtttaatccacccttgagaatctgcgttaccgcctccaataccgctagtttcagtgagccaaccgtggctgattcgggaacgtctaccaatagctccgagatattcaacgacttaataccgaatttcactgaaaatgcaacaagagaatgttatataaataacaatttttcatatagatttgatctcaaatagatatacataccggtacatggagtatcatgtgattcagatgaatgattttggtaaaacagctttcgtttcttcaaaggatacatattctgcgattcttggctaatacacgaacctcgctcttttaagtgactcacctttcttttactatctacataaatccaaggaaatacaaaaaaaaaaaaaaagaaggtcaataatattcttcatttctctgtaaaaaagctttccttatatataagtaaagttcgcgagtgatatgatgacttgatcttaccgatcttggaacgtgaatcaaagttttcttcttgtgtgattggcgagttaggcatggaagggccaagagctaaccagtccttagacaataacacctgagaaaggttctccagaccaggttgcggcttaacctcaacttccattgtctccaagaagttattgacgacgacattatcgtccttcgtctcctttgtttcgtgagccaacgagccgataacaattcggtttttacgctcacctgagaatcttccagccacttgggctaaaacctcgaactccgatctttgttttctcataatttttagcctgcgtccctggataaaaaataaaagatgcaatcgagtgagccaaaatgtatgtaacttatggcaaaataaatcatgttcgaatgtatatgcgtactctgggtgatctacatgccctaggaacaacaggaagttggtaaatatcgacaccacagtccaccatgttccttgcaacacacacaactgcaaattgcttacgttaagcctgagcctgcgcaatctcggtttatcaaacattcatatatccgatatatgagacacaaaaatgatgaggataattggaaaaacaaacattcgtcacaaatctcatacaaattcacaaaccttttgattatctgaaacgattttgattttgtgcgagaaagaaaagtgagatttatgttggaatttgtttgtgtggaagtaaaatatatagaaagatatgagccgtataaaaacatccgcctttaaagttgggtttgtgtctgaacaaaaaccccatgaaaccacaaaaattctttacaaaaaaactccaatgttttaagaaaatttgaactcaattttaacaacacatgtcaacatctgagtagtctgaaattatcagtaaatttaaaacgttttctgaattatatttttctctaaagacatgtttttttttgggggctaaaactaaccaacgttttttttagcttttagacctaaaaccctcctccgaacagtttggaccagttcttcgttcccatgacttctcaacatcgatccttcttttaacacgtggacgactctacattattcatggataaatctcttctcattcactaatattttcttgttgtggaggaatttctttgcgagtactttttggataaataacgtggcaaaatggagtacatattttgttccattcggaagcattttaggatgtaactggcaatcagttaaagaaacgtgttgaataaggtgtatatataatagaaatcaagtcaaatgaatttgaatggaaaatgtgattgcagaacaataaattaaattgataatgtttaaaattaatgttgaatgatacttaattttaagtaaaactttggatttaatctttttcgctaacgtagctcccaagttaacgacaatatatggtcaacaaatttaaagttgccaaagcaatctaaggttatatatattattggtagttaattctcatatctagcgaaaaccataaaacaataatcattcttaagaaagcttcaacttcgtcactttcattaactatttatgttttaactgtttcaaatcaaactgataatgataggttggattttttagtagacaattcggattccaaatgccaaatggtatgtaggtacataaacaatatagagaaagagtaggtcaccgatagaaagcacgaccaaaagcgtcgatgtcaaagctcgatgcttacgtactaaagatacaagtagacgagtcaattacaataaaaagaaacccctggacgacggagcggttgaactacttaacaagtcagtcctaattcggatgataagcaaattaagcaaaagactcggttctcttttttctttttagggccacttttatttagggtaataaataactattatccttatgatcacaaaatttatttatttttcttactaaaacttttgtttataaattagtttgtaaacaattttgagacacgaaataacataacttttcctttttttgttttgatgattgttttttaggaaccatgtgtgatgcatatttggtaaagaccattgacttatttaactctttcctttttttcttgttttcagactcaaaaactccaaccaaaatttgcttattgttgtatagattgaactttgcacttagctcccaaagtccaacacccgattaaaaactcccataaagagctaaacacgaaacctaatttctccctacacacatctcaaatctctccaattttgttcaaagctcgaattctgttcaaagctcggatttttaattgcttcaatg

SEQ ID NO: 34928 - DNA, 3000 bp, Unknown; identical to SEQ ID NO: 28651
  misc_feature (1)..( 3000): 2750-1469P.txt file - cDNA_ID_3083159; gDNA_ID_2926239; Annot_ID_203990

SEQ ID NO: 34929 - DNA, 3000 bp, Unknown
  misc_feature (1)..( 3000): 2750-1469P.txt file - cDNA_ID_3083163; gDNA_ID_2926239; Annot_ID_142814
cggcaaaatcaaataatctttttcttagttcgaatttaatttcccaagagaaaaatgtcaggccgaggaaagggaggaaaaggattaggaaagggaggagccaagagacatcggaaagtactcagagacaacatccaagggattaccaaacctgcgattcgtcgtctcgcgagaagaggaggcgtgaagcgtatcagtggtttgatctatgaagagactcgcggcgttctcaagatctttctcgagaacgtgattcgtgacgccgttacttacacggagcacgctcgccggaaaactgttacggcgatggacgtcgtttacgctctcaagagacaaggacgaactttgtatggattcggcggctaaatcgttcggattgcaatttcggattttgtaaactcttcaatttcagcatctagggatttcagatttgtaatttctcagttaaacgatgaatgaattgaaaaaaaaagaattgtcttcaactttaatttttaatcatatacagtaatcgaaacgtgatttaactaatcctctgtttattacgaaatcattctaataatcgtaacgccactttcgcgtttagttaaattttccctgtgaaatgctccgtatgggctcataataagttacagtaaaatcttttggctaataatgtagtggcccaacatatatgttttgtttgggcctattataataagtagtcagcactcagtaaaaccttttgtagtggcccaacaaaatttatcgtcgaagtctcgaaatcaaatttttaaattgattatgtcaagtgataacttcattgaaaaattctagtgtagggtaactggaagagaatatagattcttcaccaatcaggtgcaatcgccatattactaacgtaattgtacaaaaatatacaattacatcaatgtcaatagtttagtgtacattaacatattctcaatcagtcgttactgaagtcaaattttataatgagttgttgttgtataatgggactctctacctagaacagttcgctgtacttatactgtagccactgaaaattacttttttctctaatcgacccatttttctgattttttcgaccatgaataataaaccacttttctttccgatttacacaaatacaaaagctatggagcaaaatgtgttgtttctttttcattattattgctatagactgtttcatacacaagttccagtacaacttaaaacaccatgatttcacagacaatttcactctgccgaccttatttgggcgtgtgagtcgtcaatgtcaaagctatagtgtctttataaattgaggatgtattcttttctttcttttttttgtcaacaaaattattaggattagcaatcttattttctacaaagagatacaacaagtgtatttgacataactcttatgacatatctgatcaacatgcaaaatatgactttgagctgcaatttaaggtacaatagtctagctagattcatgaatcttctctataaatctttttttttctttttttttttaatgttctatctttgagctgtaatgtaaaaaaagatgggtgagaccaaacttgctatgttttgaactaactgttcctcaaaatttggaggaccacttgtttggcacttttggcttgccttcatgaaaagtccaaatctatttcatagaaagggaaatgaaataacgatcgcctcgtgattttcagttttttttttttttttttttttttttttgtaatcagtattcttgtgaattctcccactatctaaacttttaaaaagtaatatgattgacgtagtttctcttaaaaaatttaaataagtttttttccattggatatgtgtcttggactaatatttcgaccattaggtaggtcagaaaatatggatttcgagtctataacttttggtgacctttttatcgcgtcaatcggatttgagagatccttaagataatatgcacaaaagtaactaacgctccaaaacatctaatagaaaaccgtgtgatcattatattaatcttaaaccacaaacatacataattacttaaccatgaaatggtcgaaataaagtgtgattacaaaatttatagcatcttcgaggcagtccactgctttagatcctttatttctacaatttcagatgtctctttgccacaatctaactcttaattttttcatactgtatatgatagtcatagctattatcaacagttttatttcaaacttgacgaacaatctaaactagataaaaagttaggaaagtcgtaaataccaagcagaattgagataccacttcttggaaaaatcaacagctctatttaatgaaaatattgccaacttatatcgaaatactttggaatatatgagaagtcatagatacgtgtcaatttggttgcacttgtaaaacccatccacgccgacgcagcatttgtcaacgcccatctctcgcgtcccacgtttgactcacatgattcctgcttcggtgataagccactcttattttagtttgcaatttccgtctgtgagacgagttgtttctttttttcttctcaatactaaatttatgttattagttttgcttgaaataaaactgataagaatgagttatagcaaccacaaattgtttttgagtagatttttactttctatactttattgtaaacatgaacaattcaaagacatagatggtttctaattatagcacccaaaatctaatggtttttaaattttctactaaaaaaacaaatatcataagaaaaaaaaaaaaaaccaaatacttccactcaaggtctagtcacacgtgagatgcaccaaaattacaagtaacaacataattacttttttgaatcttcaaaccaatacatttataatttttgcctataaatttcttcacatatcttcttcatacttgaactatatcacatgttccaaatatagacgagaacaaaacaaaaaaaaaaagtcgtcgataagagagtcctttgaaatccccaaaatg

SEQ ID NO: 34930 - DNA, 3000 bp, Unknown; identical to SEQ ID NO: 34929
  misc_feature (1)..( 3000): 2750-1469P.txt file - cDNA_ID_3083163; gDNA_ID_2926239; Annot_ID_203986

SEQ ID NO: 34931 - DNA, 3000 bp, Unknown
  misc_feature (1)..( 3000): 2750-1469P.txt file - cDNA_ID_3083167; gDNA_ID_2926239; Annot_ID_142813
gcttatgttttatttgaacattaaccaaccgttgtataaattcaaattgatagctaggcaggcccggctctaggggagtgccagaggtgctagtacacagggtcctcatttttttttcttaattttaagtcttctagtttgcagtttttttttttttaaggggaaaactacaaaaaaaacaaccaccaaaataaaagataataagtttaaaataaaaatacagtaaacacatgtcacataaagttattttgtttagatttaagggctatttttgtttgtagcacagggcccaataaaatattgagccgggctgctaggtttactatcactataatagacacggttgcaatttgatagctaggtttgctctcaaccgttgtatagtaatattagtcaccataatacaaatctgcagttcattaatcatagactgatggacacggttgcaatttgatagctaagtttactatgtgcatcgaagatgatgcagttagcaatggtagcttcaaaacattagtccgtgattcttttgtcacctccgaaataaacatttttatcttaaatatatgtgcaagattatactataatgcttctggaaatatgtagtatataaaattttttgtttaaacgtgtcttcccaacaaagattatagttatatactacacttttattataaaggcgtttcttattgttttggggtaataaagaaaaactgatcaattaaggactagtcatatatatgcatgcatgaaaactttatttttatttttttttctgcatgaaaactttatacgaatataccttttcgaatgggccaatgtttacgtaatcgtcacttactgatccacttgcagatttatgatcttcttcataatgcaacaataaagtgaaataatgattacccattaatgtagtaagtgtggttatttttaattaaactgtttgtacgcggggttgactttaaccaggtactaaacgacgagacgtttgcaatactagtgctaatggcactcttcacaacgttcataacgacgcctactgtaatggccatttacaagccggcacgtggcacccaccgcaaactaaaagacttgtcggcgagccaagactccaccaaggaagagcttcgcatcctagcctgcctccacggcccagccaatgtctcctccctcatctctctcgtcgagtccatccgaaccaccaaggtaaattacctttcttttatatttttacgttacaataatctatatttaaatttgtaaatctatgataagagttatatcagaaaattaagatatcattgaaatgctcaatgaaaatgtatcctacgtataattacacacattttgtatagttaaaattaaaaatcagctgggtaataatttataatcttggttaataatttaaaaagtcgtatttgttttggcagatactacggctaaagctgtttgtgatgcatctgatggaactaacggaacggtcttcgtcaatcataatggtgcaaagagcccgtaaaaacggacttcctttcgttcaccgttaccgtcatggtgagcgtcacagcaacgtcataggaggcttcgaagcctatcgtcaactaggccgggtcgcagtccggcccatcaccgcagtctctccattacccacaatgcacgaagacatttgccacatggcagataccaagagggtcacaatgatcattttacctttccacaaacgatggaacgctgatcatggtcatagccaccaccaccaagacggaggaggagatggaaacgtaccggaaaacgttggtcatggttggcgattggttaaccaaagggttttgaagaatgcgccgtgttcggtggcggttcttgtagaccgtggacttgggtccattgaggcccaaactttgagcttagatgggtcgaatgtggttgaaagggtttgtgtgattttctttggtgggcctgatgaccgtgagtctatagagctcggcgggagaatggctgagcatccggccgttaaagttaccgttattaggtttttggtaagagaaacgttgaggagtaccgccgtcactttacgaccggcaccgtctaaaggcaaggagaagaactatgcctttttaacaaccaacgtggatccagaaaaagaaaaggtaaatctcttttgatcccctatgtttatataccagttatgacaaatataactatagctttctttcttggaaaaataattataggaattagacgaaggggcattggaagacttcaagagcaaatggaaagaaatggtggagtacaaagaaaaggaaccaaacaacatcattgaagaaatactgtcaataggacagagtaaagactttgatctaatagtggttggaagagggaggataccgtcggccgaggtggcggcattagctgagcgtcaagctgaacatcctgagttaggtcctatcggagacgtgctcgcctcttcgatcaaccacatcattccatcaatccttgtggttcaacaacacaacaaagctcatgtagaggatattacggtttccaaaattgttagtgagtcttctctaagtattaacggagacacaaatgtatgataacaataaataaattgatctagtacttaaacttcggcttaatgcatggttaaagtggttagttgaagatgtagtttatctacaatatatagatagctcttgagtaagaattgtaagatcgtctacatataaataaccatgattgggcatcttgggcatcgtctacatataatttcatatttggactaaatagtaaatacaattatcatttgggccatttgagaaactaccggaaacctctcacgtgccagagacacgtaccaaaaaaaaccccgaacatttattaggaagaagagaaaaaacggaaaagaaaaaaaaacgcatcaatctgagcagcacaagtctgcgagatttggattagatctgattcaggttggattgatcatcgttcggagctccgggaaacatg

SEQ ID NO: 34932 - DNA, 3000 bp, Unknown; identical to SEQ ID NO: 34931
  misc_feature (1)..( 3000): 2750-1469P.txt file - cDNA_ID_3083167; gDNA_ID_2926239; Annot_ID_203985

SEQ ID NO: 34933 - DNA, 1472 bp, Unknown
  misc_feature (1)..( 1472): 2750-1469P.txt file - cDNA_ID_3083193; gDNA_ID_2926240; Annot_ID_142871
tcgactcacctcttcctcctttctctatcttgtaccaataatctcttcagaaactaatgcatgtataggaaacggggatatatatcaaaatagttgctcgtatatgatttgtcgtccacacaaaatgcgtctcatttattacaacatataaatgaaagaaacgcgtctaatacatgagagtatgattatagctaaaacaaactaagcttgtaatagtaattcttatataaaccatccctcgccatagaattttgaacctcgaaatcactaattatccagccatttctgagctgtatttcaaaattgtgggttttatatattattaagatatatacaaaattataaggtcagtaattcttctttgatcgaccaatgtagaaggggcaggtaccaaacacaagcctaggcatagtgataacgtttggtgacctgtttccatcgtactcaaaaacgacctttgctcaacttgatacgctgcgtttcatttattccttgctgtggattttagcatatttatccagcactttaatatgggtcatggaatgggctcataacagtttactgtcttctattagactcaaataagtccatcaggcccaaccatttaaggtcgtcatttgatgtttgactttttaacgacacatcatgcacgacgaattaagctcattacataacatcaggatggtaataacaatctaccaaaccatactttatcatataaagaatatatactgtatgcgtttatatatttaacatttactggagtattttttggcccaaaaataaatggagtaatcatttaatctttccttggaagccttgcgtgatattagtgcttttgatttgaactgcattatcaaataaatttaaagacatacgaagaattgaatagaagaatgtattctatgctaataaatcgacgagaaatatatatataattcccactatttgatcactattggtagtcaataatataaaaaaagaattataattaaaataaaaaacttaggtgaaggtggatgtaacgatcaaaagcaggttgaatacactaactgatttcaaccacaaccacttgtagacaatatacttgtagtacaatataattgatttgcaataattataataccttatgattctaagcaaagtttgtccatctttaagcatggataatcaacggttttaactactttcatgttcaccggttgaataaattattttacctgaggttctgatcacatgcggcaaccacacggtgaggcgatgattataaccgttggatgaatgtcacggaccgttatataaattccaccactctcgcgtcgttaaaattaattaaaaatctataaaggtaaaagatttcatctttctcctgacgcgttttggcggttcgttctgcacagtttcttcttctgatgctctttttttgtttttaagaattaagggtttctactttaatcgattggagcacaatg

SEQ ID NO: 34934 - DNA, 1472 bp, Unknown; identical to SEQ ID NO: 34933
  misc_feature (1)..( 1472): 2750-1469P.txt file - cDNA_ID_3083193; gDNA_ID_2926240; Annot_ID_204063

SEQ ID NO: 34935 - DNA, 3003 bp, Unknown
  misc_feature (1)..( 3003): 2750-1469P.txt file - cDNA_ID_3083201; gDNA_ID_2926240; Annot_ID_142867
gtgagacgttttcaccgtcgacaagtttaagaacggttaggtttacgtaaggttggtttgtcattctaaccgcaaaggccagtgtctcacggtcgtctgctccaccgaggaatattgaacagatgttgattctcattgagccgttcttcatcgccgttcccatgttcttgaaatctggaagccgtccttggtccattagaaccgcaacggagctaggtgaggcattccggacgttgcgacagagccttcgttctgctgcagtcccgtcggccatcccgaaaatgatgagatcggtttctttttcgaaggccaaggcacatacatcctcgtgcatcgtcttgctcggtgcaactgctgtgaaacattcaacggaaacgttttcttgcaaatcgtggccgcttcggaatttctcgaaggctttggagatctgatctctgcggctggaagacgttgatgactcgtcgttgtgacctggatggtgttgaatgaggagagggacgttattttgctcaagctcttcgagattaacggaaacgatggagtgcgaagaggcgctcgagggacaagtagagagctccaagacggtgaggatgggaggaacggtttcacggtggtagaaacaagtgaggatcttgagaggtttgtttggttcgtagtgttgaacggtttgtcgccggtaagtgatgtgtttcctctgcacccacccgtagagatttttgacaatggccgtgaaaatggtcgagtgaaccatggcagagatcaccattatcccaaatgcctcgtggcttatattctgcatcccttaaaacaagtagttaaaagtcaaaacactaattggcgatgaatgatatttcatttgtactaaatcaatgtgtaccttgtagttcaagagctgtttgaagatttggacatcgtagatcccttgtatgcagacgatgaagccgacaatcactgcgtgtgatataggaacttggaagtaaagcgatggaaggacgatggaggcaaactttgcagcactaatggtaaagataaggaactccaaagatatgatgtcgcgtagattgaatgaaaagaaatccactttgttaccaatcccgatgacgtaacacggcataagaaccgcataacagaagctaccgatcttgtcagtgagaccagtaccgaaaggaggcgtcttaggagtgacaagaccgagagccacggatccgactacgtaaggaaaccctacagtttcagacaggaaagtggcggtgcacaacatgacgcaaatggtgcatagatgggaagccttgagtttctttccttcaggggttctcttcactatccagttgaatattggtcggcacacaactactataccaaccagcagtagtacctttgtgaaggtaggcagataagtggtcttggagtaattttgatgcaagaaactgtcaaaggtaatcaaaaggaggaaaaaaccccagccgaagcagttagccaccattatggaggagagggctaaccttccgggctccgagttcagcatcttgagattcgacaaaaccgaatacgccacttgaaaatacactacggattggtttgttagtaaattgtggagctgctcgggattatttttcgccacggttccacggatgttgctcgtgattactgtacatgctatggcgcccaccacgtaaggaaacagaaaaagagataatccattgatgattgctagcttgcctcctcgctttataactcccatgtccacttgagccgtgcttatgtatgagatgaacatgaaggatattgcctcaaatgattctattatgaaatagcttcttgtgttgaataatttttttactaaatcaatgttttgtcccaaagccgagggtcctaagaatatcccagcctgtttcatatataccaacaaaatatcacacttctatagtttaaacctttttttctttgcgggaaatatagagagatccaaaatttattaaaaaaaacgtagaaaatggtatgataaagtgattacataccagaatttgagtgacgaagtcgacatttgcgagagggcggagaagagcttggaagacggaagagagagaagagacgagagaaatgagaagaagaagaagaggagttgaatatttcaatggatcatctcctctaagtaatccgccagagcttgatcccaaccatgcctcgcatacaaattcatgtgtgccattacttgtaacactattgttcatcttgtttctctttgggaatattttttcttcttaaaactagtattcacgttcttctttataaccatttttgtttgtgtttttgaattcagcataacgctaactaattgagcaaacagatcaagcttgttgagctggggaagaagatacatgtatcttttttaagatattaaacagtttttgttgttttttcaaggattttgtgttgactttattataaccgtcagagaaaaataggaaattatatatgtcatatctcactttggcagatgtattttttggtattttacacattttttttttattatagttttatttttttgttgatcctgatcttttttaaattaatacttataaggagtattactaggttgattattaattaatctttttttgttagggatctaacttcatggatttagtagctaggttggttattataacatcaacatgcaaaatatatattacaaacacacatgtttgtgcaatcaatctcaggctataatgatgatcatctgaccatgctcaagatttttgtaccacacagaaaacatatatagaaaaccttaaaagtaggatgacctctaaagagaaataaagaacaagaggataaacaacatgtacaattaaacccctaaatatagctagagagagcagaaacaaaaaaaagaagagaataattaatactttcttcttttcttcaactcacaacacaatctctctctttccctctatggcttgactctttaggggaaatacctagcaggagggaatg

SEQ ID NO: 34936 - DNA, 3003 bp, Unknown; identical to SEQ ID NO: 34935
  misc_feature (1)..( 3003): 2750-1469P.txt file - cDNA_ID_3083201; gDNA_ID_2926240; Annot_ID_204059

SEQ ID NO: 34937 - DNA, 3003 bp, Unknown
  misc_feature (1)..( 3003): 2750-1469P.txt file - cDNA_ID_3083209; gDNA_ID_2926240; Annot_ID_204057
atataacttaacacacaaaaacccaaccaggagcgaaatcaacaaacagataattctgaaacaaaagcgcagagcagagtttccaaatcagtaaacaacgaaattccaaccttacatctcaactcctcgtgaaatcgaaacacgataagaaccatgcgatgacaaaaccctaggaaaataagcaaaaggcaacgactgaaacctaaatgctcacttaaactggaatcggagcttgatcaacagagaagttgagtgagagcggtgaaaaatcgaagaagacgaggtctcagagagaaagagagagagagggagaagaagcttaggccatcatgactgatggcaatgcaaaagacgatgacaaagccggaggagcgacggaaactgagcgacggaatttttagagccttttaagctgcaaattttaaatataccttcttcttcttcttttttttcaatttcttctgctttctaatatacaactttctcctttttactttttctacggtaaattttgaaagaaattagacattagtcaaactgtttacaagtatttccttctgcggaaaaatagacatcgatgcaaaatatttttaaaaaatatatatctattaatttatcatttttaagaaaaaattatcctttgcatataaaatgcgcgtaacaatgaatttcctcgatgaatttgaagaaaaacaataattggtcatattaaaagaaaaagaagaagtaaatataatattatctataaaaaatcatgtgttgtcaaatcatgcaatgaaaacatgaatacaataacacaattcaatataccttttagcatataggcatggtcataaactaattaataagaatattgtttcttttgttgataaaatattgtttgtctccgaagaaatatatgtagggagatattaagttattatgattgtttctaatgaagtgagacattaagacttattactaatagtagctaacttaaatggaaaaatgtaaaccgtgaaaactataatacttctatcaaacaaatgaaaaaggagacacatcttcctcttttatacttttaccctttttagattttattagatgtggacatgcaatgttgcataagccaaacagtaaaagttgtactaaacattatataaatgctcaactaaacaaagagaaacagacattataataatcgctagttttgtacttaagtgtggttgcgtgatagaaatatttgttttatagccatggtacgtattacctaagtacgtaggatcgtaaatgggttgagagaatgaatgttcttgatcccattttcttatgacagtattttgatttgggtgatttgcagatataacattttttcactaaataattaactaactaacaccataaatttgtaaatgtaataaataaccttcaaggggtgtgaaaagacatcactgtcctggtgttacgtttgtcagcgaggaaggaaaatgtggtgacgtggctttattattagtgttgaggtgagaaaagaaatcaggtggtatgagagaagttcctttttctctttcttttttctttaccccttcccaattgtaattcatattatctaatctttaaaaaattaattcaagttcatgatatatcaattaaaaagttgtatagttttctacatatatcatgacttaaattttttaaaacagacacaaaataatttagatgtgaatagtgttgtcaatgaataacataacgttctgtatagatacacaatatttttttatggaaagatattaaaccctaagggataatatatagggaacccaagggtttaaatctaaaccaataattaaatcacttaacatccttaatcaaaacaaataattcattttaaaacgtatataaaacaaggtatacgtaaatagtatatttacaaatagaatagtatctctcaacttgcaacaacaaaactcaatttcataaccaagacaccaagcgcaacaacgaaagtcgattccctgaatccaaattgtgttcctctctctgtaattcgaaacccccaaatcaaatctcacccaaaagtaattaagagactctgatttgaaaacaaaaacaagtaacgatgtaggtgtgaggactttactggggagaaagagagggggagggaaaaagaaagagagagaaagagagagggggagagagagaaagagagaagggagagagaacggaagagagaggtacacataaagagagatgagagaaatagatagaggggtaaacttggaattaatatacaaaatatagaggatatcatttttttctttttttaatgttagtttcttaattataaactttttgttggttagttttgccaattccccttttgattttatgaaaatagggttttctcaataattaagttggtatcatgagtaaaaaatcatttcaagcataaacaatcttaaactcttaaattgtttacgactaaagctttttttgttttcgtaaacacatcagatttatcacaagatgcaaccaaaagatttgccaaatcctcaaaaaaaaaaatcgatcaaagcgtttgcgttttttcttttcttttattttttttaatgaaaaataatgaagaaaacaatttcatgcaataattacgttggaagcctttttgggctcgaaattcgaatgctttatctatgatgggattgcaagaattttttattaaaaaaaaaaagttatggcgtttcggttaaactcagaaactctaatcgagttagaaaactcacgatcgagttttggagctttggttaggattgaactacaccagttattgcaaactccgaaaagaaatcaaggtccgcataaccacgaaccaaacaagaccggaattaaatccccaaaagattaaatgttccaatttggaccggtccacagaaacacaaaaccaggaccggaccaagcaaataacaaaagataaaattggtcaacgaaaagtcagctataatctctgctctccacaacaaattaacaatg

SEQ ID NO: 34938 - DNA, 3000 bp, Unknown
  misc_feature (1)..( 3000): 2750-1469P.txt file - cDNA_ID_3083216; gDNA_ID_2926240; Annot_ID_204055
cccatcatagataaagcattcgaatttcgagcccaaaaaggcttccaacgtaattattgcatgaaattgttttcttcattatttttcattaaaaaaaataaaagaaaagaaaaaacgcaaacgctttgatcgatttttttttttgaggatttggcaaatcttttggttgcatcttgtgataaatctgatgtgtttacgaaaacaaaaaaagctttagtcgtaaacaatttaagagtttaagattgtttatgcttgaaatgattttttactcatgataccaacttaattattgagaaaaccctattttcataaaatcaaaaggggaattggcaaaactaaccaacaaaaagtttataattaagaaactaacattaaaaaaagaaaaaaatgatatcctctatattttgtatattaattccaagtttacccctctatctatttctctcatctctctttatgtgtacctctctcttccgttctctctcccttctctctttctctctctccccctctctctttctctctctttctttttccctccccctctctttctccccagtaaagtcctcacacctacatcgttacttgtttttgttttcaaatcagagtctcttaattacttttgggtgagatttgatttgggggtttcgaattacagagagaggaacacaatttggattcagggaatcgactttcgttgttgcgcttggtgtcttggttatgaaattgagttttgttgttgcaagttgagagatactattctatttgtaaatatactatttacgtataccttgttttatatacgttttaaaatgaattatttgttttgattaaggatgttaagtgatttaattattggtttagatttaaacccttgggttccctatatattatcccttagggtttaatatctttccataaaaaaatattgtgtatctatacagaacgttatgttattcattgacaacactattcacatctaaattattttgtgtctgttttaaaaaatttaagtcatgatatatgtagaaaactatacaactttttaattgatatatcatgaacttgaattaattttttaaagattagataatatgaattacaattgggaaggggtaaagaaaaaagaaagagaaaaaggaacttctctcataccacctgatttcttttctcacctcaacactaataataaagccacgtcaccacattttccttcctcgctgacaaacgtaacaccaggacagtgatgtcttttcacaccccttgaaggttatttattacatttacaaatttatggtgttagttagttaattatttagtgaaaaaatgttatatctgcaaatcacccaaatcaaaatactgtcataagaaaatgggatcaagaacattcattctctcaacccatttacgatcctacgtacttaggtaatacgtaccatggctataaaacaaatatttctatcacgcaaccacacttaagtacaaaactagcgattattataatgtctgtttctctttgtttagttgagcatttatataatgtttagtacaacttttactgtttggcttatgcaacattgcatgtccacatctaataaaatctaaaaagggtaaaagtataaaagaggaagatgtgtctcctttttcatttgtttgatagaagtattatagttttcacggtttacatttttccatttaagttagctactattagtaataagtcttaatgtctcacttcattagaaacaatcataataacttaatatctccctacatatatttcttcggagacaaacaatattttatcaacaaaagaaacaatattcttattaattagtttatgaccatgcctatatgctaaaaggtatattgaattgtgttattgtattcatgttttcattgcatgatttgacaacacatgattttttatagataatattatatttacttcttctttttcttttaatatgaccaattattgtttttcttcaaattcatcgaggaaattcattgttacgcgcattttatatgcaaaggataattttttcttaaaaatgataaattaatagatatatattttttaaaaatattttgcatcgatgtctatttttccgcagaaggaaatacttgtaaacagtttgactaatgtctaatttctttcaaaatttaccgtagaaaaagtaaaaaggagaaagttgtatattagaaagcagaagaaattgaaaaaaaagaagaagaagaaggtatatttaaaatttgcagcttaaaaggctctaaaaattccgtcgctcagtttccgtcgctcctccggctttgtcatcgtcttttgcattgccatcagtcatgatggcctaagcttcttctccctctctctctctttctctctgagacctcgtcttcttcgatttttcaccgctctcactcaacttctctgttgatcaagctccgattccagtttaagtgagcatttaggtttcagtcgttgccttttgcttattttcctagggttttgtcatcgcatggttcttatcgtgtttcgatttcacgaggagttgagatgtaaggttggaatttcgttgtttactgatttggaaactctgctctgcgcttttgtttcagaattatctgtttgttgatttcgctcctggttgggtttttgtgtgttaagttatatggccttgttcgttagctgactgaaaattgtatacatttgtgtttcgtatttcatcatgtgaatttcttcgtgattttgtaatttcacatcaatggctgcctcataagctacctcttgagtgtcttaataatgcacaccatgtgtttgaaggttttcatccttctgttgtctagttagtaaaaccgtacgaaaaatctggagactgtgtctgtcttgattacatgcttgagcaataagacccgtttcaatcattggaaggactggatttgttgttacactgtaaatcctttgatattctttccttttacccaatcaatgtcaggatg

SEQ ID NO: 34939 - DNA, 3000 bp, Unknown
  misc_feature (1)..( 3000): 2750-1469P.txt file - cDNA_ID_3083220; gDNA_ID_2926240; Annot_ID_204053
agctaacaagaacaatttattggaaacttacttttaacagcacagctgaaaggtttgatcctagagagcactcctggatgaatattgcatcgatgaagtcgagaagaggctgccattctcttgttgttctgaatgaaaaactgtaagtttcttctccccatttttcttcttctttgagagtaactaacagacaaattttgggtaagagttttaaggttgtattcatatgcactattgcagatatgcgattggtgggtttgatggtgagacaatggtatcgagtgttgagatatatgagccaaggacagggacatggatgacgggagaaccaatgaaggatttaagaggatattcagcagtggcagtggttaaagactcaatatatgtgatcggaggatacaaaggggaagaggatgacatattagacactgtaggatcagttctgaacttgaaatgaaattaaaacaatttacataagcagacacggtttaatctttgatcatgtgtgtgtttgcaggttgagtgttttaaggaaggtgaagggtggaaaaacgtgccttcttcctcgatcggtaggcgttgctttctatctgcggtggctttgtaaatggggaaactttgaagctgttgtttttttggtggccaagtcatgagagacagagataagcctttaggagttttgattttggggaaagagtttccctctatgaagtagaagcaaaatggaaatatcgatttgctataaaaaagtacaaaaaaacatctaaccaattaggtgcgttcgggtctaggtcgagagatctattttataaacgttcctgggcactcaaatttgagcgggcttttataactagattaaggcccatttctaaacaaaataatccaaaatcacttcatcagagcgtttgaaagaatcttcgaaacgagaatgcaaacgtaaaaacgatgggcttgggcctaagcgaataaaaaaggtttaaggataaaaggggaaaattcctgggtggtcttactctctttatccgcttgactaaaaaaaattggcgtcgagtgatagagacgaagaagaagaagaaaatgccgtgcctcaacctctccaccaacgttaaccttgacggcgtcgatacatcttccattctctcggaagcttcctccaccgtcgcgaaaatcatcggcaagcctgagaacgtaatccctttttctctctcgatttaacctctagttcgtttcgttctgttcgaattttgtttcgattcttcgttttctcctgagatttgccttgtgtgcgtctttatctcttaatcattttcttctccttattgaataacagcgattcgagtgttgttttcttcacatgcatgatatagaaaccctaagcaattttatctcgttgctccgttctattctagtggttcacatttccggagtcttctcttgacttatttgtacaatcttcgttggggttcttcttttttattttaccacgatttctaggccattcctggcccttgaatttctcattgctgaagtttgttttcaaaaacaatattggtctgctttgacgattgcttgtttatgttagtgatgtttaaatatttttgtcctgtaatgttgtttcttagatcattatctgattgcattgttcattgtggtaatttgcagtatgtgatgattgtcttgaaaggctcagtgcctatgtcatttggcgggaccgaggatcctgcagcttatggtgaattagtttctatcggtggccttaatgcggatgtgaacaagaagctaagcgctgctgtttccgccattcttgagactaagctatcggtgcccaagtctcgattcttcctcaagttttatgacaccaaggcaagcaattccctctctctgataacttttttgatgtagtgacataacatatgcaaatgtgttaatgatttcatatgcccgatatgcgtccatgtctcattttcattgttcgttgtctctctaggaccatcaaagtcaagaatatgcacaatgtttacacgctttacaccagcactactaggtcatgaatagggaacaaatacatcttatgtgtgtaagttcatcatcataagacggacctataacttttactcataaactaggcattataaacaattaaatcaaatgcataaaccgttccactactcgaattcaatctttacacccacactgttgagttatttaggagattcgttcaacttctctaaatccgttgtctaactggcttagagggtcatccatcatctggagtgtttatgcctataaccacctgatatatcaattatacatttcttttctcgtgtggttcttcttgcagggatccttctttggttggaacggggcgactctttaattccgtggtaggtgattagtgtgattgtcttgaaatgtatgatctactctcatcgatcaagtaactttgaactacttcgtattgtaaacatatctaaggtttgatggagttgcattaagaaataacatttatgctatatatgatgctacaacttactatcagggtaaacaatggttatttagtctttgtctactcgttagatataattatgtttagaattcgaagatgaatgttatcaaagaaaaaaggatttgacattgtcaagtctactactccatatgacagatcaacattgtgttaaaaatattttctattagggaaacttcctgtgactggaacattaatggtcaaatgcactttgcctaagtaatcaagaattattgtataaactacgttaagcaaaaaaataacctgagttataatatcaggaggttatttttatttttattttagcaaatgaatatagattagctatcagatgaagcaaggtgtataatcaaagttgaaagacgcgtaattgtgatcctatatatacataacactaccgcaacttcagcaacctctaaatcattcgtctcctaaaattttccaatctcaaaatcccaaaagaacaaaatcgaatg

SEQ ID NO: 34940 - DNA, 3003 bp, Unknown; identical to SEQ ID NO: 28664
  misc_feature (1)..( 3003): 2750-1469P.txt file - cDNA_ID_3083224; gDNA_ID_2926240; Annot_ID_204052

SEQ ID NO: 34941 - DNA, 3003 bp, Unknown
  misc_feature (1)..( 3003): 2750-1469P.txt file - cDNA_ID_3083229; gDNA_ID_2926240; Annot_ID_204048
aaatcttcagaaacatatctaaatattggatgttgaaaaagaatgcatcttatatttatctatttgtgcagattgttgcaaatccagtcttaacgtgtagaacgaattggagaggagcaaattctgactggtaagcagtttctgatttcccatacatttcagtgcattgaattatcttaggaattctaaggataattcctaaggatttttgattcaaatcttagtgattggaatagcaaacttggggactgttacttagcttctccactgaactattggacctgcttagtgtctccaccgaactgttgaggatcctgcacgcttctggtacttggttacttccataagcattgcatacatacatgacaaagttctggtagttctgttcaccaaagacatataaatgaaaagttttctttctcctttgatcttgaaagttattagcttaatttataggactaacctcttgaagtggtaggttattcacaaccacccatggtacaaatctatgtgctggataaagttcagaagtttcttcagcatacctctgttcaagctgcacattgtcacatagatgtcattttttcttgcttattatatgtttagctttcctgttgtggctgtataagttaactaatgttctctcctctgagcaggatttacctggtttccgtatccgttaatgtaacaatcaaccgctgctctgctcaatccaaccatttctaaacaatcagcccatttttcaagtttgttctccaagactagctgttccgtacagtagatgtatccaaaatgcttcatctgcaagtgacataggcagagcacatataattcacattaacagtcaaagcctctatatggtaatcttactgcataaatccaagaagattttggtagcttttaccgtttaagagacttaccacatcagggtatgcgtttattgcacaggcatgaattgcgttgagcgcacactcagcttctccgtgctgaaaacaaagcaacagtcaaatgctatgtcctaattctatgatgtacaatgcaagtgagacatagcaagaagagtccaagacctggcagagaatggttccatctggtctgatagcggcgttgccccatggaacgagctggagatcaatggatgagattaagccggtttcgaagatcttaggcaagcggttgacgatgaattctgcacagaaggggcatagagcttcgtagtataaacttagtgtaactttctggcttgaagacagagataagaggcagaagaagattgtgcaacttgtgatgcaaagcctctgatatgatgccattggtggaaacaagaagaagaggaagattgcagagaattgtttttgactcttgctttattcttgtgtctcattaaacaaggaaagtaagacataaaactgtttcttattactttcagtgattcgttgatgctttattattgtttaaaggcatcttgggcgttttggcgttgaaacaattgttgcggcgttgtttgatttaactgaaaacggcacgtagttagttttcggaatatcaaaacgacatgatgtttaatcgctgggttgggtcagtcacacttcgtcttccacatctaatccacctgagcttactgagtcggaacaacatcagccaataaagccctgaaccctaattttcttttggctttggctggagaacgactgtatgtgtgttcaacaatgtcgtcgatgaacttcaatccatttcaaaactggttcgagaaaccaccgaacccagtcccgtccatcaacttcgtctcgctcgctgattccttctttcccaagtcgcagtctccgaatttcgcttcgattggacttccaaaattctcaaagaagtccccaaaacccgaaacagcaggaaccgacgaaccaggaccgtacaagcaaatagcagagcagttcttatgggagtgtgagaacataccggattacaggcacactccagaagtggataagcttctcaacgaagatccagttttcgagaagaaggagaatccgagcacagaagagattgaagctgagcagaaatggtgggagagttttcgagcgagtcctgtggttcagtttatgactcgcgccgaggagattgccgacgatatgaacaagatggagctcgaggataacgacacgccttatcggaaagaagacaaggattactggagagccattcctcatgtcccgggctttgacgggaggcccatgcctaggaaggcgatcaaatcaaaggaagagagtgatgataagttttgggatttcatgaaacagtttctcttcggcctctggggtttccgtcaacgtccttacccgcctggtcgacccattgatgtggctcaggctattggttacaaacggctcgagaagcgctattatgactgtaagtgccttcgtttgcttaaccatagtgtgatatcttggtgaaatgattttgactctcccatgtcatgatgtttctgaatcgttaagggagcatattcaagtgtttctggatcgttaagacattaccgggttgcttcatattgatgttgtttctgtgtttgtgggatttgatccatattctgtgtttatgagttagtaggtggctatcatgattcagtgagaggctctggattccaagctcttgttgttcttaatgttgttaaattgtatagtcatagtttcttgtctatgcgcgagtttatatggttccacattttatcttgtttatgttctgcatgaaggtccaagcttgtgcctgttgttgaattgcaggaatatgatgaaagtggtatgcttttttgtgggttcctttgtgttggatcataaccttttgtttgttctcctatgatttaaaattgtagtcataatgaagactggtggttggtggtataaagaccgacttggccgttctagaggcccttgtgagattataacccttaagacggcttatggagctggaataattgacagagatactttcatttggggcgaggacatg

SEQ ID NO: 34942 - DNA, 3003 bp, Unknown; identical to SEQ ID NO: 28660
  misc_feature (1)..( 3003): 2750-1469P.txt file - cDNA_ID_3083255; gDNA_ID_2926240; Annot_ID_204039

SEQ ID NO: 34943 - DNA, 651 bp, Unknown
  misc_feature (1)..( 651): 2750-1469P.txt file - cDNA_ID_3083257; gDNA_ID_2926240; Annot_ID_204037
acgaagaattgggaaagacgatgagtctctattctttacgggctgcgaagaagctggcctggaggtgaagcatctcggaaaccgagtttattgtatcaagcttagagaaagcaacctctgaagaataggctgacaaactcatgaatcatccacatgctcgcctctgaaactaaaggttctgtttgtttctctcgctgcttatttggatttgctttttctgtcaaaattaatgtgaaatgagatagtgtcgattcttaactaatgtttcccttaatcaattgaatttgatgggtggacggaaaaaaaaactgtatttcatttgtagtataatatgtggggaaattagtgaagaaaagaacatagaatcaatattggcattttctttcaaaaatggggcaataagaaaagaactattaattagaactgagacgatcacacacataaagaatcgcattcttgctttgccgtgagaaagtttgaaatgaaaataaattgtgatactttgcctgtgtacatacataaagagtcttgggcattgcatatacttactatagcttcagccaattgttgtgacagctaaacattaaatcttttcacacaaaaaaaaaaaaaaaagggaaagacttgtaagccttgaatctgtaacccatg

SEQ ID NO: 34944 - DNA, 3003 bp, Unknown; identical to SEQ ID NO: 28670
  misc_feature (1)..( 3003): 2750-1469P.txt file - cDNA_ID_3083280; gDNA_ID_2926241; Annot_ID_204099

SEQ ID NO: 34945 - DNA, 3000 bp, Unknown
  misc_feature (1)..( 3000): 2750-1469P.txt file - cDNA_ID_3083297; gDNA_ID_2926241; Annot_ID_142893
aggtaaattacactgttcaatttaaacgctgcgtttaacaacatatagatttccgctaacttctagcataacaatgtgctaaagagccaaagtatattggagattggtgtttgttacttgtacaataattaatcataatgaaagattgttctctctgtgcaatctcatattgcaaatcaaaatttggaccatatagccaaccaaaaaaaaaaaaaacagatgaatacacttgaaaaactgtgccgaatatattggaaattaactcttttcaaaacttaagtggaaaactaaacgtttgtaaatgaacaaagagtcataaacgaaacttggatgatccaaccatatcctctcgttttattttaataatagtgtggacatcgacataaataaacgaataattctagagaagatgaaaagccctagttgaatttttcaaatttttaataatacagtagtgtggatatcgaaaataaataaacgaaatatgcaaaaacctctcggatacgtaattccaatatatacttatatatgttctcacagtaaaaaaataaatatggtgcaaggagaatttgattggaagtaacgaaaataaaactcgaaatcaactattatcatttaggcatttatgatgtccacacgaatatatatatatatatatatatatatatatatatatatatattctacttcttttttcgaatacacgcattataccaaaaaaaaacttataattactctagagaagatcaaaagtccctactagttgaacttcaatgactacacacattaacaaaaaaacgtttaaatattctagagaagatacaaagccctagttgaatcaaccacgagtcatggcgcttcgtatgaaccatgtaaggtttcttcttatcctcattgtggttgctttcgtggccggagaaagttttacggtgaagcaagattcagcaaagggagatgtaatttgggaagaagtatttcacggggattatggttcttggagcccgactccaaaaattccaagacgtagtccagcacctattcctcatgatgattttgcaccaccacgtaggttgaaagcgtaattagagatttctgattttgctaacgatcaaagcgagatttttttatagttatagaatctcttgatacgttatatcttttttaagcatctatatattatactatagtctatagatttcgataagaataatggttttgagaaaaaatttccttgtcatgctttaaattgataataagttttttatgccgcatatcactgttcagtaatctgtttctaaattagtgtttttcttactcgatctctacctatctagcgtaattataccttgtaaatcaaaatttagaccttaaaacatgtttacgctctgatcaatcgaatgtgctccagaatatcaaaagtcggaaaccctaaaaactatatttcgtggtgcgacacaagtctcttacatttctgaacatgcaatagtaaagctgtatcgctagcttatcgagattattgcatctttatatacttctagtgttctatctctttgtactctattttttttctgttttctagaaaattatgaaattattatatcaccaatatttgttacaaaaacaaaacaaaaaggtgttcttccctgcaaagatcaatgggtgaagagagtgtgaatattgcttgaaatttagtttgtgtgaaaaaagcatattccaacacactcgattttcattgaattaaaaatacgaaataggaaatttgatatttaaataggaaataggaaataagatcagctatatagtaagaaaatttgatatttaacttttgtttttgatgtgcgtatatatttgttatgtcttgtaagttgtaaatctacaagtttcaaaattgattaaaaacaggtgatttcagagggatatttgaaatcacatggtagatgtgtcataatcaaacacatgtttaagaagggtcccacaattacgcgttctatttatttaacttttattggtacatctttctactactacctttcttgtggccctacttttactagatcataaaatcatgatacaagcttgatttatgattcagtcaaatcaaatctatattatatgacctaaactttggaacattactcaaagtgaaacatcaataactcattaacacatctgattactgttgaagtatcctctctagtattaataccaactaattctttcctttcaagtgtcaactatgtatatatctctatatatattactaaatagttgaaatatcttctgatttttcacaaataattacgtagtattattagcgaactaacacccacattccctgttcaattaattcaccaacctcaattaatatgtgtattaagcctgaaattattagagacagatattttgtgcctcactatatcattaaatgtcgtttaaatgttcttagtcaatgaacgctctttcttttcagatttcttttctatcaacaaaaactgatactaatatgtctatatatataacgcaaacgtttaattaaagaattgacttaaattcttagttaagttacaacattcttttatttattgtaaactaaaatttcctaaattataaagacaatttttgtactaattatttaaaaaaaatattatataagctgataaaacaggtcaagtgatatttgacgtcatcatttctatcgaggaaaataatatttatccaaatctaacagtgctataaaattcaacttcagcttaaaaaaataaaaataaaaattcaattacggcgactttctcatcttcgaagagtgttcaaacacgaatcaaacaaaacaaagaaaacgaataaaaagttccgatctttgacgaacacagagaaacataagaagaattgcaattttgtgaattttggtcatctctgtctttgaaaaagagaaaaaaacagagagagatttgcggtgacaatcaatcaaaaagctagaaactttagagtaaacagagaatg

SEQ ID NO: 34946 - DNA, 3000 bp, Unknown; identical to SEQ ID NO: 34945
  misc_feature (1)..( 3000): 2750-1469P.txt file - cDNA_ID_3083297; gDNA_ID_2926241; Annot_ID_204093

SEQ ID NO: 34947 - DNA, 3000 bp, Unknown; identical to SEQ ID NO: 28669
  misc_feature (1)..( 3000): 2750-1469P.txt file - cDNA_ID_3083311; gDNA_ID_2926241; Annot_ID_204088

SEQ ID NO: 34948 - DNA, 3000 bp, Unknown
  misc_feature (1)..( 3000): 2750-1469P.txt file - cDNA_ID_3083321; gDNA_ID_2926241; Annot_ID_142885
attccgtgtacgtcctgttttccttaacacgtacacaacgaccaaacatgttttcctttggttcaaatttccatttatcttatttgcatctccactcaccgaccatagtaaatacgggaatatccattacccaactgcatcataaattcaggagaaacccattaaatgcaactgaaaacatgattatatctacaaaaataaatagaatttcgatgtacacacttagaaacataaatatttacacatttagcattttcaaccaacaaaattggaaataaaaaaattctgggtttttctataaaaaaacaaagtcgatttcgaataaaatgaagatcatagcgtgttataacaaaaaaaatctttaaaacttcattacttacacgataatgcttatcttggctccaaacttcgtaaatagacaagatcaacacttcttgagcatcaatgtacgttcgcaattaatgtttgttcctggattcatctttaactcaacaattattatcaataattttataatataataacatgtaatgatgattttgcattaattataacaagagtcacgtctaaactttttgggccattaaatgttgatgtcatttcgtttataatgaaaaaatctctcttctaactgtacagcgcgctcctcaacgtgaaacaaaaatatctctaactaaaccggaacagtgtacctaactaaacctgactaactaaaccgtacattcaacaatttctcatctgtagcagcaagggcaaaatggtcaaatttcagctgaaaagacaaaacgtgaaaaccacctttcactttggcaattcctgaaaataaaacatgatcaaagggtgtggcttgcaaattacccttagataaatgagaagcgtatataaagaaattagtaggagcgtatcaacttaaaaaaggaaagtttgttacccgaaccatgtatagctgttagattatcacctaaccgtgtataacggctagattatcaccgaacctaaggttggtgttttgctctgggctttaaacaaaccctaagtgaaaaggaaaaaggaaacttgagtctcaaacaaataagtttataaatacctgcgtctcgcgtcttctatctccacgagttaaaagatgcaatttctctgattagctttattatcaattctcttcttcgatatctgtctgcttcaagatgatgatgctctgattctttcttcgcccttcgtttagaaagaatcattccacaagtcaaagcccaagaaagactcatacatatacaacggatctctgttcacttgttatagctacgaagaagacgagagagagagatcatcacacacgcaagcatcacgtctcgtataaacgacggaggatattcacttcgccgtcaatttgggaccacatctcaccgtagaaagagagagcgagacgattcgaaggagttaaaggcttacatgtcgccgggatttaaggcttttggattcatgatgttggaggttttctccgcgatggagattgagcaggtggagggatcgtcggagattgggggattcgtttttccggtaacggttactgatgatcgcatgtgctctcagatggtcgatgtgttctcggaggcccaacacaaacaatttcagcccatcaaacaatgagccccattgtcaggttatttcgcaactcattttcttgtttaatttagaaattaatatatttttaattaaagggtttttcctcagtgatgtcgaaaaaaagggttttttctcattaatttttaaaaaatcttttgcaatttttattcaagtttttgtttaaactttaagttttttttttatttttgaagtaatattttagatcaagtgttttatttttaaaatatacataatatttttgttttaaatgttaaattttagtatgtgtaaactaattggacacaacatcccgtccataatatgagatccttaagcggtgttctaggtttaatatgtttacatatatataaatgtttaacaattttttattttaaaaaaattttaaatttgtattttttctaccactatttaaactttaatattttttttatttctaattaatattttagataaaataatttttatatatacatagtatgttttttgtttttaagtgttaaattttaaatatgtgtaaactaaatgaatacaacatcccgtccataatataaggtccttaagcggtgttctaggttcaatatgttatacacatctttaaattttaacattttttatattttaaaatatattaagttgtatttttcatatcactatttaaaatttaaggtttttgtttttgtttttgtttttgtttttatacaaaatatttttgttttaaatgttaaattttaattatgtgtaaactaattggacacaatatcttgtccataatatgaggtccttaagcggtgttctaaattcaatatgtttatacatataatttttttacattttaaaaaaaataaattaaaatttgcaattttttaccactattaaaagttttttaatttttgaaaaatatatataatagtaaaaatacttaaaaatatctaaaaataaccgaaacaccagaaaatatctaaaacaatggatactaaattttaaaactgaaagaagtggaaccaaactgaactaaattttaaaatattcaaataaactttataatcgaaagaaccgaaatcgagtggaaccgaaccgataaccgattgggtaatcgcggaggattactttcaagaagagattcgtgatcttagccgtacacttgtcgggatctgagccgcgcctgtaaggagaaagagagagatggttctagttttaaaatgcagcgttttgtggaaagctcaccatcgacggtctgttactgggccacgtcatcgaaacggataaaatggaaccatccaaaaggaagatagaagtaccaagaagattgcggagagtcgtgaaaagttttgagctttgatcactcactcactagtaatg

SEQ ID NO: 34949 - DNA, 3000 bp, Unknown; identical to SEQ ID NO: 34948
  misc_feature (1)..( 3000): 2750-1469P.txt file - cDNA_ID_3083321; gDNA_ID_2926241; Annot_ID_204086

SEQ ID NO: 34950 - DNA, 3000 bp, Unknown
  misc_feature (1)..( 3000): 2750-1469P.txt file - cDNA_ID_3083338; gDNA_ID_2926241; Annot_ID_142882
acaaaatgcatacaaattgtacttttaaatatttcataggctttgcataactaaaatacttagattttagatgggaaaaaacattgaagataaccaagagtatcgtcttgggaaaaatatctcccctcgcctcggtggaatatctggaggtcgatcttgtccaataactcgctgttgaaactcagctggatttcggctgttagaccacgatgagctagtggagcaagaagatcgttgttcagccatccaaagtttgtgcctaatggcctttcagcattaacgattctaactaccgcctcgtcttccgagtcttccttataaatgacctcgcactcgatctttacaccagccattctagacttggagattcccatatggctcaagttttcgacttgtatatggaatcgatcattggagccacactctagctccgcgccacatttcttaagtggtatctcctcacaacttatggtagaagatgatagcttttctcgggtagttacgtaaatgacaaaggtgagatccgacaaggaaattttgggtttggtaagtttcacttccttagctccggaatgttctccttctttggccatcatcacctgtgacttctcttttctttgttttggaatgagttttatgttattcaccatccatatttttagtgttacaaatcttctttatatctcaccacaatgactctcaattatttttatgtttttttgcattaattctcattaattgttaattgattaattaggagtaatttttataacaaaatattgaattcctataatctccttttcacatgcatatattattaacttccaaatttattgctcatggtttaaacattatgtgttaacatatttttatactacattattattgtatgtatttaatatcataggtttaaatataaatttaattaataatatgcaattatgcatggcacggggaaccactaagactattgtcatgatattaatatgctgttaaagggctttaacgggcttcggggtttaaaaggcctcagatcttagcaaccgcttaaattctcggtttagtttcggttaagacgaattatcatcaaattagaattagaagttgatattccttttggttcgattcaatttgttttggagagaaatgtcatttctcctccgcttaacaccgccgccgttatctcaccgccggagctcatctctctttctcaaacatccatttcaacaatctccgagacctctgagctccggtaaaccctcgaaaataggggataaaaaaaaaataggggattggtttcttgttcatcaagcatcaacgcctttgcagtaaattttttggtgcaaaacaaagctcttgattatttaggtagaaacgcttacatatttttaaatttcacagactttgtatatacataataattagtttttagaggggaaaaaacattgaagatatctaagagtatcttcaggggaaaaatatctctggtcgctttcaatgaatatctcaaggctgatcttgtcaagtaagtcgccgtttaaactcaccttgacatcgccggttaggccacgtctgattagatcttctggagcaagaagatcgttgaacaaccatcgtaagtttgtgtctaatgaccttcgacctttaacgattgtgacaatgttttgccaatctttcttataaacgacttcccaagtgatcattacatcatccataccagacttgggcagttcaaaacgactcaagtctacgatttctattttgacccggtcattagggttaaactcgcggtccgcgccaaattctacaactgttaacttctttgatttggttgtgtacacgcctatgacaaaggtgagatccgacatggagattttgggtttgggaagttccttagctcccgagtgttctccttcttcggccatgaccaccggggacttctccatctacttttaacctctctttgttttggaatgaattttgtgtttatatattcaccctccataatttatatatagtggtacaaatcctcaatgaattaggaatactggaactaaaattgattacaattaaatatctaatatagagttttaattttcgtcatatattctaataatatagagtatttttttgaataatttacaaaatatatggaaatttgtagatttatactagctaggtgtattatgggccattctgcagcatttcatggttatgagtccaacatttcatactaggtggattagatattaaaataatgaattaatttaattactataataaattaataattttcagattttattatttttagagattttttatgatttaatttagtattgattttttcttattaaatattagttagataagggtgttaaatattttgacaaatgttaacacatatttttatctaattagatttattctctgagttatttcaaactaaattaaaattctctcacaaaacaaaatacatatgttattaactgattgtaaactttcatttgtgtcaacaaactacttttacagttttgaaacaacttcttattcatgacatttgctctataattatactaggtggtggacctctcccaccatgttacgaacctaaatctaaaatacatatatcaatatgttacaatttcaactaaagttaatcgaaacgttttaaattgcaaacaaaattaactgaaatttagtttaaatgtttttctaccaaaaactataaatctcttgaaatattcaatatagtgtgtataatgagttttaaaatttatttaatagttgtaaagtaaaactatttggggttaaatatcaacctcttacttgataagatcaggttgggcctcgggtattaaactcataaaggcctcagatcttacttcttagcaatcgcttaaatgttcgggtttaggttcggttcagaagaattatcaccgaattagaattagaagttgattcgttttggttcgattaaatttgttttggagagaaatg

SEQ ID NO: 34951 - DNA, 3000 bp, Unknown; identical to SEQ ID NO: 34950
  misc_feature (1)..( 3000): 2750-1469P.txt file - cDNA_ID_3083338; gDNA_ID_2926241; Annot_ID_204083

SEQ ID NO: 34952 - DNA, 3000 bp, Unknown; identical to SEQ ID NO: 672
  misc_feature (1)..( 3000): 2750-1469P.txt file - cDNA_ID_3083344; gDNA_ID_1620305; Annot_ID_152801

SEQ ID NO: 34953 - DNA, 3000 bp, Unknown; identical to SEQ ID NO: 28668
  misc_feature (1)..( 3000): 2750-1469P.txt file - cDNA_ID_3083344; gDNA_ID_2926241; Annot_ID_204080

SEQ ID NO: 34954 - DNA, 3000 bp, Unknown; identical to SEQ ID NO: 671
  misc_feature (1)..( 3000): 2750-1469P.txt file - cDNA_ID_3083348; gDNA_ID_2926241; Annot_ID_204077

SEQ ID NO: 34955 - DNA, 3000 bp, Unknown; identical to SEQ ID NO: 677
  misc_feature (1)..( 3000): 2750-1469P.txt file - cDNA_ID_3083365; gDNA_ID_1620305; Annot_ID_152793

SEQ ID NO: 34956 - DNA, 3000 bp, Unknown
  misc_feature (1)..( 3000): 2750-1469P.txt file - cDNA_ID_3083365; gDNA_ID_2926241; Annot_ID_204072
ggcgcgattcatcttctaagcacgggatcaagcgattttcttcaaagctattacatcaacccgatccttaaccggatattcacgcctgatcaatactcagatcgtctcatgaaaccctattccacctttgtccaagtaacttaaccaacaccacaccgtacctatctttaacttttccggtttactctaaaccgatggtccaatcctttttttgttttggcagaatttgtatgatttaggagctagaaagattggagtgacgacgttaccgccattgggttgtttaccggcggcgataaccttgtttggtgaaaccgggaacaataatacctgcgtggaaagactaaaccaggatgcggtttccttcaataccaaactcaacaacacgtctatgaacttaaccaacaatcttcccggtctgaaattggtcgtctttgacatctataatcctctcttaaacatggccatgaaccctgtcgagaatggtacgatttctatcaaaccgcaactttatttaacgactaacaccgacactttaatttctcgttttaaatatttcaattttttatatttttgaacgtagggttttttgaatcaagaagagcatgttgtggaaccggaacagtggaaacgtcgtttctatgtaatgcaagatcggtgggtacatgttcgaatgctacgaattacgtgttttgggatggttttcatccatccgaagcagccaatcgtgttatcgcaaataatcttcttgtccaaggaatacccctcatctcttaaacctaagtttattccaaaacattgattcagatagttaagatgttatatgatcaaacaaaacacagaaaaaagatataatgaaaactattcttgatataaacaaagaaagctcaaggggaaagttagtttctttcacatgatttaacatgggatctcttcgtggtcgcgtttggactaaacccaacgaattaatgggtattttaatttacaaatgggttcccgaaataattaaaaagaaaaaatctttgtttctggtatggcagaatagtgtaagaggtaacgtatgtctctttaaattcgaatacgaacgacgtactacgaagcaggttcaaacaaactaaaagttatcttctttttcaagcaactcctttaatctctcttccaaaaaaccctaatcattcacgacttcttggtactcagtcctctcaaaatcttttactgcattcaaccagaaaatgaagatgtttattacaatgtcgatgtgcttatcgggttatcgcctgtttctacgccgggcgttgggaccgggtgagacacttgtaccgggctctaatcataatgggagattcagttgttgatgccggtaacaacaaccaccgtattaccctcgtcaaagccaattttcctccctacggacgtgacttcgtcgcccacagtgcaactggccgtttctctaacggaaaacttgccacagactttaccggttcgaaccagcctagctaattcacattatagtacaatctatcatgcatttcctttttccttaaaatttgtttgttgttgagcagctgagaatttagggtttacatcttacccggtggcttaccttagccaagaagcaaatgagacaaatttgttaaccggagccaatttcgcatctggagcttccggttttgacgacgcaactgccatattttacgtaactaattaatctcctcaagcctgtttaatgtagctatatattaagttagtaataaataacattgatatggtcttatcgatcattattgtagaatgcaataacattgagccagcagctgaaaaactacaaagagtaccaaaacaaggtgacgaacattgtgggaaaagaaagagcaaatgagatattctcaggtgcaattcatcttctaagcacaggatcaagcgattttcttcaaagttattacatcaatccgatccttaaccggattttcacgcctgatcaatactcagatcatctcttgagatcctattccacctttgtccaagtaacttaaccaacactacaacgcaccaagttttaattttaccggtttactctctaaaccggttttcttttttggcagaatttgtatggtttaggggctaggaggattggagtgacgacgttaccgccattaggttgtttaccagcagcgataaccctgtttggtggggtcgggaacaatatgtgcgtggaaagactaaaccaggatgcagtttccttcaatacgaaactcaacaacacgtctattaacttaaccaacaatcttcccggtctgaagttggtcgtctttgacatctataatcctctattgaacatggtcataaaccctgtcgagtatggtacggtattttgacatttcgactaacacctacattctttttttttgttcccattaatatcttttgttaatggttttttaaactgtagggtttttcgaatcaagaagggcttgttgtggaacgggtacaatggaaacttcgttcctatgtaatgcattgtcggtgggtacatgctcgaatgctacgaattacgtgttttgggatggttttcatccatccgaggcagccaatcgtgttatcgcaaataatcttcttgtccaaggaatacccctcatctcttaaacctaactttattccaaaacattgactcaaacagtcaaaaatatgaatatatgatgaaaatatatcctagatcgttatatagttcaatgaatggttggagattattaactaaaggtttggtttggaaattattgctttctttaataaataaatttgtaaataaataatttcagttacggggatatttgatcatatcaatagtaaagagcgaaatgtatatatttcccactaatatagggaccttaaataaattgcttgattacaaaaatggtccttctcttctgaagtaaatagaacaagtgagaaaggtttatccatggcgatttaggcgcccaaaagctcaaaaattcattcatg

SEQ ID NO: 34957 - DNA, 3000 bp, Unknown
  misc_feature (1)..( 3000): 2750-1469P.txt file - cDNA_ID_3083424; gDNA_ID_2926242; Annot_ID_142919
cgcaattaccgcgtttaaatttcccacaactaccagtggattggccatagtcggcgtaagtgatctttgaaataacatatccttgttcgcaatcgaaatccaatgcgattggtttaccatccttagcctctttatgagtcgcgcacattgtgtattccgctgactcactaagagaggaattaatggagctagagagactacgtttctcgtctccgtgaaaagaaacgtctatctttgaagcgaaactaaacacgaaggaaagaaacagaacaacaagcaaaataaagccatgaagacaacggcaatgtgagtctcccattttgttgttggtgttgtgttctcactaataatcaaaaggaatatgagaatgaggactaggctatttatggataatttttatatacatttgagttataatgtgaatgtggtcgtgaagttttctctccatttctcactctccttcttcttggcttttgggggagttaatgaataacaatccttttgacttttctacgattacttaataacaggtttgcattttcagtagcaaaaataagtaaatatcattgatttttaaattgtttcctaaataataggttataggttatagttaatcacataagacttttttagttttgtacaatttttgtgactaactattttataaattattttgcataactttttatattttagatataagttattatttgaaaatttatttcattcctataaattacattttttcattttgcttaggggtttataaactctaggttggtgccacatcgaagcatgacttgctcttataggtctagttgttgaactatcaccgcaacatttgataaacaatattaggaacatgtatgaaaaatctgtaactatggcaagtatcaaaaagtttttgacaaaacaagttcttgttctagaaaaacttgtccatactcatgaaaactcaaacaaatctgtctcaaaagttccgaaaactatgtaagtgtcatttttaaatcttgtcttcttacaaatttcatttatttttaactaatcatacttataaacgaattcttataggatatacctgcattcaaaatcaaggatttggtatataagagagacaaacaagtgagagaagaagagtttatctaacttgtcaacgacggccctctacttgttgtgatagatacttatgaaagcttaaaggaatgtaaagatgtaagtggtatttgtagttggtataattcatttttaaacatattacaactgatttcatatcttgtaaattttgaatatgacaaaatctatcatggtcaaacaaatcgaaaaaacacaagcacatgtggccatgtagtcttaatgactggtttcgacacaactctggaaggtgtcaactactggaaaattcagaattcttggggtacaaaatatgggcataacggttttggcaaaattataaggaagtccagccagtgaaacaacaaacaatctatgtttctcaaaatcattcagctgttggtttgatattgagactctctcttctatatgtttgctaaataacttaaggcttcctttttctaggtttagttgcgagtagattttgaaaaacaaaagatgcatgaatggtattaagcgctgagctttactgatagacaatactaatttggttaatcttatactatttatttggggagtacatcgtaagttataattttgaaagtataacaaatatcattaggatgccatttaaaaacttaataatataacaaaattattccactaactaaactcgcacgtcatggatcagaaatcgggtttacaaatatttacaaagattacacaaatatttaaaaacaacattaactatttagttagcaaatggtggtagaaaaacgacagtttgttaaatcatggacaaacggtaatctaaaaaaaaaaaaaaaacaaatctgtagctcatgactttttcgattggacagatgaagataaacgatatggaccatatgggtagcagaagctaagcttattagaagctaaagatgagactcgtcaacagaaagcgaaaattaagatgcttaaagaatctctaaagatcataaatatataagatgtgagtagtgtgaacaatacgttaatgaataaatacgagtaagaaagaaactataatttcaaaatgaagttatggcaattaatgagaagaaaaaatgcttcgtcgacaatttatcgtgttgttttggaaaggttacgagactggaaattgaagtggattcaaaaatagtgactggtttataagatagcgatcattaattttcatccactgtcatctttgatacgtttttgcgataattttatatcaaaagattagataatgcacataactcatgtgtataaaaagttaaatcgataactatgtgttttcatttatatatgttggatttttattcgtttgagtctatttccgaacttgttcatttgattttgttcttaaataccgatgaagctacttatccaggagatgttggactgcagtttattttcttacttttttccaataaattggagacaataatggtctcttccatagccttcgaccaaaaacaagaaagaaagaaacaagaaacgcccaatttttaatactcgtactacacaatttagaagtaagggagccgaccacaattgcttccttacacgttaagtccaagctctctcgatgcatgaaaatcccacgtggcatggttcctcaatagaacgatcttcttagatacgtgtcgggcgaaatgatatttggaagataagttggaaaataagaaaaatgcgtaccagaacacacgtggcaggttttgctttatcaaagtcatgacgtggcatctcattggaaccaaaaacttgctataaaaacaacaagcagctctaaatgcttcattaacacgacgagtattcggcaaagtttaaagaatccatcttaaatctttacttggaagccaagcaaacaagaaacaaatcatg

SEQ ID NO: 34958 - DNA, 3000 bp, Unknown; identical to SEQ ID NO: 34957
  misc_feature (1)..( 3000): 2750-1469P.txt file - cDNA_ID_3083424; gDNA_ID_2926242; Annot_ID_204134

SEQ ID NO: 34959 - DNA, 3003 bp, Unknown; identical to SEQ ID NO: 28682
  misc_feature (1)..( 3003): 2750-1469P.txt file - cDNA_ID_3083430; gDNA_ID_2926242; Annot_ID_204133

SEQ ID NO: 34960 - DNA, 3000 bp, Unknown
  misc_feature (1)..( 3000): 2750-1469P.txt file - cDNA_ID_3083470; gDNA_ID_2926242; Annot_ID_204123
ttccctagtcctagagatgggtaagaactgagcttccctatatctgaatgatgcatcattgccgacatttcactttgagtgtcagaatcatcaggtggctctaacgcaagagctgaatcccaaaatttctgcatcatcgtgtttgccatatcatttacagctccagaactgttctccaccattgaaatagctgcgtgagtaatctgaagaacgtctacacaagctgcagctgatccatctttatctataattggaagatgtagaaactttccatcatgcattgtatgcaacgcatccagaatcgttgtctctagcgatgcacattcaggattcggtgtcattaccttctcgacaagagtcaattcaggagataaattttgtgccaccactcgcatcagaatgtcctttgaagtcaagattccactgattttgttccccgtggaaatgattacagagttaacccgcaaatccctcatccttttcgcagcaactgaaacaggatctgatggtgctacaagtgcaaccttcgaattgtctgtaataatcgttgacaaggcgggtttaaacattctctccctcaaggtttcaatgaaagcatacggtgcagaatatccgcttccccattgcttctccacaccttccactgcagcagctaaagcactaccttgctctgcagctttctccatcctagaaatagcatcatacaaacactttgtaatatccaacaaagcaatgacttcaccattctccacaacaggcaagtgtctaaacttcccttgaaccatcttctgaagagcctcaagcgccaacgaatcagaagtaacaaaaataggattcctagtcataaccttagagaccaaagtttgatccggtctcaacccttcagcaatcactcttgtagctacatctttatcagtaacaatcccggaaagaagcgcacttgaatcagtcaacaaacaagcatcaacacgcctagcagccattcttcgacaagcatcgaaaacagtagttccttcaggaatagtaagagctttcgataacctaagcttcttcactgttctctctccattagaaggagcttgagattgaggttgaggaggaggtgaattgggttttgaggtgttcccattaacacttccattctctgattgtactggtttcttagaaggtggtggtcctcgccgtacagtagaattgcttctcctccctgatgttgaagaaggacccgtcgcttgagtactcatattcggtcaatctagggtttacttagatcctaaatccgtcaaaaatgattcctttagatatcaaactcgtctctgcaaatgaaaaattcaacctttaattcaaaaactattgaaatttcatctaaagcacgaatctgaataaaacccaattcacaataaagacgatttgctctgagaatacgatgcaacatacacgaaaaggattcgaatttaacggacgagggaaatgaaacaacttgaaaccctaaggatttgagcagaagttatgtgggaagattgggaatttagggtttaccttcttctttcttcttcaaggtctctctctcgagcacttttgttgccaaaaaacaaacggctcttaacaattgagttaagccatttatcgagttttcattggttgttcctgtttccgcgtgtgtggtggttcgccacctcctttcttataatcgacgactaaaaatgttaaatataatactaatatttctttctataaaattcgtaaaagcaaaaatgttttttttttttctgataaatgtctataaatcaccctttctttttaaacaatgaaatttgatgacatttctctcttgtatctagaagagttaatggctaacataaatacaaaatttttttaattcaaataaatatgatttgtgtgggttacatggaaaaattgtcaaataataaagcaaaaaaaaattgtatagatgcagtgcaagttgtttctggtcaacttgccgtcgagcctcacaactgtttgttacaagtggactcgcatgtaattccctcttttaataacttaccagttacaccatccaacatgtgatttgacagaaaaatattttagtgaaatgtgatcggtgcagatttttctatgtacgtttaagcctttaaggtagacgtttaatgcaaaaatatccgtggaaataacaacaccgattaatggaaccaagtagatacctcctccgtttggatggctcaaatgcaaccatgatgcaagcttttgcgatcgaccaaagtgagagaactagatcgagatggattattcggaaccattacggcacccttatgtaatggcagcatcttaatagtaaacaaaagctttagcctaaggttttagcttccttcactctttgcatacattgtgaatctgcggttttagatggaccatagtggaaaaaggctttcatcaataactcgtggacttgatcaatggtagaaaagagaacacatagatggaaaactagatatttgatatatccatctttggttcaaactcttatccagtgttgaggtgatatacacatgaagacataacaatcgcattgccgagaaactagtattcattaacctttttctctaaagacattgtcctatcaatctaaaatttagatgttaaaaaagaaacccaaaagatgtagctatcttaaaatgacagtcgtttgcgagactggccaggccatcccatgggccataggctcaagttgtgcttggcagaatttagtgattggttttttttgtataaacaatcattagtttaaggctttacttgcaacaaatgaagagtttaagggttctttttggtaattttcccgaatcacacaagtgagctagctcatcagagtccacgagcttcccactaaaaaattgaaaattgttgcttctgtcatctgaaattaaacaaagcgagaaaaggcgatacaaacgatttcgaatgcttcatcttctcctttgaaaatccttcttctgcttaatg

SEQ ID NO: 34961 - DNA, 3003 bp, Unknown; identical to SEQ ID NO: 28680
  misc_feature (1)..( 3003): 2750-1469P.txt file - cDNA_ID_3083475; gDNA_ID_2926242; Annot_ID_204121

SEQ ID NO: 34962 - DNA, 3003 bp, Unknown
  misc_feature (1)..( 3003): 2750-1469P.txt file - cDNA_ID_3083484; gDNA_ID_2926242; Annot_ID_142904
gttacggttgtatattatttgatttttcctatgcattttccattagactctatttgatttttcctatgcatcttctattagattctagttcattctttcttatttttttaattcatttgtcttgggtggctaatgaagcaataatggtttttagtttttatttgagatatttgtaattaatgatgcatataatttactgttttacgtggaaaaacgtattctaatttcttgtaaattgcaatcgcattgtatattgtaccgaggaaaaggatcgatttgcctgcgtgtgtataagctttatcaacgagatccaaagtaatctatatatgacccattgacctaccatcatacacaaagtcaacacacctaaaaatgattatgatcatgttaatctattaccgcttcacatacaattgataaaaccaaactaaaactaaaactaaatataaatactataaactagttaagtaacccacgaaaaagtctcggcttggctataaaaatgcagtcaccttccactttttattatctttctgatagtcattctatcagaaatattttatacattagactgatttgtagtattttcgtctgcttaaatttgaacatatcgttcgttaatcattaatgtttcctaagttagtaacaggcctaattcttaattgtatgttcaatacttttatcttatgatctgatgtctgaactttgaggtaaaatggtactagtatagttccatagttatgaatttgaaagactgattaaaaatatatattcaaaatacatatcaatctacagtgttctttttttgtttgctaaattatatgaatctacaaaataaaaacgttatttcttcgaaagaagtgttgtcgaaaaaacattttgaaaagaactgcgcattggctacctgtcttattctgacaatattgctccaccgttatattttaaaagcattcacatctatttttatcttctcaccaatcttacctactaccatgtgttcgcagtaaattaagacatacgacgatcgaaatactgtaattatttatttttattgattacactaaactaatcttttcatcaagataatctttcttatgggatttctgattgtaaaggggtttttcctcaatttttccctattattttttcaatttagttttgcccaaaaaaaaaaaaagaaactatttaataaagttctataatatattattgatataatccgattgagttagctcgattagaagaatcatagatggctagataaagacatctagtcgacctctactactctagtgatctaagattcaactggagagcagtgttatgactttgaaaaaaaaaaaaaaaaaaatcagcatgatatacaacttttatagattagtcactattcgatgaatgatgggaaatttctttggcaatttgactttggtcaaatatgtcatgatattggtggaagtaaattattgatcatcaacatttccgggaggtgaaatcagttttgacatgacagtatataatattaaaatacttgtttctatgaataaaaacagcataaatccaaataaagctcgaattatttaaataaaagaacaataacaattcagataaatttatgaacaataataaaagagttttgaaatggaattaaatatcttctgaagtgaaatatgtaataaaaatacagtagtaatttttatttgttttgaggcataataaaatgaggaaaaaacccgcaaacatatgctgtgggacccaccatgttttttttttcaacttgatcatctcttaactctctctcattcaccagaaaacaaaaattacacaaaaatcaaaacttttactttttatttctcctctctggatcttcctcttcaaagctcaaggccattagggtttatctgagctccaaaatcaccctaattctagtgtatttctcagcaagcaagcttcttctttttttgtcctgggtaagcctttgttccttcaatttatcgccagcttcttctttatctcttaccttttcttctttgcacgcctccattagcactttatttatttttcttctgtaaccctctctttgatttgctttaattcatgagatttggggaccgtattcagggttttttttgggtgggtttctctgatttttttttcctttttcagacctttcattatctctatgtggtcacttaaggtctctgcagtttcaattcaaaaatttagtttaaaaaaaaaaaaaatctgggtgtgtgttcattagctagctcctctttgttcactcattggctctctatgatttgacatttaagattattgctgcatttaattgtgctaaatcgattctgcactcatgcttcagctactgttctttgtgtccctgtaaatttaagtttttgagatctgaaactataagaaattttccgattttggttctcattagttgttagatctcttatctcactcgaagcttctttttttacgcggtttgatttattaatttcgttacttctctgtaaattctcgatctttagggttcttctcatcccctggtttaataatgggtccaatctcagttcttgttcactctaattttactttcacaatatctccaattacgcagatgctttttgacaaattttctccattaaaagtgtcttcttttttagctgtattaaatttataggtctctctatctgtactggtatagggttcatgattgagtctacaaaaacataatgaatgacctaaaagctattaactttcgtttctagatctgcttgcttctctttaatatcttcacctcattgctctaatagacattaatctccatttgaagttagtattcttttaccagttttactgatttttctttttcattcaggtaactgtgattgttgcaggatcttgtgtagaaacagatcacaagaagatgaatgataactcggtggtgcggctttgattatcttcagagattttagattctgtatccactctgttgcgatg

SEQ ID NO: 34963 - DNA, 3003 bp, Unknown; identical to SEQ ID NO: 34962
  misc_feature (1)..( 3003): 2750-1469P.txt file - cDNA_ID_3083484; gDNA_ID_2926242; Annot_ID_204118

SEQ ID NO: 34964 - DNA, 3003 bp, Unknown; identical to SEQ ID NO: 28671
  misc_feature (1)..( 3003): 2750-1469P.txt file - cDNA_ID_3083490; gDNA_ID_2926242; Annot_ID_204113

SEQ ID NO: 34965 - DNA, 3003 bp, Unknown
  misc_feature (1)..( 3003): 2750-1469P.txt file - cDNA_ID_3083524; gDNA_ID_2926243; Annot_ID_142940
gataacgtataatgttatcttgaatgtgtttgggaaaatgggtactccttggaataagattacgtctcttgttgagaagatgaagagtgatgggattgctccggatgcgtatacttacaacactcttataacttgttgtaaacgaggctctttgcatcaggaagctgctcaggtttttgaagaaatgaaggctgctgggtttagttatgataaggttacttataatgcgttattagatgtttatggaaagtctcatcggcctaaggaagctatgaaggttttgaatgaaatggtgctcaatggattttctccgagcattgtgacttacaactccttgatctctgcatatgcgagggatggtatgctggatgaggcaatggagcttaaaaatcagatggcggaaaagggaacgaaacctgatgtttttacttatacaacacttttgtcagggtttgagagggctgggaaggtcgaatctgctatgagtatttttgaagagatgagaaatgcagggtgcaaaccaaatatttgtacttttaatgcctttataaagatgtatggtaacaggggaaagtttactgaaatgatgaagatatttgacgagatcaatgtgtgtggtctctcccccgacattgtcacttggaatacactattagcagtctttggccaaaacgggatggattcagaagtatcgggtgtattcaaggaaatgaagagagctgggttcgtacccgaaagggaaactttcaacaccctaatcagtgcgtatagccgctgtggttcgtttgaacaagctatgactgtttacagacgaatgcttgatgctggggtcactcctgacctttccacctataacactgtgttggcagctttggcccgtggaggaatgtgggaacaatctgaaaaagttcttgcagagatggaggatggtcggtgcaaaccaaatgaattaacttactgctctctacttcatgcatatgcaaatggcaaggagattggtctgatgcattctctagcagaagaggtttattctggagttatcgagcctcgagctgtgcttttgaagacccttgtcttggtttgtagtaagtgtgatcttttgccagaggctgaacgtgcattctctgagctcaaagaaagagggttttcaccagacataaccacattaaattccatggtctccatatatggaagaaggcagatggtggcaaaggcgaacggagtcttggactacatgaaagaaaggggtttcacaccaagcatggcgacctacaatagcctcatgtatatgcatagtcggtctgcagatttcggaaaatcagaggaaatcttgagggaaatactggctaaggggatcaagccagacatcatatcgtacaacacagtcatttacgcctattgtagaaatactcggatgagagatgcatctagaatattttcagagatgaggaattcagggattgtccctgatgttatcacctacaatacgtttattggttcttatgcagctgactcaatgtttgaggaggccatcggcgtcgttaggtacatgatcaagcatggttgtagaccaaaccagaacacctacaactccattgtcgatggatactgcaagctaaacaggaaagatgaggcaaaactttttgtcgaagatctgaggaatcttgatccccatgctcccaaaggcgaggatcttaggttgctggaacggatagtgaagaagtggccatagataattgttgatgagaaacctcacagtaaacttgtcaaaccctgacttcagatctgctgtaagtgttaatttttatcataactttcatgctcgttgagcatgtgaggcacctttttttcttttcttgtttgtacttgagagagaaaaagtcccactatttgccttcaaatttaaataaggataaactgttagaaataagaatatttcattgttagtgtgttacatctgtaaccattccaatgactgaaggagtattgttgccctttgtgaaatatgtagacacatcaactgctgacttctggactgatttcaatctaactttaaaatagtctgaacactttgttgctgcagaggaaggtcctaaacacttaagctcgtagctgttagtgcaggatccgtggtgaagaactcaacaagtgatatatcttcttggtgactcatagtaagaattatctgcataagagcttcaatgtttctcagctctcactgtagttaccgtctcacatgatcttaaacttgatagtaagaattgtctgtgaatcggattgtattgaccataactgttagaatctcagcgtagctgctataagcctgatcatgttctcgaaagagttattatggctcttacctaatggctatttgatttctgcattaggtgtatcgtgtcagatgcttctcacggttgttgtctgagaagaacataactgaggcgtcacacacaagagggacatacggcagtatcggtcaaaaccagtttttccggggaatggtatatatatatatatatgagtcaatgtgtctagaaaatggttaccaatggtattttctttttgatatttgttcctgtgttttgtactttctctgatttggttatctatttaaccaaaagcaatgtaacacagctagcaaaccaaggcagctaacagtaaatgccaacgtccatgttattgtctcgagcctttttgttgttcttattgtcaataaccaatatccctaaacccggttaacaatagtcgggaaaccgaaccgtattggtggatcctatcaaatcaaagcaaaccagaacagataaacgaattgaaccaaatcagagctaaaccgaaaaaatgcaacttgaaattctgctggacctacattgggcctttcggcctgtataaatttccacaatttacggtaatacccttgtaagaaaccctaagtaataatgatgtgctttaaaagcgcacagcctcacttccaaacccttcgtttacagcaaaaaatcgaaaatg

SEQ ID NO: 34966 - DNA, 3 bp, Unknown
  misc_feature (1)..( 3): 2750-1469P.txt file - cDNA_ID_3083544; gDNA_ID_2926224; Annot_ID_203412
cgc

SEQ ID NO: 34967 - DNA, 3003 bp, Unknown; identical to SEQ ID NO: 28703
  misc_feature (1)..( 3003): 2750-1469P.txt file - cDNA_ID_3083544; gDNA_ID_2926243; Annot_ID_204185

SEQ ID NO: 34968 - DNA, 3000 bp, Unknown
  misc_feature (1)..( 3000): 2750-1469P.txt file - cDNA_ID_3083554; gDNA_ID_2926243; Annot_ID_204182
accgtaacgtttaaatatctcgttcagcttttcttcagatggaaccgaacctgaatccgcaaagttgaggactaaagcatagggtggtaatgaatctgcagaacagtccttgagaccaatttgctctttcgagcctgagccagtgatttctttatttgcaggtaatatctcttcttctgcagagtctttcttatcacaaggttctgatgtctcagtgatacttgccttctttgagtcaccattgagtttactgcaaaacagttcattaatgaacttttcaaaatcttcataattcgaggggtctatgttgattgaatcaggtattcccgttgaggtattggcagcgtgaaggcttgagagcatctcatcaggagaagaaatctttctttcagcaagctcttgatgtctcggcttcttagtcttctcattctcaacttccgtagatttagaagcacggcaaggcttaagtgtaggagttaaagaattcatctcattttccactccagttccatgacacggttcagccgtcttctgcagtttattagtatcacccactgacaaaagactttcctcattagagtgtttagacactgaatcctccttttgctgacttttcttgatccttttctcagacttaccagattccgaagactcaaccttacgcttcttttcagaatgcgacttaccatccaatttctcagttgatctgctcccacagcgtttctttacagtcaaatctgacaaagtcttctcctttgtctgttcagcattatctttataatctgtctttctctttttggcagatattccttcatccatatttacttctgggagagaagccagggtcgcagcagattccaccgaccttacaaatgtttcatagtcaatgaagtgagaatagtctttccattgttgaaaagccaatacctgagctcggttaatcacaaattgcagcttctcagtcgcatcatagcaaggaaagcaagctaaatgcttcatataatccacaagtttagcaggttcaaaagagattccatccgataacttgtctccaccgtatctaacacttgagtcctcacgaattccagcattgattatgttctgagtcttgagtttgttataggcttcctctgaaacacaagagcaagataaaccaaactctactctccttgaaacctcatccaaagcacaatcaatagcatcacgaaactcagcggagttactctgctcctgcatttgagagaaattctgatgaaaaggctttatctgagatgcattattccaagcaaatgtacaatccccaaaatacgcaaccaagacatttcctttcttgaagtgcctcatcgcagctttagaggcaacagatttatcaaagaccagtccaggccaccatggataacttcttagtttagcccaaaccaaatctgagtcaaaaagcttcagattctctttagaaaatcctttcttatccttgttcttaagcagatctgaatcagcatcaaaatcaaccccgttacagagactatccttatcatcacgagcagagacaaatacttttcgctcaactccagtgaggttcactaccaagtcctgagcttgaaagctcatgggatcagctagggtttcagatgtgtgagccataccgtagtcaaaactcgacgcatttatggcaaaatcagcgttggagtcagattcgactccttctggttccgtagacataacgagcaccaacaaaaatccctagacaacgaagaaacaaaaaaaagcagaaattgcttcagtatatgcttccattaaagcaaaaacagtacatcatacgagagacgaagaaaataatcggagagcaaaaaaggtggacagaacctccggtggcggttacggtttcgccggcgacgaaagcttagattttgggtaatgaagaaataacagagtttctttcgttttgagggggtttatgagagagctacgtgtacgtcacgaattattccacgtggcagtacttgattttgtctcgactcatcacaaccatacattattacattgagtgaggttcaaaattttcaaacttttgcttttccctctttatttgaacttgaatttgacttgtttttactgatattaaatagaatagaattttactacaagtagattagaattttactacaactagtttatttctaaagaattaaatttgttaattttatgtttaatgagaaccaaatgttttcctacaacattaagacacttttttataagttttctaaacttgtttaatagtatgttttactaaaaagtgatattttgaaaaacctcttttggggatatttttaaatactcctcatagactaacaaaataatatatcaattcatatataaacacaataacaccgtttattgtgtaaagtgcttagctctctcaatggtcaaaaaatgcaaaatccattttcttgttatgtctttgtcatttttattgttatgtcatgtggcgtctcaacattgagaggatattttgggagccagtaacgttcgagattcaaaattgtggatgagattttaacgattgaaacaaaagtactaaaaaatagtcgtttattagcacatgtactcttttttttgtttggacagctattagcacatgtactcttatatgtatgtatgtatataaaaacgtgaatagtgagtggaataagagaaagtagttaaaattcaaagcgataagagtaccattttgtttttattatattctattctatggacgcgattcctctgcgttgtttacctattcaaatgaagttctaagccaaaaaaaaaattagtcgatttgtttttatgttcataacaccccacgggctaactaatatggtccaaaacaatataacaacaacaaaataatcacgcaaaaatctaaaaaaccagccttgtgtccatactccacccacatatataaggagagaaacaaaaagagcgtaagataaatcaaggagaagattaagaaagatg

SEQ ID NO: 34969 - DNA, 3003 bp, Unknown; identical to SEQ ID NO: 28695
  misc_feature (1)..( 3003): 2750-1469P.txt file - cDNA_ID_3083578; gDNA_ID_2926243; Annot_ID_204175

SEQ ID NO: 34970 - DNA, 3003 bp, Unknown; identical to SEQ ID NO: 34965
  misc_feature (1)..( 3003): 2750-1469P.txt file - cDNA_ID_3083584; gDNA_ID_2926243; Annot_ID_204174

SEQ ID NO: 34971 - DNA, 3003 bp, Unknown; identical to SEQ ID NO: 28694
  misc_feature (1)..( 3003): 2750-1469P.txt file - cDNA_ID_3083592; gDNA_ID_2926243; Annot_ID_204171

SEQ ID NO: 34972 - DNA, 3000 bp, Unknown
  misc_feature (1)..( 3000): 2750-1469P.txt file - cDNA_ID_3083596; gDNA_ID_2926243; Annot_ID_204170
agaaacattaaggtgaaaaccttagtgaactgtggtgttaggtttcgatataatctattaagtcaatgcgaacgttcttattatagtgttttatattggtgtcggagggatgcggtataacaccaaacttacttgatagctggtagagagttgttgcgagcaagaagtcgtcaagaagatatataacttgttgagtgcacaaacagctaagagcttaagtgttcatgaccttcctctgcagcatcaacatattcagactaaattatggttagattatatctcatagagcacaacaatcctcatttaatcattggaacggttaaaaacataacacactaaaggcgaactagtcttaatttctatagttaaacttcaaggcagatagtaagtaggtttgttagctgttagagactttttctcactcattcttatcacgaaaagacaaatgtgcctcacatactcaacgagcacagaagtaatgataaaattataacttacagtaggttcaaagtcagggtttgacaagttcactgtgaggtttctcatcaacagcaaaacctgcaagaaaaactgtgattagtgacggatactaggaaaaagaacaatcactgacagctacaaataggtaccatgacacctaaaactgactcatggttgtaacaatcccattatttgaccaacatctccatagaatcatggtactttggctttttggtgtttccaactcgtgaatctatatattgcaagtactgatctttatatttatcttctcacacagctgaatttattcgggaactcaaagaagaagactaaatgattgatatgctgcaacacacatatcagttaatctaaaggcaagtaaagctccaactcacagtttcgaaatttataggatccatttccttgagctttttcatgcggcctttgctgtcaggatcgaacacactcccaatgaagttataaacctcagcaaaatcaggaagacctgcaaagcaaccattacaacagcgtccaccacaaaatgaaaactaagaaatagtccctcaattgttcagataattaccatgcattgagggagcttgtttcgccagtctcaaacccttagaatctgatagtgttctgcttgagcttccgataccagatgctgaaggactagtttcacttatcatgtcatttgatccaacatcaactgaaacaatgatatgtaagccgcatttagcatatgaaaacttcagaagatagagtgactagactaccaaagcaaaatataaaaactgagtacagatgagaacgcatgccttctgctccacaaagagtatcaagttcatcttctggtggaataaccccacttacagcaatgtttaacaatgcagatgtatcatcatcccatggagtatatccaggcaggttatttatttgagtaggaaaggacatggaaacgtgaagcgacatttgagctgcagatttgagttgaaatcagattgattacatgttactccatctgtcaacccaaagtaatatctattacaatagaactaaccatttttcgatgccttttgaggatatggatgagcagctttgcgcttaggcctagggggtggaacatgtgctaaagtcccatttttttggacctttagaaagtatttttgggcatggctcctgatctgcagtaaatcaaacaggcacaggatgattgagtggggaaatgtgccaaggttgtatattaaaccaaaaatccaaagaagctgatctcaaacctgaataactgtctttgaaccaacaaaatcttctatctttttccagtcacgatcaaacctaaggacacgagaaaattgtcaggacaaagtaagattcttttttctaaaagagagagaagcctttcacacacacaaaagagcaatgtaatatgtggaagtaacgaaccattaccaaaatctgaattgtagtttaggactgtagttggaaattggtttcatgcatagctctaaaagctgacttgtagtaagttttttcagttctcatgttaaacatttttaataaagaaagatacgacttctgcaaaataccactatttatgcagaaaccagatgccaagtcctctactcaatcattttggcaacctaagataagcttaaaccatacttcggttttatgagaagaaacattcatcagcgattaatataaattctgatctatcgaatatacaatccaacctaacaaatcaaagaagacattgttgcttctgcaaaatccaattgcatacgcaaaactccagatgatctaccacataaccaaacttcgatctgattaagcaaattaagtagaaattacgcgaaattacgcaaaattcagctataaattagagctcgaaacacaaagaatcagtcaatcaaatagctggtggaagaaaaaaagagcgcggtaaaattacaattgaagagcttccagaaacttgtcgtgttctccttcagtccaactctctctagacttggtgattgtgtaagctttcctcaccttcttctccggtgcttcaccagcttccgtcgttgcaatcgtcgtctctgtagcatctgtagaagtttccgccggtattacttcggcgaccaccggattggttgaggtcattatcggtattttattcaagatagagatcgtctagagagagagagactgaagagagaaggggttagagagagaaatgacgacgatatccacatggcgggcaagaagttggtgtataatatgtggagacgcttcgcttgcaatttcaggccatccatttttctcctttttcttattttatttcttaaaatttaaaatcaaagtaccaaatcggtttatatataccggtgtattttaacactacaaatccggtccggtgtggaagttgtaaaaatagcctttcaaatccaatccatttgatttacatgaaattagaaaaccagaaaaactgagccacaatgatgatacgatgatgatcctaaccgttggcgaggaatg

SEQ ID NO: 34973 - DNA, 3000 bp, Unknown; identical to SEQ ID NO: 28693
  misc_feature (1)..( 3000): 2750-1469P.txt file - cDNA_ID_3083601; gDNA_ID_2926243; Annot_ID_204168

SEQ ID NO: 34974 - DNA, 3000 bp, Unknown; identical to SEQ ID NO: 28690
  misc_feature (1)..( 3000): 2750-1469P.txt file - cDNA_ID_3083616; gDNA_ID_2926243; Annot_ID_204165

SEQ ID NO: 34975 - DNA, 3003 bp, Unknown; identical to SEQ ID NO: 28689
  misc_feature (1)..( 3003): 2750-1469P.txt file - cDNA_ID_3083618; gDNA_ID_2926243; Annot_ID_204164

SEQ ID NO: 34976 - DNA, 3003 bp, Unknown; identical to SEQ ID NO: 28688
  misc_feature (1)..( 3003): 2750-1469P.txt file - cDNA_ID_3083629; gDNA_ID_2926243; Annot_ID_204162

SEQ ID NO: 34977 - DNA, 3000 bp, Unknown; identical to SEQ ID NO: 28683
  misc_feature (1)..( 3000): 2750-1469P.txt file - cDNA_ID_3083637; gDNA_ID_2926243; Annot_ID_204158

SEQ ID NO: 34978 - DNA, 3000 bp, Unknown; identical to SEQ ID NO: 28683
  misc_feature (1)..( 3000): 2750-1469P.txt file - cDNA_ID_3083637; gDNA_ID_2926262; Annot_ID_204794

SEQ ID NO: 34979 - DNA, 1190 bp, Unknown
  misc_feature (1)..( 1190): 2750-1469P.txt file - cDNA_ID_3083643; gDNA_ID_2926243; Annot_ID_204157
tcaatcttctgttgttggagaacacaaatctgtcgctaaggtcaaagctttttcctcctccttcgattgctgttctagacatgatgaatcagagtctgtaatcgttactttctgtggctaggagcagcgaatcctgaccgttggattggtttttctttttctttttaatgtccgtgatattattgtctgaagaagaaagagagaccagttttgacttttgacttcgagtaatgagaagaaaaagcacagtgagattgctgttcttgacgttgagtcagagtctgtggctaggagcagcttcttttgttttttgaatcgacaatggttgaggaataaacgaaatcctgaccgttggattttttcttttcttttcttctacttaataatgtccgtgatattattattgtctaaaggggagacccgagaaagagcgagaccagttttgactttttggacattgtgtgttttcgattcgatcttttttttctgaaggtatgcttttgaattcgatttttttttttttttctcgagatctttgcttcgtggtgtttcctttggacttcgtttggtgatatttctgggtttcgtcttttgacgttttttttttcttctcgatgaaatgtttactcagctgccaaatttctctgtttgatattgagtgagagagatttgttactttttacaaaatcaactagttttaggttaccaaatttggtttcggtttcgatgcttaaacaataacttggtgtagtcggtctctgtatgaatgtgtgtgtgtgttgtttttgctgctgatttggatctgtgcttttgttatagcgttgaaaatgcctcgttatgatgacctttgaacacggactcgttatatgctaatttggaactttgcttgaaacagttgatttttatctggatttacatttgatgttttatgcttttatctcaaaactctgtatatatgaagctacggatatttgacctctgatatcctattttgaagtctcagccttgagtgcaccacctgcatgaggatgtcatgagatttttttttttagtggtttttgaatcttgtaactactagttgttttggagaaattatgagattgttcctaaaatgtttggtagcccttgtaataaaggtgtcagctttgctcttgggaaatgttttcgttggtcttagatgttggtaaatg

SEQ ID NO: 34980 - DNA, 904 bp, Unknown
  misc_feature (1)..( 904): 2750-1469P.txt file - cDNA_ID_3083649; gDNA_ID_2926244; Annot_ID_142951
aagctttctctctttccactagggtttcgtgatctctatgagttcttcgattggttgtttttttcttttctcaaagtttctctctctccattagtctgctgatgttaccaatgaacctaccgaccttttctctcacgcgctagcttcggcgtttggtaataatcttcatttggtttttatttcacctgcgtggtttttttttcctttcattttaaagattttgcagtaacaatcatattgaaatccaaatggctaatgttattacactgcataggttagttgcttctagttatttatattaaagatttgatactactatgaattataatttgattggctataaacatccgattataccagctcctacaattgagaaagttataacaaaatggttgtcaatacattaatgaatactaaccaccttaattaaaattgacaccagtgaaaaagcattaaatatttggaccaccttttaaatagatgattaatcagtaattggacaaaatgctagtatttttacaaatcgggaaataaaggggtgaaatcgtaaataaataaaaagtatgggccacataataaagaagaatacaggcgcatgagaaattaacataattacctctcctttattacagttagtcaatttctaacccaaaacttttgttttgttctttcctttttcttaattttgattttattaaaatttggtcatgtattttcactactgtaatagagctggcatctctgatctttcaactccaccaatctcgaaatcttttctttcaattttctcaaaaaattaaaaccctaattcttattggattctgtttccttgaggagcaattgtgttctgttcgctgcattttttttgttctgctgacggaggaagaagaaacgagaagagatg

SEQ ID NO: 34981 - DNA, 904 bp, Unknown; identical to SEQ ID NO: 34980
  misc_feature (1)..( 904): 2750-1469P.txt file - cDNA_ID_3083649; gDNA_ID_2926244; Annot_ID_204210

SEQ ID NO: 34982 - DNA, 115 bp, Unknown
  misc_feature (1)..( 115): 2750-1469P.txt file - cDNA_ID_3083658; gDNA_ID_2926245; Annot_ID_204212
caatatctgttgcgcttctacaggaaaatcactcacattgcgaggaaaaaagattatttgactcaaggaaacaaaagataattcggaaatttcttttgttttcctctcagtgatg

SEQ ID NO: 34983 - DNA, 3003 bp, Unknown; identical to SEQ ID NO: 28712
  misc_feature (1)..( 3003): 2750-1469P.txt file - cDNA_ID_3083705; gDNA_ID_2926246; Annot_ID_204238

SEQ ID NO: 34984 - DNA, 3000 bp, Unknown; identical to SEQ ID NO: 28711
  misc_feature (1)..( 3000): 2750-1469P.txt file - cDNA_ID_3083709; gDNA_ID_2926246; Annot_ID_204237

SEQ ID NO: 34985 - DNA, 3003 bp, Unknown
  misc_feature (1)..( 3003): 2750-1469P.txt file - cDNA_ID_3083714; gDNA_ID_2926246; Annot_ID_142964
gactttctgttggagttcatcaacagcctgctgtaaggattgtatagtttttgatacaatatcttcgtatacggtttccacttcagccatcgaatctaggctgaaaatgatcccttcctgtataaacacatcttctagcattttgatgtcttcgttgctcatcctctctttcatctgtataaaataacaataatgcaaatgtatcttctacatcccgttttctgaatattagagagaatgaggaaatggctgacgtagagtcttaaccttttctaggatcctcccacatttttcatctttggtaaccgaggagggttcctcctgtgccttcgcagatttcacttcactagcacgtggtgatgcttttatgtgttttgccctgtacagtaaatggaagcaaacatctctcttaaacacgttcaataacgtaacacatggagcaagaaaccgttactgtgctctgagatgcatacctcatgccaaacctgagagttgagagcgtctcagatgcatttaaagtgcttggtgagcaacagcaaagcagcgccattcgagaatttccaccctgtggcatgagagaccacaatagaattgagaacaagctagaaaattataaaataaaatcaacctgagaagatatactaaccagggcatcctgtaagatgcgagtaagcttggagtcacgatatggtatgtgattccctttgctagatggcccactagtgagagcgtttatcacgttccccaaggctgagagcgatttattgatcgtcttcgcttcttcaagaaccctaccttctgctccagttttgtctgctttctctgagccagccaggtcgacaagaatcagttttcctgtttttaccctgttcacatgccagatatgtatataagctccaccactacagcatcacttttttctgattaattgtaaaaaatcgttaccttttatctttaactgaatcctgctggattgtgaacaagtaggcgcagtggcttctactgctggacatattcatttctgtcattcattgttaaactggaaacattcttcaagatgactctcaatcagttttaacctttcagtcaactcggagtagcataatcataatctcactatcgactaaatggggaaacattgaacaagtaagtgctgtaaaagctaagaggatacgggtttccccaactgcgcggttagctaaaccggtctgaaatggcaattggcatcagaaataagaaagaagaaggccgtataaggcaattaagaaacttagggtagctgctatcttacgcatagatgttgtaatgcctccaccgaatctgatacaggcacctgaagcaacgaatgattaaaacttgcctacccagtaaagatttttctcaacactagcaaatagaagatataagacaatgaagctagcctctgtaacgcctgacaagagtattccttgtgttttgttctccttgatctgtatgtttgcttttgataagtccaacaggtccctgagagatatatgaatttatcgataagctatataccctagaagaaatcagagggaattacatacacaatacctgactttctccatgtagatctcaacctagaggagacaaaagacacgtaagatgtctatacaggagagcttgaaaggagacttatagcaagtgcatttaagtcagtaccatagacaatttaacagtgtatcttgcaatatcattggaagagctgatttgctcaaacatcccatggaccactcttggaagaagtcctttattgtgctcatcacagtcctggatgcctggtccctgaatcaatcgaagaaaaccaaaatgagccagaagaaggaatggtccttgtgctacaggaagaggtatcaagatgagttaggtgacctccatggaataagtcttcccagcccctgtctgcatagtataacatgaaacgatcaaattgagatcaaaatctgccaaattaagaaaaagacattgaaagcatttccagataaaagagatcaggagaagaacaaacctgtccataagtgatgattgttccgtttataccatttacagcgtctgaaagtagtagtagtagtacaaaggtaaaagatgcaaaagacaaaggtaggaggaaaccaaaaccaaaaatgttgattacattgtaaaatcataagattggtgctcaaatgtttagatctaaaatccagaagagaagatcaaggaatcaattagtacctctcatgatggggagagccagaaactcataaaccgcagcttgggtagagtcctcataaaaaactctatcgaggctaaatgtaaattcatcttccttgtcatcctacacgcaagtaaaaacgctagatagagtttgagagacagagagagagagacaatattaatcaagcacacggcgtcgagtagacaaacttggaaaacgaaggtttcagcgtcgatgggtcgagcacagacaccatctctgctgggatcgcgcatctctttagagcttcgcggcctgaatcgcgcacagacggttacgttagacatctcctctccttatcggaacgagctcagtctacagtgaaacacccaaaatgagtcagcagaagatgaatgaaattggggaaatagtagcacaggaaatttgaagctgagagaaaaggaatcggaacttacctctcaaatggagtggagagtcagagtagggtttctcttacgggcgggaaagaagaaactcgaaatctgatttttgagaaaagagaaggaagaagaagaaggagaaggagaagaggtcacgaggatacgcgtgtgggttgttaaaagatctaatggtccataagaagacacgtgtcactaggaacacggtagctaaggtgcccgccacgcagagaataatagcttagaaagaatagggggtgttgttatccccttgggcgtggagtggattagggagactcgcactcttcttcttcttctttgtacccagaaagaaagagagctccaacaatg

SEQ ID NO: 34986 - DNA, 3003 bp, Unknown; identical to SEQ ID NO: 34985
  misc_feature (1)..( 3003): 2750-1469P.txt file - cDNA_ID_3083714; gDNA_ID_2926246; Annot_ID_204236

SEQ ID NO: 34987 - DNA, 3000 bp, Unknown; identical to SEQ ID NO: 28710
  misc_feature (1)..( 3000): 2750-1469P.txt file - cDNA_ID_3083720; gDNA_ID_2926246; Annot_ID_204235

SEQ ID NO: 34988 - DNA, 3000 bp, Unknown; identical to SEQ ID NO: 28709
  misc_feature (1)..( 3000): 2750-1469P.txt file - cDNA_ID_3083724; gDNA_ID_2926246; Annot_ID_204233

SEQ ID NO: 34989 - DNA, 3003 bp, Unknown
  misc_feature (1)..( 3003): 2750-1469P.txt file - cDNA_ID_3083734; gDNA_ID_2926246; Annot_ID_142959
actcccttggcggagaccagaacctctccagacgaggattgaagaccagagtagcactctagccgaggaagaggtacctcattcattactcgacattttatctatcaaaaaggcagctaatgaaatacaaattctgtaagcagatgtggaaagtggatgtgtataacagacaaggcaaaaccttattggagagatgcgacaagctgctccacagcattgctgaaatggccgctgctgaggccggagactcacaaccgagccccgtctctgttcttgacgcctcaatttaccacgaggactcttctccgtcccccgtcctgaaacgcacccttgactttgctgatgctgaagaagacgaatcctggggtggctcaatattatcatcgtccgactctgaatatgtatacatctcggacatcctccgagcctcagattgccttccacaagagtccgacagcttctcctttctggaaaagcagcaatacctcaaaggaaaatgcgcctccagagccgcagctcaggaaagacgcctcatcttcgacgcagtgcaagagattgtggcgcggagaaggagcttgcccccgtggatgatggtaggagaggctgataataagatgcaagtgatctggtctgaatttcagaagataagagacaaaaagtcgtccacggaggaagatgaccttgtgggatacgtgtgcggggtcctcggaagagatttgtcggaggaccgatggcgagattttcaggtggagatgtcagaagcagttcttgacgtcgaacgcctcatattcaaagatctcatcggcgagaccatacgccagttggcttttcttaacaggtccgactcgctgcgtaggaggctgctcttttgatataaaactagactaaattctctgacccaagtctgaaactaaacccaacctacgacctataccatgtctaaccaaacatgcgagagtgatagttcttttgtgtgtttttttgtgtgaaatgtgtgatttatcaagtttgggacttggcgcctgttgtctaaaagactaaaaccatacactcttttttttgctctttctgaatcaaactgctgctcatttgtgtggtgtattcggactaataaagactttaaaagtgttatgggcttcaagtggaccgtttatctctaatcatagtctactccaacattcatctacttcagtagtggcccattcagacccaataaggcttttcggcattgacttatatgagcagagagagaaatatgcaaaagatgatcaaagaaaaacttgtgatttgtaattttcaaaaatatgcaaagaaaagcggatcatactccagtagtctttttctttgaaaaacagaatcatataataatatcttccaaactgtaaaaagaaaacgagagaggtagacacaacacacacttttattttttttgaggtggaaaaaaaaacgttaatgggggaacaaagccacgtgaaggtgggaagaacgcaccaattatagtataaggtgacaagtcagcagagaggtcacagtcgtggaccaatccacttccaacaccaccatagccgtcccttcgacactttggctgacaaatgttcaaaggcatattttatattgggaccaagattttgcttgggacaagctatgccccacgactctcccgctagtgctctctggtcgcttctcctctgcttctagagaccaaccatttccaccaactctgttttcagttcacacacctcattctgcaatgcccaccaccgcaccaatggagttgagaagagcccaacttctttcttcactctctgttcaaaactggactggtcaaaccatcatctctctttgaccctactcctacactcgagatttctaatgggtgcacaatctccactgggccaccttttgtcaccagtctctctctctctctctctcttttcttttttaatccttctccataacatttttatacctttctgattactattgctggctccattgaagaatgatcctaatcttgaagaaactgaaagtaactcgtgccaaagagatagtaagtagtaataaaaataaatggaccactccagatgattctatctgaagaagcagtgagtccctctctgttatccacctgcccgatgtttagcaaaagttaactaaagcataatataaagctaatcttttatcataatgtctgatcaaaagaatttaagaaaagaagagatgattcatttagttttgtcagctagctgcaatgggaggccttaaatcagtcaggtaacaggaagacttactcattggttgctttgctttgagctgccacagcctcttttagtttacaaggattgtgttgttgggtcccaacactagtgaaattgcctcctattttcccacagagagcacaaggattttttcccttgcacgttccaccattcttttactctcacggatgatacaggaaccaatcctttttgcgcttcatctgagtcaaaagcctgaaaaagaccacatataatacatctcagcctaaaaagcaaataccatacctacgactggaaacatatgggataagaggataaataaataaagggaatccttcaaatggtaagtttcaaagtaaaagtgttatggtatgatcttgtctgccttttctttgaaaaagccaagattgtgggtgtaactgttatcaaaagataaaaagattcgtgagatctttctttcttgtgactttttccttcaactaggctcctcctttatggcttctctccgccaacaaagaaagggagaggcctcaactataaagctatttataaccctttgttagacaatcagtccccattcggagattggttgcctcggccattcagaaatcacactacttttttatttatttatttataagatcaaaaacccttttccatccttggtttctatactcttgtctctcagaaatcaagaggccttatgagctatctacatgcaagcctcctcaggaaaagaaccatg

SEQ ID NO: 34990 - DNA, 3003 bp, Unknown; identical to SEQ ID NO: 34989
  misc_feature (1)..( 3003): 2750-1469P.txt file - cDNA_ID_3083734; gDNA_ID_2926246; Annot_ID_204231

SEQ ID NO: 34991 - DNA, 3003 bp, Unknown
  misc_feature (1)..( 3003): 2750-1469P.txt file - cDNA_ID_3083739; gDNA_ID_2926246; Annot_ID_142958
aggagtctgtttctcacggcgggggcaagcacaggatccttgcagagcttgcccgcgttgaacaggaagtcgctttcttggaggtagctaaactaactcgtatctctttcaaattccgacgtaggtctctcgtggatagctcaattatcctttttagatcaattgttacaacaattaggtaaaggtcgctaagattgtttcctgtgaaagcaaaaaccagtatggcagatctgttccaatcagaagagcatggtagttctcttgacaataagtggcaccatttcagtcagtcttgtttatgactctatgaattgtattcccaaaatctaaatctgctgggttctctttggatccactattggaatggttctctgttgatcttattcttagggatgtgcaagaatacttttgatcatagtccaattagtatcattctctcttggttatcatctatcgaggcatgttaaaagttaaccttctcccaagtttctctgttgcacagataatgtgtttgcctattgttcctactagtgagctctaacacttactaaaaatagctttactctctctttctgtttcatgtactatatccagaaagagttgaaggaggtcgagaacacagatattgtatcaaccgtgtgtgaggagtaagtatgggatactcaacctatgtttttttttaacgcttgcaagcaactgtgtgctagctcctgtaggtatattatctggatttgactgaaacttgtacgttgattggtgatcaaattgatattcccttggttcgcaggctgctatctgtcatcgagaaaggacccgatcctctgttgccactgtgagtgctttttaaaccttgaaactctagtgttggtttggactgaataactgatggatgttgtggtgctggcagaaccaatggacctttgaacttaggatgggaccggtggtttgaaggaccaaatggaggagaaggctgcagatgcttaatactttgattcgctagacagagtaatgtgttacatatactagtttcttgctaggatatcattttacatgggatccaaaatggggctgtagcagagaaaaagcgtacagattaatgagcattggaattgcatagaacggcttagttgcacctacgtaaacagtattatatgtatatgtaatgtatgggatccggatctgacatacgagtaatggagtttcaggcttacagcttctcatcttcttattctagatcttgttgaaagaagctgaaatgtgcatagtgatatttgggggctaatagagtaatagctaatgaggaagtgggtacaatcttgaagaccgttaagtgtgtctctcttttttctttttagataacttttggccacatccaccctccatgatacacacacgctagtttcgaggatcagaatacatacatacctatgtttattatatagatagaacgataatggaacacagagcacatgcctcatctgttgtctttttattattacttattactcttctcctccacttctgtattattacagtctgttaaagtagaacccccttttgtttttttctttctatgtctcaaaaattaaaacaagttatgaggtttaaaaaaaaaattgagaaatgtagagggtattagtagaagtgatttacggtaagtttattcgacagctaaaaagatagtttatgcattccaaaatattcctcaaatttgtgatgagtaaacaaatactggtaaggtgggttttctgacaacctttggatatacagtagtatgtcatctgttttcattgcctcattggtcaagatcaaagttgatgacctcattagagctccttcttctcccataaataaaaaaaaattgatcaaagtttgtagtatgaatttgttatataaacagaagagaaattaacacagagatgtgagttggtccaaaagaaaaatgattgagcagccggaagaagcacgttacaacatctgcagcatatctggtcagagagagtacagaaatattggggattcaaacaattcacctcgtgatgaaacctgaacattgaaacatgcattatagcctcactcacatgctcacataatgccaaaccctttttctctgttcccgccttgcttttttttttcgtggcaatagaatacaatacattggttgggtgattaaataaagagaatgactaggataagtaagttagccgttaaagttgtaaatctcgagtaagtgaagtggtccgtttttatgaaactcataaaaacgaaagtcccatgtccctaaaacactagtagaatgtggtaacgtatcttcttcacattcacgttttcatatgggaaacgaatgaaataaacaatgcaaaacgcaataacttaattagaatcttgaactggccgataagtgcaaccgtaacggaaagcagaggcagagagagaagagagaagagggagagagctgccttgggaatagatagaaagagagcgtatcaacggtggtcattactttatgatggcattcccaactttgaaactgccacgtcgatgtcggtcaacagcggggtccatatctcctcatcttccgttccatattttttccacgtggcatttttctttcctcttgaaacaagaattcagaattgaatcgtaaactctgaactagagtaagtaaataatgtattgactagaagaagaagtaagtagtacgggctgggtaagtaaagataataaatatgcggggtttgatctttacttatttattaggactcaaacttagccattattaactcaaaaatcaaaattactcctaaaacaagcagataggaaaaaacacaaataaataaaaaaaaggaaattgaatgcagagttgtcagagtgtatttaaaaaagaaaaaaaaagcacgttaggaggagtatcctttagactagagtaagggagtgggtgctttaaagaagcagagaagcgggagaagagtgtgcagcagcaacagccaacagaagaaaatg

SEQ ID NO: 34992 - DNA, 3003 bp, Unknown; identical to SEQ ID NO: 34991
  misc_feature (1)..( 3003): 2750-1469P.txt file - cDNA_ID_3083739; gDNA_ID_2926246; Annot_ID_204230

SEQ ID NO: 34993 - DNA, 3003 bp, Unknown
  misc_feature (1)..( 3003): 2750-1469P.txt file - cDNA_ID_3083745; gDNA_ID_2926246; Annot_ID_142955
cttcaagaagacaacatcaccaacaacaacgtcaaagatggagatatgttgccgcctgctgtcccgaaggacttccactttgatgttattgcttatcttggacagcttgtcgaactgtctctcctgcctaaagttgctgagagcagagacaactatgaccaagaagactgctacaaagatgcttccgccttcataccaaccttctttgatgccatgttctttgataccgaagccaagggagaaaatagcgcagaccaacaagatcaagatggttaggtctttgaaagcttcatacacaaagaagagaagtcctttaggcggtggcttatggtaggtgttagagccaaagaggtcacggcgtctactgacttcttgctcattcccgtggatccctttggtggggttagtcctaagggaagcggcgacaccctccacgccgcccagcgcttggatgcccggtaagtccttacccttcatgatctccacaagttgttcttgatcaatggcaggaacgtaagagagaggcatagagttgatctttgctccctcaccggactcgagggctgtgtaggagagagagagagaggcatctgaggttttgggatcaatccttgcgggaactatctccttaacaagagagagcatagccctcatagagtagatggcagcgtaggcaaaacgccaacgcctctgggccttgttgaggctggaggtggtaaggttgagcaaaagtgcactgtaatcatattccttgaggtccctcatgctttatttgtgtgaaagaaagagagtttttagaaggaaaagagtctcgctctctctcaactaaatgtggtgttacttgtaagacacttaagactcgcaaagaatgatttctctctctctaataccctaagcttcgtggtactatttaaatccgtattggccgccttttgattgctatttatctgctttaaaatattaaatatctcgtgtaaagtaacttgtcctagtttaatattttcaggcggtggaaccactcagaaacgttgtaaacacgaagtcatgtcgatcaaaggacatgggccgcacatccttttgtacttgtgttttgacttatctgttgtctcgtgtttcggtttggaaccactgtgccctaaaagagagagttaatctgagattttggtagtaatttctaaagcagccgtatgatgtaatggtgtggacaagccgtcattgtagaatgaggaggaatagcgtgcgtgtaccaacttgcttagtccgcacggacaaatgaaaagaaatggcgaatatagtaaagcgaaagaagaaaaaaaggatttagattgaatcttccacaccaacttggtttggtataatatctatcaagtgaaatttatactactcaaactcaaaatccgtctacttttccacaaatctatgtttagaaataataaaatggagcagcgtgtacgacgaaggcattatgagtttgatcaccgaaacttcatagcactttccattttcgctgtcatctctttctttgttcatgtgacgacagcaagacataaaagcagttgactttatttttataaacaaacaaaataagttgacctccactaaaactagacgtgaggtgagaccagatttggcataaaattccgatacaagcgatgaagtgaatgtcgagaaactcctcaaatcatatacatacatacacagagatgctcagtgacatacattagatcacgagttactgtatgtggataagaaagaaacaagagtgtttgcaccaaaagcagtagcaagcttaacaaaatcccaaccaacaaatacaatggcttgctcgagaataaatagactaaccatcatcttatgaaactaaacaatggttcaggaataagtagaagggaagattacaactaattaagctcactcataacggtaactagtaataacaaagctctcagcatgcaacaaattaagagctatggtttaagaagaagatccctggctgtgcagcagcagttgttggtgtgcagacgcagtgaaccaccaagccccatgagatccctccacctgctttcctccggcattgaagctagccacaccaatccctcaacctccttgtccttggcgattcgcgcatctaaaaaggcaccagagcacttgtctttggcgaaagcagcgcacttgcccttggcggcagccacacagccctcgaattcccgctcttcgcacttctctcgttccctcatgtcaccaccagatccccgccaccacggcggcttacagttgttggaggcggagacggcgcacccaattttagcaccttcctcgcactggtccttgattagggtttcgcaacgcttgaaagcggctgaccatgaatccagtgatcggaaagctagaacataagaaccaccggagggtacaggtccccggagcagcggaatcggacggtcgaacacaacggtagtcgcagccgccgagaaatcatcgtcatcttccatcatttcaatttctcttcaaaggcccatcgggcttttgattgaggccatccacctatatttatttaattaattaagtttgggggatccaaaacataattagtataacgatactactactaaccgactggactagattattctacttgatatatcctctcgagaactattgctgccgctactcgtttcatatctccgtctccggctcgatccgccaagtagagtaagcaggtatctccgagcatcttgacatcgcttctttcctgcttctgtttcctttgaccttattacagagggaggactcatcattcttctttctcttctactttttttcatgtttattttggggtttagggttttagaagtttgatcgatctgttattataactttggtttcaatcgatctgggtgtccatttgcttttcgatgtttaggattttctgtgcttatttgaatcaccttgtatcttgtatttctccttgtaatttagcacatcatctgcactgcagcaatg

SEQ ID NO: 34994 - DNA, 3003 bp, Unknown; identical to SEQ ID NO: 34993
  misc_feature (1)..( 3003): 2750-1469P.txt file - cDNA_ID_3083745; gDNA_ID_2926246; Annot_ID_204227

SEQ ID NO: 34995 - DNA, 3003 bp, Unknown; identical to SEQ ID NO: 28862
  misc_feature (1)..( 3003): 2750-1469P.txt file - cDNA_ID_3083762; gDNA_ID_2926227; Annot_ID_203551

SEQ ID NO: 34996 - DNA, 3003 bp, Unknown; identical to SEQ ID NO: 28862
  misc_feature (1)..( 3003): 2750-1469P.txt file - cDNA_ID_3083762; gDNA_ID_2926246; Annot_ID_204222

SEQ ID NO: 34997 - DNA, 884 bp, Unknown
  misc_feature (1)..( 884): 2750-1469P.txt file - cDNA_ID_3083777; gDNA_ID_2926246; Annot_ID_204215
gatcgctttgaaaagaaaaaccggagtacaatatttcagttacggaaaataattgcgtacaaaaatgggcaaaaaaatggctctacgttacttaagcgagcaaaatcatttttactagaaaagagaactgaaaaagcaaagttttgtatttttttctcttcatatatatatatatatatatatatctttttttttttcatctttatatatatatatatatatatatatatatatatatatatatatatatatatatatatctaaaataggaattgagcaaggaaaatctcatactactaatttgaaatttaagaaaaaaaggaaggcgaatcgtagacgggaaattgttcttttgccgctctcggacgaatcgtctggtctgcttctttttccttcttcttatagtctttgctttttggccttaagaaaatgattttatcttttgataaagtttccatttttggtgatataatacaaatagtgtattagtagtttgattctcttcaccacggtgtcggtacgattgaagctcctccctccaagagccttcgtacagaggtatattttaattaattttgtgcatcatgatgattgcgggagctggttcccactttttcgctgtttatgaaaattactcactctcactgtttgatgaaagcaatcataaatctcgctgaaagctaccctttatttgttttaatctttaatctggtgcatgacttgacactgattggattgcctcatctctgtatgtagcagtttctccatgtatactcttttcttttttaagaaaaaattataatttattaagacttgttttgttatatggtttttgttttgaagacgtttctgctgaaatttcaagcaagtgtgtttgtcagatg

SEQ ID NO: 34998 - DNA, 3000 bp, Unknown; identical to SEQ ID NO: 28722
  misc_feature (1)..( 3000): 2750-1469P.txt file - cDNA_ID_3083858; gDNA_ID_2926248; Annot_ID_204277

SEQ ID NO: 34999 - DNA, 3000 bp, Unknown
  misc_feature (1)..( 3000): 2750-1469P.txt file - cDNA_ID_3083862; gDNA_ID_2926248; Annot_ID_142979
tttggaatcttttagaagcagaatatgtgcttatggtttttttaatttattttggttgcattttggtaaggtttttaagggaaatacataccaccaaatgatgccggtttagttagtaatgactgacgactagtgaagtaaagtctctccttatatctctttgctaaaagcttcaatatttgtttaatagtaaacattgtcaacagatttggaaagactaaatcaacgtttaacaatatgtcaaaatgtaattcaaattgattaatcatagtagcgaaatttgaagaacctttttcttttgttgattaaaaaatccaaatctctacgtttttctcacattcttcaatcttcttgaccttgtcccgtttaattccttcactaaaatcttttcaaccctcacgtgctgatgttgacatggaataattgttgttacttgtcaaataataagaagaagaaaaaacagactaatgtatgttcctctttgattgttctggttaggcaaattacttgcatatctccacatgtacgaattagtaatattcattcataaagttagtatgatttatagattcaaaaaaataaacacagatcgagtttagtttagtcaaatatttgaatgttttcaagaacaagaagagtttctgcaatcaactgaaatatcattttcatggtcttggttcaaaaccagcagtattacaaacagtgagaaaggtttttggtatttgtaacaacaatgtattgttgcagtgactccaaattcaaaaatggaagtcatgtgcattcaccaagttacggcaaaagtaaaagactaaacttattactatttccgaataatccggagcgataccctaaacaacattcacctcaaaagttctaaataacacgaataggctgatttttgtatatatgcttttggctgacgttttttttttgttctttgctttaagacttcaattcttttaagcaaaaatttggatgggaaataaaaaggatgatgaggtggcctacttgtattgagcggataaacatcagccaacaaaaatctttgttaaaataaaaagtgaaagacagagagagagatggccacgtggacaaacatggtgggcgtttacacgtggaatataacaacactccgcgttgctgattatttgattccatttaaataaaattaaaaaatactgattattctttcttttgttcacagaaaattccttcattcacaatttctcttttaaataattaaagaccacaaattttgaacataagaattagaaaaattaaagatcattcactagagtagtcgacattattattaatttagtataaataaataaggtgtgaatccacgtgggatgacaggtgggagcgaagtctagtgcatgtcatgtaagattttgatttactttcaacacgcttcatcgctatttggaccacttcgctgacttttttttgtttttttttttactactgagtagtactagtatttcttacacatatcagagccaaaaatacaaccccgacgaatctttctttagatacaaataaaaaatatttactcctacaagtttcattcaccgtacgttttacttgttatatcattgcaatgacgcggcttctaaatatgtactaccatatgtgtgtttgggaatctgacagttgtatattgcactggatccaaaccatttcagaacaagagtacattttctctgttcgtacgcattatttgttttgtgccgactgcgaatataacgatttccatttattcatatactaaatatcatacaatccataaatgaatagtcttctttttttcttgggggaatttacaattccaatcaaattaatttcttagctaatcataacggtagtcttgttttctgtaacttaattcttcttcttttttattttgataggaacgttaggtatctattatgtaaaacttgctaacaacaattctctaattctttgtttatatctgatctcttcctccatgacacggggctaatctaaacttctaaaagcatattgatccaatagcttatttaatatattttgtctgtcaaccattaggttacttttgttacgatgaatttttcaaaagaaaaatacaagaattatgggatgaggaaaatctagtgggtcaattgaccataaaggctaaatcggattgaagaataaaaatcggattgtgactcgtaactcgtaagcgtgacgaaatattaacgcaacatttatatgtattgggacaaattattaacgaataactaccaaatgcaaaaaatacgagacagttgagtacttgagcttggtcacaaaatcatcatcaaggaaaaacaataaccatacagtaaaaatatagttctacaactttacaaatttgaaagcgtgtttagaatgatgcacacaaataatcaatctgtcaaaaaaaaacatattgtttgattttactctaagattaaggcgattgtttttacttaagatattcttaactgatgcaagttacccctgtaattgtttgagattgctatttttaaactctagaatacgaagaaaaaaaaagtatgaattatttagttagctgctttaaatctagagtttatcatccgaaaaagggatatctaagctttattatttttaatgtaatcacgaattgtgtccttttcaccaaaagagtcattcgtgttcgtattttattcaactaaataattctataagttctagtatattcaataattattaaaaaatctcatcttaataattttaattagagaaaagaacaaaaaactacacttctatcgtccctctacgatttcacaccttcttttcacacatccttataaattaattagattcttctcttttctctccttcctctctgtcttctcttctttttttcaatgaaacctctcttcatttataagtaacccaacaaaaaaataaaattatctccctcttatttcttctcttcacgtcacaaagacaattcgattccaaataatg

SEQ ID NO: 35000 - DNA, 3000 bp, Unknown; identical to SEQ ID NO: 34999
  misc_feature (1)..( 3000): 2750-1469P.txt file - cDNA_ID_3083862; gDNA_ID_2926248; Annot_ID_204275

SEQ ID NO: 35001 - DNA, 3000 bp, Unknown; identical to SEQ ID NO: 28719
  misc_feature (1)..( 3000): 2750-1469P.txt file - cDNA_ID_3083866; gDNA_ID_2926248; Annot_ID_204273

SEQ ID NO: 35002 - DNA, 3000 bp, Unknown; identical to SEQ ID NO: 28718
  misc_feature (1)..( 3000): 2750-1469P.txt file - cDNA_ID_3083870; gDNA_ID_2926248; Annot_ID_204272

SEQ ID NO: 35003 - DNA, 3000 bp, Unknown
  misc_feature (1)..( 3000): 2750-1469P.txt file - cDNA_ID_3083876; gDNA_ID_2926248; Annot_ID_142974
cctcccaagatcagagcaacagtagttgctatccatcctccaaccaggaagggttgaggccaaaaccgagtttgcattctcctctgccacgtgagtctccaaaaaacatccgacaagaagattattagaagaaggaccttcatatacacaacaaaaggtgaaggtgaaagcacagctttcaatgagaagaaggaccttcaaggtccttactagcagctaaatcaatagaacctgcctcagaagaacggagacgattatgccactttttgagttctttcttcttagccttagtagacatgactgtccaacccataggcaagggaaaactgggatctggatctttgatggagtcacgcatagacctcttaggttgagcagcttgttgaatagaaccagaaccctgaattactccaaccttgagatcagatgagatcgttcctggttttgcaacccaccttttactagccaaagtctgcgatgaaagagaagactggggagagaaaggtaatagagggtcagtaatccgtggaggagagctaagggatcgcttttttgatctagagcgcctcctttttgatttcgacaaaggtatctcagctgcaataggaggagaaaggtcgacacctctaactgagtcactacttccagctgccggaagaatattggaggaagagccacctctttggctcctgaaggagagtccttcttaaatggcaattttttctgaagagggatgaggcaacgactcaataaatgtccgtatttaccacaatttaaacacttcggcggaggtcgaggatactccacatcaaccctagcagaattaccctgaacatcctttacaacaacagaagaaggaagaggcaagtccagcttgatcaccaccttaactttagttgaacctatattgatggggtctaatcttgatttttctgtgtgaagaggaacccctatggcactagcaataacactaatcccttcaagcgaatagagctgaggaggaacattcttcaatacagcccaggttggagcagtcttcaactcatcaatattaaggagaccttctgaagaccaagggtagactgtacaagaacagttaccagcttgccagaatcccacatccaccacccattggcgagtattaagagccggaataaaaatcagagccacagtctcggagacgatgcgaacggtaatatcaccgtaatttccccaaattggattcaaatcagagaagatccgggttgcaggaggacaagagccatgaaattgagctacgacatggcccttccacaaagcagcagacttcaacaagaccgaggaaggagcgatcacaaccggagtaccatcttccaagtaagttggctgactcatttgcttaaggttatgcagtgaagccttaaacttagctacccaaggaagatcaatttttgaatcggagctgggggcctgagaggaagagcccgaaataggagtcgaagactgaggaatagcagatcccaaagagagagacttggtagcaaccatatctgaggagccaacaggccctgagctcggagctaagagaggagctgagccaactgaaggagtcaaaatgggggaaccagcggaggagatctcggacactgatcccaagccaaccgaggaggaaattacagtaggcagaggctgaatggatgacccattcgcttcaatagctaccagaggagtaagagtagacgacttcgggatgagagaaacagtctccgaaataacctcgggagacaaggaattctcttccaagtcgaaaaccagaggaacagggagaaccagagccaaagagccagcgcagggaagaccagaggaaggaggcgaagcagatccggaaggagcagacgacgacagggggacagagccggactgagcgcaagccaaaacccgagcgaactttgaactgacaggaaggagagggatcttctttttcttcttagacatgacaagatctcaaccggcgagaagccggcgaccagcaacgcggcggcagaaacggaaaaaccctaatcgcctaaaagttggtcacattgtttatgtactcaaaatgaatgttgggaatatattaccggcgactctgttggtttgagatattaacaatgattcgaagagatagttttcaaggtaatcactaaacacgttagaatgtctggcaaaaaaaaaatttacacgttgaaatatacattgttgtttaacaacatgttattaacccttttttttggttttaatgttatgaaaacataacaacttgttctcacgcgttaacatgtgctcccacgttaacacattaataatccatttaaatattaatgaaatagcaatgttccatcaccatggagactttttgttgttcatgtgatactttataatgagcgtcgtaagtttactaacatagataagagtgtaatttatgagaacaagaacaatttgttcccaaatcccaagtaacagaattagtatgaatcgtttaactatataagaagcaaggaacaaaaagactcgcaatgttgttaaatatggccacatacacatgtgaagtattatggtatgggatcacgatgtaactctacccttgcgcgcatcacatgtaaattattgaattctaataatttatttcaagttaatacaagtcgtcttgaacaataatacaactgatcagtatatctttataaacaattaaaatatattattttcgtttctttgcacgttgaattaaatgtaagtccagagaggaaaatcagatgattaattctgtatgtctaattgaacattttataatataatcgtatgcattattcgtataaaaaactatataattactaaacaattttattacgaaataaactggtagtgttttgaatctactacaacgcacaaacaactatataatccaacagcattatactgctcacaagaaaaacaaagagagcttcatcatcatatcctaattattaagctcattttccaatg

SEQ ID NO: 35004 - DNA, 3000 bp, Unknown; identical to SEQ ID NO: 35003
  misc_feature (1)..( 3000): 2750-1469P.txt file - cDNA_ID_3083876; gDNA_ID_2926248; Annot_ID_204268

SEQ ID NO: 35005 - DNA, 3000 bp, Unknown
  misc_feature (1)..( 3000): 2750-1469P.txt file - cDNA_ID_3083880; gDNA_ID_2926248; Annot_ID_142973
gctcatcgccaacccggagctcaacaacatcgggtgctgtaacgagctaaacgccggttacgccgccgatggatacgctcgatctcgtggagtcggtgcttgcgtcgtgactttcaccgttggtggactcagcgttttgaacgctatcgctggtgcgtacagtgagaacctaccagttatatgtatcgttggaggtcctaactccaacgattttggcactaaccggattcttcatcacaccattggtttacctgattttagccaagagcttaggtgtttccaaactgttacttgctatcaggtataaccacattatcgaatcttgatcatcacattcttagattttgacagtgtgtttgttttcaggctgtggtgaaccatttagaggatgctcatgaacagatcgacaaggcgatagcaacagctctgagagagagcaagcctgtgtacattagcatcagctgtaacttagctgccattcctcatcctacatttgctagttatcctgtcccttttgacctaactccaaggtaaatataactgatcaatcctgttctcttcaagaatcaagctcaaagatgtgtggattgtttcttaaattaggttgagcaacaaggattgtttagaagctgccgtggaagcaacattggagtttctaaacaaggccgtgaagcccgttatggtcggtggtcccaagttgcgtgtggctaaagctagggatgcctttgtggagctagctgatgcttcaggctaccccgtggcagtgatgccatctgccaaaggctttgtcccagagaaccatcctcatttcattggcacttactggggagcagtgagcactcttttctgctctgagattgtcgagtccgcggatgcttacatcttcgcaggtccaatcttcaacgactacagctccgttggttactcacttctcctcaagaaagaaaaagccatcattgtgcatcctgatagtgtcgttgtggctaatggtcctacctttggttgcgttcggatgagcgaattcttcagggagttggctaagagggtgaaacctaacaagacggcttatgagaactaccatagaatctttgtccctgaaggtaagcctttgaaatgcaaaccaagagagcctttgagaatcaacgcaatgttccaacacattcagaagatgctctctaatgaaaccgctgtgattgctgaaactggtgattcttggttcaattgtcagaaacttaagctgcctaaaggatgtgggtacgtatctagaaaaaggaaactaaatcttttaccttttaacattgttgaagcagtcaatataagctcatctagtaaagtcaacatctagaaattgctggttaaagagtggtggtatatatgtacttggttggaaacgatataaaatgccttggtatttagcctgagatgatttatgggcctatatagatatccccagaactttttagtaattctctggaaaagaaaaaacacacaagagttttaaaaagtcgttgttctctatattgtaggtacgagtttcaaatgcagtatggatcaattggttggtctgttggtgcgactctaggatacgctcaagcaacaccggagaagagagtgttgtctttcattggagacggaagtttccaagtgacggctcaggacgtttccacaatgattcgtaacggacagaagaccatcatcttcctgatcaacaacggtggctacaccattgaagttgagattcatgatggtccttacaatgtgatcaagaattggaactacactggtcttgtcgatgctattcataatggtgaaggcaaatgctggaccacaaaggtaattgatgtttacagttggaaattaaacatatgagtccagggttgaagagtaacattatgaatgttgtgtttttggtaggtgagatacgaggaggagttagtggaagcgattaacacggcgacattggagaagaaagatagtctttgtttcattgaagtgattgttcacaaggatgatacgagcaaagagttgcttgagtggggctctcgcgtctcagctgctaatggtcgtcctcccaatcctcagtagaagcaagagaaaagaaacgaatcttgagtgtcgctcaagcatctatcgtttattggcaatctaatcacatcgctacttttgttctttctcttatgtctaattaagtactggtttcgattttttgaccgctggttttaattgattttgcttttaatatccttcatattagggaaccccttgttgacaaagttttcattataaacttcaatatttctgctttttcttaaacgtgaaatgaaaattgttgatggaatcaggatggaatattctaatcttattaatgcctttacgtgcatgtaaattattgagttccaataattatactaacttctcaatataaggtaataaaattcttgaacaatacgaatctagtatttctttaggttctttttcgtttctttggcagctacttaatgtaagttatatcatagttaagacgaaaatcagagacttaatgctgcattaatggttcatcttggcaaacaagttcaaagatacatatatagttaataacaaaaataaaataaaaaatccatgttatactctaatatagtttgaaaataaatttattttcatcatcttctaacgtaaaatgtcttttcgtatcacaaaaaattataaattttttagtgcaaaataaaacgtccgtgtttcgtgtatataagtatcaatttatataagtaaatttctatctgtaaaaaagtaactaaatgtaagatgacagcaagaaaattgcaaaaatatttcagtaaatctttatgcttttggcacaaggaagtcagaaaccgaatgtaatttgcactaatcaacatgtacaactatataacccatctaataattccaatttattactcatcatcaccactaaaataaatactaaaaggtttcattttcttcataataagctttccaatg

SEQ ID NO: 35006 - DNA, 3000 bp, Unknown; identical to SEQ ID NO: 35005
  misc_feature (1)..( 3000): 2750-1469P.txt file - cDNA_ID_3083880; gDNA_ID_2926248; Annot_ID_204267

SEQ ID NO: 35007 - DNA, 3003 bp, Unknown; identical to SEQ ID NO: 28717
  misc_feature (1)..( 3003): 2750-1469P.txt file - cDNA_ID_3083884; gDNA_ID_2926248; Annot_ID_204266

SEQ ID NO: 35008 - DNA, 3003 bp, Unknown; identical to SEQ ID NO: 26633
  misc_feature (1)..( 3003): 2750-1469P.txt file - cDNA_ID_3083892; gDNA_ID_2926248; Annot_ID_204264

SEQ ID NO: 35009 - DNA, 3000 bp, Unknown
  misc_feature (1)..( 3000): 2750-1469P.txt file - cDNA_ID_3083930; gDNA_ID_2926249; Annot_ID_204321
cgagagatagcattttaattgtttagggcctccataatgttaggaacgtatatgcactttgataatttaaagccaatagagccaagaaacctgaatatttcaaagaacaatcgaaaaaacaagtaatttgtcagtttgtcactgacaaaacaaatccatatccaatttttcaaccattattcgccattcgaattccaagaacaatgttcactgctccaaattaaaaacacagagattctccgcgagaattgctgtcgtccaggcgaccgtttaatttttctgataaattataagccaattttcataataaccaaaatacccctgttgaatagtcaaatcttgtagcaaaataatatgatcagcccatgcatatttatagacgattaaccctcttttggaccaaaattcgtacaacaatcttcctaaaacaacactaaacaattcagtccaggcgacgatctctcctagagcagaagaccgaggaggccacgccggcgacaaccaagagaccaaaaaaacaaacacaccgccttaacaatcaagtgacatcaccgttgtctcctcttttctattatttgataaataataaataaattcattttgttttacttgactttgactttgaacattatgagtactgataccgctttacgtatcttggtccaatatttcgattgcccatacttaagctgtgaatggtaaccaaaaccgcatccaaaaccgcactacaacagtgttgtaacagtatcaaaatctctacatatacatatgtatctatgtattttcgttattatttgaatcgcatcgcactttttccacaccacaaaacgcaatcaccattcggaaccttaatttaatttttcaatagagcgaacttgttaattgtaattcgccacaactatatatttcactttaactagacacaccctttcgttgatttttttttttttttttgcacacaccctttagttgattagtattaccaaatttctagacagatagaaccatataagtaacggatagtaataaaaaaaaagagactatcttttagatgcatggggataaggaactgtcagtttttagtttttatttcgtgtttttaaaacataaatgaaacacatgcttttttagggggtattatagaattgggtacttattgggccaaaaactagagaaaaagaacattttaatgggcttataaaaataagtacttgttgaaataaaaaatgacgattttacccctttctctaattgattgtgttctcatctttcatcgtcttcttcatcatcaccacaattttttccgaccacaacagtccttgcttctcagttctccccaccgcaattacttcattaacgccgtattcttctactctatcattgttatatccgtcaacaccaatcttttctaaaatcccatggatccaatcaaacgaattgtcattgaaggaatctaaactctaagggatactgtccagggaacccaaaaactctaatcttaaacacaaatcagatcaattattttccaattcatcaaaattctaaaccaaaagagaaatcaatttttatcgaagctttgaaaaacttggatgttggaaggagaaagagaaaaacaatcgacaatgaattattagggcaaaaacgtctttacaaccatatataagtacctagatttgtgaggtatatgagatatgccttattcaacaaaggaatagacttaattgtggtttattcataatcgatcctgcttttttaccaggtacagaagggagagagataaaggttacattatgattaatttgaaaaatagattgaacattatgcaggagaaaagctgaggaaaagaaagcagaagaagacaggttgtcataagaaaagagagtaatgacattagaagattccaaaagataaaaaaattactgaagtggacattggagatggtgttggcagagagatttgtcctctcttttctctctatataaaataaaatatctcatatttcttccgttatatattctcctcgtatatagtatatattcaatgactgatgggaatataatctaaaatatattaactcgagtactaaaattctcagttctacgtcttgtcttgtttaatacaaggaaaaactgatacgactataatctagtattgtactatttcatttttccttataataaaatttgaatttttggtttgtctagtgtgacatgacatctctgcgcgtgtacgttcccggctaaaactttgggaagtgtgtttctctgttgcagtaaagattacagtgtatatcattctatattattatagtatataaattatagttctcttctcaaaccagaaatttacttttaagtataaataattgttgattctgtaattaaacaatgaatttgtactaaggtatttagacaaattcactcctctctcagttaataaataatcaaaggggaagaacagagttgcatgaatagaaagctagggtttgctctataattgtagtctttttgtattaggttaaagatggatccctggagagtttgaccctcccctatttatacaatgggtcgaacataccaaaatatgataaacttctaattatcttaagtctaaatctccattacttccattcttcatgagattaccctcttttaaatggaagttttcccttcacacgacctcagaagccgcttatggcgatctcgattgtcgacctaaatcttctggcgagctcatgacttaaggcccattcacaggctatccgggattccccggttcaatcgaattctcgattttattcacgttattccttggtttaaattggtattgtcggaggtgctaattcctgcaccaacaattagtccccccagttcggagagtccgagttgcttaattcgaaatttccgaacttagaaattgaatattcgatttaaatcttggaaagcgtgaattaatcattagatttccgaatcgattcgtatttcgaacgtatctgacatg

SEQ ID NO: 35010 - DNA, 3000 bp, Unknown
  misc_feature (1)..( 3000): 2750-1469P.txt file - cDNA_ID_3083942; gDNA_ID_2926249; Annot_ID_143005
aatgctcctggtggacccaatggttatatgtaaccagatcaatgggcctttaatgggtcaaaattattatcactcaaagcttctaatcaaacaaaggcccaaatacgtgaagagctctccgccgtaaatcagtggcttttcaccgacttcgccattgctaaccgccgtcgagcttccatggctgctgctccatggctccatctctctaggagaagaagctccactcagacttcattaagaagcttcctcatttgctcttcttcattcgattcggatgaattcatttccagtcaaagccgcgtaatcggcgggagaggagaagaggaagtacgattttccggtgctctcttctctcgtatgattcattcttctacttatcatccttaccgtcaaattccattgccacactcctctgtacaactgcttgatgcgagtcttgggtgtagaggtttctctagtggtagttctaatgttagtgatggatgtgatgaagaagttgaatctgaatgcgataatgatgaagaaactggggtcagttgtgttgaatcaagtactaatccggaagaagtagagagagtctgcaaagtgattgatgaattgtttgcgttagatagaaatatggaagctgttcttgatgaaatgaaactagatttatcacatgatctcatcgttgaggttttagaacgttttcgacatgctaggaagcctgcatttaggttcttctgttgggctgcagagagacaaggatttgctcatgactcaagaacatataactccatgatgagtattttagcaaagactagacagttcgagacgatggtttcggttctcgaagagatgggtacgaaaggtctattgacgatggagacattcactatcgcgatgaaagctttcgctgctgcgaaagagaggaagaaagctgttggtatctttgagttgatgaagaagtacaagtttaagattggtgttgaaaccattaattgcttgcttgatagtcttggcagggctaagcttggaaaagaagctcaggttctgtttgataagctgaaggagaggtttacacctaatatgatgacttacactgttctactcaatggttggtgcagggtgaggaacttgatagaagcagctagaatctggaatgatatgattgatcagggattgaaacctgacattgtagctcacaacgtaatgcttgaagggttgttgaggagtaggaaaaaatcagatgcgatcaaattgttccatgttatgaaatccaagggaccttgccctaatgtccgtagctataccatcatgatccgtgacttctgcaaacagtcgagcatggaaactgccattgaatactttgatgacatggttgattccgggttgcaacctgatgcagcggtttacacgtgtctgatcacggggtttgggactcagaagaagctggatactgtttacgaactgctcaaggagatgcaagaaaagggacatcctccggatggcaaaacgtataatgcgttgatcaaactgatggcgaaccagaaaatgccggaacatgccacaaggatctacaacaagatgatccagaacgaaattgagccatcgatacacacattcaacatgataatgaaatcatacttcatggcgagaaactatgagatggggagagcagtttgggaagagatgatcaagaaagggatttgtcctgacgataactcctacacggttttgatcagagggcttataggtgaaggcaagtcgagagaggcatgcagatacttagaggagatgcttgacaaaggaatgaaaacccctttgattgattataacaagtttgcagctgatttccacagaggggggcaaccggagatatttgaggaattggcacagagagctaagttctcaggtaagtttgctgcagcagagatctttgcgagatgggctcagatgactagaaggagattcaaacagaggttcatggaagattgatgacttgggggcgggtaactggatcgttcaactcactcactcggagaaagcttatctgcgaacatgacttcactagcacagcttggactgaactgatcgttcaactcactcactcggagaaagcttttttgtaatttgcttctataacaagaaaatattaattaacagttgtgcactctaatgaaaaaattaagcattctttcactgagaaagtgaagaattgcaactaggccgagagaatagcttaaaacagagcttaaatcgtctgcaaatcatttgaatacaaaacaaagttttagcaaaaggaagatgaaaagttgatgtaaatcatttgaatacaaaacaaagtttaacaaaaggaagatgaaacgtaaatgttttctataaaataaagtttaacaaaaggaagaaagaaacataaaaaaccaaaccagtgtaatgtggacactaaagatgaaagacaaaaaaggtaagaaacttcaacatttctatcatcaaacttgacattaagctttaaaatccccagaaacccaaaatgtgataacatttctatcctagatttctagttttagagaaagatcaagaacataaaacaaaagaataactctcttttattatttaggaaactctgtcaaaacctaaatctcttgatctctcttaaagtcatatataaattaaacttatgtatattggagcttaatatataaattattttgttttatgatttaagaaataagaaagaagctaacaatatatgaacaattgaattaatattgaaaactaagagaaatttggttttgggttattacaaaaaaacaattacagtattagccaagaaaagagagagtttgctcttatagggtctaaaagaaggcccatttacaaatgggcttattagtttaaaggactggtgcttctcttcgtcaatggaggttggtataataatagggtttctgtaggtacgaaagaaaaccctatttgcgcggcatctctctcgtcttcctttactccgtcaaaaccatg

SEQ ID NO: 35011 - DNA, 3000 bp, Unknown
  misc_feature (1)..( 3000): 2750-1469P.txt file - cDNA_ID_3083942; gDNA_ID_2926249; Annot_ID_204318
agggcattggagattcgttcggaggattgggagaaagctggtctgcaactagtgtggcccatgccagatcgccttcttcaggataatcgcattgtttctgacagggcgatctgacgttttatctggccgatagcagatgatccttggtggctttttggattgtttttttcctttgctttttattttcgaataaacgcccttgtgatggctggcgaccttgttaaactctaatttattctggaataaatgtctttgtaatatcccccgatctcgttcggtcgttgattaatacaatgcaatcttattaaattggcttatttcctccgcgacctctgaggtcggcttttgagttcttttcgaagtaacgcaattttttctgtctaattggactagatgttaggtgcgagactgagcccggcttttgagaaagaatattcagcgtgtgctggatgcgagacgtctctcggcttatgtccagcaggcttatgtatgatttaaagagggagttctgggctctgtttccaaaataagtgaggcgggctcagcatattatttggggggcgagatgctgggctcggcttactccccgtagagcatctgttcggcagatcgcgaaacggttcggcttatgtttctgtccgaaccagagcttaagtgcgagaaaactggtctcggctttcccaaaaattaagtttctaatagggcgtggattatttcaccactgcatccatgtgggacgcgcgtcgaacgcctggccagggcgccgagagttgacataacagatcttaaagcgaactctgtattgagaatgcaaactttaattttattaagtattatacctgcatccttgcgataggcgatctgcgtacttagaatatatgaatacagtttgttttttttttttttttttttttgtagctaagctaataatagtaccttttgaggtgggctgcattccacggattttccacttctttcagcttcatggtcatcagcagatagactcctggatgaagtaccttcgagatcaaataaggtccttcccatcgagctccgagttttccggcgttctcttcggtgatactgtaaacttcccgaagcacgaggtcgcctacgttgaagcaacgttctcggacgttacgattgtagtatctcgccgctgcattctggtaattctggatccggatggcggcttgatcgcgaagttcttcggcgaaatcattgtggtcgcctaaaagctgatcgttcagtttgtggtcgttggacatcatgcatcttcgtaaagttggaactccggcttcgtttggagccattgcctcgatgccgtaagccagggagaaaggggataatgatgtaggtcgccgaggcgtagttctgtatgactagagtacgccatccagctcgtttgcccaattcccctttttagggcctagtcttttcttaatcccggctatgatcgttttgtttgtggcttcggctagaccgttcccttgagggtatcttggagtcgagttgctcatgcgaatgttccatttggcgaggaagtttctagtaatgagcgagacgaactgcttcccattgtctgtaacgatctcataaggaagaccgtgccggcaaataatgttcttccagatgaatgcaaccacatcgcgtgacttgactttgtggtatgcctgtgcctcgacccatttggtgaagtaatcagttaagactaacataaatcttttggatccggaaggaggcattggtcctacgatatccatggcccatcgcatgaatggatacggcgccgtgatcgaacgcagtatctcgggaggaacgttcttcatcgggccgtgtctctgacatggttcgcacttcgccgcgtaggcttcgcagtccgccagcatagttggccagtaatgaccatcttttttgattttaaggcagagagctcgtccgccagtaatgactttgtggtatgcatgtgcctcgacccatttggtgaagtaatcagttaggactaacataaatcttttggatccggaaggaggcattggtcctacgatatccatggcccatcgcatgaatggatacggcgccgtgaccgaacgcagtatctcgggaggaacgttcttcatcgggccgtgtctctgacatggttcgcacttcaccgcgtaggcttcgcagtccgccagcatagttggccagtaatgaccatcttttttgattttaaggcagagagctcgtccgccagaatgattccccccgtctccgtcatgcgtttccttcatgagtgttagaaatggagatttagacctaagataattagaagtttatcatattttggtatgttcgacccattgtataaataggggagggtcaaactccccagagatccatctttaacctaatacaagagactacaattatagagcaaaccctagctttctattcaagcaactctgttcttcccctttgattatttgttagctgagagaggagtgaatttgtctaaatcccttagtacaaattcattgtttgattacagaatcaacaatccctttagttttatatacatcccgcagagttattgatgattgatgttacactgattgactcatcttgattttcagttatgtaatatccataaacacgtatacaaagataacgtgaactaagagaaatgtatgatagaatcaaataaatctgaaaataaattggtcccctaaaaaaaacttgagaaaatatcacgaccctaaaacgaagataagatgcatacagataacttccaactaaaaaaagaaattgacacctttgatgattatgcgtttgcgctttaatgctcctggtggacccaatggttatatgtaaccagatcaatgggcctttaatgggtcaaaattattatcactcaaagcttctaatcaaacaaaggcccaaatacgtgaagagctctccgccgtaaatcagtggcttttcaccgacttcgccattgctaaccgccgtcgagcttccatg

SEQ ID NO: 35012 - DNA, 3003 bp, Unknown
  misc_feature (1)..( 3003): 2750-1469P.txt file - cDNA_ID_3083958; gDNA_ID_2926249; Annot_ID_142996
gtaacaaccaatttagcaggcttacaactggaacaaggtatatggtataaatttaaattgaagatagcatttacgtatacctggtcaagcttgtaatagccttccttgtctgtgacagatcttagactaccatctactaagattttaacgccctcaactcccactgaattaccgtcaactacgcgacccccaatggagaatcctgttacctaaaggagcattcagttcaatatttagtggacagaacatgtaagcagagtccgattatagaaacacagagtggtataagagtttgcagttattcttgacctgaaatttttggggaacagtgacatgttgatgctctacagatacaggcataacaggaggtgaaacatcaaagaccgtattctcacccttataatgcggcaccaattcgtattttcctgagtaaatcaaagtgaccaaaaaacaggtcaatagaaatatagagctggaccatgcaaccagaattccaagcgtccttcttgaacttcaacatgcttaatagtcatttaacttatgttgtacaatacataattcatcaggctaaagcttaaggtaaaatgaatgctcaatgaattggttatggataagtaatgatttaccacaagggatggacttgaaactgaaaattccttctgcatcggatacagcatggcaaagagatttcctttctccagcagcgtcaccagatccttggggacaatctaccatggaaacatcatctgaatgcaaatatatatggacacccaggattggattcccctacaaaaggaaacaaaataatttctataaaaaaattaaaattaagaatagagacagacaagtgcatgatggataggaacccaatcaaaccaatgatattcagattctactcatgaaagcagaggaatgtagttggatttgaacatcggaagaaaaaagaaacagagcaatagagggattacctgagcaacaaccgaccccttaagatcataaccaaggacgaagaatatgtcatcaaccatgccatttgcaaatccaagttccacctacaggtaaacagagaacttgaactattagcatgcataattaacaaagttcaagccaaatatatagaaacggatacaatagtaaagaaccgagtagggaaagacatgtgaacttaaaatggaaaaggttggtctggagaattttatacaaaaaaagtaaaataaaaattaaatgcaaaatcaaaaagatctgagacctctgttgaaccgcgaacttcaacttgcagctctggatgggatgcacggatattgtatgttcctgcaaccaatcagacaggctcgtcatttgattataacaagatacctggaaactaggcacttgacatttgatattactctatgggaaaacttccaactacatacatgcaaggcaagaataacaaagtgatagaaaaatagaaaaagagacactgatgatgaaagcttactccttacctggaataatattcttgaataagtagctcccatctgacgatgtgagaacagaagcgacaggatcttctgatccatcagaagacaacaattcaacattgacatctgctgggcctccattcttaatcagacaactctccccaccaacagctcccaagactttaccggataatgtaaaactgcaatatacaaaagagtaaagcatgaaaattttaaacgaagaaagatgaccaaaccaccaattacaaagttgaaaaaagaaaaaagaggcaaacgcatagactaaaacgaaccccgtgaagtggaagttaatatcatcattgttgttgcaactagagtcgtcaacaacaacagttacctgcaacaccaaatttaatgtcataactagctacaagccggatgtttttttatcaagaaagattcttgatgcataatcctcagagaaaaaatggcaaacagattaaccttatctggattccatgaccatccgtcaggtccatttatcttgagaatgaatgagccctacgagaagaaagcatagaaatcacttgcagaataaatgcaacaccgattaaccccgaaaagggtatgatgaataccttgtcatatactgggatgaaatagtaaccatttggggcacactgtgtactgtcttttaccaatccatctactgtttgaagctcaaccttgtaatttgaaggggaacaaacaaacaaatcaatgaaacctcactcagaaaaagatagaaaaaaaaacagtcaactaattgaattcttactgtgatatgagaaaaatccagtttcccatcggatcctttccgagacctgaccaaagacgaactcgcctgcacgtttaataattcagcagcgttagttaataaatccagatccgatcgttcttactgctgctagttcgttaacccatgataatctccaaaaatcaaaacatcctccaactacactgaatctactttagaagcaaacacacacactagctagtaaaatcggtcaggaagcaatcagaacgatggataaaacgaatcgggaaagaaagaaaaaaaagagagataaacctcgacaaaaccaccgcagccttttatcgaatccgcggaaacaccgtagactgtagaaatcgctatgaggaaaacgatcagagaatgacaaatcttcctactggccgccattgtacccgacgtgaagctccagtgaaggagctaaaatggttgaacttaagaaaaagaagaatgattattgttcgtcaatggagcacggatccaagatatcggaccgatgactccgatctgtagatctccgttggttttatcaaggttctcttgactctttagggcttaatgggctttataaagcccactaaaaataatatttaattaaaaataatatttaattaaaaataattgttttttaattacagctgtcgtgatttgcttaccgtttgaagaagagtcaagtaatcgtcagtcaactgtagaaaccaaatttccggtagaaaaatcaaaatg

SEQ ID NO: 35013 - DNA, 3003 bp, Unknown; identical to SEQ ID NO: 35012
  misc_feature (1)..( 3003): 2750-1469P.txt file - cDNA_ID_3083958; gDNA_ID_2926249; Annot_ID_204308

SEQ ID NO: 35014 - DNA, 3000 bp, Unknown; identical to SEQ ID NO: 28725
  misc_feature (1)..( 3000): 2750-1469P.txt file - cDNA_ID_3083962; gDNA_ID_2926249; Annot_ID_204307

SEQ ID NO: 35015 - DNA, 3000 bp, Unknown; identical to SEQ ID NO: 28724
  misc_feature (1)..( 3000): 2750-1469P.txt file - cDNA_ID_3083969; gDNA_ID_2926249; Annot_ID_204305

SEQ ID NO: 35016 - DNA, 3000 bp, Unknown; identical to SEQ ID NO: 28723
  misc_feature (1)..( 3000): 2750-1469P.txt file - cDNA_ID_3083980; gDNA_ID_2926249; Annot_ID_204302

SEQ ID NO: 35017 - DNA, 3000 bp, Unknown
  misc_feature (1)..( 3000): 2750-1469P.txt file - cDNA_ID_3083986; gDNA_ID_2926249; Annot_ID_142990
actctggtctgagttatggtaactatagacagtttcctccttatgctgagtttgatgatggctactcttcaaatcctcctccctatggtggaaacaatatgccaatggattccaagggaagatatccaaatcatggagataactattcttcaaggcatcaagacaacaattatggtgggttccaacgccagagacgtgaagaatatggaaaagcctacaatcgttattagatgactgtagtcagaacttgtttggtaagttgtttctcctctatgaagatgaaagttagtaatgtgctgttcttggagtttatggttttgattgagtagcagatcgaagtgtacattgtggatttttgaagagttcatctttgtctctccctactttgtggcctaaaaaagttgtttgaaaatttcagggtctgcgactctgctgaatatgtgttacgacgaacgagcaaaccaagggttgtaggtaatctgaattcttattaggttgtacacaatgtggcttggagacaatgagcaaactaagggttgtttccttgctgttacgtcactctcatatgtagtaatgttgaataccactatcctttggcttttgtttttaaatatctaaagatttcttgtttaagagtagtgataaaaccattatgattgtactcgtagtttagcctttaaagatattgttttctttgagatatgtttcatttgtgcatatgaatctcttttgcttctgtcaaaatggattctgtctggccatggtttgcaagagttctctgctttccaggagctaacgtctcaaaacttgatcggaagaactttgtttaatactaatttcaaagtttccccaaatctcgttctgacgtgcattagttatgttttgactcttcgttttcctctccaaaagttgcgacttccgcgcttcccaataaagatgcagagcttggttggaacttgaaagaactttgtggtgacattaataatgcagagcttggttggaacttgaaagaactttgtggtgacattaaaagggtcgtattgtctcttcgttttcttctccaaaggtgcgacttttgttattccctttacgcctatataatggcggacgcatctcccaagttttaaacatatatcccattctctccttacctttgagagatgtcgacatccactgtagaaactggatatggtggtcgcatcagagtgacagtggctagaaatgacagagacattaccagtgaagtgagaacatttctgtgtaataaagaaaacgcgaacaaaatcatcggtctggatacagaacgatcggttgtaggaggcgatagcgaatacccaccggagagcaagctcgtgattctcgagctcagtgatggccagaattgcctaataatcccgcttccttatgtacaaggtaataagctgcccgtttctctcaccaatttcctcaatcttccagatttcacctttacaggtgttggtataaacaaggctttgaaaatgctcaagagcgagtgtggtttgacctgcaagaatgccgttgatatcggaccttcgtcgtgggcctctctcagctagattcgtggcgagatcaaacttcatttcagtcattgggtctcgttttggaaaccaacaagccctatctatgaagattgggacaatgacagtcttaccgaggatcagatcaatcttgcagcagcgaatgcttacttggctttcaaagttgggaatttgattagagaagctatgtattgagtcatgcctctgtttgtttttttgtttgtttcggtctctcctatgttttgtcttgttttgctcgtcaattgcctgcagttcaatggacgattttgtcaccatcttaaatcattttggccccaaggtctaatatttggtaaggtatgcccgtatgggattgttacttgttagaaacttcatcactttgcaacacgcgacattcgtaaatcgcaacccccattactttacccggctaccaaagggttgaatcttctcaccaaaataatttagtccataaaaggtacaaatattcggcttgtcatctcgttaattattgggctgggcctgaaattttaaaacctattacaaatctattattagcccacaaacctggaacagttgggctcttttaaaaatttaaaattatgggtactggaatccaacggcagagacaatggataagcctacaatcgttattagacctttttagtctgtctgattgtgtacagaagatttgtttcagtttaggcattattgcattttgaagacttgatggaatggtttatgtgttgccatgaagaacttattcaggaagataaaatctaacgttatgacattactaatatttgcctcatgaatcttaaaggtcaagacagctgtactacatgcatttaactttcgactcttcggtttcctctccaaatgatgtggcttttgaaatctaacgttatgacattactaatatttgcctcatgaatcttaaaggtcaagacagctgtactacatgcatttaactttcgactcttcggtttcctctccaaatgatgtggcttttgaaattcccttttacctataaagatgcaagtatatcttgagcacttggattcatcatgtaccctcattattccagtaaaatatgaattcgaagtgttaagacgataatttcagtatattcagatattgggccggcctgacaactttatacttattacaaaagcctatattagccaacataactaacacttggctccttttccaaatattttgagggggctaaagtatatattgtttagatttggggtcaaattgaaaattataattaaacttaagccgcctctctcttcttctaactcacgcagccgaaccctagctttcataaaattttcattcatcatcgttcttgcttcttgctaaaggccttgccttgtgcttcctcgtcctatctctcttacctccgtaatttgttcgtaagagaagtatcgtgatg

SEQ ID NO: 35018 - DNA, 3000 bp, Unknown; identical to SEQ ID NO: 35017
  misc_feature (1)..( 3000): 2750-1469P.txt file - cDNA_ID_3083986; gDNA_ID_2926249; Annot_ID_204300

SEQ ID NO: 35019 - DNA, 3003 bp, Unknown
  misc_feature (1)..( 3003): 2750-1469P.txt file - cDNA_ID_3084000; gDNA_ID_2684120; Annot_ID_190926
tgattaatcggtatattgactcttagcaaaaaaaaaaaaaaatcggtatattgataaaaccgattctcattctaacaaaatagttacagttttgataaatatccaatttatacaacgataagggaaatagcagaggaacgtgtggagtggtattgtttaagagatccgagaaactgagttgaattttttttttctcaaagagaaagatcaaaggtttcacgtgaggagtagaaagtggaagaccgacataaatgcattatgtattgttgcatattatggaatgtatcaaaactacccaatactcattaccatgtggtgggttatatctcacattggcctcttctccactatgtagtgctgtccatcaattattaaaaaaattaatggtgtaaagtatcttcattgttgtttgtttcttaagagttgaatgtgatatgtcaatatcctctatactaaaatatttgatataatttgatagagttttcatgttgtgtggattgaaccaaagaaaattttgacccttgtatgtagttgtaagtagctttgcttgttcttagtctccacttagtcactcgttttgtaagaaaaaaagtggttgcagcgaaaatataacaaatgtaaaatttaataaagttacacgatttaacaaatgtaagccaaaaatgaatatctcgtcggaaatttactcaaaagttacacgtcttaagcttacaaactcactttatttttccgatcaacattcccttaaaaaacaacattgttttactttcttcttttctattttttaaaatgtgaaatgcacttaaaaagcttaattccttttaaactaatggaaacaaattctttcagtgtttattaatatcaatggatcggataactcaagagtctagataatgaagtaacttatacataaaaaaactttttaagtgcggtttgcataatttaatttgtttcctatttagtatataataacccatttgactaaatatataatactctttcttaaatctttaatactctttttttttaatcccactagtttgcgtgtacgccacttctaaatttatgttagtatcagaccttgaccttaacactgtacaatgggaagagtcccaaacatagtaggagtagtcggaaattagagcatctccatcagtagtctctcatatagtttctcattaactaaaaaatataaaatgataataaagtagaagagagattgagaatagtttctctgcagagaaactttagaataatgattaagagactatgtgtatatgtgtgtttataattggacagaagttaaatcataataaaatatcattatttattttttttagaaactttttgaaatatctcaccaatggagattacgctctcttttttttttttccttatatattcccagtcataacttggagttgtattaaatgtacctacgataaaaaaatcacgtgagaataaaacggagtatttctttacctttacaaaagaaaatgaaaataaaacaattaaacttttaaggaagatcagataagtagttgaaagcctttaatctagtagttgaggactgatgagattaagtagtgagaggaagaggcttgaggaggatctctaacattaatcaaactctctcatcttcctcctgcactccaacaaaatcttctcgtctctctttaaaccaatagcacacaatggcacatgaaacaccacccacgcccagtacaagaaagaggatctgcagcttattcttgatcgtttgtgtcattgcatgtattattggtttggtcgtttttatactcatcaacgaatgcaaacgtccggcgccaaaagtagaattagcttctatggacttcatggtgcttaatatcacatagactcgtcttagtgcaaagtgggatttgtccataaggatccctgcagatcttcctggtgactatatatgtcttcaaggagactttcaagtttcatttctttacaagaatgttactctctttacctcacctccacaaaagtaagctgtttactattaacaacctccgataccgctgtcctcagcttcttaaagtttctgttgttgtctccgacgaaaacattagttcgattggaacatacattatggaagatgtcaaagagaagaagcaagtaacttttggattgcagttttctcttaccgattgcagaaaaaagacgttaggagttatgagttatgcatgctgtggagtcaccttgaggttcgaacccggatctgagatgaaggcgtctgtgtttggaaagcatccaaggtacacaaatttctgaccaagtccacgtcaacaccagtataatgttagagtttgcaaagatttgacattacttaagggctttattgaattagagatttagtttatttgtaaatgactttagatttggttcgactttatttagggtctaaagtttattgtataactgtttaatatttgtcaggacttaatgaagatgtaatgtttagactttggtgtattttgtacgacatgcatgatataataaaggaattatcataattaaattgaacttataaaaatatgacttgccttacttctcttttgaaatagaaattctaatgtaggtaaaatgtttgtgtttacataattacattacatcaacaaacgtaaaaaaatgtttgtgtcattaaatgtttatccacgtactcttcacaacgatcataagtcataattcagaaaattcctttaataaatgtgaactgaataagcttttgtatagtcatcaaataaaaagtcaactgtacaattaaaagtccgcaaacatctcgatcgtctaagagacgacttttctcgtaactttatgaagaatatacaatagtagtggcttgatcgcgtccacacatttacattgcgacttttcttgcatgccgtctcacgcactatatttaggcaaaacacaattgtcttcatttcaagactagttcttgttttctccatattcctcaacaacatcaaaatg

SEQ ID NO: 35020 - DNA, 3003 bp, Unknown; identical to SEQ ID NO: 35019
  misc_feature (1)..( 3003): 2750-1469P.txt file - cDNA_ID_3084000; gDNA_ID_2926250; Annot_ID_143023

SEQ ID NO: 35021 - DNA, 3003 bp, Unknown; identical to SEQ ID NO: 35019
  misc_feature (1)..( 3003): 2750-1469P.txt file - cDNA_ID_3084000; gDNA_ID_2926250; Annot_ID_204348

SEQ ID NO: 35022 - DNA, 3000 bp, Unknown; identical to SEQ ID NO: 28730
  misc_feature (1)..( 3000): 2750-1469P.txt file - cDNA_ID_3084005; gDNA_ID_2926250; Annot_ID_204341

SEQ ID NO: 35023 - DNA, 3003 bp, Unknown
  misc_feature (1)..( 3003): 2750-1469P.txt file - cDNA_ID_3084009; gDNA_ID_1972165; Annot_ID_179758
aataaaaaccaaacaaaagcttcaatatgattcacttaaaatgtggtaagtaggggagatgaaaaggacttatcttatagaaattgagtcgtttattttgttggtccaccatacatttacatgaaatggttacatcaggacgagtgttgtctgagacctagaaaatcagaaaccaaaaccacaaaagaattaaaatgaaattacagacacaatcatgaatctctaacataagaaataacaaaaccaccttcacgtgatacaactctttggtttcttcaacacaaaatcccattttgtgtacagctctatacccaacattttcgacataagactttgggacatttgtacgaaacattttcttcaatttctccaaagtgcttttagttaacggaccatctcttagagttcctgatgaactaacactgcatcaatttgataagataacaatcggtaaacttgtttattcaacataaaaaagacttgattagcgagaaatgcgcaatccaactatagtttctaagttgtctagatagtagataaccgactcaactatagtgtccaagttgtcaacacagtttcaatccactacaaaccacctacggtaattacaatgctcttaaaccaacactaggctaatcactaaccctgccccaggtaaaacagagtttgtgtgtgtccctaaaaactgaaaatttgaggagaagtcaaaaaccttactcatggaaaacaacattaccaaaccgagcgatcagtctgagtttgacatcctctgatccaccataacctagcaacgtcttctttgccctatcaaatcccattataatgtcatcctccactttctctgtcacccataaccatggattttccagttttcccaaatcactcttcgctaagattaccaaagatttttcttctgcgtctttcctccactctgaagaaccgggcacaagttgaaagttgctatcctctggatccgaaccaacgagaaaccatctagaaatgtaaccgtttgcgtagattatctttgtattagtactcccgacgtttttattgtgttttttaagaagagaaggtggaacagaggatgctctcaatgcaacattttcaagtcgtttatgtggtggaacgtaagacatctctgaaacgaatatatgatactaggaaaattaaaagctgattccaaaaagataactcaagtttccgagcaacgaagtatgagaagaagaaacaaaagagtaccttttaattatatcagcttaggtcattcaaaagaagaacgacgatcatacgagaggaaactgaaaaggcgcagagcagtgaactgaagtggaagagacgagacggtttggtctttttatcactagaagtttagtcttggaaatgtgcataatatttaatttcatttcaattttcaaatcaaaaaataaaaccgataacgaaactcttgttatcatattatgagcgttgataatttagagaatctctgttcttttagaaaattgtatgaacattttgttaaataaataactatttttaaatgctaaacctcattgtttagtcctaaatgttaggaatcttagtattcatttttttttcctcttatgatatacacttccggtttagatttctaggacgttttaaatttaattattactgctaataaaaatagttatttatttttaaacaattaaataaaacaattgtatctctagagtaaaaaaagttttaaaaattttggtgaatgtttttatttggcaacccaacttaattcctgaaacgaatcacgagaattatttaacgtactacaaaaggtacatctaattttctaaaaccgaattagactatcgtcttggttgtttttggatgttgcatgtctatattatgataattattctgtaagcattacaattaaatcgtttctgtttttactaaaggagttttgactgttttaaacgactgtaaacactcgtgtgtctgcttaaatcatgtggaaagttaaatgataacagttagaacatccaactttacatatgctttgattagacattttctacgatatgtttcggattgacacgtgctaatcatatctgatcattttcccattttacatatgttctaattaggcattttcgacgatacattttagatcgataatgtgttaataatcatctgacattttttactttgtatgttctaattatgtatttatacgataaacattagatcgacacatgcaaaacattcgacaatttgttgaacactgaagacctaatttggtataatacagctcagcgaagatacgttacaactaatttggagcgtttatagaaaatataggcaaatagccaaatatgctaataaaaagatttagaactttaataggtaatttaacacattttataacacacaagcatatatatttaaaagggaaaaaactagtcaactttcatagaccatcattaccataataactcaattcaatcaaattttaatttttggctactatttttcttttctaaaaccaaaacatcatcatagtagattcttcaattttaaaatatagaattcaaattgttgaccagggaataaatagaattgcaaaaaaacaaattaagatattttacattccaacttttcccccaaaaaattagagaaaaaaatcaaattaaattcaataattccaaaacataaaacgtacaaaaaagttaatgataaaaaaacgtaaaaaaaaatacaaaaatacaaagaaaaaagaaagacagcgtggagagtaaagctattggtagcatggctgcaacagaaggccaagtgtttggtcttacaatttcatttttaactctttgtgttaattaacccaattagccctttcctccttcagggtttatttaacttgccctttctcgtttcctcctttttttcttaaaccactctgcttcctcttcctctgagaaatcaaatcactcacactccaaaaaaaaatctaaactttctcagagtttaatg

SEQ ID NO: 35024 - DNA, 2987 bp, Unknown
  misc_feature (1)..( 2987): 2750-1469P.txt file - cDNA_ID_3084009; gDNA_ID_2926250; Annot_ID_204339
aagcttcaatatgattcacttaaaatgtggtaagtaggggagatgaaaaggacttatcttatagaaattgagtcgtttattttgttggtccaccatacatttacatgaaatggttacatcaggacgagtgttgtctgagacctagaaaatcagaaaccaaaaccacaaaagaattaaaatgaaattacagacacaatcatgaatctctaacataagaaataacaaaaccaccttcacgtgatacaactctttggtttcttcaacacaaaatcccattttgtgtacagctctatacccaacattttcgacataagactttgggacatttgtacgaaacattttcttcaatttctccaaagtgcttttagttaacggaccatctcttagagttcctgatgaactaacactgcatcaatttgataagataacaatcggtaaacttgtttattcaacataaaaaagacttgattagcgagaaatgcgcaatccaactatagtttctaagttgtctagatagtagataaccgactcaactatagtgtccaagttgtcaacacagtttcaatccactacaaaccacctacggtaattacaatgctcttaaaccaacactaggctaatcactaaccctgccccaggtaaaacagagtttgtgtgtgtccctaaaaactgaaaatttgaggagaagtcaaaaaccttactcatggaaaacaacattaccaaaccgagcgatcagtctgagtttgacatcctctgatccaccataacctagcaacgtcttctttgccctatcaaatcccattataatgtcatcctccactttctctgtcacccataaccatggattttccagttttcccaaatcactcttcgctaagattaccaaagatttttcttctgcgtctttcctccactctgaagaaccgggcacaagttgaaagttgctatcctctggatccgaaccaacgagaaaccatctagaaatgtaaccgtttgcgtagattatctttgtattagtactcccgacgtttttattgtgttttttaagaagagaaggtggaacagaggatgctctcaatgcaacattttcaagtcgtttatgtggtggaacgtaagacatctctgaaacgaatatatgatactaggaaaattaaaagctgattccaaaaagataactcaagtttccgagcaacgaagtatgagaagaagaaacaaaagagtaccttttaattatatcagcttaggtcattcaaaagaagaacgacgatcatacgagaggaaactgaaaaggcgcagagcagtgaactgaagtggaagagacgagacggtttggtctttttatcactagaagtttagtcttggaaatgtgcataatatttaatttcatttcaattttcaaatcaaaaaataaaaccgataacgaaactcttgttatcatattatgagcgttgataatttagagaatctctgttcttttagaaaattgtatgaacattttgttaaataaataactatttttaaatgctaaacctcattgtttagtcctaaatgttaggaatcttagtattcatttttttttcctcttatgatatacacttccggtttagatttctaggacgttttaaatttaattattactgctaataaaaatagttatttatttttaaacaattaaataaaacaattgtatctctagagtaaaaaaagttttaaaaattttggtgaatgtttttatttggcaacccaacttaattcctgaaacgaatcacgagaattatttaacgtactacaaaaggtacatctaattttctaaaaccgaattagactatcgtcttggttgtttttggatgttgcatgtctatattatgataattattctgtaagcattacaattaaatcgtttctgtttttactaaaggagttttgactgttttaaacgactgtaaacactcgtgtgtctgcttaaatcatgtggaaagttaaatgataacagttagaacatccaactttacatatgctttgattagacattttctacgatatgtttcggattgacacgtgctaatcatatctgatcattttcccattttacatatgttctaattaggcattttcgacgatacattttagatcgataatgtgttaataatcatctgacattttttactttgtatgttctaattatgtatttatacgataaacattagatcgacacatgcaaaacattcgacaatttgttgaacactgaagacctaatttggtataatacagctcagcgaagatacgttacaactaatttggagcgtttatagaaaatataggcaaatagccaaatatgctaataaaaagatttagaactttaataggtaatttaacacattttataacacacaagcatatatatttaaaagggaaaaaactagtcaactttcatagaccatcattaccataataactcaattcaatcaaattttaatttttggctactatttttcttttctaaaaccaaaacatcatcatagtagattcttcaattttaaaatatagaattcaaattgttgaccagggaataaatagaattgcaaaaaaacaaattaagatattttacattccaacttttcccccaaaaaattagagaaaaaaatcaaattaaattcaataattccaaaacataaaacgtacaaaaaagttaatgataaaaaaacgtaaaaaaaaatacaaaaatacaaagaaaaaagaaagacagcgtggagagtaaagctattggtagcatggctgcaacagaaggccaagtgtttggtcttacaatttcatttttaactctttgtgttaattaacccaattagccctttcctccttcagggtttatttaacttgccctttctcgtttcctcctttttttcttaaaccactctgcttcctcttcctctgagaaatcaaatcactcacactccaaaaaaaaatctaaactttctcagagtttaatg

SEQ ID NO: 35025 - DNA, 3003 bp, Unknown
  misc_feature (1)..( 3003): 2750-1469P.txt file - cDNA_ID_3084023; gDNA_ID_2926251; Annot_ID_143043
aggttactttcttgattaaagtacaagagtatttcagtgtttatttattataaccattattggatatccgttgggataagtgttcatacacaaaatggtttagtaatatcgatacgcatcaagccaatgaataattaatagttttccccatcattattggttttgggtcagaaaccaaatagttttcatctaaaatctttgaatgtaaaaagtgatccaccacagcacgctgagatgaaccctcaaaagaggataagtatacatgttggatacgaatgataactaagccatcctagaaggatttatataccgctcattttgaagactatcatattatataatcagctattccaacataagggggagaatgtatacagctggtgaaaaaaaagataaaaagaaatgaattatcaatgatcctcggagtaaagaatgtatattaagagtctaaaagataatttaattatagaatttagcgttgtaattgccagacgcatttgctgacccaaataaagtgatgaagtcacttataccagttgtaaattaaatgctccagaatataatgaatgtcctgtaaggaccaatttcaaactgctattgagtcttaagatcgcatgaagcgtaatagaccttggttccaaatataaatatcctcgtaaaagtgaaggagcacaaaattaaaaatgaccaaattgaggaaataaatattttgatgatctcttgaagagagtgaatgatccctaaaagagacataaacatgacaaatgaaacattcaagtacttgacaatgaagagatctagctagctatgtcatgtcaaaatataatggaatcaaaagcaaatcgacgtcgtaatatatttgcatgctatgagcagttgaaattatagacaaaaaggaggatcatgaaagaaagtctattgaaaagtgtacacaaagtaatgattagccaaaaatggaaaagaagaaatagacatataattataatctctagtagagatatttagactagtagtctatgcacatgatgtgtaaaaccagtggaaaataaatgagtctttatgtgaaagaatagtgaaattaatgataagaaatgtattatgaagagatatattctcttgtggtggatgtaatattttttttttaagtatctaaagtctggcaataagagacggaacactggatatgacatttatatgaaattcttgaaagatataatctctgaaggattaattatatgagaattatgttctctagaactctactcgatcgaataaaaaaaaaaaatatatgtaacatgacatataatcatataaatgtatatttatgttgagtttgcaaaatatattgatcaaactaatatttgttttgaaaatcattaaaactcctagagagttatcataagtaatacgatgacaataatctatgataaaatatcactagataatgatatttataagtctatatgaaaaccatataattttgatcattaagattatggttattaattccaacgagatattgtatttgattgaaaatcatctcctgaagaagatgtttccgagggggagattgaatgatatgcgtggatgtaccctttttccttatcatagtttttatcccacatgatttttctatgacaaggtttttaacgagacattaaagaacacgcaaataatacacttgatgaatgttaggaaattctatcaatcatccaaatgaatattatacactaatgatatttagagaaataaataagatggtcaagataaatcatctaaaagattcatgagcagcagaaaaatggcgttgtactttatccagaaatttgttcaagagaagaattggcagacttattctcaaatactgtttattctctgccacatcttctaatcatgcagagattttaccaattcatgaagctagccgcgagtgtgtatggctaagatccatagttcaccatatacaagaagactgtggtatgtatgcagggaaaaagactccaacaaatatgtacgaagacaatgcagcatgcataactcaaagacggatacatcaaaggcgatagaacaaagcacatcctaccaaaattcttctttacccacgatctacaaaagagcgtcgatgtacaagttttacagatccgttcgaatgataatctggctgacttattcaccaaggcgctacctattgctacttattcatcgtatcggattacgccgtctcaaagatctcgacgaatatactcataagggggagtaattgtgtgttgcactctttttcccttaaccatggtttttcctattgggttttcctggtaaggttcttaatgaggcagcatttcaaatactttacgagttatgatactataatggtcatcagggggagtgttatgaataaagatggatgcccattataaggcccatcatctaagcccataatctacatgtttttagggttttaccatttccttatactcctatataaagaaccctttatctcaatggaataacacactcatttcctctatctctttctctgtttataacaaaatttactattttttaaattatgttttaaaatgtgattactttccaaactcactcttttgttaattattatgatttatcttcaaaaatttggctacttagtcaatattctcatgaatcaatacaaaatatccggttcaactatccccggtttggtgtaatcataaccgatgcaatcatatatttaatgaattaaaaaatagaagaagcgcaacgtttcagaaatcaaaaagccccaacgttccgattaatttcaaaaaactgaaataaatctcagccgttcattaacacgctcctttcaccctccgatcacatctcgtcttcttcacaacgtttcctttactctctctctccatctcttcccccttgagacccaaatttcaaatttctctcttctctctctcactgactcagtgaattctcatcttctctcatcacccaaccaaatcaagcatg

SEQ ID NO: 35026 - DNA, 3003 bp, Unknown; identical to SEQ ID NO: 35025
  misc_feature (1)..( 3003): 2750-1469P.txt file - cDNA_ID_3084023; gDNA_ID_2926251; Annot_ID_204391

SEQ ID NO: 35027 - DNA, 3000 bp, Unknown; identical to SEQ ID NO: 28738
  misc_feature (1)..( 3000): 2750-1469P.txt file - cDNA_ID_3084041; gDNA_ID_2926251; Annot_ID_204385

SEQ ID NO: 35028 - DNA, 3000 bp, Unknown
  misc_feature (1)..( 3000): 2750-1469P.txt file - cDNA_ID_3084092; gDNA_ID_2926251; Annot_ID_143026
ttaaggtggttcgcaacaacagtatgtctcgaccactttgcaaacaatgcaagtctcgttgcatatttccagtcatcttggaaacatggaatgaaagctgcctccgtaatgaatattattgctctgaagcttgtttctattcctaattttattatatatgttgttttcgagctttttatatttgatgtgtgattttgatttatttgattgcgaccatgtttttttctattctaggtgagtacccacgctacgcgtgggcttatgtttagctttgattttttatattatctttacttgttcattcgttctaagaacttgtagttttttgaaattattttcatatggaactattaaatttcatagtatcatataactaataaattttgtaaaattaataaatctaaactatagatgacaatagagttattaagtttgtgagagaaataagagaattcactataacaaagtcatcactgtgagatgcatggttattatcatgttggtaatattgtgtatcaagtcacagaagaatttgtttttttttagtgtacgctttagattgaggtaaatcataaaatcaacatcacgagttttctcttacaccaaaataatttgaatctcatctacaaccagaaagaataataataatggtcatgggttatgtttctattaaacattctgctaactttgtctctaaatccaaaaactcggcttcatgtacgcaagccaattcatcaaactactatttgccacatagaacctacaatcattcactttgttcaatttaccttacaacaatatacacaaaatttgtatttgtatggataagaaggtgtaagaacaaaaatgattgactttgtgtgctaccatttattatattcatgttttcttcttttttttgtgcattttactcagttaagtgctagaacggtattaatattagtaaaagcaatgtagatataaacatttaaaataaccttacaaacttcttgataacttagctttaaactatttgatgcatataaagctagctatgaggtgatggagtctaaaacctactttagccatgaaaatgatagttttatgaagagtcgatgctttaaaatgatagaggagaagtttaagggttgatgataatcttaaattgaagaagtatataaaagtcattgattattggaaggtaaaacttaattttaactttttagctttaaattctatttggacatgtgacattcttttaggtgttgatgtgtcactcatacagagagagttgaccaactttcatatatatgatttaacgtgtcttgcttcaacatgaataaaaaattacgttttaaagttttttttgttaaatattattttcattaatttaactaggaaatgaacccgcccgatatcgcgttggagcttattttataaatttgtattttatgattaagttttatatgggtactttaatgtaataatgtatagtgttatgaatatattgttcagaagaagactgattacgagttttaatattattttttaaaaatattattatttggatgtgttagttctattatatacagaataaataaacccactattaaagtggttatgatatactttgcacattttatttagtcctacttaaaatatgaataaattgctttaaactacaataaatattttataataaatatagcatctcaaatataataagaacgttgtatttaaaacatgggagatttgcaaaactacccttttttactacccttttgcaacaatacctttttatgttgtccatttttaaaaataccccttcccttgccaaaaatgaccaaagtaccctcatctaattggaacatgtaatttgaaactgaaattttcccgccaaatttctggcgtcaaaatttattttttccgccaaaacaaaattctgccaaactttttttccgccaaaaaaaaattcctgccaaaaaaaaatttcccgccaattttgttttcgtaacagattttttctcagccaaaaaaggcttttaaaaatccttgtaaattttttttgggcggaaatagatttacaagggattttcaaagggttttaaaagatttacaagagatttttaaaggattttaaaatatttacaagggattttaaaagggttttaaaatatttacaagggattttaaaagggttttaaaatatttacaagggattttaaaaggttttaaaaagatttacaagagtttttaaagagtgttcttgtaaatttttcaaaaatcttttaaaaacccttgtacatcctttaaactccatttaaaccttttaaaaatctcttgtaaatcttttaaaatctcttgtaaattttccttttaaaattccttgtaaatactttaaaactattttaaaatcccatgtaaatcttttaaaatccttttaaaatccattgtaaatctatttcccgccaaaaaattgtttttgacgggaaattgttttttgaaaaaataatttttgcgggaaatattttggcggaaaaatttgggcaggaaatttgttttggaatattttaggcaaaaaaatattaatgttacatttttgttaacataagataatttccaaataggggtaaaatggtcattaaaaatttaaagagggtagaaatgaaaatgaataaaacaaaagggtagagttgaaaagaggcatcatgaaaagggcattagaaagaatttttcttaaaatatctaaacctaaaatgtcaagcattacaataatcaatttaaaataatctaatatactatagaaggtaactcaaatcgacaacatggacatttatgatttgtctcaaaccatttttcaaggcgttctgcatcaaacacattattttgtggattgttagtggttagttagactagctacatttatttcacttatgtggttcttcacttctattttcagaattctcagaagtttatgatctaagtaagtggtgttcgagttatgtctatgagtcaccgatg

SEQ ID NO: 35029 - DNA, 3000 bp, Unknown
  misc_feature (1)..( 3000): 2750-1469P.txt file - cDNA_ID_3084092; gDNA_ID_2926251; Annot_ID_204367
aggtggttcgcaacaacagtatgtctcgaccactttgcaaacaatgcaagtctcgttgcatatttccagtcatcttggaaacatggaatgaaagctgcctccgtaatgaatattattgctctgaagcttgtttctattcctaattttattatatatgttgttttcgagctttttatatttgatgtgtgattttgatttatttgattgcgaccatgtttttttctattctaggtgagtacccacgctacgcgtgggcttatgtttagctttgattttttatattatctttacttgttcattcgttctaagaacttgtagttttttgaaattattttcatatggaactattaaatttcatagtatcatataactaataaattttgtaaaattaataaatctaaactatagatgacaatagagttattaagtttgtgagagaaataagagaattcactataacaaagtcatcactgtgagatgcatggttattatcatgttggtaatattgtgtatcaagtcacagaagaatttgtttttttttagtgtacgctttagattgaggtaaatcataaaatcaacatcacgagttttctcttacaccaaaataatttgaatctcatctacaaccagaaagaataataataatggtcatgggttatgtttctattaaacattctgctaactttgtctctaaatccaaaaactcggcttcatgtacgcaagccaattcatcaaactactatttgccacatagaacctacaatcattcactttgttcaatttaccttacaacaatatacacaaaatttgtatttgtatggataagaaggtgtaagaacaaaaatgattgactttgtgtgctaccatttattatattcatgttttcttcttttttttgtgcattttactcagttaagtgctagaacggtattaatattagtaaaagcaatgtagatataaacatttaaaataaccttacaaacttcttgataacttagctttaaactatttgatgcatataaagctagctatgaggtgatggagtctaaaacctactttagccatgaaaatgatagttttatgaagagtcgatgctttaaaatgatagaggagaagtttaagggttgatgataatcttaaattgaagaagtatataaaagtcattgattattggaaggtaaaacttaattttaactttttagctttaaattctatttggacatgtgacattcttttaggtgttgatgtgtcactcatacagagagagttgaccaactttcatatatatgatttaacgtgtcttgcttcaacatgaataaaaaattacgttttaaagttttttttgttaaatattattttcattaatttaactaggaaatgaacccgcccgatatcgcgttggagcttattttataaatttgtattttatgattaagttttatatgggtactttaatgtaataatgtatagtgttatgaatatattgttcagaagaagactgattacgagttttaatattattttttaaaaatattattatttggatgtgttagttctattatatacagaataaataaacccactattaaagtggttatgatatactttgcacattttatttagtcctacttaaaatatgaataaattgctttaaactacaataaatattttataataaatatagcatctcaaatataataagaacgttgtatttaaaacatgggagatttgcaaaactacccttttttactacccttttgcaacaatacctttttatgttgtccatttttaaaaataccccttcccttgccaaaaatgaccaaagtaccctcatctaattggaacatgtaatttgaaactgaaattttcccgccaaatttctggcgtcaaaatttattttttccgccaaaacaaaattctgccaaactttttttccgccaaaaaaaaattcctgccaaaaaaaaatttcccgccaattttgttttcgtaacagattttttctcagccaaaaaaggcttttaaaaatccttgtaaattttttttgggcggaaatagatttacaagggattttcaaagggttttaaaagatttacaagagatttttaaaggattttaaaatatttacaagggattttaaaagggttttaaaatatttacaagggattttaaaagggttttaaaatatttacaagggattttaaaaggttttaaaaagatttacaagagtttttaaagagtgttcttgtaaatttttcaaaaatcttttaaaaacccttgtacatcctttaaactccatttaaaccttttaaaaatctcttgtaaatcttttaaaatctcttgtaaattttccttttaaaattccttgtaaatactttaaaactattttaaaatcccatgtaaatcttttaaaatccttttaaaatccattgtaaatctatttcccgccaaaaaattgtttttgacgggaaattgttttttgaaaaaataatttttgcgggaaatattttggcggaaaaatttgggcaggaaatttgttttggaatattttaggcaaaaaaatattaatgttacatttttgttaacataagataatttccaaataggggtaaaatggtcattaaaaatttaaagagggtagaaatgaaaatgaataaaacaaaagggtagagttgaaaagaggcatcatgaaaagggcattagaaagaatttttcttaaaatatctaaacctaaaatgtcaagcattacaataatcaatttaaaataatctaatatactatagaaggtaactcaaatcgacaacatggacatttatgatttgtctcaaaccatttttcaaggcgttctgcatcaaacacattattttgtggattgttagtggttagttagactagctacatttatttcacttatgtggttcttcacttctattttcagaattctcagaagtttatgatctaagtaagtggtgttcgagttatgtctatgagtcaccgatgatg

SEQ ID NO: 35030 - DNA, 3000 bp, Unknown
  misc_feature (1)..( 3000): 2750-1469P.txt file - cDNA_ID_3084106; gDNA_ID_2926251; Annot_ID_204363
acgtgttaatctcagatgaagatcaagctattctgctgctcatgtccttaccgaagcagtttgatcaactgaaagatactcttaagtatagctcaggaagaacaactctctcagtcgatgaagtagttggagctatttactcaaaggagctggaacttggctcaaataagaagagtatacgaggacaagctgagggtctgtatgtcaaagagaagaacgagacaagaggtagaccagagcagagggaaaatgacaacaagaacaactgttctagatctagatctaagtctaaaactaggaaaggttgttggatctatggagaagagggacatttcaaggcgtcatgtccaaacaagggaaagccacataacaaagggaaagaccaagggaacaacagcaagggcgaagctcctttggttacaaagaacacatttgagggcttaggatactatgtgtcagaggcattacattcaactgacgtaaatctggagaatgagtggatcatggacaaaggttgcagttaccacatgactcacaagaagtaatggtttgaggatttgagtgaagatgtaggaggatctgtaagaattgggaacaagacaacctcaaaggtcaaaggcattggaagggttagaatccaaaacaaggatggaacatctttcttactcacccttgtaaggtacattcctgacatggatcataatttaccatctatgggaaccttagatgaacaaggttatagttttgagtcaagtaaaggagtcttagtggttaaggaaggaactagggctgtactgataggtaacaaacatgagaagctttacttactccaaggaaagcctgagataagtaattcaatgactgtggagagaaggaaagatgatacagtcttatgtcacagaagattaggccatataagtcaaaagaatatggatatcttggtcaagaaagggtacctagaccgaaagagagtctcaagacttgaaatgtgtgaagaatgtatctatgttaaagcaagaaggttaatttttgtgaacgcaactcatggaactgaagataagttaagctatatccactctgacttatggggagcaccatcggttcctttatttctgggaaagtgtcagtatttcatctcattcatagatgactactcaagaaaaacgtgggtttactttctcaagcataaagatgaggcatttggaacatttgctgagtggtgtgttatggttgaaaaccaaacggatagaaagattaagattctaagaaccgacaatggtctagaattctgtaataatcagttcaatgagttttgcaaggatagaggcatagtcagacctcgaacatgtgcctatactcctcaacaaaacagcgttgtagagaggatgaacataacgattatggagaaggtcagaagcatgttaagcgagtctggcttaccaaagacgttctaggctgaagctacgaacactgcagtcaccctcttcaacaagacaccgtcatctacaatcgattttgagattcctgataagtgctggtcaggtaagtctccggtttatagctatctaaaaagatttggctgtgttgcttttgttcatgccggtgaaggcaaactggtgcctagagcaaagaagtgcatctttctaggctatcctgcaggggtaaagggatacaaagtctgggtgttggatgaaaagaagtgcacagttagcaggaatgtagcatttcaggaaaatgctgtttacaaggatttgatgcaaaaaaaaaaacaaagatgatcaagatcaagctgaaacatcaagagattctttcgacatttatctagaaggccttggagatttgagtttaggtggagacctcttggaagaaacaggatccctgggaggtccttcacaaactcaggtcaatctctaagatgatgattcagagaacaatgaagtggtgactaatactcttgacagttaccatttggtcagagatagagaaagaagggaggtaagagctcctaggcgctttgatgtggaaggctattacagtgagtctgcagatgatgaggaatcattaaatgctgaagcccttgtcaccacttttgatggagataccatcgaacctgcaagttatcaagaagcactgaaagatgatgattgggttctgtggaaggaaggcatagatgaagagatggattcactgttgagaaatgatacatggactgtagtcacaaagcctaaagaacagagagtgatcggctgcaaatggattttcaagcgtaagcctggaattccaggtgtagagatggcaagatttaaagcaagactcgttgctaagggatatgcacaacgagaagggatagattacactgaagttttctctcctatggtgaaacacgtttccataaggattctgcttgccattgttgcagaggaggactatgaactggagcaacttgatgttaaaattacatttcttcatggagaattggaagagaagatctatatggaagctcctaaaggtttcgaagatcagtttaagtcagatcaagtgtgtctgttaaacaaatccctatatggtctgaaacagtcaccaaaaagatggaaccagaagttcgatagctacatgctagagattggttttgagaagagtcctcgtgatagttgtgcttacataaagtcactggaggatggttcaaagatctacttactcatctatgtagatgacatgttggtggctacaaaagacatgaaggtcatttcagaattgaagcagaagttaagtgagagatttgaaatgaaagaccttggagctgcaaagaaaattcttggtatggagatcacaagagaaagaagtaaaggaaccttaacactgtctcaagaagattatctaaataaggtattggagctttataaaatggagcaatgcaagccggtgatgactcgtcttggtgttcaccttaagatgcaggctgcttcagagcagcaactcctggatgatgaagagtacatg

SEQ ID NO: 35031 - DNA, 317 bp, Unknown; identical to SEQ ID NO: 28741
  misc_feature (1)..( 317): 2750-1469P.txt file - cDNA_ID_3084146; gDNA_ID_2926252; Annot_ID_204416

SEQ ID NO: 35032 - DNA, 3000 bp, Unknown; identical to SEQ ID NO: 28740
  misc_feature (1)..( 3000): 2750-1469P.txt file - cDNA_ID_3084163; gDNA_ID_2926252; Annot_ID_204411

SEQ ID NO: 35033 - DNA, 3003 bp, Unknown
  misc_feature (1)..( 3003): 2750-1469P.txt file - cDNA_ID_3084167; gDNA_ID_2926252; Annot_ID_143050
cgtggtttgaaccctttgacttgccatgagtctgagagagtctttcaatgacatttctagcaaccgaacgaggcgatccatgccgcaacccattatccacacaatcagcagaagagtaacgtaaatgggtgcctttagcttctctaaatgactgggactttcgtttctcatcgaaagtgtctgatggtgatgtagggactgtccattgaactcggggtggaagcctccttcgatttatactctcagaaacaccactgtgtgaagaattactcttttgcttgcacggttccaaatgctcttctccatcaatataacggtccagaactttactagagacattactcgaacaagatgatgaactcccagacgaatcatgctgaaacttgtctgctttacactgcctttctctaacttgtctttctggagtaaagcatctggtacacagtattcattacattgtttgtcagtggtttaatcaaatatagaaccaagatagcgaaaacattacagaaaatcatcaaaacaatctcataagaatgaagaaaggccaaaagcataccgagatgaatgattgcgccgcctatccttgcttttagtagcactagttgttagttcattcttggaagtttctccaaacttgtcaaaaaggaaacctgcagaggaccatgaaaggcttcgtctaagagctagaccaccagaaacttgaccatgtgacttaggactatcgaactcttgttcagcctgactactagcttgggttctcatcttactatccgcttctttttcgcagttaacttgtttatcatttccattaccagaagatctgaaaaagaagagctttttcattgttttctccaatcaaaaggtgctataacaactgcagctgcaatcaaaacatatagaagcaaatcaatagattgtaagatatctcctgcactaaactaggaaaagttcacattttgcagcaaattagttcatgtcaatctccaaaaaaagtgctccaagtgaatcttacaaacaatttgctcgatgaaagataaaccagttcaacaaaagaaatgagaaaaaacagcataaatgatcttagactcgagataatcaactataactctactcagagattcagaaactcaagacttatcatagtaaacatcgagccaaggcctaaaataaaagaccagactaccctaagcatcttcaaagctacgataaaccctagagactaatcaaatcacaaatcgaacctaaatcctacttgcggagaagttgatgaagattatgttcggcgagattactcgaacactaacaaaatctagaaaggctctctctttaaacgatctcaatcgatttcgtcgccagaaaatccaactctactctctctactctcttctaatagttggaaaattgaaagaaaaaggaaaaaaaaacactgagaggcgacagctttttatgacgacacaattggctttaaagaaaaccaaagaaacacagagaaaaattttaaaatttcaaaagggaagatctttagaatttatgaacataccataaaacagcgattttgcaaatcgaaaattcgaatggagaagaaactgaaacgcagatttaataacagcgctagataacgtggatttgatctaaagggagaagtgcaagaagtgtgagagtgtctcgttgacgacgaagaatccaaaagaacaaaacggctccaaaaatctttattggcggtgtgataatgtaaatagagtatccagtgaagggtatttctggtaacctttttaaatctttcattgcgcggcggatagagccatttggacttttggaggagcggggctacaattatttgtttttcactaacaacacataacagtgatcaataacaacattggaaaaacttgtaaattacaaattaaatgtagggtatttagttgttttaagataagtataataaaatatataggtttgagtgatatgaggtaattatgatacagttttgaagtgataacgataagaattgttggtatgataccgtttttgttgttgataagctttgagaccgggaaggtgtatgtataccaccatacctaatactataaattaccaactacgctcataatcaattatataattataaatttggtataaaagtcgagaaatctaacaaaaatgataaggttatttctcaatttactttcatgctttatttttcttctttatgtttggcaatagcacctagtatttaaacaatacatatagtatttcgacacatagttgcccgtaataaattgaaataatataaaagagaagtaatgcgttattttagatagaaatctgacatcatatatttataattatattttctataaataaaatattatctatatatagtttttttacacttggaattatatattgaccacacatcatgtgttaaattttttttttttttttttttttgcattgatactttggccatattttagttttactcataacatattaggtataatcacgatcagtcctaatattttgaaagcccaaaaaaaaaaagactttattttgagatattttttcacaaggtaaatttaatttcagtaaaaaaagggtttttaataattaaaaatatctgtatattaatattttgtatagactagttatatattaatcaaaaattgggaatcctagactatttttgtttcatcaactggacctggtactggatcaaacgttgctgcaaactaaaatgacaaagcccaaaaatcaaaacatactctcggttagggattagatcagaccggacggtttcctaccttttcaaacgctgtcgttttgaactatagagtaccacaaaccaacgacgccgtttcacttggcactatttatttcttctgtagttttttttcttctcatacatatatcaatcaatcaagatcaccaccacaaggcaaaatctaaactctctctgcaaaatttctgctaacttcttcctcccattttcttgccatg

SEQ ID NO: 35034 - DNA, 3003 bp, Unknown; identical to SEQ ID NO: 35033
  misc_feature (1)..( 3003): 2750-1469P.txt file - cDNA_ID_3084167; gDNA_ID_2926252; Annot_ID_204410

SEQ ID NO: 35035 - DNA, 3000 bp, Unknown
  misc_feature (1)..( 3000): 2750-1469P.txt file - cDNA_ID_3084171; gDNA_ID_2926252; Annot_ID_143049
gtctcgaaatatgacatccgcagcatgtagtctacaagaatccgtttcagtttggtattattccattcagtaatattttccacatctactgaatccaaatgatcgatgcgagcacgacatctctgggcttgcaaattctccacattgctcccttcttccaactgagatacaaaaccaaaaaaatacgtaagccaggccatatccatgtgatgttactccagaagatatagaaactatcccaaatgataaaaatttagaagacaatgcaaatagtcagatgggaagttccaatgaaccaactccaccactacattgaattcatcgagatccaatgtctagtgagacataattgccaaagacagatactttactttgatcttcaacatcgaagatcaaattttttacagataagtggatatcatttagcaaaatcagaaactttaatcgctaaattaattgattcagtttcgtctacataatttaaaacaccgatcacagagggagagagacggaaaaatcaacctttcgtttgaggccttgtaatcgagtaacaaggcaagtaagacgcgaaacggtatcgtctttagaccaatcggaatcagccaattctccgacgccgttaacaatggttgagacctctttctcgaaagaacggtgattggtacggatcgtcttcttgtaatgctcgaaaggaacgcggaggagctggtgctcaagcttgagagattccgtaaattgattcgatctcgaagacgagacgacgaccggcgacggagtgatcgtagcggcggattccgtcatgacggtgtcagagtttccgttggtggcggaatcgatttccatggcaagaaaatgggaggaagaagttagcagaaattttgcagagagagtttagattttgccttgtggtggtgatcttgattgattgatatatgtatgagaagaaaaaaaactacagaagaaataaatagtgccaagtgaaacggcgtcgttggtttgtggtactctatagttcaaaacgacagcgtttgaaaaggtaggaaaccgtccggtctgatctaatccctaaccgagagtatgttttgatttttgggctttgtcattttagtttgcagcaacgtttgatccagtaccaggtccagttgatgaaacaaaaatagtctaggattcccaatttttgattaatatataactagtctatacaaaatattaatatacagatatttttaattattaaaaaccctttttttactgaaattaaatttaccttgtgaaaaaatatctcaaaataaagtctttttttttttgggctttcaaaatattaggactgatcgtgattatacctaatatgttatgagtaaaactaaaatatggccaaagtatcaatgcaaaaaaaaaaaaaaaaaaaaaatttaacacatgatgtgtggtcaatatataattccaagtgtaaaaaaactatatatagataatattttatttatagaaaatataattataaatatatgatgtcagatttctatctaaaataacgcattacttctcttttatattatttcaatttattacgggcaactatgtgtcgaaatactatatgtattgtttaaatactaggtgctattgccaaacataaagaagaaaaataaagcatgaaagtaaattgagaaataaccttatcatttttgttagatttctcgacttttataccaaatttataattatataattgattatgagcgtagttggtaatttatagtattaggtatggtggtatacatacaccttcccggtctcaaagcttatcaacaacaaaaacggtatcataccaacaattcttatcgttatcacttcaaaactgtatcataattacctcatatcactcaaacctatatattttattatacttatcttaaaacaactaaataccctacatttaatttgtaatttacaagtttttccaatgttgttattgatcactgttatgtgttgttagtgaaaaacaaataattgtagccccgctcctccaaaagtccaaatggctctatccgccgcgcaatgaaagatttaaaaaggttaccagaaatacccttcactggatactctatttacattatcacaccgccaataaagatttttggagccgttttgttcttttggattcttcgtcgtcaacgagacactctcacacttcttgcacttctccctttagatcaaatccacgttatctagcgctgttattaaatctgcgtttcagtttcttctccattcgaattttcgatttgcaaaatcgctgttttatggtatgttcataaattctaaagatcttcccttttgaaattttaaaatttttctctgtgtttctttggttttctttaaagccaattgtgtcgtcataaaaagctgtcgcctctcagtgtttttttttcctttttctttcaattttccaactattagaagagagtagagagagtagagttggattttctggcgacgaaatcgattgagatcgtttaaagagagagcctttctagattttgttagtgttcgagtaatctcgccgaacataatcttcatcaacttctccgcaagtaggatttaggttcgatttgtgatttgattagtctctagggtttatcgtagctttgaagatgcttagggtagtctggtcttttattttaggccttggctcgatgtttactatgataagtcttgagtttctgaatctctgagtagagttatagttgattatctcgagtctaagatcatttatgctgttttttctcatttcttttgttgaactggtttatctttcatcgagcaaattgtttgtaagattcacttggagcactttttttggagattgacatgaactaatttgctgcaaaatgtgaacttttcctagtttagtgcaggagatatcttacaatctattgatttgcttctatatgttttgattgcagctgcagttgttatagcaccttttgattggagaaaacaatg

SEQ ID NO: 35036 - DNA, 3000 bp, Unknown; identical to SEQ ID NO: 35035
  misc_feature (1)..( 3000): 2750-1469P.txt file - cDNA_ID_3084171; gDNA_ID_2926252; Annot_ID_204409

SEQ ID NO: 35037 - DNA, 3000 bp, Unknown
  misc_feature (1)..( 3000): 2750-1469P.txt file - cDNA_ID_3084175; gDNA_ID_2926252; Annot_ID_204408
agaaaaggagaagagcgagctgcaggctggattggagaaagagcttgatagaagatcaggtgagtggacgtcaaaactcgaaaaattccagcttgaagagaagaagctccgagagcgtgtaagagagcttgctgagcataatgtctcactccagagagaactatctgctttccacgaaaatgagacagagaacaaagacatgataacacatttggagagaagagttgctgagctgaccacaacagcagataaattgcatgaagagaacaattatgttaaacaaactctctccaagttacaagagagttacgcaggtgctacagaagatcttgatttcttgagaagaaactttgaagagaaggatcaagaatgcagggagttgcacaaatctgttacaaagtttttcagaacttgcaaagaacaagggaagacaattgagggacttcgagatggtgtttctgaggaggttaagaagcaaccgtcagagaaattagaccagttggtcaagaaattgcaggtcgagcaggtaaggttgacagggatcgagctttcacttagaagggaagtagaatcaatgaagcttgaaactgactctcttcgccatgaaaatatctgtctactgaatcgattgaaagggaatggtcaagaaatagacattacaacccttaagctagagaatgagttgaagatgcgtgtctgctacttgcaagaacagggactgtcaatgttaaatgagagcagccagctgtgttacaagttactgaagttcatcaaagggaaattaactcagcttcctgaaacctatcaggataagaattcagtgaaggacggattaagtgagcagtttatgattgagtctgaaatgaaagtccatgggataaggcgcggaactgaaaacctgaagaggagtttgcaaacggtgaccagtgtggtagcttcgaattcagaatcgtcttcctcaaatactggtaggcctagggaacaaagaaaccaatcagttgaagtaagtccacggatatgtccatttcttaatatctctattgtattttcttgtatgtcctgttttgctttacactaatatgtggctaatgtatacctggcccaatctcatgtaggaaaacttgcgagcagaactgagtgctgagaccctaatcacaagtttagtgcgggagaaactgtattccaaggaaaaggaaatcgaacagctccaagcagaactagcagcagcagtacgaggtaatgagattctgagatgtgaggtccaaagcagtttagacaacctatcagttacaacccacgaactgaaagacctcaagcatcaggtattgcaaaacaagaataacacatatcccatgtctgtttttgtatataaagaaactattcccatttataaaatgttaactttacgctaatcttttttgacatcagatgttgaagaaggaggaaagcataagacggctcgaaagcaatctccaggaagcggcgaaagaaatggcgaggctgaacgcactattgtcaaaagtgtctaatgaaagaggccagatatggagtgagtataaacaatacggtgagaaaaacatgcttttgaactcagagaacgagacattgaaaggaatggtagagaaattggaggagaaggtattagagaaagaaggagagatcacaatactacaagacacaatcggaagcaagcatctgaatctcctctcaagtcctgatttcttggtataagggtttttctttatcattgtttcttagacgatgggtcattctttggggcttatagatatgattgtttcttcttttatttttacttttcttcttttggattgcttatctcaaagctggattctctctagtttcagatttgtacttaaaaatgggcttataaacttagtggtgaagtttatggtaaagaaagtttgtcatttgactcaattctattcaataaatcttcataagccattagttcaaaaagagactagcaataattttatatatatactatcttacataaatatatatatatatatatatatagacttggtatttttacttttttcactaaatatatgatcacttttcactatagttagtcattctttttctcaataagtttgacaaagctagtcttatattattttttttcctacacttgtagtaacaaattggtaccatattttagagaatatttcataaaaatagtagaggtattaaatgttgcaaaaaaaaagtcaaaccgttaaagtcaaaaagaaatggagagacgacaggtagagaaaataaaatactataaatttaccagaaaaaaaaaaacaccataaacacgatgaccgcgactatcggtactttctctctctaaaaaaaacaaatccaacgtctccgtctcttcttcaaacgcgtcttcttctctattttaaccctctttcatcgtctctttcgctttttataggttttgatttgtattagtaatcatcttgctaatctttccccctcattgatctgaaatcgaatgatggattattattctactccaagcttttgaaataaggaaccctatttctttcatctaatcctcgatttcatcaggtatttcaaatcaattacccaatcaggttgatgggtcaaagttgaaacctttagattcatatgtggatggagttatgtaaagttttcttcttaatcaaaatttgtttctcccagatgcttgttatcagattgatgggttaaaagttaaaaaatttagtttcctatgttgaaaatttggagactttatccttttttcgattctagattactaaatgttttgtttttgtttgtgtggaatgcagattaatgttgtttacatttgtgaatgcgtgtttgaattctgaatcctgggtttgtggagttggaattgagtctgacaagaagattgggtttcttcataatatagttataagcactgatttgatgaacgatttgatagctggttcttttggttgagacatgtgaattatg

SEQ ID NO: 35038 - DNA, 3000 bp, Unknown
  misc_feature (1)..( 3000): 2750-1469P.txt file - cDNA_ID_3084179; gDNA_ID_2926252; Annot_ID_143047
gtagagaaattggaggagaaggtattagagaaagaaggagagatcacaatactacaagacacaatcggaagcaagcatctgaatctcctctcaagtcctgatttcttggtataagggtttttctttatcattgtttcttagacgatgggtcattctttggggcttatagatatgattgtttcttcttttatttttacttttcttcttttggattgcttatctcaaagctggattctctctagtttcagatttgtacttaaaaatgggcttataaacttagtggtgaagtttatggtaaagaaagtttgtcatttgactcaattctattcaataaatcttcataagccattagttcaaaaagagactagcaataattttatatatatactatcttacataaatatatatatatatatatatatagacttggtatttttacttttttcactaaatatatgatcacttttcactatagttagtcattctttttctcaataagtttgacaaagctagtcttatattattttttttcctacacttgtagtaacaaattggtaccatattttagagaatatttcataaaaatagtagaggtattaaatgttgcaaaaaaaaagtcaaaccgttaaagtcaaaaagaaatggagagacgacaggtagagaaaataaaatactataaatttaccagaaaaaaaaaaacaccataaacacgatgaccgcgactatcggtactttctctctctaaaaaaaacaaatccaacgtctccgtctcttcttcaaacgcgtcttcttctctattttaaccctctttcatcgtctctttcgctttttataggttttgatttgtattagtaatcatcttgctaatctttccccctcattgatctgaaatcgaatgatggattattattctactccaagcttttgaaataaggaaccctatttctttcatctaatcctcgatttcatcaggtatttcaaatcaattacccaatcaggttgatgggtcaaagttgaaacctttagattcatatgtggatggagttatgtaaagttttcttcttaatcaaaatttgtttctcccagatgcttgttatcagattgatgggttaaaagttaaaaaatttagtttcctatgttgaaaatttggagactttatccttttttcgattctagattactaaatgttttgtttttgtttgtgtggaatgcagattaatgttgtttacatttgtgaatgcgtgtttgaattctgaatcctgggtttgtggagttggaattgagtctgacaagaagattgggtttcttcataatatagttataagcactgatttgatgaacgatttgatagctggttcttttggttgagacatgtgaattatggtatctacaacatttaggagaattgtatcgccttgttggagaccttttggtattggagaagattctagtcctggtagtgatgatacgaatggccgtctcgatggtctcttgtggtacaaagattctgggaaccacatcactggagagttttctatggcagtcgttcaagctaacaaccttcttgaagatcatagccagttagaatctggtcctattagtttgcatgagtctggacctgaggcaacttttgttggtgtttatgatggtcatggaggtcccgaggctgctcggtttgtaaacgataggctcttttataacatcaagaggtacacatcagaacagcgagggatgtcgcctgatgttatcaccagagggtttgtagcaacagaggaggagtttctcggtttagtgcaggagcaatggaagaccaagccacagattgcttctgtgggagcttgttgtttggttggtattgtttgtaatggattgttgtatgttgcaaacgcaggagattctcgggttgtgttagggaaagtcgcaaatccgtttaaagagttgaaagctgttcagttatcaacagagcataatgcaagtatcgaatctgtgagagaggagttacgtttgttgcatcctgatgatccgaatatcgtggtcttgaaacacaaagtttggcgtgttaaagggattatacaggtctcaagatccattggtgacgcataccttaaaagagcggagtttaatcaagaaccgctactacctaagtttagggttccagaacgttttgaaaagccgatcatgagagcggaaccgactataacagttcataagattcatccggaagatcagtttcttatatttgcctcggatggtttatgggagcatctaagcaaccaggaagctgttgatattgtcaattcttgtccacgcaatgtaagacatatcacaacactcttcttgtcttgtttttttgtctggtttgaattggttttgttgtttgttgaatttgtggtgtcttgttgattctttcagggtgtggctcggaagttagtgaaagctgcattacaagaagcagcaaagaagagagagatgaggtattctgatttggagaagatagaacgtggcattcggcgacactttcacgacgatattaccgttattgttgtcttcctccacgctacaaacttcgctactcgaactccgatctctgtcaaaggaggtggtctcctctcagcccataatcccgttttatagatcattttttttctccttatttgaaccagaatttgattttgtttgcttcttttgttacaaaattgtgtgaaaatcttacttctttaattattttctgatcgaaaagtgtaaatttcctctcttttttcctcaaatctcaattgtactttctgtttacgaaatagtgaaacagaatcgaaccaacattcatcaatctgaatttgaaccgaattttactcttataccgaatttaaaccgaaatagaatcttattctatccgaattgaaccaaaccggaagttgtggcagtcaaacaaaaaggttcagtggaaaccattttcccggaaaatcctttcaggagctgagaaagtgaaagctgtgaggtatg

SEQ ID NO: 35039 - DNA, 3000 bp, Unknown; identical to SEQ ID NO: 35038
  misc_feature (1)..( 3000): 2750-1469P.txt file - cDNA_ID_3084179; gDNA_ID_2926252; Annot_ID_204407

SEQ ID NO: 35040 - DNA, 3003 bp, Unknown
  misc_feature (1)..( 3003): 2750-1469P.txt file - cDNA_ID_3084185; gDNA_ID_2926252; Annot_ID_204404
cttatttgttcattcgttttctgagattctatatcaaataatagtcagtcatcactagaaaatgctcaaacaactaatatgattcatacacatttcatatcatatgcttggcaatattggaccgaacttcatgatttttctgtccatgaatgcaaatgtgttgtgatctctgagttacatctcaaaatgtgaacttgacatcatattctcgttcaaaaaaggaagataagacaaaacatttaagaaacatttcacaatcatagggggcaaaagatcaaaatttaaaatttcggacgagagtggaaactatcaatctttaaggggatgatttggcaaaagtgttgtttttatttttcttttactgttttcgttttatcatctttcaacgtctttctctcccgacggccaaaaaccccaattttgccaaatccaattttacacccagaaaccctaattttccttactttgatttgattttgtgatggacgattatacaagagagatgatggatctcaagactttggtcactcgaaccctagagaagaaaggtgtcctcgctaagatccgggtaaattccctctacttctctaccatacattattcgcagaaatttttgagtggaaatgagaacagagaagtgattcgtttgaaatacatacattactctttttctagggttcctgctattcagatcgaaatgctcgatattgttaattgcctatgcatctggaatcttgctgatagtttatttgtgtttgtaggctgagctccgtgcaagtgtgtttgaagcaattgaagaagaggatagagtgatagagaacaatgaaggaccgcctccagctctgttgggaagctgtaatgatcgtgcaaggaagcttcatgcttctccttcaggttttttcttcacaagtttttgcttttatccttttaaatctttcctctatgaatggtttggttctaaatggcatctcttggtttgaaatttttgttgaaatgcaggaaggttactatctgcgttgatttgtgaatacttggactgggcacaacttaatcacacgctcatagtttatcaacctgaaagcaatttggtaatcaatataatcccgttttcttttgctatgtttcattaagaagattgttgatgaatttttctcactaatctggtgaactcctgcaaaacctattcaaagccaaaagattcgtggaagtctgagttacgcgactttaatagcaacaatggttttgagctcaatagaaatggagatagtggaccactccttctcgatgttcttgaagggttcttgaagtttgaggtatttctttctttttttcccctgaagatgtttgcagccaagtgtgaaacagaactttactatctataacttcttctcttagtttacaatctttacaaccatactctaaacaaattacaatagtccacctgtagtatgtgtgatttatgagttgtagtgttaacagttcctattatgtaagtgaagatgatcaatactttacacccaagctttacaaacaccaacttacataaaatcttggtactctgtcctcgcaaccaagagaagaagttatagatagtaaaattcagttttccaagaaaaataaagtctcttagtagagattagagttcttcagagatttgaaaaacacgtttagcaaatttcctagcctcaagttctcttcacatctaagaatcatgtttccatcctatcatagttaaaaccattatcatctgtttttgccgtatgctcctcagatgtagtgatcaacttttttttgtaatgaattttttcttcagagcatgacgcagggcatgggtagtagttcaaggagagattcagaaacagagtcgtcatcaagccttgagtccagaaatcctcctcgcagatcatctgcttctgatagcttacctcctcaacgaaggtacacatatcttcaacttcttattattatgccaaatcaaagatcgttactcttcgacatgattgctttatttaccttcaaataaatgggcaggccggtttctgcatctcaagcatcgggtgagtcatcatttccctagtttcttgaagtattggttgaaatacgtatgcttcattattttttgataccaaataaatatgacaagatgttacagatagaagagccgggttgtctacatctgggtacagaaaagatgaattcaactggagacaaggtaaccaagatacacatgaagaggtaacaagagcttcagcggcgctggaaaatctacagcttgataggaaaactcggaacttaacatcgtcttggaggtaagctttcaaggaagtctcattgaatcccacattgaaatgaaaacaaagcaagttgtggtaaatctgatccatcgggcttgcttgtgttgtaggaatgtgagggatggaacaaatgaagaagaagggagagattgatttaggctttggataaacatttcagcttctggattagtagagtaatggtttgtgtacgtgatatatgtatgtttctcctttatttgcaactgcgttttcaattagccttttttttaacgcacgaacctctgtctccttgagaacaaaaaacatgaaacagtaaaatgttttcttttgagatttgttatgggaagagaagagttcagaaagaagaatcaaagaaagcacaatgtggttgaatattttcattcacttgcttcttattttagtgtctccaaaattattatgtctctagtaataaacaaggtttttgaatgatgtgttcactgtttgttttactcgtactttttttttgttttccctttagtcttctctctctctctcgcttcttcgtttaaaactttaaactaaagtatcgaagaagccaactctggatgacgcaaaagcttctctcagaacggcattgtagaattctccggtgaccaaataatccgattgcattagtagggaatctgttattttgatctgatccgtcaaattggcggtaagaacaatg

SEQ ID NO: 35041 - DNA, 3000 bp, Unknown
  misc_feature (1)..( 3000): 2750-1469P.txt file - cDNA_ID_3084233; gDNA_ID_2926253; Annot_ID_143072
tataccactatatcagtattgtataatgaacatgcaaattacatttttaaatttacccaccattttgcacttttaccttatacaagtgaaaagggacaatagtactaggtcccactacgatataaaaaggaaagatacgatttttctttatctctaaacacgaaacatatactgtatgatggtttgtaatagatggtataatcagaatgcatttgaatagttgattaacattttcgctttcgtaaagatgaaacagagagatataattctacaacatttgccggagtccaattgtccaaaagtaatatctttaattcatttttaacagaaaacaaaagtaacatctctatgaatcatggtttatagcccattaatatgtagttcatacatatctaaaaatatattatcgtctactggaaattattgcaaggagattcctaatagactttctaggactattaattaatagggctattgattatcagttgtttcataagttaagtaggaacactaaagtataattgaacaatagactatttatttcgtatactgtattagtgtattctaaattgtattttattacgttccacgtaattgggccataagaagacccggcaatccacgtgaaagagaatccttcccactagcatccacgttgccacattaatttttaaatagtttctcatcaattaaacattataatattaatcaccataaacatcaccataaattttttgttggtacaacaatctccatcttttgtttgtcgcatatcttcggataacaaactttttttagtggaatgtgttttctaaatggtaaatgaccatactatatactagtagaacgtaaaaaacaaaatgctaaatccaatacaacttcttaaaccttgtgtaaaacttttaaattagcaaaaaaaatattaacgagatacctatcaggctactacaccacaattaatctcagagagcccaaaacaataatcattaattcattacatatccctaggagaactcctttttaaaatctttcaaaaactttagcatttccgatggtcaaaatcccccaaaataataatatggatccgtttccacgcgctccttgcaatttataaataaaattcattagaccaaaccttattttttacccttatgtatatagtatgtttgatttacatgagggaaaaaaacgaagtcgttacatgtcgtggtttacacgcgataaagaagagcgtgagagaatagtgaatctaaacctgaactgtcttggtcattaagtgaaaaatgcatggaaaatctcgagttgttgtttcctacatctctctgttttttttgttttaataaagtttttactatttcctatacgtatcaacttgtaagcaaaacctttttcaaactttgatccataaattaaatacatatcgatgtatctcgtatatatatattacagtgaccaagctcttcatttttttctgtattattttttgttgtagtaggcttttgttttgatggaggaaaacccgcatcgagtttcacgtagaaaccatggcgggacccactgtcaaaacgacgccgtggacgaagagaaccgtcgacgacggcataaccaccacactcacggcgacgaagtcaaatgctccagtaagagatgccgatcgtgggcggctgcggcgattgctgactgtgtagcgctttgttgctgtccatgtgcgatcatcaaccttcttactcttactctcgtcaaagtcccgtggatgatcggacggcgatgtctcggcggcggcggtcggaataagaagaagcggagagtaatacacaggaggaaacgccgcgggaatatcaacggtgaagatgagttttatcatcataataaccatcaccgccggtttgagacagccgaggagggtgagaaatgcggctgcggcggtggcggaggaggatgttatggcggcggagattatgatgatcaccggtttgtggtagagagagatgggagtttaacgaaggaggaggaggaggaggagagaacgacgtcgtgtaaaggagaagatcatgatgagtcgcgaataagtgcaagagttgaagccgagagagtgtggttagagttgtatcagattggtcatcttggatttggtagagtctctttcactggaattcaatgattgatcaatttgtaggattttttagttatattcgaataaatataaaatgtgaatgttttagtctatgtgttctattctatgataggtctcgctcgtgagcgtattcgcatatatacatctcgatcgatccactatgctagaaaccacatttgtgatatataactgcagaaatttgttcattccatcaaaatatcatgaattagctcgacagtggacctagaagtgttcacattgttagagacttatacctttaaataatttgattcataaaactagttttgaaaaaaaaaaaaaacagagaggaagtggttattggtagtttgatgattttttatcacattccaaagcttttgtcattcaatttttttagttacaattaattctatataatgccagtaaattatactcagtatgattggaagatgatttcttaacacttataagttcatatgatttttctcatattcactaaatacttaaaaccctatacaattagaatcttttatttaaatcaataaagtacaaactatataacaaaatgaagctagcctaccaataacacccaaaatatagcaatgggcccgtttataaacagattgaatagttgggctagataagagacccactaacaaagttctgctcctaaaccgaccctgcgcattttagtcggcagcaaaatttattacgatatcgtgctctaatgtgcgccgtccgcgcacaataccctttcctctctgcttgtgcctgacatagttgttattcagttcattcctgcttccccgccttcctcttttaggaaccaatagagctcgagagagtagtcgagtgaaacaataatg

SEQ ID NO: 35042 - DNA, 3000 bp, Unknown; identical to SEQ ID NO: 35041
  misc_feature (1)..( 3000): 2750-1469P.txt file - cDNA_ID_3084233; gDNA_ID_2926253; Annot_ID_204450

SEQ ID NO: 35043 - DNA, 3000 bp, Unknown
  misc_feature (1)..( 3000): 2750-1469P.txt file - cDNA_ID_3084245; gDNA_ID_2926253; Annot_ID_143068
attatatatcgatgagacggatagaaacgcagctaaacaatagaaatgctcacttacctttgtgtcatcacttgtcccgtcaccttttgcgccatggtcaagcacattgattgttccggaacttcccccttcggcgatagaccttcggtttcctttccagtatacactgtacctagcgtcacaagtcccgaatctcgaagagaataaggagattaagaggagaaagttcagggaaagacatttcaatgttagtctacacatctttaatattgtaaacgatttgtttctagggtagaatttgtttaattatgagatgatataaaatggtaaagcgagggtcatatttataagtggagaaaaaacactgttacgcatatgagaatgaatctatgatacagttaaacagttagatgaggacaaaaagccttggaactctcttccttttcaaatcaagcatgtttctactcatttgctatattttattaaattgacatcaacatctttacttacgatttggctttgatttgttgttgaataggcgtgttacttagaaattgttttggtcgctactaatatcttagtgtgttctctagcattagttctaattttcatgcaatggctatgtattactgattttgaaggtttgtgtacagttttttaggcgctagaaataactgattactttcgtttagaacagagcataggtccggtcagatacttagccggtcttggtaagctattcggttcaatgaaaaccaaaatccatgtatcaggcatcaatagaaatggcgaaagagtcaagaaaagttgccatacagatgtcacgtaaacctcatcatcagataatcttatttatgtttagttcctgaaatcaagcaacgtaatttatgttaaatcgatggtgtcactgaatcttttaaaatcaagtaatcctttgttgtcaactcatatttgcaaagatccattaattgcaagacaataagatgctcgatattgttttctgtttattgttatagagagcttaaaccaacatctgaggatttctggttaattataagcatattagtaaggtccagtgtatgaaattaaactcgtgatctgaatacacgtgcatgagtccccaggtaaaaggatatataggctgctataataagatttgcacgttgctacgtgtatgggtgtatgcagcccatgcgtgttgacaaactttgttgaattattctatttgatttcatgatcttgagaagcctattgcttaccaaaattggaataacataatcactcattgtagaagttcttctaatcttgttactattttattaatttttctattgcttttggcagttgaaagtttgatatatagattttgttttcaagtaactgatttcttgtcctctttctcacaatatcttgaatataataagtacaagataggtaatggtacttttttttggtttaaatgagatagttaacgttgcaacgtgagactaattttgcaatattttgatggtttaatcattttatatattatacaggggggaaaaatgttggatggcaaatcggtgaagtggtcataactcgcaagtcacatgaacaatatttctagtactccgtagaattcgtgtatgtccaagtccaacaactcgcataagacgtaaaatttgaaaatttcatcattgtgtattcttaacccgtgatttgatgtaacgtttactacgttcgtctataatctagagcattgtaataggcgtgtatgattgaatcattttaatagtgactatttgtttttggtcaacttctatattaatgttttacatgcatcgtgttgtatacttgtattgcacgcaattatgtgaataacgtcaatcgtgtacgaaattcactcttttgtcgtaaccatttatttacaattggtgattcctatctaaaatcccaattggcaattatttattactcggacaaaaaaatttaaattcaaaaagtgctagttacaggccttatcatttaagagaaagtatatagcaagcccatattcatttaaggcccatcctcgtgtaagaccacaccaacggtcgaatcagacacgacatcgaatagcgaactaaatcttgtcgctttatgtgatgacttggcgatttcgtaattgagatttccttttctgacaaaacaacattacacaatttaacaaataccgaaaaagtgaagaacgagaatctgtgtacgccacgcttcgcttaacgtttcatactcctctaactagtagccgtccgattagtttctggcttttcatgacctaaatctaaccgtcaattagagaagcttacaatacacttaaccgcaggaaagatattcaaaaccattaaaagcagtcaacacaaatgacgtgagtcttagtaattccaaccaaaacacgccacgtgtgcggatactcttcttccttgagagcgcggacgtcaaaactaactatcaactgaaactttgaaactacctattggggtccgctctctctctctctctgccatcagaagaaaaaaccaaacaccgagacaaaacacatcacgaagaagagagagatttgccattttcggcaaggaagtgttttattctagggcttctctagttgctgcgtagacaagatggtggagtgaaattgcggcggtgacttttcaggtatgacggcgccacgacgtagtcggcgatttactttttgtgtttgtttaacttgtttagcttgacgctgagagattatggaacaaaacatctagttttacagattagggaggtttgaggttgtggttaactttggataaatctattgttaaatgtagagctaggcttttgggagctcttacttattagatcttattcactgtctctgtgctaaagtaatttttgttccaatttggttgtgtgaaagtgatttaacaaaaacctatgttttgtttgtgtgtttggacttaacagattgacaaattgaattaaagatcttgaatacatatg

SEQ ID NO: 35044 - DNA, 3000 bp, Unknown; identical to SEQ ID NO: 35043
  misc_feature (1)..( 3000): 2750-1469P.txt file - cDNA_ID_3084245; gDNA_ID_2926253; Annot_ID_204446

SEQ ID NO: 35045 - DNA, 3000 bp, Unknown; identical to SEQ ID NO: 28749
  misc_feature (1)..( 3000): 2750-1469P.txt file - cDNA_ID_3084253; gDNA_ID_2926253; Annot_ID_204444

SEQ ID NO: 35046 - DNA, 3003 bp, Unknown
  misc_feature (1)..( 3003): 2750-1469P.txt file - cDNA_ID_3084257; gDNA_ID_2926253; Annot_ID_143065
cttgtgaagtcctcagatcagatttcattggtaagtttattctgatttacaacatctctttctactttcttctccaactcaaactaaaagagctctagatctacacattatccgaatgctcttgccttggaaggatcctaaaaatcaaagtactaaagtagtgaatttgggactgaacctctcctcgattttcaaatcctagtggctagtactaaaatcatgttgtatagactgaagttctgttctttagtctacaattttttccaatatgtatcatcgactttctatggtcacacatctttggattaataagtcgaaaggattgctttaagtagataagtatctttagagaaatagtttgacattctttggccttggaaagtcaggggaatcaaaaccaactgtcataggcatataagtccttatttccttgagagtttcattctttcttataccggtttttgctcatgatgagtttgttttttgcagagataagaacgtttgaggtgcttctcagaacatatgaagtgaaggaagtgaaaatggataccagtagcatggttggtgagagccacgaggaggacaatgaaggaatgaggccttgcaagagaaagcaccgttcaaacgaaaacgacactgtttcacaggacaactcttctaatgcttcttcagtcgtcatggctcggccttgtagtgaagcaagaggtcacaccggttacttaacgtttgcaagactccaatgtctagcttagtccaaattctccaactacattatgatattcatgtattagatattttcatgatttgtcttattacgctttctttttgttaaaaaaataattgctgtgaatttgtttctagaatacaaaattcgaaatttggtaatgacaaaaccaaaatccaaaattttgaaatatgataaatagtagtttctagagataaattgttctacaagtaatatataaatagaaacgcgtttccttttctcgatgggagaaggagacatgtaatgcactctataaatatcgaaaacgtctgtttaattttctttctcttacaattgtctattcacaaaccctagagatccattcttcgaaagcctgagatcaaaatccaaattcttttttcctcttcttataattttccctttatccatcaagaaattatgtgtcccttgagatttgtattagtgttcttctcggcggtactcgcaggatatatcgcgtggaggacggtgaattctacgccggaactattctcagacgagttattacaagccgaagccaaggaaaaacaaggactcgatttcaagagaaagatggataatgggttatggacgttcgttgatatggctagcggaagatacctttggagaaatctcaaggagatgcgtcagagaagtcaatgaccgatataaacaaagtttcgcctgtttggcttctgatatgtagaaagttgagaacaagaaaaattgtttcttcgttttcgtaaatcttgtccgaattcatctgaatttggtagtttcattcattctttaatttggtattcatgtacttgaatttcatcgttcgtataaataaagaaaccttattcttcccgccaactctaatatattaatctgaaggtaaacgaacgaactagatgatagagatcatatcaaacccacaaatttaaccataaccaaccttaatacataattacatactaaagagtaaagagttaacaaatcttgtaaaacaagttgataaagccttttacaaagcttaagtcttaagatgtgaatagcttagcttgtggcttaggccattcacatcggtaatgatatgagtagattggaatttctttatacataattttgtttttctaaagtaaaaacatatagaggaaattatggcctactttcagaaggttttggctaaaaaaaagaaaccaaacttatatagagagatagagatttaggacaacaaaaagcaccatataatataagttttcattgttcatatagtcctaaatcctaattagttatgcttttgtttctgcaattctgcttggatatgtttgtataactttcttgtaatttggatgaccaactattgtatctgatttcatatcaatgaatgaatcagatgttaaaaaaaaaaaacttgattcaatctgtatagagtgatttttaagggactacaataacatgggcccaaataaatgtttaagataagctaagagaagattaagcccaataaggaattgagagggccctcgatattatattaaaagaaaagaaatgtagctggaaacgaaccggcacggatttcactccttacttttctccactccagtctctctcttttctgcgtttcctcttctctctgtggcgtagagttatagagaggaatttaggtcttcttctttggtttttcctttgctcttcattctcatactctctcgacagtgaaatcaggttcttgttttttttcgtagacctacatttttcgaatttcgtttttttcttcgtgccgaaatgtcgatatctctctttgtctttgccgtaccattttctgtagttggggattttagctgcattttttattttccttaggttctgggttatatttctctgtttgttagtgtcttctcttgttgtctgaagagtaacgaggtcgaatctgttcttctgcatgttagggtttttgttggcgttgtgtctcaacctgtggtgtaatgagataatcagagacccttttgtgaaaaagtttcgcttttgtcttctttccgtctatatgtttggtgtgtgtttctcgacttaaaaaatccatgctttctggtaaagtgatggtctttgtcattgggttgctttgcttctgttgatagtttcttctggtgttgttttgtttttgttttctgatagtgatgtgaattgcaaagttctgttttttttccctgttgatcgtttaaattttagctattattggtttcgacatgttgttcttccaggaatttggtatg

SEQ ID NO: 35047 - DNA, 3003 bp, Unknown; identical to SEQ ID NO: 35046
  misc_feature (1)..( 3003): 2750-1469P.txt file - cDNA_ID_3084257; gDNA_ID_2926253; Annot_ID_204443

SEQ ID NO: 35048 - DNA, 3003 bp, Unknown; identical to SEQ ID NO: 28748
  misc_feature (1)..( 3003): 2750-1469P.txt file - cDNA_ID_3084264; gDNA_ID_2926253; Annot_ID_204441

SEQ ID NO: 35049 - DNA, 3000 bp, Unknown; identical to SEQ ID NO: 28747
  misc_feature (1)..( 3000): 2750-1469P.txt file - cDNA_ID_3084268; gDNA_ID_2926253; Annot_ID_204440

SEQ ID NO: 35050 - DNA, 3000 bp, Unknown
  misc_feature (1)..( 3000): 2750-1469P.txt file - cDNA_ID_3084272; gDNA_ID_2926253; Annot_ID_143062
acaaggttacagttgaaagtgcagaagcagctcttaagtaagtgctattgattctttgcattttctatggtttagattcttttagtaacagaaaacattttaatttctatgtgaaataagctgatttcgcgcttaaaacttttatgtttgcaggtacaatgttgctatcaaatgtgccactataactcctggtatgtgatgtccttcgcaaatcgcaacacatatgctgcttgttccgatcagaggaagcatttttacatcttctgtatgttatttttggcagatgagggtagagtgaaggagtttggactgaaatcaatgtggaggagtcctaatgggacgatcagaaacattctagatggtttgtctctgtattgtcaaaaaacaatgcatgtttgctgaataggaatatcttggttaaattgcttgcgactttttattttatcctgttagcaggttcttttacaatctagtatctacacatttcttacacagtgttctatattttctaggaaccgtattccgtgaacctattatgtgcagcaatatcccccggcttgttcctggtaaatttatttgccttgttatgaatctgtgttaggatctgttttgagataccaaatgagaactcaaatcttttgtctttataggttgggaaaagcctatatgcattggtagacatgcctttggtgaccagtatcgtgccactgatacagtaattaaagggccaggaaagttgaaaatggtttttggtaagatcataccaaactatattcattagacaatgaggattcttcaatcatatagttcagattctaagtggatacatctcttgtctaattagtcccagaagatggaaacgcacctgtggagctagatgtatatgatttcaagggcccaggtgtcgcacttgctatgtacaacgtagatgaggtctgtctcttttagtaactggctttagttttggcatggttttggtttctgacaaccatgctggttttgtgacatgccagtcaattagagcttttgctgagtcatctatggcgatggcattaactaagaaatggccattatacttgagcaccaagaacacaattctcaagaaatatgatggcaggtttgtttttatcttcttggtgatttgaagtctgggtttcacttttcagcaagcgagctgctttaatatgtggtggaacaatacagatttaaggacatatttcaagaagtttatgaggcgaattggaagcaaaagtttgaagagcactcaatctggtcctttttcttaaaaaattgtgttctgcgtcctttttctttacatattcattaaaggtaatatgtgaataatactgttggtttaggtacgagcaccggttgattgatgacatggtggcttacgcagtcaaaagtgaaggtggctatgtctgggcttgcaaaaactacgacggtgatgttcaaagcgatcttcttgcccaaggtataaattaaaaaatatagttcttaaaattattatttttgtatcgatacagcaactaagatacttaatgcttcctttctttattcttttctaaatgtagggtttggctcattaggcctcatgacctccgttttggtttgtatcgttaaccgaaagccaatattcaatttttctttgcaaatgaaagtcttgatatgatatgttttgttcagctgtccgctgatgggaaaacactcgagtcggaagcggctcatggaacagtaactcggcatttccgactgcaccaaaagggacaagaaaccagtactaacagcatagcctcaatatttgcatggacacgcggcttagaacacaggtctcttgcctttcacacacggtctacattactagttaactgagttctgcatttctttatgcatttacactgacaacgttcttgtgtcttgtaacctagtttctcttgattttcattttgatggattttttttaccctttttgcttctcaagggcgaaactggataagaacgagaaattaatggatttcgtgaagaagctcgagtcgtcatgtgtaaacactgttgagacagggaaaatgaccaaggatcttgcccttttaatccatggtcccaagtaagtagtctttccttttctcactagcagcaacttttctattacaatctggtcatgtgcatgaaatacgaaagagcttaatctgtcttgaactttaatgtgaaatcaaatccaaactgatcctgttccaagctgatgaatgtgctgaaaactctaattaagttgtgtattttaatagaaaaccatatagaagccaaaccgattcatactggattaagttataatgctgttactgttctattatcgttcttgatggtttaataaaacatttttaatgcagggtgagtagggatttgtttttgaacacggaagagttcattgatgcagtagcctccaagctcaaaacacagttcaaagagcttcctcttgtctgaccattcctgggaattgggaacaatacaaaaataatgctcgcaataattcataacccaacacaaaacaaaaataatattggcgggtttatatgaatattttggttggaaataaacgtttttgcttaatttttccaatttattttaaaaatttgagtgacaatatctgttttcagtttcgtatccaacactaatttatacatacactaaaaagtgatcaatggcgatttgcaatatcagttttgctgggttaagtaggtgttaaaattgttgaaaatgaacggtatacttgaagaaattttgtccaagaatcaaaatctaaaacagagatcataggcgtcggtttaatgtttgtaaattcgattatttatagcagaaccgtaccgaaccagaccgggactgctaaaacccttcttttagttttcgttgtcggctcagtcctcacttcaccggtgcgttaaacccttttccgttctcattccctctcttctccgcatctctcactctctctgtgtatgtgtgatg

SEQ ID NO: 35051 - DNA, 3000 bp, Unknown; identical to SEQ ID NO: 35050
  misc_feature (1)..( 3000): 2750-1469P.txt file - cDNA_ID_3084272; gDNA_ID_2926253; Annot_ID_204439

SEQ ID NO: 35052 - DNA, 3000 bp, Unknown; identical to SEQ ID NO: 28746
  misc_feature (1)..( 3000): 2750-1469P.txt file - cDNA_ID_3084276; gDNA_ID_2926253; Annot_ID_204438

SEQ ID NO: 35053 - DNA, 3000 bp, Unknown; identical to SEQ ID NO: 28745
  misc_feature (1)..( 3000): 2750-1469P.txt file - cDNA_ID_3084282; gDNA_ID_2926253; Annot_ID_204436

SEQ ID NO: 35054 - DNA, 3000 bp, Unknown
  misc_feature (1)..( 3000): 2750-1469P.txt file - cDNA_ID_3084286; gDNA_ID_2926253; Annot_ID_143058
tatgtttcagcagcattgcagggtaagttgttaaaaccttcacttcattagcaagtttggtaatactgtaactgaacttatgagctgtcctctatagtgtgatactgtaaagagggatatatgctttttgttttaactcattaattttcaaaggaaagatggtttagctgccaagagagacttagaagttagaaccactgattttagattttagtgtcttattgtgagagttgctttgttagtggactcttcactgttggctcactttttttttttgcatatgatcttgcagagaaaatcacttccagagttttggcgagatcgtcctgtagtaagttgcttttctctggtcacatatttaactaccgcaccgtattaagttattaacagttcctccttgcccgttagctcatgcccattcgatttctacatgttttactctgtagaatctggcaggcatttacagtttgatgaccaggacacgatgtgttgtactaatgtaatcttattgtgtagccagctgaaggttggaaggaacacaactgtatacctgatgagcactatgttcagacattgctatctgtaagatcaatgtttgatccaaccatgtgaattgttgtttagaaataaatagtattactaatcaaatctggtaatgcttcttcaaatttcagcaaaagggtgtagatagcgaactcacacgaagatcactgacacactcagcttgggacctttcatcctcgaaaagtaatgaacgtcgtggatggcatcctatgacttacaagttttctgatgctactcctgatcttatacagtccattaaggtaagcatccgtaagaccaacattttatttggtagaaatgaaactatccattacaatgtatgtatctctttttctttttttcttgccatggctttagccctcttacaaacttaaaacataaatagaatctctaactaaacacattgattctcagggaatcgacaatatcaactacgagactgaataccggcgagaatggtgtagcagtaaagggaaaccatcaccgtgcttcctcttcgccaggaagttcactcgtcccgccgctctccgcctactccgtgaagtaaacttttctttcactatcatagcttaaactaagaaactaacatcacaaacattttgatgaactcattgtgggtttctttacttcctctatttctttggcagactatcttgttagagggcaaagagcatgacaataagtagatccttcaccatttaaagcatatattacacataggtacgtaagataaccaagagttactatgtttgtacaattgtactactgtgatttcatctgtaatacttacgatgacgaatttacatagaaacttacaccatttggtaaatgagtaaaagccagccttgataaaagatggacggtagagaaagagctcagcaggggtgacctgagaacacatgaaaacgagagctgtaacaatgacgtagcgtcattacagccgttgattactcgtgtgttctcatatcaaccctgtcgagatccactaccttcatgatatattgatatcttcttgttattacattttgagttttggtttgtctcaaacatgctggaaactataaatacacagacaatgaatggattgggtagtacacaataacaccacaacaattgtgtagtacacgagcaagttatgtggcattcattatgtttgggatagtacaagaaaaaacttcggacatgtgtactgcaaacttgattaaaagaagaaaatcatcatcattgtacttttctgaaagtacaacggcgagttttgtactagcagaatttccgaactttctatggtagtattaaaatttctctatggtccctagtccccatattctaaatttagatcaaagtggcctcacaattacgaaaagtggggcaaagttacaaaagcccatattagcaattttgtttaataacttgcatggagagtggggaaaagtaataaaagcccatattctttgtgacaaaagagagcgcgtaaattttgcatatattggttttagtcccacatcgtaaacacagagagaagaataacaaactcaaggcatatataaaacggagagagctctcgaagaaaattcacggagccgtgcaataagcacatagcgaactattctttcgccttttactaaagaataccgtgtgcttgtcgtaccaagcggcatacgcctatttttggagggttgtctcttactgagattaactctatcaatcaataacttgaaaattttctcaataaattaattttcctcaacattcaatctttaatctttaaacgtattcctcaataaatgacttacgagtaactttccatcaagtgttcagcttaaacaagtcccacatcggaagtgtatttgcaaaccaaaggcaaagttttgctataaaaaggatcacgatttacttacctaagcatacctttctcggccttttggctaagatcaagtgtagtatctgttcttatcagtttaatatctgatatgtggaccatcggttcacacgatattaactcaatttattgagggagtgagccatcaaaatagcttgctatttgtgctcacactattgcaagggattggcgtatcccaccaatcacagtgtaaagacttttgagttagtcatgttttaagttgttctcaaagtcgtaactgcagtaaaatcctgctggttcttcttttgtccctccatcgagttgtgtttgagatttcatcgttgcagaaagtaaatagttatgggccaatttaagttagtaggcccaactggcttcagcaattagttgaaatgctgacttagaaaaagcaacaagaccgatgaaaaatgatgacattatttcatcaggaagttagaaaatcatataaaatcgaaatcaagggagactaaaaaaattatataatgcaatctttcgatctaataaaatcggccctgttctcggataagcagataatg

SEQ ID NO: 35055 - DNA, 3000 bp, Unknown
  misc_feature (1)..( 3000): 2750-1469P.txt file - cDNA_ID_3084286; gDNA_ID_2926253; Annot_ID_204435
tctgaatagaaaacacgcagaaattgtggtgaatgatacctctgtctttcctatgtttcagcagcattgcagggtaagttgttaaaaccttcacttcattagcaagtttggtaatactgtaactgaacttatgagctgtcctctatagtgtgatactgtaaagagggatatatgctttttgttttaactcattaattttcaaaggaaagatggtttagctgccaagagagacttagaagttagaaccactgattttagattttagtgtcttattgtgagagttgctttgttagtggactcttcactgttggctcactttttttttttgcatatgatcttgcagagaaaatcacttccagagttttggcgagatcgtcctgtagtaagttgcttttctctggtcacatatttaactaccgcaccgtattaagttattaacagttcctccttgcccgttagctcatgcccattcgatttctacatgttttactctgtagaatctggcaggcatttacagtttgatgaccaggacacgatgtgttgtactaatgtaatcttattgtgtagccagctgaaggttggaaggaacacaactgtatacctgatgagcactatgttcagacattgctatctgtaagatcaatgtttgatccaaccatgtgaattgttgtttagaaataaatagtattactaatcaaatctggtaatgcttcttcaaatttcagcaaaagggtgtagatagcgaactcacacgaagatcactgacacactcagcttgggacctttcatcctcgaaaagtaatgaacgtcgtggatggcatcctatgacttacaagttttctgatgctactcctgatcttatacagtccattaaggtaagcatccgtaagaccaacattttatttggtagaaatgaaactatccattacaatgtatgtatctctttttctttttttcttgccatggctttagccctcttacaaacttaaaacataaatagaatctctaactaaacacattgattctcagggaatcgacaatatcaactacgagactgaataccggcgagaatggtgtagcagtaaagggaaaccatcaccgtgcttcctcttcgccaggaagttcactcgtcccgccgctctccgcctactccgtgaagtaaacttttctttcactatcatagcttaaactaagaaactaacatcacaaacattttgatgaactcattgtgggtttctttacttcctctatttctttggcagactatcttgttagagggcaaagagcatgacaataagtagatccttcaccatttaaagcatatattacacataggtacgtaagataaccaagagttactatgtttgtacaattgtactactgtgatttcatctgtaatacttacgatgacgaatttacatagaaacttacaccatttggtaaatgagtaaaagccagccttgataaaagatggacggtagagaaagagctcagcaggggtgacctgagaacacatgaaaacgagagctgtaacaatgacgtagcgtcattacagccgttgattactcgtgtgttctcatatcaaccctgtcgagatccactaccttcatgatatattgatatcttcttgttattacattttgagttttggtttgtctcaaacatgctggaaactataaatacacagacaatgaatggattgggtagtacacaataacaccacaacaattgtgtagtacacgagcaagttatgtggcattcattatgtttgggatagtacaagaaaaaacttcggacatgtgtactgcaaacttgattaaaagaagaaaatcatcatcattgtacttttctgaaagtacaacggcgagttttgtactagcagaatttccgaactttctatggtagtattaaaatttctctatggtccctagtccccatattctaaatttagatcaaagtggcctcacaattacgaaaagtggggcaaagttacaaaagcccatattagcaattttgtttaataacttgcatggagagtggggaaaagtaataaaagcccatattctttgtgacaaaagagagcgcgtaaattttgcatatattggttttagtcccacatcgtaaacacagagagaagaataacaaactcaaggcatatataaaacggagagagctctcgaagaaaattcacggagccgtgcaataagcacatagcgaactattctttcgccttttactaaagaataccgtgtgcttgtcgtaccaagcggcatacgcctatttttggagggttgtctcttactgagattaactctatcaatcaataacttgaaaattttctcaataaattaattttcctcaacattcaatctttaatctttaaacgtattcctcaataaatgacttacgagtaactttccatcaagtgttcagcttaaacaagtcccacatcggaagtgtatttgcaaaccaaaggcaaagttttgctataaaaaggatcacgatttacttacctaagcatacctttctcggccttttggctaagatcaagtgtagtatctgttcttatcagtttaatatctgatatgtggaccatcggttcacacgatattaactcaatttattgagggagtgagccatcaaaatagcttgctatttgtgctcacactattgcaagggattggcgtatcccaccaatcacagtgtaaagacttttgagttagtcatgttttaagttgttctcaaagtcgtaactgcagtaaaatcctgctggttcttcttttgtccctccatcgagttgtgtttgagatttcatcgttgcagaaagtaaatagttatgggccaatttaagttagtaggcccaactggcttcagcaattagttgaaatgctgacttagaaaaagcaacaagaccgatgaaaaatgatgacattatttcatcaggaagttagaaaatcatataaaatcgaaatcaagggagactaaaaaaattatataatg

SEQ ID NO: 35056 - DNA, 3000 bp, Unknown
  misc_feature (1)..( 3000): 2750-1469P.txt file - cDNA_ID_3084309; gDNA_ID_2926218; Annot_ID_203169
ccaacatctagttaattaatcgtagtttataatatctatattattcatatcacatactaataaattacattgtttatgttagattcatgtaataattaggcgtggatcagctctacaaaaggaaaacgattagaaaaggtattactgagtatcaagttcgatgagttggttggttgggatgagagataaatttatatctacaatgaagaatatagagcctacaaggttactagtttatttatttatcaggaaatgatgagcaatttgatcgaatagtgaaatagttttgacaaaaagaatcattaccttttattctttcatagacgacgtccatatattgatcgactaatattcttaaaactaaaggctatcaactttttatttttcctttgaaaatggtcgaacgagaatctgcatctaatacatggccgtgtctagattattaaacgcatgataaaataaatatttttttaatatgtcacaagaattttttattttttgttagtgggcgtttaattaacttttgttattaaatattttaaaaccatatcatatccattatatatcaattttatgttaaataactagaaaaatacgcatataaaataaataaataaaactgtaattttaaaataatctagaaaagagaaatattattaaaaaaagagacgcctttactttgtcgtgtcaaccgaaaatcaggtaatggctgacgtggcaaaactctggtcgaggttgcacgcttaggacccacatatacctaagagtttggagaaacggttgccgttagcagtttagtcatcaaagactttgactccagagaaatagttttttttttttttttggggcaaaacagtagatgttatgaaattaggagattttttttctttccattttgtattttggacaaaaatttagttatattctgttttttttttcttccataaagtgcacagtcctcgaatttacccatttggtggtttacaataagagcacgtcgcatccaaaattgtcctgtgaatgtgatatatggtcaaaagaatattaacatgcatgtctcatacgtacgaaaatatgcttgatttcattaaatacttatttagcatgaaaattatttctcacataccggtaattaattgattttcagtattagactttctagctttgctaagaattgcattgagtatatatatatatatatatatatatgtgtgtttttgtgattttgccacatttctttttacaaactttggccaagcgtaattagctcatcagccataaattaatcacgcgtaactaaggactcgataaacgggattaacgtgatgcggacaattatttgcatatgatacttttatgcctcgtagggttccacatgttaggtagagacactcttgattccttacacgtgaggtgtcggttcggaattttgatttgaaccttgccttaatgtcatgccatattgccatggacgcatatttatatataacttcatacacattaacacatgatatatatattttacttctatgggtgtataatgtaacatacgaacatataacaataaatatgtcctttggctaccgaatatgataatgaatctatgatttattacgttattgttcaagttaatatatatgtggaaacaaagatatatgtatatatatatgaggaatgcttacactaaagtcgtttgtttcttgatgcatatatatactgtagttttttacgaatatgaagagataactggttgcgaaatcagaaagcttacaaaaattaagaaagtatgtatatatatatatatgaaagtgtggtttgttcaatcaacaattgatttaggttccacaattaattaacaaaaaggtgataatttcgttatcccaaaaaaaataaaaataagcttcaatcaaatgtaaaccgaactatatctgaaagtagtggtcataaaaataattgtagactattttagtcccataaccacgtttccctttttaataaggtttccttctcctagaagttactaagaatcctattcaaattcttctaaatctcgtaattaaatcatgatgcatgcatatgcatcgatgttttctacatcagcagtggaagcttctatgagattttgagcatctgagattctagagtatgagaagaataaaattcaccggcgagtcatgaagatgacatgtgaggcaaatttcagataaaatggttcaggtaaatggacattcaaagaagaagtgaaaatgggattaattaagccatcgagtgaaaaagcatgtagttaaattccgttgagaatctgatatttgatcttactgcaggagggagtcttcgaacaatgaatatctgattctgccggataaattattgaatcgagttaaactcacgagtgaataaacgtgaatgactttggcacacaaccgtgactcgaactccgatgaatatttgtcagcgatgagatactaagccacgtggcattatataaatttcaacagtatagcatatatagctaaaagaaaataatacagttataacttataagaaggaaatgttccgatgcagttacgagaatcttttggcgtattataaaattacatgctaggagcatgattggctgatacaagtcttaatgcggtaatcgttaaaataataaactaaagtggtgattaaaaatgaaaaaatccttcaaattattttgaatttttacaattgtggaaccatgttacagagcatggtatttcaatttttatcgtactactactactacggtattgtttccatttttttaataataacacaaaaggggttaaatcatgataaataacaaaaatgaaggaccaacactttgaagagaagattattgcctaatgtgtattttcttgaattttcaaattttcattttgaaactttttgattgaaaataattggttctgttcgtatgagttcctgagattatttattaattaatatatatactaaaaaattaggagcaagatg

SEQ ID NO: 35057 - DNA, 3000 bp, Unknown; identical to SEQ ID NO: 35056
  misc_feature (1)..( 3000): 2750-1469P.txt file - cDNA_ID_3084309; gDNA_ID_2926254; Annot_ID_204483

SEQ ID NO: 35058 - DNA, 3003 bp, Unknown; identical to SEQ ID NO: 28758
  misc_feature (1)..( 3003): 2750-1469P.txt file - cDNA_ID_3084324; gDNA_ID_1971813; Annot_ID_175854

SEQ ID NO: 35059 - DNA, 3003 bp, Unknown; identical to SEQ ID NO: 28758
  misc_feature (1)..( 3003): 2750-1469P.txt file - cDNA_ID_3084324; gDNA_ID_2926218; Annot_ID_203158

SEQ ID NO: 35060 - DNA, 3003 bp, Unknown; identical to SEQ ID NO: 28758
  misc_feature (1)..( 3003): 2750-1469P.txt file - cDNA_ID_3084324; gDNA_ID_2926254; Annot_ID_204472

SEQ ID NO: 35061 - DNA, 3000 bp, Unknown
  misc_feature (1)..( 3000): 2750-1469P.txt file - cDNA_ID_3084348; gDNA_ID_2926262; Annot_ID_143234
gccaagaagataactacttacaaggaggtattactctctttgttccattaaggaattggtgatgtaatcaatgagttttcagtttaagacgcattagaattgatctttatatgaacaagtattcacttcaagaagcaatcctctaagttagttgttgagcattgtctcaaattcttcttctaatcaggagtcttgcccttatatagaggcattgtatcagaaaatgtgaaaatctacgtttgagactgtggctcttgtgattccaggttgcagacgaaattatttcagattttgccacaattaagcaaaacgcagagaagcctttgaatgaaaatgaggtatagcgagatggaaagctcatatcatctgtcttgagttatttggaaaaaaaaaaagctataacaacattctcttatgttcaatcagtacaatgagaagaacataaggcggagagtctacgatgcgctcaatgtgttcatggcgttggatattattgcaagggataaaaaggaaatccggtggaaaggacttcctattacctgcaaaaaggatgtggaagaagtcaaggtttagcttccaagcttttcctttcagttatctcatctatgtaattgctctctctcttcgtcttctctactaatctctctacctctatttgcagatggatcgtaataaagttatgagcagtgtgcaaaagaaggctgcttttcttaaagagttgagagaaaaggtgatcttctttctgtttgatggaaaatttaaatacaagactctcttagaatttgagatcttgttatgcatgtcaatagatgacaaaagttattgatattgcaggttttctagaatccatagatacgtcgtgtattgaatcattttatgttgtcttaatgaaatgttaaaccgtctttctacgttttgcttataatgttactcaaatgttgttatcatcaggtctcaagtcttgagagtcttatgtcgagaaatcaagagatggttgtgaagactcaaggcccagcagaaggatttaccttaccattcattctacttgaggtacttcaaaaatctctttctcgtccgtagtttctatttcatgtttttcgatatcctaatctatttccatctctatagacaaaccctcacgcagtagtcgaaatcgagatttctgaagatatgcaacttgtacacctcgacttcaataggtaaaaataaacaacatttcttctcaaaatcaaaatcagttctgctatctcttaaatcggaattgaaatcttcgtaaattttgttgtgagcagcacacctttctcggtccatgatgatgcttacattttgaaactgatgcaagaacagaagcaagaacagaacagagtatcttcttcttcatctacacatcaccaatctcaacatagctccgctcattcttcatccagttcttgcattgcttctggaacctcaggcccggtttgctggaactcgggatccattgatactcgctgaccgagcttctattcccaaattcttcaagaagaagaagtaatgatctaattggtatactaaaaaattatacatctggtttagtgttcaattgagagagactgtaaaatcaattcataggccaacaaatgtttgtttatccaattttcctttttattcgaacttgatgcgatatttcaacggaaacagaaactattgttttaaaccaaaactaaccgtgttgaatctattggctattttccttctgtttgattggtctaacaaatttagtctccggttaggttggtttaccgaagctagttagattcaatttacgcgcttaaatggcgcgtgtgctaggaaagttcaaaatttgcaattcccatgcaaaaataatgttttttgtctggaaaaggaaaaaaagagacatcgcggcggttcgagggaaagaaaagcgaaattggttggggacacttcggaagaatgttggactgtttttcaattgccgtcaaaataaatactatatactattcttttcatcaacttaatctactcattctcaatacattttaaatcaatatcatctaatattatttagtaattagtgttggcccattttagtccaatctattagttacttgtttagttaaagttgaggtatatagacgtactaaaattcaagcacaaccaatttctcttctgtataattagatttgtagctgatatagtccacaaaagcagtagatatcatatcagccctaattttcttatagaacaactaagatatatcacaattgcagttttctcttgaataccactaagtactaacgtcacctagatccaatcctaacgtttatcatcttttattttatttttcgattttttgcatgctaattaaaacgtttctaaatatcttgacgtacatcaatgttttctgatttttactgactttaaagtttaaaccatacaaccagtcaagctaagtgcttttttcttttattttctaaaactgtgtatatgtataatttgcacacatagtacagaagtagcagtattgccagaaagagagaatcagaaagaaacttatgggttaagcaatcggacacactcactctcctccaccttcccaaaaccctaagcaaatatgtatataatatataaaacaaaaagagcctcgcaataacactgtggacacactcaattcttattttattcatctatatatataattaatatgatattcaaacatattctatatatatatatatatgtgtatatgtgtgggtatgtatataaatgaataaaggttcttcctttacctttgccttctctctctatctttcgctaagctctcatctcctcttctttcctctctctaaagctcttccctttgtttttattgatgtaattctccacttcttcatataagccttcaccaaaaaaaaaatcagctttaaatcctttatttgctcaaaaaaaaacagaaaactaaagagagaagatatcatcaaagaagaaagatcaaagatg

SEQ ID NO: 35062 - DNA, 3000 bp, Unknown; identical to SEQ ID NO: 35061
  misc_feature (1)..( 3000): 2750-1469P.txt file - cDNA_ID_3084348; gDNA_ID_2926255; Annot_ID_204523

SEQ ID NO: 35063 - DNA, 3000 bp, Unknown; identical to SEQ ID NO: 35061
  misc_feature (1)..( 3000): 2750-1469P.txt file - cDNA_ID_3084348; gDNA_ID_2926262; Annot_ID_204768

SEQ ID NO: 35064 - DNA, 3000 bp, Unknown; identical to SEQ ID NO: 28775
  misc_feature (1)..( 3000): 2750-1469P.txt file - cDNA_ID_3084359; gDNA_ID_2926255; Annot_ID_204518

SEQ ID NO: 35065 - DNA, 3003 bp, Unknown
  misc_feature (1)..( 3003): 2750-1469P.txt file - cDNA_ID_3084363; gDNA_ID_2926255; Annot_ID_143111
catctttgggtcaaaccaagcttcctcatcatcactcttctcttttttcttaaactctttttcatcaaaatctgatttgcttccatcagtgttatcatcaacttgaatgttgttatctactctaaactcttcactgtcactgttgcttgattcctcagacatgagataaagcgggttcaacgaaccaaccgcgggtgaaatgccaaccttcttgttaaagacacggttacgttcatcaccatttgaggaattcttatctgaagatccaacctcactcaatgaatccttctcttttgagtttgactggacaggataagtacagctacggtggtgacggcctttcttcttagacttgtcctctattacaagtgccttgatcaaagctttcacagaccttttgatttcagaatgtgtttttcttgacctctcttctgaattaagtttcttggacttctcctctggattatgcttcttttttgttttctctcctgagttggaagactctttggactttactgcagaactaggcttctttggtctttgcacagattcctaaagcaatgagtcccattggtgagagagttaataagaatataccataccgctgtaagataataagtttgcatcaacttactacatctgttttatcttccagcttgatcttgggtactggaataccatctggtgatgatggtatagtgttgtttacttcgttttttgttccttaaagcagaaaatagaaaatgttacaaaagataaacaattatggtcatgagcttcctttattaatataggagctgagaacattaaacagaaccagggtataaacttatctattactaaacttggcttcaagcacatatatccaaccaaaccaaaacatttgagattatgaagtgtgctatcttttgaagtactaaaacggaacgaggacatggcaaaaacaccaaactaaggtacgagagagcagaagaatcaacaaaactgtcttaccaggagcggttcttctacaaacgggtcttttgtgaggaagtcgtttcttgatgtaacgccaatggttgtgtttaagaatgtcaaatagaccccacatgaatccagggtggttttggattggggagcaagtaactttgtgacgcaagttcttccccattggttacttgtggtaaaaaaaaaaaaactcactcaagctataactttatcaaacctgaaaaacaaaacataagccataaaacacatcaatctccagcaaaatttataacgaaaacagaataagaattttgcagaagcagaacattttaatggtcagagaattgaactttggatcaatcttttacattacccagattgtgaaggttgaagagcatgaaaccgttcacatatatctaaatttcaaataatgaagacactaagtaataacataaaacgtacttatacgcattctacaacgtacaaggtcatcaatggtgatcccaaatccaaaacggtaatcgtgattttggcaatttacccaatcatatatacacgaaatggacacaatttggaaacggaattaatgtggttacctttgtgggaaaggtgaaatgtttatggatttgtgtggaacatcgtcttctcggttgccatatccatggcgaaagaaagaaagagagaagacagagcggaaccatgcgtgcgtgcgtaacatgaactttcagaaatttgccgttttcacgaattttggatttatttatcttgttttgtatattaaaatgaataaatgggccttataacaacatgggctaactataataatcttgatttttcatgggttccttaatgggctgacgattgaccaattggcccagctcaggacaatttttagcccctttttcaatatctggcacaataatattaacctcccttttctttttaaaatgtgaaactggtagtgcgtatatatcaattcttcaataacctccctgtagaaccaaataaaaattaacaaatatagaaaaagtttttagtttttattttgtgtaattgtaaatttgctctgattatctgtctaaagaaaatatatcgttttacgacatttgtgatttattcgcgactaaatgtcacatgcaaattttattgggtgtattgaatatttgaagtttatagagttaatgtggtagtcttgtaaaattcgttcttttttactctccacgtaatgataaaaccataacgtaatttctattttcatttccaagatggtactatatttttatactatttgtatttggctatttgctttcaacccattatcaagtcatttgactttttgccattaatacttaaattactttcttttctgatctcttacaaaaccaccacactcttcctcaaaagtcaactccttcgtataaaaaacatctgttttttaatagaccaaaaacattatatatgttagtataattttgtttttatttcttcgatattgcacgttggtttagtcaaaccgaatcggatagcgcattcccgaatcagaatgttaacaggatttgaattttcttgggttagaaattaaaaaattgtgccaacttcagcccacaaaaaaaaaacaacaataagatcaattataactaaaatctcttaatttggacaattttttttaagaaaaagacgtatatcaataaatatataaataatctgaacttaaatcaaactaatctttaggttcgtaataattaatagaaaagattttggccaaaagtattttgtagtataattttactaattccactaacaattagaataaaccaatccctaaagaataaaacttcacaaagtcaactcttcactttctctctcccacctatgtgactctgtctcttcttcttcatttggttccaacttccaacatatattcaaccaaactcaattctcaagcatctccttttcatgaacaacgccgattcaagtggctagagaaaaacgacatcgttttaaagattctaatctctcacttctcttaaacaaatg

SEQ ID NO: 35066 - DNA, 3003 bp, Unknown; identical to SEQ ID NO: 35065
  misc_feature (1)..( 3003): 2750-1469P.txt file - cDNA_ID_3084363; gDNA_ID_2926255; Annot_ID_204517

SEQ ID NO: 35067 - DNA, 3003 bp, Unknown; identical to SEQ ID NO: 28771
  misc_feature (1)..( 3003): 2750-1469P.txt file - cDNA_ID_3084395; gDNA_ID_2926255; Annot_ID_204508

SEQ ID NO: 35068 - DNA, 453 bp, Unknown
  misc_feature (1)..( 453): 2750-1469P.txt file - cDNA_ID_3084401; gDNA_ID_2926255; Annot_ID_204501
aagcttgtgagtctgtgacagacgacagttcaattatacagttgtttcggaatatgtacagaaccaacaaaaaaagtcaataatttcgtagtttaattatggaagcttttgataaaaaaaaaaacaaattatggaagcatgtcgtttttgtggcgacgagttcatgaaaaacgtcacgtagttagatattcaaaatgatcaattgccataaataacagttatggcccataagtaacagagatagtaagggctgggcccaaaaattcaattaagaaattagtaagagtgtcagtaatttttaccactaagaagatgacatgtgtaatcacaacgactaaccttcaaatcagacggtcatcaatgctcacaccaatcggtccgttcccatactctcctttaatggcttctgagagatatttaagtttagcaaaaaaatcctaagcttctacaatg

SEQ ID NO: 35069 - DNA, 3000 bp, Unknown; identical to SEQ ID NO: 1022
  misc_feature (1)..( 3000): 2750-1469P.txt file - cDNA_ID_3084430; gDNA_ID_2926256; Annot_ID_143119

SEQ ID NO: 35070 - DNA, 3000 bp, Unknown; identical to SEQ ID NO: 1022
  misc_feature (1)..( 3000): 2750-1469P.txt file - cDNA_ID_3084430; gDNA_ID_2926256; Annot_ID_204556

SEQ ID NO: 35071 - DNA, 3003 bp, Unknown
  misc_feature (1)..( 3003): 2750-1469P.txt file - cDNA_ID_3084446; gDNA_ID_2926272; Annot_ID_205177
cctcacgaatcagcgtcctcgggaaggtctagggttagactattggtgggaagatgagaggctttcaaaatcagaggacctggaggaactgagagacgcaatggactcgatgtcgaagatgttgaaagatctgaaggatttgcagaatcaacgagattgtgaggaggacgtgaagaagaagggtgttttacacggaactcatcaaaagcaaacctttaatcctgaatcatgttctgtgaatttcgatgggtttaacaagaacactgaagaatttgatcttgatgaaatatttgattatgtgtcaacagctgaagctctatcgatgaacttggacatggacgatgtctctgtggtgaccacgaatcaaaaccccgtctctgcttctgaaactgttgaagatagagaattggttgttcacaaaaatatggatgaggacaatatccacgtgtctgatatggacgacaaggatacgatgctaatgatttctgacaagaacaatgttttacctgaaaacttggatgaattcgatcaagagctagatcttgatcagctacttgattttgagacaaactatgaaagccttttgaagagttgtgagatggaggattatgcctcgatggtgactacaaagcaaaatctgtgctcaaatcctgaagctgttgaagatggaggattaatgattcaaaaagatttaccggaggataatctctgcttttctgattatttcagtgacttacattgctgatatttgaaactccctccaagataacagatgtttcaaggattgcttcggtttattttcgttagagatactttactcaaggaaggttccggtttgacttcaatcaattttccatgcttcattggatttctgggatgttgatctaactcaaaccggttcagttttggtttgccttaactaatgaagaaaccatccttttttcttttaagttttgtagtcttttctatcaacttgtcttgttttatatgtgtgatgttttcttcttatattaaaagtttaaaaccaatgagtcttactactctttttttcttgtatcaacttgtgtcttgtttaactgtgggatgttttctaatctaaccaacaaataatattaaaaccaatattgagtcttacaacagaaaacatctgtctgacaatctttgattaggaatgtctctgctttcttattaagtaccaaaaccagtcatcatctaggccagtattttgtgattacttcataacttgaaaacagataaagctttaccaaaatagagcagaatggctccataacaaattgcagaagaaccggtgctaattgattccattcaaaacgtgatgcagagaagtgtttatatggcggggaaagtttgggaaaaaacaccttgtaattggttcaaatgcaatgtagggggagcttgggtgttaagaaatgagttgggtggttttacttcacagtcgccgggcgatatttagtataagaagtgtagaggatgcaaagctaagagttttgctttggtctattgaaagcatgtcaagtcacaaagtcatgagagtttttttttgcttgccaagaaaaaggattggtagaagcagttaataggccgcaggcttggcccctcttttaaagctcaatcttttgctttaaagagttttttgtttagttccaggtgtggaagatgatggttttggaaacttttggtgcaaacaggggagcaaatcttattgctaaaagtgtgacaggagatctgagactgcagtcgtatgtggcaatgggtcctccaagctgcctggtaagagtttttgaggaagaaaggacttgcatctctgtttgttaatgcagtttcgtttcatgggctaaagttctttttgtgaactgatatttgcagtccgttgttgagtttgtttagtgtagggagtttgttttgtctcctgtagtttagaccctcacttttttgtagctatatggctttatcagtgtataaaagccagatgatgagaaaaagaaaaaaaaattgcagaagaacccttaatttatgacatatataataccactcatgaagaacagttgaaatttctgacaagtaaattgaattccaaccaagtcaaacacgtttattcgagtttcttttttgttttttctcaaagtataataagatgttgaattctgattagctgaaagatgacacgattttattcattgtttttgggtctaccaaaattggaaagtgagtaaataaatggctttctgcgacatttggctttcccatgttactaatttattaaaggaacagttgaacgcaataaataaaaacaaagacatgcactgatcacacaattcctagactcccaaattatcattctaacaggtaaatttcacggtgatatgttaaatatgtagcctgtaggtccaaatacaacaactactttttttgttttttttctattttcattatacatccttattgttatctaattagtaattatcagcattaaagatctgggacactcctgtttaaagctttcatcgactatttgcctattagttgtaacaatcagcctatggttataggtgaatctagactcatataatcaattctgacttaaaccttgtttgaaagtaaagagtgtttctaaacggttacctatagttgtaaacattcatgtctataataaaaacacaccaatatcaatttacacatagccaaataagagtctcaaatgagtcaaaatattaaaactgatttatgaaaacacaaattttataaaaataaatggtgaacaaatgttaagattagtgaaagttcctattttgaaaaacaaatgtctttgaacccaattaatatgccttgtaaaccagtccatagtatcaaactccaaaaaaaaaaagttacttttaatttcaaatatttacataaaattttgcatgcactactctgttcttatataatcttcgtcttcttcttctctgcttgagtcaacaagaaataaacagagctaaaatg

SEQ ID NO: 35072 - DNA, 3003 bp, Unknown; identical to SEQ ID NO: 28473
  misc_feature (1)..( 3003): 2750-1469P.txt file - cDNA_ID_3084458; gDNA_ID_2926256; Annot_ID_204547

SEQ ID NO: 35073 - DNA, 3003 bp, Unknown; identical to SEQ ID NO: 28472
  misc_feature (1)..( 3003): 2750-1469P.txt file - cDNA_ID_3084462; gDNA_ID_2926256; Annot_ID_204545

SEQ ID NO: 35074 - DNA, 3003 bp, Unknown; identical to SEQ ID NO: 28472
  misc_feature (1)..( 3003): 2750-1469P.txt file - cDNA_ID_3084462; gDNA_ID_2926272; Annot_ID_205172

SEQ ID NO: 35075 - DNA, 3003 bp, Unknown
  misc_feature (1)..( 3003): 2750-1469P.txt file - cDNA_ID_3084465; gDNA_ID_2926272; Annot_ID_143454
aacatggagctccaagaaggtgacatgtccaaggctttggttgctttgcatccaacaactacttctattccaactcccaaactaaagaacattagccgtctcaggacagagcaccaagtgtaagctaatatctcctcctatattttatcttccatataaattttggggaaaaaatcgctctccatctggttttagaacatgcgggtcagccagggttatggcatttttatatatttcaccgatcggcccgagctggctctggttgactcgtatgccaccctgcattgaacaaaccagtaggagacaagcaagcaaaacgttttaagataaggtctatggtaaaatgacaaggtaactgataaatgtgtcgtctatttgcaggtacgagctcccagattcacatcgtctccttgatggtgtaagtcaatttttaactctctctatactcgagttgtttcacttgagcaacactgtttaaaagtcctcatttgataaaataacagatggataaaagagaaccagatgatccaagtccttatctcttagctatatggacaccaggtgagaataaaactgcaatgtttcattcatgtgtctacagtatcaaagaaagtacagctagagctaaaaagcatttgaaatagagtcggttaaatatgaaagtttgaatctgtaaatgaaagccggaacgtagcattggtggatgttatatgtaaattagtttttgagattggtctaatgtagttgtttgactgccaggtgaaacagcgaattcggcacaaccgcctgaacagaagtgtggagggaaagcgtctggcaaaatgtgctttgacgagacttgttctgagtgtaacagtctgagggaagcaaactcacagacagttcgaggaactcttctggtgagattatcttgatcttttgtgttgctcatgaaaaggagaagtgagaatacaagtttgctaatatcattttttcgtcattcacagataccttgtcggactgccatgagaggaagttttccgctcaacgggacatatttccaagtcaacgaggttagatgaaataaaactcaaacagacagacgaaacattatttctgtttagtgttggttctttatcctccttgccattttttatcttgcagttatttgcagaccacgagtccagtctcaaacccatcgatgttcctagagattggatatgggatctcccaagaaggactgtttacttcggaacatcagtaacatcaatattcagaggtaaaaacattcgtaatagagttagttaatcaaatgtccaaaacacaagaaagcttcaccgtccaatacacaagaaagcttcaccttctctttgccaaaaaagatcttagaatgttttgctgaatttgtgcaggtctttcaacggagcagatacagttctgcttttggaaaggtaaacgttaactttcgacccagagaaatccggaaaatctattgctttgttctgatcaatacgttaaacatatacacacacactttacacttaggaccaatactgttctgatctgtgatagaaactggtaaacatctaacaattatgattgcaggattcgtatgtgtccgtggattcgaacagaagacaagagcaccgcgtccattaatggcaaggttgcattttcctgcgagcaaattgaagaacaacaaaacctaaagatgactggaagaaagcaaacgcattgcttctctgctctcctctatttaaagccaggaaaagtcccatttagacataataacaggaatccaaataggctattttctctttctttcttatttcattcatagagcagaagcgacacaaaaaagttttttgggttatttattttctctctaacaaatttgtagcgttttgggtctttttctggctgtcactagcgtggcaaatccaatgtctgcgcacacttaggcgcattgtcaataaaatttctccggccaccggagtgtttagcatcttttaaccggcggctaatgcgaatatttccggtaacacatattccttattctatgttgggttttgtgataacggcagtgggccttactagacaatgatcatcaataaaactaacacaaagttgaatgctacaaagtagaaagtgaagaaaaaataatatagacattgccgaatgccaaccaaaaagaaaagcaaaatcatcaaatcgaacaaagtatttttataattactctcgactcttgagcataataatctctttgattaagcatgaaacattgtttttaataaaatactaaacatgttatatgttaagaaaaattgaattatttttgtaacatggatataacttgaaaaaacatgtgtgtgaagaacagaaaagattatataataatatggtagattaaaaacattagattatacgaggagcaaagtagttagcaccagcaaaaactcacatactcatgtttagcatgtgcccaacacaacacttacaccttttgggcctcacgaatggccaagtaggtgagagagaatcactgttatttacctttttgccctcatgtatattctctcgttaaaagtatctgaaccaatgattatccgccacgtagatactctctgggtgcaccaagttgcaagagtagcatctaaaccaatcactttgaatatatccaagatgccatcccggttcaagtttttatcaagagtaaaagttccattttcatttctcataatcagattcgtattcacgcgcctattatctcgaacttatccaacacgcgcgtttaatcaaccgttggattctcaatggacggtggattaaattagctgaaaagtaaagcggtgcgttttacgcgcttcttctggctagccgccgcacgtgtcatgcacgtgatagcgcacgttagctttgaccattgtcttttgttctctattagttttttaacacacgcccccttattcgatttctcacccacccaaagccactcactctctcttctctctctctgaagcgatg

SEQ ID NO: 35076 - DNA, 3003 bp, Unknown; identical to SEQ ID NO: 35075
  misc_feature (1)..( 3003): 2750-1469P.txt file - cDNA_ID_3084465; gDNA_ID_2926256; Annot_ID_204544

SEQ ID NO: 35077 - DNA, 3003 bp, Unknown; identical to SEQ ID NO: 35075
  misc_feature (1)..( 3003): 2750-1469P.txt file - cDNA_ID_3084465; gDNA_ID_2926272; Annot_ID_205171

SEQ ID NO: 35078 - DNA, 1859 bp, Unknown; identical to SEQ ID NO: 28781
  misc_feature (1)..( 1859): 2750-1469P.txt file - cDNA_ID_3084480; gDNA_ID_2926257; Annot_ID_204611

SEQ ID NO: 35079 - DNA, 3000 bp, Unknown
  misc_feature (1)..( 3000): 2750-1469P.txt file - cDNA_ID_3084488; gDNA_ID_2926257; Annot_ID_143148
ctcaattgatggaatatttggtgatgcagctaaggggaaggagtcattgagctttgggatgaggattcgtgttgcgttgggagcagcaaaaggtattctctaccttcacacagaagccaacccgccagttttccaccgagacatcaaagccagtaacatcctcctcgaccccaacttcaatgccaaagttgcagactttggactgtctcgacttgctcctgttttggaggacgaagaggatgtgcctaagcacgtctcaaccgttgtccgtgggactccagtgagtcatcaaaatgaatgatgtgaaacatatattggcacaagagattcattgcttagttttattgaatgttgtaggggtacctggatcctgaatatttcctgacacacaagctgacggacaagagcgatgtttacagcatcggagttgtgttcttggagctgctgactggtatgcacgccatatcccatggaaaaaatatagtacgagaggtgaagacggctgagcagagggatatgatggtatcgctgatagacaagagaatggagccgtggtcgatggaaagtgttgaaaagtttgcggctttggcactgaggtgtagccacgactcaccagagatgaggccaggaatggcggaggtggtgaaggagctggagtcactgctccaagcatcccccgatagggagacaagagtggaattggcgtcatcttcgtcagtgctgtcaacatcgtcgtcgaatgtgacaagagacctttacgagtcgtcgagccttctaggaagcgatctcagcagcggctttgttcccagcatcgctcctcgctgactccaaccattgcatctatgtacaaatctctatacatatactttgactccacctttcttactttttaaccaattagatatcttccagttacactgtaatatattcttttcaaaaatcgttaataccaaacttcgaatcaaaaaaaaaaaaaaaaaattcgttataccaacatcaatgtctgaaggcccaatacaggcccaatcacagtccctggtttcgtttttaattttcctccgatcaacgctgaaacttgtcgacccgccggcgacgatggatttacagcaaaagcaggcgtgttggaaacttgaactcgaggttatagataacgattcttcatgggtatgcttcagcttctccacctcttatatcaccgtttcttcgggttccgttttgctaaagcttatgctgatgtaggtcagtaaatttgatccttctaagaagaagaagaagaagaagcagaagcctctgatacgcgaagacgacatcttcttccagaatggaggacactttacgggtaatgaattagctttcaaagaattgcgttggaagataatcagttaatcgtacccaaatctatgttgtgtctgaagctactgtcctttattgatgttatcgtaacagaggataacttaccggactgtcaatctagccggaaatttgagccagattatggctacaaagaggtacttttcgctaaaattagagttctttagttatgctactggttctcatttgtgatccgagcttttctatgctctgcagctcttgagtatggtgtttgataggcttcgtgaggaagatgtcgaggtttctacagagaggccaagaacagtgatgatgcctcctcagctccttgcagaagggacgataactgtttgtttaaactttgctgatctctgcagaacgtacgaattctaactcatcttccctttaactacttgtagttattgagccatttatcacttttaaatatacatttttcaggatgcataggaagccagatcatgtcatgaaattcttacttgcccaaatggagacaaaagtatcgctgaacaaacagcagcggctagagattaagggtttagtgtcttctaaggattttcaagctgtgttccggaaatacattggtgaattccataactagtctccggtgttgattttttttttgtttttctagtggtgggtgtcttgtctgatatgtaaaatcattgtgtcttagatgcgttcgtaatctgcgtctgctgcaaaagtcctgacacagctctcgcggaggagggcaatggtcttttcaatctcagatgtgagacggtaagtagaataatctctgcaaccatctgattgctgcgttcaggtcaggggaaagatgaggataaattggtctcatttgagtctgttcttgtgcagtgtggtttagtagcaccagtcgatataccaaatctactgtgaagaaactcatgaagatatggaaattcaagagcaacgtgctgggcaaggttccattgtaagatttatagtgatttcttctgactttgttagtcagttgtatcagaagacgttttctctacaactctaaaaaagaagttcccgcgtcctgagagatgttgtagggctgaactaaaactctcgaaaccgtttgtgagatgtctttagctagtgtatgcctaatggaagttctttaatgatcagttactgagacaaaacgcaaatgatgcaaatttgctaagagtaacgtgtcattttatatgcacgtaatgcaaaaacataagttccctagttcctgtcacggtaaagaggatttgctttagatcacattgtgcatttgtgaaatgactttaaagatgggttggtccgaagcttgcgcaagaaaaattgaatatgacatgtcagctaactctagtgggggttggcttcgaatcttagcttggcagtgacacgttactttggagttgtctcacattccagtcctctgattaatatctctccaacatgtgcttcaagtttcatctctttgcttttgggctgaaacctaggaccgcttcccttgccttgtaagttaatgttttttatttaaataatcaagtccatgttttattgactctgtggatatgaatatatacctaaacatgcaaccaaatgaagaggaatctgttctcatccataaaccaacgaaaaatg

SEQ ID NO: 35080 - DNA, 3000 bp, Unknown; identical to SEQ ID NO: 35079
  misc_feature (1)..( 3000): 2750-1469P.txt file - cDNA_ID_3084488; gDNA_ID_2926257; Annot_ID_204609

SEQ ID NO: 35081 - DNA, 3003 bp, Unknown
  misc_feature (1)..( 3003): 2750-1469P.txt file - cDNA_ID_3084492; gDNA_ID_2926257; Annot_ID_143147
acaatttaatttataaatgctcgtgctgtatagcacgggttatgatctagtcaactatatatgatacaatggtatgcaattatgttactttttggtttgaaagttgcttagattgattctaagcaaacaattttttgttccataaattctctcttatctagtatttcaatcacatcataataggctcatggctaaatattggattgacataatttgaataacaaatatataactaactactcatttgctttaaaagttttcatatgaaatagaaaaaagaaagcaaaaattaagtagtcttttataccattattaggtttctctctttgcatttgtatatagtcatattggagagagtgtcgtatattgaatttttcggtatatctaacgtctcaaaagactattacttaaaaaacatgcacaccattgttaatgttaccaatttatcataaaacacaaaaagaccatatcatataaaccaaaaaaatgtaataatacgaaacgactaagttaaaaattactgaactatgaatggtttagtagcaaacagctaagttgcaatacacaaaaatttctaatcgttatcgaataatgattattaaaaaagtagcaaaataagaaaagtaaaatgaaagtagtgtatgatacagtaacatgattttttgtattttctattttaaatgaagatatttagttaagagtgggattaatggaggatttaatgcaatgtgaaacttttaatttttatattactaagttttgttttttaaatgatattaatttagaatgacatgtgacactcattgatgtgatgatgtgttactcatatggagagaattgaccaattttcatatatatatatatatatatatatatatatatgatttgacgttacggaaaactatataatgtatgcggggcttgaatatattgaaataaatctgtcttggtcatttaaattttgcctgagtcctgacatgggcttagatgtagaaagggagaacagaagttggaataaatcacgtttatgaattcgattaatacataaatggtgtggatgaggtgtgttttgtcgtttctagtattcaacttgcgggttagatcttactttacattaataatatatcatatagtatttgtaattatttctttttaataaaaagataaaattaataatagaggcgatggagatggataatatagttgactgattgtttaatgttaactagcgttggggacagatggatccacacaactcgactcaaaaaattaatgcctggtttacgaacgtgtctttcttgacggaccccatgctttcattgtttggacatagatacttacttttgattccatattccaattttctaatctattagtaaatgattacgtttgtagaggtggtagctgatagatggcttcaaatgtttggggcaaacttaagtgaaaatatccaaattcaactggatagttttttaaaactgaaataggttttataattttcagaagaaggatcaacaataacgacatttgttttaatactatagagaagagagggagagatctaacacaaggtttctcaatttggtcttaactcttaactactagtattaaaatggtatgcgattaaataaactgctagttggataacaaaattagttgccgacaattaaatgaagggaatggtttctcaaatttggcaagtagagtgtttttatattatacccgtgtgggctaaacagaaaagaatgggcctatggatcaagagaaaagcccaattgtaacgagacattacaatatcaagatatgatgggttgggtatttgcgatgatcatatctctctccaacacattacttttggtcgagctttcttcttcaatgggcccattagcgatctcgacggagctttcttcatctggttgttcttcacctgcctgaaaaaggtcgagaaaaaacccataaatgaatgggaagaaagaaggaaagggagagtagtgttgaaacatttattacgaaggtgaagcgtctcatcttctcctgctgctccttggctctcagagatcggattggagaaatcttctgttgtccaaatcaaacggcaaattactttaaatactcttcataactaaaagaaagaagctactatatatgtttgctgcttacagaggaataggcgtggagctccttcaatcgaaagaggcgatcgacctggatttcaaggcttttctgtgtctctcctctctggagaagatggctcatgtgcagatccatggcttcatctctctcctttagcagcttctcagtgctctctcgatcctctctcagcctctcgagtttcttcttgaaggcactaagctcctccgcaagagaagcatcgattgatgtctcaagattcagattctccttgagcttctctgcagctttgggcttcacgaagaaagcatcctcctttggggtctggtagatgtttctcggctgcagtgcttttcgacctgaacatttcatttctttttgtgttttggatgatgaatgtttgagattgagagaaaagcaaagcaaagcaagcagagcaacttatctcaaaatgcttttttagaaccaaaaatgatgttcacaataagattatagaaaggagaggccatttcacacagaaagagaagaatcataagcaatacgacaagacaaaaaaagaaagagaaaaaaagaaactagccgttaagcgccgaatccaattcaaattcaaaataaatcttttttttttgttttttgtatagttaggaagtagttggtgaacaaaaaacgaaagtaaaacctcagggactgttacaaattaacattttaattggacataattgagattattgggctatattgggccactattgagatgattgggctatattgggccacttgatgtcactcatatgaatgacatgacgacatttggacataaaatgaaccaaccaaccaaaaaaaagaaagggagagcttcaaagagataagatg

SEQ ID NO: 35082 - DNA, 3003 bp, Unknown; identical to SEQ ID NO: 35081
  misc_feature (1)..( 3003): 2750-1469P.txt file - cDNA_ID_3084492; gDNA_ID_2926257; Annot_ID_204608

SEQ ID NO: 35083 - DNA, 3000 bp, Unknown; identical to SEQ ID NO: 28780
  misc_feature (1)..( 3000): 2750-1469P.txt file - cDNA_ID_3084504; gDNA_ID_2926257; Annot_ID_204605

SEQ ID NO: 35084 - DNA, 3003 bp, Unknown
  misc_feature (1)..( 3003): 2750-1469P.txt file - cDNA_ID_3084517; gDNA_ID_2926257; Annot_ID_143142
atgacattagcagagagagagaagtagaaagttagacttacttaaagtctatagcgtagttaagtactcaatcttcttcttgtcaagtgattaactggtagtatcacacgccaaactaattggttaaatgttataacttaaagcctatgttttatcctttatcaatacttgaaacaaaacttaggagatcaactaactatgtatattatcgattatataagttttatgtttttttggatattttctacaattgtgcattccataatgatcatatatagtgtatctaattttaaatattttattataaaatatttaaactatcttaccatgccgaagaaaagaaaacgaagaataaaaagtgaatttttttttttatcaacattagttatctttaaaataaaattatcactatattaaatgttaaaatatttattatcatttcacatctaaaatatatttttatattcgtaaattggtagtatctttacattttacacaactatatatgtatatttataatatttgtacaagtgattacctgtagattagtgtggctattaataagtttaacactacaatttttcttactttaaatattctaaccttttttcttgaaattgttttagtgtttaatacttttttagcctttaagtttttttttttttaaatggcgttgacatacatataaaaattaatattagtacatgtacagtatattgacaaactagaataattaaagcttaaaaaaatactataataaatgggttgaaatgacttgattgcttatttaagcaaaaacatatactttccatttcaataacacatccagctaagtaaaaataaatgtaacgtatctttgaatacagaaagaaaaaaacgaaatttcgatatttgaaatttaaaacaaaggatgagtaaatgcaacttgcttaatcttggtttactacagatacagaaacaactaagagtggacctgtgttttcctaactaatatacatcatcatattagtaatatataaagaaagtacaaatcgaaactgacagaaagttaagaaaatattaccaaataaggagattaattgataatctacgagtagatagaaaaggaaataaggaattgttaggattgcaaatgggaaagaagaaaagtgatgagaggcataaatcttgaggatgatatattaagaatcaaagacttaaggcaaaaaatagtgtcaataagccgtttccttgaatgttactttctgaacttgggattctctaccataattgtcaagattttctagacattaacgattagcaccctattgaacaataaatacaagcactcttgttcctttctcatctcatattcacacaaacacaaacccccaaaatcacttttgttccttggactatggaactaaacctctctacacccacatcatgttcctccagcagcatctcatcatcttcgcatgaggccatccctaggaccaagggtaaaacgaaagaggaggtcacggctgagccgtcgaaggagaatcagcagcggctagagttccgcttcctgttcaacgagagtagtacaagaaacgaggctaaagcgagggtgtttgcttgcaccttctgcaaaaaagagttctctacgtctcaagccttaggaggacatcagaacgctcacaagcaagagcgatcattggctaaaaggcgtaaagagatcgaaatcaactatcctgaactctccatctacagccagtacccgccaagtggactttccttcagcagcagctcctcgcagtatgatctcggggttcgttacaatcctaacattgctaaaactactaagccctatccgttcaacatcttcgcatgtcgatttggatacagagggggactaaatttccctcccatgtctcacctctcggttccaaagacagacgatttgtccataaacttgatttcaaatctagagggcagcattcacgaccaagccgtaaaaaaagatcaacctgaagctgatccttgcaaggattctgatatagacttgtcccttaagctatagaatgcatgttcttttttaggagagttaatttttactagtttgtccttgattctgcacttctttcttacattgtgtttttacatataatttttaagtgaagaaaaaagtgactttcatgaattccctggtcttctacttaaaacacaaaaaagtgtttgggtaattaacttctgaatttcaaattttataaaacgtatttgtgttgataacagcttatttgctaacttaatgataaataaagactacaatatatgagagagttataacccttttaatatttgaatttcaacagttaataatatcatttattaatttgattatgttcctcctattagcaaatatgcagaaagaaaacccgacatttatataaagccacaactactaaaacttgttagatgatctaattattgactcgacctccacaagactaaatttagagttgaagtttttggatatatatgtatacatatagagactagagagagtacatattaaaattcaaaaatgatatatttgtatatagaagattccaacctgaagatgaggatgcaagttggtggaagtgttgtgggatagaaattcagacagattttgtgatgtgagttaagtcttgttgtttaaaatattaagaaaaggtttccttagcgtgatctctctcgaactaaacagcaagaagttacaatgctaccaaaggacgcaatgagctaggtcaactcaagctcctccaggatgaaactgaaagtgtacagagcaaagtcctctcttgggatttgagcttagtaggtgaaggttgcattcaattaccctcaactaatagcattcactcctcagcccccctcaaccacccaccctactctcttctctgaggttatataaacctcattctcactagcatactaagcataatagtacgcagagacaagagagagatagagagaaaagagagagatagagaaatg

SEQ ID NO: 35085 - DNA, 3003 bp, Unknown; identical to SEQ ID NO: 35084
  misc_feature (1)..( 3003): 2750-1469P.txt file - cDNA_ID_3084517; gDNA_ID_2926257; Annot_ID_204601

SEQ ID NO: 35086 - DNA, 3003 bp, Unknown; identical to SEQ ID NO: 28779
  misc_feature (1)..( 3003): 2750-1469P.txt file - cDNA_ID_3084523; gDNA_ID_2926257; Annot_ID_204599

SEQ ID NO: 35087 - DNA, 3000 bp, Unknown
  misc_feature (1)..( 3000): 2750-1469P.txt file - cDNA_ID_3084535; gDNA_ID_2926257; Annot_ID_204595
ttgtaacaataaatgttgagaaataagtaaatagcgaaagcaaggaatggatcggagaatatgcagaaacctaaccatgcatgttccctgtgtccccatgggatactttaattgatgcgggctctcctttttggaccttggatgtgtggtccttgatcaactaatctcctactattaaaacaaataaagaaacccatttagagaaaatgttgtcggaactcggaagagatcgttctcaccataccgagttaccatcaataatcttaagataaagaattgattttatgactgaggcgcaaagaattgaaaaatctatggccggagtccatttctttctttattcgtatatttgctatccaaatttaataggagtaggtggttaatatttacgaattgtagaaaattgacttagcctaaccataaaatttaaaccgtcgatgtcatcagaatttaatttgttttaatctttatttaggtttctgcttacctaatcagctgcgtataactttgaaacagttttctcgcgttatttaaacaaaattttggctactgactgacgtttcccttagttcttattctagtctgcgtatgcgatattatgaaatactaataaatttgtcggtaagcaattgtaataacattaaacttgtcgtgagaatatgaatcatatatacaaaaaactacttcctgcaatagaagcgagaacattttcagatttttctatactcactaatgataataatatatgtatagacataagacgcgtgtctattaagatcgagaaaaaaagaatgttgtgtgttttgaccgttaagtgtttgtaattaatcttcatgatgaaacgaatgtaaatctatgtataccagaaatacagtttaacaaaagaattctggttatcaagcgtcgttagctcaattagtaaagaccctaggcgaagcttagagatcgtcggttcgagtgacgcttggaacgaaactaatattacatgatgtggtttcgggtctgaggaattacgggcttcgacccagaacctcctggtattcaaaaaaaaaaaaaaaaaaaaagaattctggttttacgatatcaaatatcaatacatgcatatcgtggacggacaaatactgtaattagatgttgaattaatggaaattatatagtcgccagaccattaataaacgtaagacaatgcttacgggagatatcagttatgttatcgtacgtttctttcttctgcacgaaagccctttatttttcttcctgcagccttcatttattcttgcattacgttttttttttttttttgtaaacgtgtttataacatattaacatggacctcgtatattccatttttttaattcattttatttatgttttcttttgttaattacttcagaagttatttatggtcatatatattatatcgttaaattttgtcgtaaaaatgggttatatggtcacattaatcttgcatgggaccaaaagtaacaagctaaattaataatgtattcttttattttgtttgtcaacaattaataatgtattcaaaatcagtagatattttgattggagcaacctttcgaaccaacgaaagaaaaggggcaattatataaccatccatttttattgacagaaccttgatttcgtaattatttaacgagcttctttccttcctccttctctttttccccaacgaaagaagcttccatgaaacagcatcagaaaaaatcaaaattaaaaacaaatgaaatctttcgtacatcacattattaacgcggtaatttatttttattttattcccgtacatgtcttttaatggatttatatatattaaaaaagatgttgatttggttttatgtgaatactgtagtactaatttatgcctaccaaaaaaaaatagtactaatttatgtgtggcttggatttatatatatgtacaaatgggcacagcgtgacagcgaaaatagtaacgtacgatttatctaatctttaaaacgttgtgtgttttggataaattacaaaaataattaaaattgattttatattttgttgtacgctgcggtgggtagatcacgtcgtagatttactataaaaattgacactgcaaaatttatcctcttttttttggtattaaactttaaccaaaacttcacaagattataaaagccttgcactctaacaatgcaatgcgatgatttctaagtcgtcaaatgtttaagtctgaggaattgggacataattagtgtgattgtgggtagtgatcatacatggaactaatacatctttataaaattatactgactttccaacttagctaagtaagaaaatagtaactattaaaaaaaaacaatgagataatgttaaatattaatcaaatttgtttttcttttttattttgggcaaaagttattttttcaagcgcactgtttgtactttataatgtgaaacatatattgaaaataatcaattgaaatcttaaatgtagtcatatttctttttttcaaaaagcatcaaatagatcaatttgcccataagactcgatttatttttccacgaatatgggaaaaaacaactggagatttttaaaaaggaatgacatatgttttccaaatgtattaactaatgattccaacataagcaaatatattttctaaaaatagtgaaataaacaactgtgaaatgtatacaaaaagcatgaaatatattttcccaagtattgtttaaatttgataaataattcaagttatttggaacagtgatggagtggaaaaataaacataagaatcataattaaaaatgaacgtagagtttagatagtgatttgaaaagattaaggaagattaggaaatgacactagttataggacgattccaaccttgagcagtggggcgggagttgtagtaacctgtcaaccgcaatatatagcctggtgctcaaaatgagacttgaactaatactaataaggggaatttggatgttcaaaggacttaaccacgattgatg

SEQ ID NO: 35088 - DNA, 3000 bp, Unknown; identical to SEQ ID NO: 28776
  misc_feature (1)..( 3000): 2750-1469P.txt file - cDNA_ID_3084546; gDNA_ID_2926257; Annot_ID_204589

SEQ ID NO: 35089 - DNA, 3000 bp, Unknown
  misc_feature (1)..( 3000): 2750-1469P.txt file - cDNA_ID_3084583; gDNA_ID_2926258; Annot_ID_143178
tcgtggaattcgtggacggagtactggctttgcagggtgattctcccattgagaaattctccctcaagtgtataactggtattcatccagatcatgtgaatcgttggatatgtaatgtgctgcagcgtggtgtttcggatctttatcttttcactgatttttctgatgaggataccgaagaggatggtggttataggctacctcaagagatgttcgtcagtagaacactggttaagctgaaattaagaagtgaacactgtgttaattggtggcattgggatattggcgcttccttaccaaatcttaaaagtcttaatattgactcggacttgattttctttggtgagatggagaaatttctttcttctttccctgtgcttgaggaagtacacatggctaatatggagtggagagaattagatgaaaccatgtcaagtgcaagcctcacgaagctaagtatccacggcaccggtgttgaagagtttgaacatccaaagagcatttctattgatactccaaatctgctttacttaaactattctgatttagttgcggaggattatccattagttaaaatgggaaagttacttgaggctcgaatccatcttataataaaaaatgaagatcagatcaagcggataagagaaccaatttgttagaggatgatgagggtgatgttgttctccaattttgcaatgtggtgaagctcattaacggcatacaaaatattcagacactttacttaactgaagatactcttgaggtcagttttctattatgttctctctggtccatttttgaaagatcaattgcaaagtacctcattcgggttttttttttcttgttttcaggttcttactatgtgctgtgaatcaatgcctgtgttcaacaacctcaaaaccttaggacttaaaagtgatgagggtcgcggttggcaggcagtgccagctcttctgagaaactgtccacatctagaatttctaatcattgaggtcaattacagaccataaaactactcggacaacacatttgttaaagttgttggttagactcaatcgtcttattgtcttctttatgctttcagggtctcttacactctgtgacagataaatgcggggatgcttgtgactgcatttcgcgggaagacaaaggtcgttcgctcatatcttgtccagtgaagaagttagaggttagagggtttcgtggaacaattcgagagaaagagatgataaggcatttcttggagtatttcccgtgtttggatgagatggagatagatgccgaagagaatgattctacaaactttgaagtgcctagaattttaaaagttgtcgcgtataggctccacgatgtggtctcgacagagatagttggacattggcagagttcggcacaatctgggggttggtcccagacccagatggatgagatgtactatgaggtacactatttgatcaccgttttcaatcacataaattcatgacagctttgaataaactaactgtcttttcttttcttttacagttggctccccgcaataaagagcgtatctacgatatgttcttcttcatgcgtagagcttcttccacggtacctcctcctccgccacaagagatgtctcaagactaccttcagatgcaacttgaagttgcggatcttaaggagaggcaacgagaccaggaagccaagcttgcggatcttaaggagaggctacgggctatgttagatatgattgttgaccagaacccaattatagcctcagcgttgagggctagagaggcaactaactcagagcgagaaaaggcgtcgagtggtcaggagatgaccgagaaggagcgggactatgatgctctgttcgatatcattgtcgagcagaacccaatgctagcatcggcagttagagctctgcgtgcaaccgactcagagcgtgctgagacatccagtaatcaggagatgaccgagctcggccaagctacggcaacatattttcccccacgagaaggagaatagatctgtgattgttttcttaatgctttccaatttggttcggtttgtgtttatttagttggaattccagttcaaaatcctgaagcgaagcagcttgtaaatttggatcttcatatcttccctactctctcgacgttgcatctgtacacggtaggtgcggaagctaactgttctcttctgtctctgctgattttatactcctttgaaggtatcttatatcatttttgcgggtacaagtaattatgttcgactgcatataaagttatttgatttgaattgtccggttcgcattaaccaaaccaacttaagctttcagttcttttttcttcccgataaaaagcaaactttcagtttaagaagctgagacatccaaaattcaatagcatcatcagctcatcacgatgcttctctgtttataatcctaatcaattttgcaactgggcgttgggcctcacctccgtaacccaaagtcaaacaattccggtttgtttaccgaattaaaccggtgattaaagtagaaccaacaacatccacacttggttttaaaaaccctcaatttcgtttgtctgctgtcttcttcttcttaaagttggatgtttcggctactctgatgcatttgcatgtattgtcgaactgaaagtctgtgacttttcttctcctctacgatagaaaccagtgacctagcactcccaactctcactcttatcactggacgcattctccaaaattttgatcttcgattaagccattcgtagcgaggtaaatgctcaagttttacctatctcctctgcttccactgattctgtttcttgattcaaagttttctttgtgtgaattcatattttcgtgtgaattcatattttcgtgtgaattgtgaattagggttttctctgttcccgtttctactctctcatcttttggggaaaagttgtcaactttcatgttttacctgtagccgtaataacgtactcttaatctcgtgtacgcaagatg

SEQ ID NO: 35090 - DNA, 3000 bp, Unknown; identical to SEQ ID NO: 35089
  misc_feature (1)..( 3000): 2750-1469P.txt file - cDNA_ID_3084583; gDNA_ID_2926258; Annot_ID_204643

SEQ ID NO: 35091 - DNA, 3003 bp, Unknown; identical to SEQ ID NO: 28375
  misc_feature (1)..( 3003): 2750-1469P.txt file - cDNA_ID_3084587; gDNA_ID_2926258; Annot_ID_204642

SEQ ID NO: 35092 - DNA, 3000 bp, Unknown; identical to SEQ ID NO: 28374
  misc_feature (1)..( 3000): 2750-1469P.txt file - cDNA_ID_3084619; gDNA_ID_2926258; Annot_ID_204631

SEQ ID NO: 35093 - DNA, 3003 bp, Unknown
  misc_feature (1)..( 3003): 2750-1469P.txt file - cDNA_ID_3084627; gDNA_ID_2926258; Annot_ID_204628
gcagaaacacaatactgatttaaacactcaaagaagtctaaatgaatatctctaatcagtgataactgataagtacctagaggcaagatgccgagcagcagcagtagagcagttcatttcatgttcagcatgcagtatgaagaggatgtccagcactcgagccaaacgaggattaggcttgtaagacctattgcccctgtaatcaattgaagattaaagaatgtatcctgtgttacagacacgtttgaagcttgaaacagatttaaactgactaaagaaacacagtttttctgactacccttttaaaatgcaagtgttaaatcaaataaagacagaagaaagaggggaaagtacattgaatccagcatatagaggaaattctctgaataagaaaggttggccgaaggaagaacaggaggcctgcctgccgtcctcaaataagcagctgctgcaattgttggtgcctgcaaacacgttgtaaaccctttttctagtcccgcaacttatacacagatacgttaaggaaacaaatcatcaacagatagaacaatacctttccgagaatgcgaacaatctgtttatcacgaacttgttttgacttgtaaatgtcttggccctgcacccaatgaaagaaaatcgagttggcatagccattttcagaaaaaggcatcttgacagtacgaaaagaacaggatttcaaaacttacactaagagcaggatttgcatcagggtgaaagatagaaagtgcactcatggcactcacaagaactcccattgggtgtgcatcatgaggcatggactgtatgatatcctgcaaaaacattcagaaatcgtctcagatcaaaaatccatagaaaattcttttactaagcatatacacataactatattcacaacggcgagtaagacataaggtactaatactagaaagagatccagtatccttaatagacatggtttacaagcaagacaaacaacttgtacacttgacaagaaatcattttcaaaatccctctttggtttggatttgcattctgatacaaagtttggaatttgcactagtatgaaaatccaaataacgaaagagtagaaatttcaccaatactccttgtggcacagctgaatgctgagaaacagtgaactcccaatcagctagctgactttgagaaggcagatttccatacactggagacaaaaaaaggggaattttaacacgacactaagagagacacaattttcaagacattttcttttccacaagtagacgccacaaaagtaaaataagcaacaacaacaacaagaataagcaacgagattgataaagacttactgaggagataagcaacctcaataaaagtactgctctcagccaactcttcaattgggtatccccgataacgtaagattccttcatctccgtcgatgtaacaaatcgaagatcgaaccggagccgtgttcaagtaaccaggatcgtacaacttcagccccttatcatccttccccgtcgttatctgcacaccaaacatgcaaatccatcaaattccttatcatattcagggaaaattaggtgagacgaatcaaaattcagataaaactaactcgattccacaattctgttcaggattacaaatccgttacataccttcttgagatcaacggctttaacggtaccatgctctgagacagggacctgatatttcttccccgtacgctcatcgacgatcgtcaagtttcctttgagtgatccatgaggtgcagcggtaatgtgagccgatgtacaccatggcgcgatcgccggcaacacctgttccaatccgacggtatcagacaccgccaaatgcgcggtgagaacggctaatctagctttcactctctgcgaaatctccatttcttcctctcaaaaaattttaaaaaaaatatctgaattcaatttcaaaggaaggaagcgaagaagaagaagaagaaacaatcttgcggtaagtgacttggcttttgtatcctgcatttgctaattttggtagtagctgatatttttattctctgcgggtaagtgtattgaaaatcggatccattgtttatccaaagctcgacggtgataagattattcagcttagatcaacggatagaattgttcgtcaaaaactaatatggaaagtctaaagaggcttatctgtcaagtttatcaaaggattaagactttcgtttctgaaatccacccgggcaagggcagtgaagactacgcgctcaatgagaatgacaggtggaagaacacgagcgagtgtctttcagacgctatgtagatcgagtagaagtcgattggcgtcctcggattgctaaataactatctggttttcgataatgggccaactcattggtctcacattgagaaatttaatttccctaagtgtattgatcggcccattagctctttacgcctgggctgatgacaatagtaataagaacaagggaaatggtccaatatctttgcagttaaaatttatgaacatatggaaattttatatttgtagcacaaagattcaccagtaagaggctggtaatacactgcattgggtcacaacgggccggtccattaaacccaattaactcttatgtatgagaaggaacttaaaaccccattcagtttttgatggacttgtgaacgctgctactaaaccaaggtcacttctcagttctcacaacacatatgttatgtttgcaaattaaatgcagttttataatttttagtatttaactgactatcccaaattattttcaaaatatctttgaaatttaaaaagtgattcaattatgaaacctccactcacacttttgtaccatcctttgcttttgcactaatcaaatttatttgtttgttcagttaaattgttcaaaaaaggagaaagttatgtccaacaaaaaagagagaaaaaaatgcaattagccttttaataaaaaaaggagtagtaattacaaaaaaaaatgaagtactgtagattatgatg

SEQ ID NO: 35094 - DNA, 3000 bp, Unknown
  misc_feature (1)..( 3000): 2750-1469P.txt file - cDNA_ID_3084631; gDNA_ID_2926258; Annot_ID_143160
attcatgtatcattgccaccggtaatgcaataatatgaacctgcatgactatgaggaaaatataaaagtacaggaaatagccacttaacctagcaatttcaagggcgaacttcactgcgtgtgctggcattagaggtcctttcctgtctagatattgtcgaagatctccctagaaataaacacttaataattagaagcatagattttatgcagtgaaatatgaaacacagcagtttgcagaggttaagatctaaacatcttaaacaacaattaaatatcaaagccattcttcatgtcatatctaactaactgtcgaggtaaacaaaggactagctcaaaacgttgtcagtttattttgtaagcttcttaagatctactcaaccaagtattaccagaatgtttataggattccaactgctagtgttcatgatggatcttgaatctaagatgataatttgtaaacctggagaggtcatacatcctctgaatgtggttattcagattgagaaagattaggacctttggtaaatactcggtgacaatcatcatgggggtactctgagtaactgcccctagaaactgaacaacattcggatggcgtatcttttgaagcagtgcaagttcgtccctaaatgcattcctggataccagaaggatatgaaaacctttagagcatgattaatacaataatacaaagaaatcaatggatgtagactcacactttgtcttcatcagtgaacatttcctctccaaaggttttaacagccacgtcaattccacgccatgaagccttgttaaaggtaccctgtaaagcagacagacagtaattacaactgtgaacagcaaataaaagcaagtgaaaacagcaacaaataaatttgggcaagggaactacttacctttgaaattttgacagagttggaaaaatcaagctctgtaggatgaatctcgtactctggaacttctttatcagttaggacatgcataggagcaatctaaaatcagaaacgattattaaagaaatcaatccaaacattcagaaactaaaacatccatcaatgcaactatgagggataaacacataccgtaggcttagcaccatgtttctccaaaagtttaatcacatcatgatttttgtaatacactgcatctgcaagaggctggtaagatcaatcacaaattgttaaccatcactgttattgcaaccgagtttgctaaatctaagtgctccagtaaaacatatgatttgtgcggcaattcgtcgaacacaaaacgaactaaagagtctacgagaagtcaagtcaggcaaagcaaacaaaattcagcccagagaaagttcgaattcataccgtactaccccatcggtccttcgtatcaaccttagcaccacggctaagcagcagctcaacgacatcggttcgtccttgacaagcggcgacgtgaagagcagtacgggcatcgatgtcacggtaatcaacattagtacccgaatcaagcatcttattgatgccatcgatatcaccttcgttggctaaatacattaaacgaatcgtcggatccccgatcccagctgtagccgccgcagccaagtcgtcgtcctcatcttccgttaacgtatcaatcggggttcttgattccggcgcaagcgaagactgcctacctagcttgaatctcgccggcgatttaggcttaatcgtcatgttcaacagaggacttggtgagaattttctgccgcaagcaatatgagctgtaaatggaactgtaacggcagcaacagaaaagaaaaagaaaagtagaaaaaaaagtcccaaccaatcagcaggctttaagggtttgcctcttaatgcgggtgaagtatcatactcgttttcctcctccctactcatcataatctacagtacttcatttttttttgtaattactactcctttttttattaaaaggctaattgcatttttttctctcttttttgttggacataactttctccttttttgaacaatttaactgaacaaacaaataaatttgattagtgcaaaagcaaaggatggtacaaaagtgtgagtggaggtttcataattgaatcactttttaaatttcaaagatattttgaaaataatttgggatagtcagttaaatactaaaaattataaaactgcatttaatttgcaaacataacatatgtgttgtgagaactgagaagtgaccttggtttagtagcagcgttcacaagtccatcaaaaactgaatggggttttaagttccttctcatacataagagttaattgggtttaatggaccggcccgttgtgacccaatgcagtgtattaccagcctcttactggtgaatctttgtgctacaaatataaaatttccatatgttcataaattttaactgcaaagatattggaccatttcccttgttcttattactattgtcatcagcccaggcgtaaagagctaatgggccgatcaatacacttagggaaattaaatttctcaatgtgagaccaatgagttggcccattatcgaaaaccagatagttatttagcaatccgaggacgccaatcgacttctactcgatctacatagcgtctgaaagacactcgctcgtgttcttccacctgtcattctcattgagcgcgtagtcttcactgcccttgcccgggtggatttcagaaacgaaagtcttaatcctttgataaacttgacagataagcctctttagactttccatattagtttttgacgaacaattctatccgttgatctaagctgaataatcttatcaccgtcgagctttggataaacaatggatccgattttcaatacacttacccgcagagaataaaaatatcagctactaccaaaattagcaaatgcaggatacaaaagccaagtcacttaccgcaagattgtttcttcttcttcttcttcgcttccttcctttgaaattgaattcagatattttttttaaaattttttgagaggaagaaatg

SEQ ID NO: 35095 - DNA, 3000 bp, Unknown; identical to SEQ ID NO: 35094
  misc_feature (1)..( 3000): 2750-1469P.txt file - cDNA_ID_3084631; gDNA_ID_2926258; Annot_ID_204627

SEQ ID NO: 35096 - DNA, 3003 bp, Unknown
  misc_feature (1)..( 3003): 2750-1469P.txt file - cDNA_ID_3084650; gDNA_ID_2926258; Annot_ID_143154
ttttaaaaaacaaaaaaaaaactataaacttcaaagattttgctatggttattagattatgacattaaaatattaattttaatagattttcattctaaaatgcatctagatttcaatattgatttccaagtagcaagaaaattatttaaaatcatagttaaattaaattaatcttaatttgatttaaaattaaaaaaactcaaaattaagttgtcaaactacaactgactgccacaaggttataattttaatttaagcgattgcaaatatagttcaagaaaccatgcattaaaaaaaaaaaaagtggacaaattttaggtgactttgggtatttatggtcatcaatgtactctattagtggacttgaaaactttgaaaagcccaacatttgttctggctctttaatctgagacctaaacattgctgatttggtccatctaaaaaacatagtcaaagtccgtttgtccggaagttttttctaccaattccaaaaggcctttctcggcctatatgacctttgtgttggtccctgacttctcctatgactaattgctgtgccctgtgtgccatttttttttaatcagagttttctcattttatatatcaacaagttatacaatttcggattaaattccgacatcgtcaaaaaggaagaaaaaatccgaccaactctaatattattggttatagtttttgcgtgttaacattttttagttaatatagagatcaaatttgggccaaaattatctacgagaaagtctgtctcaactatccaaagttaaagatattttcgctgagaagttaaaaataatatttcgatgggcccttcaatcttagctaatttactaaagtaacccttgtcgaaaaatcaaaaatataaaatcgcaaaacgaacacggcttagtttatcttcttgtctctctctcatttcttgttattatccacgaacgaagaaaaacctagaaaacagttgaagaaagaaaatcacaagagaagccatggccggaattggaccgattactcaggattgggaaccagttgtgatccgcaagagagctcctaacgctgcagctaagcgcgacgagaagactgtcaacgccgctcgtcgaagcggcgccgatattgagaccgttcgaaaatgtttgttttctttctttctctatctccgtctctctgatctacctttgtagcttaagttgtgggagaatatttctctggtttaggttaaatttggcgattgaatctagatgagttttattacgctgtgttttagtttccatgattagggttatttgccttcgtcgccgtcactggattattgtggttgtcttagaagagatctgtgttaggttttcgcctgttgtgattcgaatttcgtttgctgcagtaacagttcgtccgattttacttatggattcttgttcgtatcagattgatgtttctgttttgacatttgaatatgcctttatcattttttctttttcgtgaaatctcctttgttctatatgagtatttctagttgttgcaagtaatcatctaacgagatttgttgtttttgttattgctgggtttagtcaatgctggatcgaacaaggctgcatcaagcggcacctccttgaacacaaagaagctagatgatgatactgagaacttatctcgtgagttattcaatctctttctcaaggtgtattgatctgatttctatattgatatagtaatgttagtatctatctctatatcccttggacacagtgggtgaactagattcttagggtctgttttcttgcaatgtttgaattgtactagtgagtggaagtctttttttgttgatgggttattgggatgccacgagctgatgctttatgtactatttatccgcaaatcactgtgttttccatatgtgtcttagattgattagtagtgttggttatctttaacaccttggttgtgtatggttttgaaatcagatgatcgtgtgcccactgaattgaagaaagccatcatgcaagctagaggggagaagaagctgactcagtcccaacttgcccatgtactttcatttttctctgtatctttctctttcttttactgtctttcgtcagtaattgaattcattgtatgggttttgattctgtagctgatcaatgagaagccacaagtgatccaagaatacgagtctgggaaagcaattccgaatcaacagatcctttcaaagctggagagggcacttggtgctaaactccgtggaaagaagtagaagtgtagaacaaagctcttaaaggtaacaacaaaagctgatcgcagtttctctccagtccacatgctttaccatatcctaaaaactatatctatgtatggtttggtttaatggcgtagtagtttgttgcgaggaatctttcatgatgtaagaaaaacaaagctgtttggaaccttttgtcattataaataatctcttctctttctttttcgtcatgtctcgtaaactttatctgccacggatgtatgttcttaaagaaattgaagattgaaattgatcaattgccaataatgatctcttttgtctctgtatatgtattgattcaaacagaaatcatagtagaaaactgtcaagagaaattgaccttttaacataatatctaagtttgggctggataatatctaatttttgggcctggataacgttttacgcgtcagggactaagttgtacaaaatgaaactaaagggacaaaatagtaaagttgggtgccactgttccccgcgccacaaaacaaaaacagtacagtgagtcagtgaagctgacattcacacacacacactcacacaaaaaccaaaaactaattttcacgaaatccgaagcttaaaaattattcctctactgtttcaatttcatctcttcttcctcttgagttggcaatttctagggttttctcattttcctttttttccatttctggaaactggtaaaaggctttttctttgtctgtgggggagaaacaaaaatg

SEQ ID NO: 35097 - DNA, 3003 bp, Unknown; identical to SEQ ID NO: 35096
  misc_feature (1)..( 3003): 2750-1469P.txt file - cDNA_ID_3084650; gDNA_ID_2926258; Annot_ID_204621

SEQ ID NO: 35098 - DNA, 75 bp, Unknown
  misc_feature (1)..( 75): 2750-1469P.txt file - cDNA_ID_3084682; gDNA_ID_2926259; Annot_ID_204688
cttcaaaactttgaaggagtggaatctgattttactcagttgatgggagcttagtctttctagcttgcattaatg

SEQ ID NO: 35099 - DNA, 3000 bp, Unknown; identical to SEQ ID NO: 28387
  misc_feature (1)..( 3000): 2750-1469P.txt file - cDNA_ID_3084686; gDNA_ID_2926259; Annot_ID_204685

SEQ ID NO: 35100 - DNA, 3003 bp, Unknown; identical to SEQ ID NO: 28382
  misc_feature (1)..( 3003): 2750-1469P.txt file - cDNA_ID_3084702; gDNA_ID_2926259; Annot_ID_204675

SEQ ID NO: 35101 - DNA, 3003 bp, Unknown
  misc_feature (1)..( 3003): 2750-1469P.txt file - cDNA_ID_3084744; gDNA_ID_2926259; Annot_ID_143182
ccttttgctccaaagcagcacaagcctgcaataagaataatgcaaacattcttcaagattcacattaactaatacaaacgtaagaaaaagtttaaggtttagtgtttaggacctgcactgcgtcctctaaagcaccgtcaagaaatgttgtaagcgcaaagttcatctttagcctatgatcagtcactctactgtcctgtaattttcagacatcataagcaaaacagaatccatcaagttttcaaagcaaggctctggatccgtgtattaccttataattgtatgttcttatcttttctgaacgagctccagtcccaacctgtttccgcaagaatcgacatagagcagaataagatgaatatttgatgatgaccttgagtttagaaagactatggggataataaaatgaagtggacctgagatttcctttcattccttatcttctcttgttgttcccttacttttatttcatacctatatatagacatataatgtttcaacaaaaaaagactaaggtgggacttgatagaggagaagaagagtagagagtttgctccttgaatgttgcttacagttttgctcgcagaagctggaaagcacgcgccttattcctaatctgggtcctttcttctgtacagaaaatgcgaatacctgacggtttgtggaatagatctatagccgtctccaccttgttcacattttggcctgcaccaagacctcttttcagtattattagcaagtgaaatgtgagagaaacagaaagcgaatttctttagcataacctccagcgccgccagatcttgcagatgtaagttcaatgtcctttgggtcaatcaccacttccacttcatcagcctaaaatgacaaaaaaaacaaagcagagatgacagttttggactggttaccaattatcaatcagaatatcgaaaaatggaacatgcgaaagctagtttacctctggcatgatggctacagttgctgtagaagtgtgtacacgaccctgtgtttctgtttgaggaacacgctggactcgatgaacaccagattcatacttgagcttgctatagacacgatttcctttaatctccatcacacacgtcttgtaacctccatgttcagccttataaaagtaggaagattaaaaagctatactggtgagaacatgtctctaagttgttatgctctactgccattttcattacacactccttaaatgccaaaacaaaacacagagagcatctcacctctgagcatgaaaccattgaaaacttccaagagctgcgctcgctgtacctctgatacatccgcacctgcaagcaaaagaataatgcaaagcatactgattcatggtaggatctgaagtttttaattattgcacttgcttctcttagccatgaaatataggaacaataaaatttgaaagttttttaagaaataagactgaaacaaaacggtgaactatcggaaggcattaaaatcagatagaggatcagaagaaatcaaggaaagcatgtacctacaaggtcaccagtccaaattgcagcttcatcgccaccagttcctgctctaactgcggaaggaactaagatttcagactcgtccagaggtagataggtaaaacaatggcgggaagtccgagcaaaaggcagtttttcaagaaaaaaggccagtgtagacaaatgatactacttgtcgacatatagtttagtcagttaccttcaagcaaaatgtttctggcatcaagaggatcggaaggaagaagtaacacctgacacaagccaacacaatgttacgagttgagtatcagaatcaaatttttaaaatgagcaacattcgattttcagctgccgaataagtcagctatggaaccaaggctctaaaccttaagttgtttttcaagctcctcaatttctttagtgagcgagttgatttcacttcctatcatttcagccatatcttcatcatctccagcctctttcgccaaaactgaagcaataaaccaatcagtaaatcataaccagcttccgaggaacagaatcaaagcaaagtaaaagaaaggaggagacttgaagggacctttgctttctagtaactgcttctcacagtccttgaatcttctgaagactgttacaacctaaaattgaattcaatgttaagaaaccccgaaaaaagctgcaaattttgaacactaaaagaatgtgcaaatacctcgtcaagctccgacatggattgtgccagtttttggtattcagattgattcgaaacaacatctgggtcagctagtttcacctacaaatcattcaaaactcttaagaatgagattaagaaacaaaccttaaccattaatggaataagtgtaggaacaaaccgataactccttccatgtcttctcaacagactccattttcctaatgaggtaaggttcctaaatgtttcaacagacaaaatcatcgaacaattctgaaacttttgaaaaaaaaatccaacattgggagaactagaatcacttacggccatacaaacgagtcgtcgagtcctgcgagaccgagaaggcggccacgagactagacaaactccagacggtgactttctcgaacgtaaagtgaatggtgacgagtgaagatgaaggaaggctcgagccgttggactcgtcgtcatcgagctattcattgtctagactctagagagagaggtggaagaagacgagtggcgcgggagttgctggataaggaagcctagtttagatgatgagacgtgtttggctattaggacaaaactatcctcgccaattatagaagaaacccttttatttattgggcctttagcccatactaatttacattctcggttacacggtgtaacttacacctgctagtaactctatgggcctatggcccaatatatgtgaagtcaaaactgattcgtcgcgaagttgagtttttgttaaataataaatcaattgaatcgcggtactcaatttcttctcttcctccggcgacgatg

SEQ ID NO: 35102 - DNA, 3003 bp, Unknown; identical to SEQ ID NO: 35101
  misc_feature (1)..( 3003): 2750-1469P.txt file - cDNA_ID_3084744; gDNA_ID_2926259; Annot_ID_204659

SEQ ID NO: 35103 - DNA, 3000 bp, Unknown
  misc_feature (1)..( 3000): 2750-1469P.txt file - cDNA_ID_3084746; gDNA_ID_2926259; Annot_ID_204658
ttgagatgggcaaagagtatagatccggcgatgactcgagcctcatgttatcgtatcacaggcatgcttttgggctcggggagcattataactcagtggtgctcgtcaacaacatcaccggatgatggatgatggactttatctaaagctttaagaaaagtgcttttgtatcaaaagtttactgaaattctttcttctttaatgtttgttggatttgagagaaccaatgtgtaacttcaatttttcatttggttacaaggcgaagcataatctattgctacacagttccaggtttttcattacagaacaagaatgtagcagcaatttgtacggagaacatgacacgaagaaacatatgacctttgaacaatttcgcgagccaatttggcagagacagttctagagatctgaaagggaatataacaaacacaagttgttcctcccgaatcttgagattttagcaccaaaagaagaaaatgatgacgaatctatgcttattatcacccataaattttgctaattcaattgacacatggccttatcacgaatctgccaaagattcttcatttctgtagatttccaaatctggtgtcagaatcatgctttcctgtttaaatctgctaaaattttgtatttttggaaagttgaaaatgcaatgaacatggattctctttctcgtgttcaatgcaacaacaactacaaagactcttaagagtcaagaccaacaactctcacatttagataaaaaaacttgaaaatggttttgacaaagtgtaaaagctaaagtaagaactgtgttggatcacttacttgctctctagactccaggtcacacaagcagaaaagtatctcaaagacgatcctctttttgtttgtttttcttgctttccgtttctttagagcctgaaacttgtggggaatctattgttgcttgaaaagataagcatctaactggataaaccataatccaatctccacctcagtggatgcatcaaaagcaaaagattttgccaaaaaaagaaaagcaccatagagtagacatgatcacactgttgcatacctccctggatccgtggatcattacaaaccatatgacaaggatatttccgtaattagaaaagaaaagtttacatgaactgtatatgcaacttggttctgatgttcatgcagtttttagagaacgccaaagggcacatcactagtatggaagtaaagtagtgacaaagatctgatttatgcaacgttaccatcctccacgtatccaactctataaataggcctactttgtaatttgtatagcatcaaagcaaaaacaaacataaagatccttgagttcccactcacatagtcacactacatttgtatcacatttatatacatagaaatggaaagcgttagaagtttagttgaagacaaaccagtggtgatattcagcaaaagctcttgctgcatgagccactcaattcaaacactgatctcagggtttggggcaaagatgacggtctacgagctagaccaattctcaaacggtcaggagatcgagaaggcattggtacagatggggtgtaaacccagtgtaccagctgtgttcatagggcaacaattcatcggtggtgctaaccaagtaatgactcttcaggtcaagaaccagctagccgcaatgctaagaagagccggagccatatgggtgtaacagaagacaagagagtcaaatgcaaactaggatagaataagatgagaatgatacatatcgttgttttgcttcttctttaattttcggggtttcgagtatctaccatgcacggatatgttttcaacaagtgcaacactatagtttacacaactctagagctaattaagatcaagaactttgtattctcagttaccatacttgttaaatcaaccaatataagctaagaagactaataagcaataaaagagaaagatttgcttttccattgatacctaaagattgttcaacaaaatgaaaggccttttatttatcatcagccatgagaaaagaagaaacaaacaaaagtagagattttcactaacttcttcacttgtaaatgtaatcttttaaaaggccatttgcatgctcgacctcagaatgtcttcgccaactatcaacagctctagaaactgtagcttttgcttcccgaatctcttgagccgagaacttgtgctctatgattcccaaaggtccaggttgcagaacattgatcacagtttcagcttctttctcaagctgcctgtacaaaatgaaaccttagaatttcaacataaacacacacacaaaaaacaaatcttttattgtgtaatctcttgtcatacggagaaatacgatgcaagcattaaccaacctaaaaagctctagattggatacaaattgaattctttttatcagtcaattcttcaatagtaacgcagtaatacaatgaagagaagaaaacaatggagaaaccttaagatcccggagaagggtaaagctctagcgatcctgtaaatcgacatcgtcgccggaggaagagaagaaattgagtaccgcgattcaattgatttattatttaacaaaaactcaacttcgcgacgaatcagttttgacttcacatatattgggccataggcccatagagttactagcaggtgtaagttacaccgtgtaaccgagaatgtaaattagtatgggctaaaggcccaataaataaaagggtttcttctataattggcgaggatagttttgtcctaatagccaaacacgtctcatcatctaaactaggcttccttatccagcaactcccgcgccactcgtcttcttccacctctctctctagagtctagacaatgaatagctcgatgacgacgagtccaacggctcgagccttccttcatcttcactcgtcaccattcactttacgttcgagaaagtcaccgtctggagtttgtctagtctcgtggccgccttctcggtctcgcaggactcgacgactcgtttgtatg

SEQ ID NO: 35104 - DNA, 13 bp, Unknown
  misc_feature (1)..( 13): 2750-1469P.txt file - cDNA_ID_3084761; gDNA_ID_2926223; Annot_ID_203388
gaattcgttgatg

SEQ ID NO: 35105 - DNA, 3003 bp, Unknown
  misc_feature (1)..( 3003): 2750-1469P.txt file - cDNA_ID_3084761; gDNA_ID_2926260; Annot_ID_204723
gatattctcttaacaatgtgagttatattcaaaaagagacttcaagtcttgaagttttagtaataactaattataatttattttatctaataacacattcatataagaattgcttcatacaacttttagatctttagtagtcaaagattgaacataatcttctggatatgtcacttattatccattcattacttctccttctcgagatgatgaaacttcaagttcatccatctcgtattgaattccactctagaatcataatgtatttatatctcatcatattaactttgagatttggagaactataccgcatcgataattttaattttgtattcccatagaaaacaatgtatatgctcttctagagtcttttaataagattttatactacttgatatactagattatttcatcgttagaattttttttttttttttttttttttctcaacttctgatgataatttaagttcttgaaaaaaaaactttgaccatcaaaaatatgatatcttcttaagatacattaaactagtcattcatgaaaatttctataagtgattatacctttaaattaagttatttatcaatcaatttattttataaaataatcaagtattatatactaatacaattttaatgcaatattgtaaaaccaatcagaataaaactattttgtgcaaaatctggattttacatatatcttgaaaaaacttttatttagggtaatatgaatgcgtgcaagatttgggtaaaatgatttcgtgcaaaattagggcaaaaccatgaacaatttttttttttttttttatttagataccacaaagatttagagaaaaaaatcttataaaaagaaaaattatcttggaacgtttttagtaaaaataataataacacaatcaaatatatgaaaatcttataaaaagatttagataataataacacaaagatttagatatatggaatcttataaaaaaaaaattattttgcaacatttttagtaaaaataataataacacaatcaaatatatggaaatcaaatatttaatatggaaaagtcaatatctaaaagtgataagatatgtataacgttttaatcaaaagagttaaataagggatatcatatcaatcataaatggattttagacaatataatatttataaaatgatattgaatatagatgcaactattcaaaactggaatgctaaaacattaatacatgcttgcatcacccaccaccggggtatgaatagttacaaaattagttatataattataaaattggtaatttatatattcaatattgtaatagtaaatcacaaaaattaacaattaacaagcatgattctcttctttaacgattttctttgtagaatcattgaatcatgcgatagtaattatagaaacaaatgataagcatgattctcttctttattgaatcattgaaaacatgcttttaccgatctatactataatcatcgatcggctcatattgttttgtttcaataatagaaaataagtactatgaaccatgagtcgataaataaacatggttcttaaaaaaaaatgtaagaatctctatatctaccttttagagcgtgctgataacgtgttataaacagagaaagagatagaagatatgagtgtattattccattgagataaagggttctttatataggagtacaaggaaagggtaaaaccctagaaacatctagatgatgggcttagatgatgggccttataatgggcatccatttttattcataacacatgcatatctttttttgtttgttaattagttacaaatacgaggaattaccgatcgagacccttatatcgattcgctgggatataagatcccttctaaccaagaatcaaactatgggtcaatcttctcgctcccaacaaagagtctcacaaccactagaccaatgtttagttagtagagccaacacattattttgtacttattacaaaacaatttaggtagtgattaacaaattactaaaagaactatcattttattagaaatattaataatacaaattaccattacatgaaaaaaaatatctaaggattgaaaaaattgtgattaaaaaatgcctattaatttgcatgtcatcttaagtataatacggtagtagaaacgcataggaaataaaatcccaaaacaaacttcgggaagaccgagtagaataatgcaacattcttgttttatatctttcacaatgccttgtttcactgcctctacacaatctggaatttttcttgcgtcagccacacaagacaatggatttggaagcaacccttgttctgacattggagccatagccaaatcattattacctttcgtatcagaaagtgatagtattacaaccatcactgttaagatagacgcacacactctttgtatgttctcacccattgttaaatgtttgtataacttgtattttatcttgtgatgctactatgacatattgtttatagtaattatatatcttgtacggttatgaatttttttgatgaaatatatatattgcctttttcatagattgtatacatgtatcatgtatgtgttagttgtccttgaacattgtatgttcttgagaataagaatactatgtatgtaatcaaaataagaagaatagaatgtaatgcacgagctttttgttttggggtcaaaagtattgtgttagattattttacttttctctctttaattcgtatttaattgttatcaaataattaaaaccaaaaaatgttttaatctataaattgtcaaaagactttgtgttgttttcaatagaaaataaaaactgtatattagtttttattattttcaatcataaataaacaaaaatttgaaaaatatttaaccaaatgatatagaaagaaattaaaaaatagttctagaggcaataaaatgaaatttaagtaatacattttatctggacaaatttttttctcccagacccagttatcgagaagcttctctcgaatatg

SEQ ID NO: 35106 - DNA, 3000 bp, Unknown
  misc_feature (1)..( 3000): 2750-1469P.txt file - cDNA_ID_3084776; gDNA_ID_2926260; Annot_ID_143212
gtgaatgtatttcaaaatcactaattcaatacgagatgatttcaaaaaaatagtaaactctttcaaaatacatagttcaatacacccccttaaataaaataaagaggaaggagagtaagagaaaagaagaagaaacctgagcactaaggtcatctccattggtgagatactttaaaagtttctcaaaaaaaatatataataatattttattataatttagtttctgtccaattataaacacacatctatacacataatctctcaatcattactttaaagtttatctgcagagaaactattttcaaactttctcctatctcttttctattttattattattttatattttttagttaataaaaaaccatgtgagagactactgatggagacgctctaagctactccaccaaataattgggaatgttcatcaattgtagtaatatgtttctttgaagagtgtgcgtagaagtttatcaccccttcatgctgaagttgattccttgttttggcaatggaatgtatgatctcgataggtgttacgagttgctcctttgcaaccgattgtgcagatcttatctctatccttgagaaactttcggagtggccgacgttagtagctgagatagcgacttttggttcccttgtctgattttttccttcatttagtattaatttcctttctcgttgatttaatgtgagggggcattgcctcggaacaaagcacgtgctcgtaatagtttgttttctcatgtaagcaaatcggttcatgaatggttttctatagaagagagtctcttccagattacttaatacataaataatgttcgacggaaaaaaaaaaaaaaaaccctgaagcttctccatcaacaaataacaccattaccagatttagcctagcactatatgtaaatgaggctgtatgttacataaatgttatacaaccaaggcaccaaaatcaaatactactctgagattaaaccacaaaataacaaattttgttatataaagagtactacccaaattaggttataacaaatttgaccatttttaatatcataacaaatacgatctcatctacaaacatccgggaactgtaaatatattaaaaatagttagatcaagtagcaaacgcaattccaatatcttttaaaaaattattgaaatcagcatgataaaaaaaaaaagataagatcggacatagaaaagtgaaataaagttttttaatcagcatgatctccaccacgtcatcggacacagcatgatgaaatcaagataaaaaggtaccgttagtgtttgttgtttagaaagttgctccccaagcatcattttagagcttatttagttgtaagtcaataagttactatagctaggtagctccttaaaagaaggtcgttttggcagttagctcggtcgatagatgcgtggcttagtttgctcttctcttaatgagtctttctattgaaatgcttatattcctggttgatgcagaacaatgatatgtcatatgtggttgtacttcgaagacaagggtttccagattcgaaaaattctcgagtaaattcgacgaaagctttctgtctttctttccaataagtcttaatagttaaatgaatcaggttgtcgacgatcggtattgatttacaacaaaaaagtaagtatacctgaaacaaaaacaaaaatcatcacttaaatttcaatcactaacttaaaaatttctgtaagcaatgttacactaacaacatatctcaagagtctcagcagatacgcaaatgaccttaactttggtgagtggtgaatgtcccaatttcatttcttaactggtgacgttggaaagtctcaccagtcagctctgttatatataccgaaaaccaaaattttctccaaattagtcattagaggttgtctatcaaaatggtgatttagtctataggactttagaatggcataaccattgccactcccaagtaacctacaagtcccgaattttactgtagagaacccatcactacacgtcaacgattcacatagttaatcactacacgtcaagtttcagttaaaggaatcaattacacgtagaatctcatgatttaggctggttcaatccatccctataataatcaatcacctcatagaacatcggtttaataatccatctgatatcaacgacacgagataaggttcagccgataccttctcgacaacactggatctcggcgggactgtttacacggcggctggaacggtgaagtggacggctaagcaatctgatatgtggcggttcaagccatggtggttagccctcatgggtcgatagttaaacaacaacatatcaacatatcataaagcaagccagaaacttccagcacaagttacagattaaatctagggctttcttacccttaacggcctcgacaatgtctacgactgctccggtgacagtggctaacgtcatgtgactcgtgttggaaacctctggcaacacacggcggtggtggtggtgatgaacgacaaagatctctcctttctgacaagttcctcgatccattcaaacacaacagcacgatgacaacaataccggtggctcaatcgtctctctcataatcacggtggttgtggctttaaagaaggtggctggataaccaacggtgaggcatagtctcgatcacgctaacggtggcttagggtttaactcaaaatagttctttttatttcgtccaaaatcagagacggcgatatacacaagcacacaaatgtaacaaagaaacccttgtcatatttagtcattgggctaaatgggctgcaacttattaacaacaaactggcccaactactaattatagaattggggatgttaaagattttgtcgtttgtaacattttctaggaaacatccatggagtttctgtgccaatagtcaacggtcacacggatccttttcttccttgttaaaatccttcttccatccatctaggatcttgctccatccttcaccattctaatg

SEQ ID NO: 35107 - DNA, 3000 bp, Unknown; identical to SEQ ID NO: 35106
  misc_feature (1)..( 3000): 2750-1469P.txt file - cDNA_ID_3084776; gDNA_ID_2926260; Annot_ID_204718

SEQ ID NO: 35108 - DNA, 3000 bp, Unknown
  misc_feature (1)..( 3000): 2750-1469P.txt file - cDNA_ID_3084780; gDNA_ID_2926260; Annot_ID_204717
atataaatttttaaaacttggtaatgtcgatttaaaaatttcatcgtcctgttatcgtcatccattaaatcgttgtaagtctttttaaaaccactgtaaaaggttttaaaatcatatacaagagtttttaaaatccttataactcttataaagtcttcaaaaacatatgtaaatcattttttaacttttcaaaaaaattattataaatattttacaacatttgtaaatatttttgaactattttaaaactcttgtgaacccttataaaaggttttaaaaagatatacaagatttttaaaagtcggatttacaagagtttttaagagttttggcagaaaattattgtcgaaatttttttgcgggaaaaattattattttattttgttaaccttcaactttttcaaataagggtaaaatctacatatacatttttgcagccattttaacaaataaatcttggacttgaaacttatttacgagtcaatgccactgaatatatttttttcaatcgacattttaaatcaaatatttacctaacaaaaatattgcctaaaatctctctatattaactccaccattacttcaaaaaaaatctagcattacttcaaaaattatcattcctaaaacctctcataagtatttattaatttttggttttaatttgctgtaaaaaaaatcagtttcaattatacaaatcttttaaggtatgattttctttccatatttatttaatatttcgttttttacagcatctaatatttcgtttataaataacaaattaattatttagcattcaagaaaatttcttctaatctatcctttaattatattgactttattgattttttaaatatatatgaatagagattcaaatcttccatatatgtttatcatcttctaaggaagttaaacaattattttctgaatctaaactaaaatttaggaaactaaatatataaataaaatcgttttaattattttctaagctaaactatattacactctgatctttactttgaatcattcattttcagtgtaatataaagaatcaatctcatattttcagttagtaaaatgtacatgtattaagataatattattgtttcaaataatgttacaaaactacccaatttaggctattaaatgacgtgaaatacaggtagtccaaaaactcaagtacatatcaatcacaaattatgactaaactaaatatttatttataacattatctacattaaaaaaattgaactacattttgtagagttattttgtttagtaagaattacaaaatatgtcattacgtaaaaggtaaaaaaatattaatttttgaaatagattattgaaatattaaaacttataaaaagtaatatctcacgagagttatatggtgggacgggtttggatcgatattaatacaaatttataatatcatcaaccaaaagtaataatacagtttaaatcttgttttaatattttatcagcatcagtttctttaattgtacatatataaaattattaactttaatacacaaataaagtgatgaagtcacttcaattacagaatttactatttagcattgtaattgccagacgcatttgctgacccaaataaagtgatgaagtcacttataccagttgtaaattaaatgctccagaatataatgaatgtcctgtaaggaccaatttcaaactgctattgagtcttaagatcgcatgaagcgtaatagaccttggttccaaatataaatatcctcgtaaaagtgaaggagcacaaaattaaaaatgaccaaattgaggaaataaatattttgatgatctcttgaagagagtgaatgatctctaaaagagacataaacatgacaaataaaacattcaagtacttgacaatgaagagatctagctagctatgtcatgtcaaaatataatggaatcaaaagcaaatcgacgtcgtaatatatttgcatgctatgagcagttgatattatagacaaaaaggaggatcatgaaagaaagtctattgaaaagtgtacacaaagtaatgattagccaaaaatggaaaagaagaaatagacatataattataatctctagtagaaatatttggactagtagtctatgcacatgatgtgtaaaaccagtggaaaataaatgagtctttatgtgaaagaatagtgaaattaatgagattttcacaaagataagaaatgtattatgaagagatatattctcttgtggtggatgtaatattttttttttaagtctaaagtctggcaataagagatggaacactggatatgacatttatatgaaattcttgaaagatataatctctgaaggattaattatatgagaattatgttctctaaaactctactcgatcgaataaaaagaaatatgtaacatggcatataatcatataaatgtatatttatgttgagtttgtcaaaatatattgatcaaactaatatttgttttgaaaatcattaaaactcctatagagttatcataagtaatacgatgacaataatgtatgataaaatatcactagataatgatatttataagtctatatgaaaaccatataattttgatcattaagattatggttattaattccaacgagatattgtatttgattgaaaatcatctcctgaagaagatgtttccgagggggagattgaatgatatacgtggatgtaccctttttccttatcatagtttttatcccacatgatttttctatgacaaggtttttaacgagacattaaagaacacgcaaataatacacttgatgaatattaagaaattctatcaatcatccaaatgaatattatacactaatgatatttagagaaataaataagatggtcaagatgaatcatctaaaagattcatgagcagaagaatggcgttgtactttatccagaaatttgtttaagagaagatttggcagacttattctcaaatactgtttattctctgccacatcttctaatcatg

SEQ ID NO: 35109 - DNA, 3000 bp, Unknown; identical to SEQ ID NO: 28388
  misc_feature (1)..( 3000): 2750-1469P.txt file - cDNA_ID_3084798; gDNA_ID_2926260; Annot_ID_204710

SEQ ID NO: 35110 - DNA, 3000 bp, Unknown
  misc_feature (1)..( 3000): 2750-1469P.txt file - cDNA_ID_3084816; gDNA_ID_2926260; Annot_ID_204705
acttatttatttctattcatttggttttggttagtctgtcactatataatgtctgattctgctaaggacaaattagccactttgtagtgacttcaaacttaaatagtattcagtcatcaatttagcaccttatcaaacatttaaaatagtgaaaaacacaaaagatccgtatttgacataaataaaattttacgagaaaacattatttgtagatggaccgagattcgtgaagatcggtcaacaaatttaaattaagttcggactcgactgcttagtaaaaatagaaaagataaaactaaaatcgaaaaaaacaagaagaataaaatatatccgttttgggaaagaaggaagtattatatatcgtgaaatagtctcttttgtataaaatagggagtcttttgtatgtaaaagatccgcaatttttaccaaataataatatagcggattatacggtgagttacacaacaaaacagaacaagaagttgttccataaatttcggttttcttagtttgttgtgatgtagatatgatctccatagatcctctaagatagtgtttgtaatctatttaaaagcttgtaatctcagttttgaatatgttggaaatacatttctcttccctttacgatctctgaatctatatagtatcagagcctgaaatttcaatctaaactctgtttttcttgttttcgacggcaaaccaacccaacccgacaacgataccagcagccacggaggtccgacgaacgatttctccgtacgatttgactgctgccgacaacccaggagtcgtgatctcgcatcctctgctccagggaacgaactatgatgagtgggcatgcggaatgaagacgtctctccttacacgaaagaagtttggattccttgacggatctatagctcgaccggctgaaggatcaccagaccttgaagactggtggacgattcaggcactcctcgtgtcatggatcaagatgtcgattgattcgaatctgaaatcgaacatctcccatcgagatgtagctaaggacttgtgggatcatctcaaaaagcgtttttctgtcatgaatgggccaaagatctaacaaatcaaggcagaattggcgtgttgcaagcacagaggacttgcaattgaagcgtacttcggaaagcttactcgcatttgggatagtatggcagcttatcgaccattgagagtatgcaagtgtggtaaatgtgaatgcaatcttggtgagttgcatgagaaagactgtgaagatgacaaagagcatcaattcctctttggacttgatgacaatgtttttcgaacagtgaggtctaccttggtgtcatgagtaccgattcagcccatggaggaggtttataacattgtgagacaagaggagaatttagtgaggaattgtacaaagggcgtcgacgaaagccaagacgtgaatgctttttgcggtccaaacaactcaacaatttcataaggaagacaaaccaacaatgttttgtaaacattgtaatcacgccagtcattcgagtgaaagcaactacggagtgatagggtaccccgagtggtgaggagacaggccaagatcttgcacatcatcgagtcacggacgttgccacggaggacataatagagcggctgggagaggtcgtaacaatgtctcatatgctaatgatgtccaagtgcatgagcctgtgagctacgaaagctcaaactatgtggtaacggacagagacacagatggtgtgagcggattcagtgactcacaatggaaggtgataaagactcttctcaatgctggaaaggtcaacgaatctgaaaattgactggtacgtaaacctttggataatggatacaggtgcttcgcatcatttaacagatgttaaggatattcaaccagttagtgttctattagctgatggtaggcaaagattgtcagtaaaagaaggatgagtacggcttgggccaactttgatacttcactcagtttttttttgttttttttatttttttattttcttttatcaaactaacttgctttcattaaagaacgagaacaagtacagaggaaagagttttagaaaacccagaacataattccatacaataaatgacgttccccaatgccaagacaagaaagataaaggtcttcgattgtagatccatgagaactttggaacaagggcttggaagcgcactgcaacaagtgagatcacggtgaatcgagaggtcttctttgaaggacgatagattggtcatggtcgaaagacgctgcgacgttgaagaatgaatcaaggttaaggttctcgtcaggacacgttgcgatacccacaataatgctatgacagagattcaagagactatggtgctatagtcggttgagggaggctttaaaacccaaagcggaaggtagagatcacttcgatagatagatccaaacattggatagcataggatctggatgatggagatggtgatgaaggtacaaaacttgtaaacgacataagaactgcttggggaacattggtcattaacgaaaggttagaacaagacaacaattaaaccaccagcaaggacgattcgagatagatagattatagatcttcaagctttcgtaaacataccacaagtccctaagagcaacaaataccagggtttgcaaagagtaaatgaaagaccaaagcgttaatggtgatacctctcttcgatggagtcacaaccacagagtaaagaagatcgacgcaagtaaagttttgggcttagcatagggcttatgaaaacagacctgagagtattaggctttgaattttttgcatatttgatgggtttgggccttcttggatgggatgggtcaaatttggaaacaaggtccactggggaaaaccctagtttcactgtggattgccagatcgagaggaggttgtggccaccgtccgtgaattacgatgagatttgcaacgcagagatcaacaccgatgcatgacggatctgcggtaacaggcgatg

SEQ ID NO: 35111 - DNA, 3003 bp, Unknown
  misc_feature (1)..( 3003): 2750-1469P.txt file - cDNA_ID_3084820; gDNA_ID_2926247; Annot_ID_142970
ctttcaaaaagtataacctaaatagttcaaatatatatgaatcatgtgccatcctttggatgagagaaatttaagaaaagttaagtcgaagttgaccagttcacagaaaaaaaaaaacagctaaacattaacattgattagccaaatattttttgctcctctaagttactatacgcattttaattaaaatttaggtgatcaatcaaatattagcacgaagatcatcctagatggaaaactaattgaataaatctctaaatcatcatctttaatctaacaagcaaaacaactccttgataatcctaaccccaattgaggatctaacttagtcataacaaaagaacataagaaataaatatagaagaaatatgttaaaatataaaataaaaaatccaggtttttttatttttttggtttttaaaaagttaggtttcataaatgtttttaaataaaaagtgtagagtcaaagattcgattcaccaaactatctctttgcctttctaagaaccagaataaaatacaaattagttgaggtgaaatgatagtgtaattttgtttttttattttcttggtccacaacataatatgaataataacacatgaatgacactaacacagaccataactcacaccaatttagtataaattgttaaatatatttgttaaaggtttttgtagtgagaagttacacatgaaaagtacataaataaataaaaaaattacacaaaaagaccttctttgctgtcgattgaattaataaacatgtgcaaattaatgtaaatatagaaacacgacacagccaaaaagaaaataacattttcttagtggtccacaaatgacaaattaagtacatacaacttcttagatagaaccaaacgaagagaggggaaaacaaaattacaaaataaaaaatattatctatcacgtggaaacaaaatgcatgaaactatatatggggtaatagcctaataggaattaaaaaaacaaaaaaaaacctaaacaaaaaaaaatccataagttatacacaaaatgtatttggcttgtcttgtgtccagattctttataatgttaatggtactttttctctttcgttgaaggcatcaaagatggtttgatagtgttacttttttgttgtgcaaaagaaaaacctttagtcctattatcttccattatctttgtatattttcactataaagtcgatataaacgttctttattgtgaactgtaatctttctgtattattgaacatgcgttaaaagaaatttttttttgcaaacctttcactttcatcaatttaattttcaattcaattagtggtcctacgtacaaagtagttgtacagtatacaacttattagatagtatggcgagacaataattagaaaaagattggactgcttgaaaattaaaggaaaaaagattcatagcaaaatcgtaagtaaataaaaattattacttcttatgatgaagcaaaatgtttgggatatgaaataatatgaacaaaagaaaaaatgattaagttcacagttgaataagtggtgatggtctaacggtttttaaataaatgaaatatgttttaaacacgatattatcaacgattgatattttattagttttaaaaatgaatacttaaaatcactagttaaattctatttttcttttaaatcttaaatcttataacaaaaatccgaaattgcttaacttttacatacaagtgtgtttataaatttgtagagttttgattactcagattggagatatcttgctaatgatattttttcttctttgggatgtgttgccttcttcgctaaaggagagagaaccccatttgtgaattctgacgtcttcggaaatgtaatgaggctacatttgacaaacttaaaaattgctcagaatcttatttgctcctaaaccaaatgatggagaaaacagtcttttacggtaatttttatctttttcttgtctaatttttctatgagattttttatttaaatagtcagttataaacattaaaatattacttgatattttgaaaattaaaatgatatatgctatgaaataattttgattattttaaatatatcactgttaaaccggtcgtccaatattagtatagtaccactttctctctacaatctctttagctttatatacatttttataggttttctaaacgtctttgtcccacaataatctctctaagtacatttttatacattttctttacaaatatttgtatacattttatatacgtatttttctatgcttaagagttttggtttacaaataatataaataattgagtatgtgaatccgacatccacgagatagtcttaatataagtgacaatagttttaaaatataagtaacaaaaactagaaatatgttttttgcagattttttgaattaaaagcattttatgcaattgatgattaaaagattcaattgaaaaaatctcaaacttgtttttcttttatcatgtaataaagttgtagttccacttgagaatatgttttttttttcctgatatccattcggcggaaattacatatatatcattttttaaaaatgttacatatcacttattaatttttttaaaaataattaacgatttattaatttatcgatttatgtcattttttacattgtttcaatttgaaatcgatttttttttattaaattataaaaatgttaatttattgagtattaatttatagagattttattctatataacattaggtggagaattacatttatattcttcttaccttcatattaggtggaggattacatttatattcttcttacataagataagaaaaagaacacgtgaactactgaacacgtgaacgcgtgatccaccaccggttcgttctgcaataccgtctcaagtataaaactaaaaattgatcgacaaaaaaaaaaagactatatataatgcctcccaagtctcttcagtgtcatcaaagtataaagtaaaaacaaagactcgagttaatatg

SEQ ID NO: 35112 - DNA, 3003 bp, Unknown; identical to SEQ ID NO: 35111
  misc_feature (1)..( 3003): 2750-1469P.txt file - cDNA_ID_3084820; gDNA_ID_2926247; Annot_ID_204257

SEQ ID NO: 35113 - DNA, 3003 bp, Unknown; identical to SEQ ID NO: 28012
  misc_feature (1)..( 3003): 2750-1469P.txt file - cDNA_ID_3084836; gDNA_ID_2926261; Annot_ID_204747

SEQ ID NO: 35114 - DNA, 3000 bp, Unknown
  misc_feature (1)..( 3000): 2750-1469P.txt file - cDNA_ID_3084840; gDNA_ID_2926261; Annot_ID_204743
aaagcttttcgagacatcaaatttcaatgagattgtttttgtttagatttgaatcgttgggctaatttggtaaataaatctacaaactatgcccaagtagcttattcatactcacgaatgaacattaagatgccacgaagctacataattatcatgttagaacaccgtcattgttctcttcagtattaatagtaaaaaaaccaaattgacgatttctcgaagactattaaaggaatatccgcaaagaagaaaaaaaaacatttttttggtaaaggactaatctttttgtttgcatcggccatctctaaccttacgattgtgtgttcttgctttgagcgaaaccctagaatcggtcttaacccatttgagcagagatgctgcgagtagcaggaaggaggcttttttctgtttcgcagagatcatcgacggcgacctccttcgtcctttcccgtgaccataccctttccgatggaggcaactcctcttccgcttctagatctgtcccctctgcagatctctcatctttcaattcttaccaccggagcgttataagaggtctgccgatctacaactctttctgtctctcgattgattttcatttctggtgttatccattgaatgattcataaatttttaaaagtcacctcttttgggcttgtataagtccggaaatgattgagattcctagtttcgtatctgcgagatgatctatgggaattaagtcatctgttttgaattcttatgatgtgtattagagcttgatgtaccatttcgtctcattcttctccttgctggaatagtgattgatcggatatgaattgaccagctttgagataatccttttttgatgagataatcgattttgacatgtagtttattcattattatggaaatggatgttttatcgtctttgggcacatcatataagatacttgcatcagtaaacgaatctggaattccatatctttaaccaaaagggctatgtttgcaatcttatcttaggagttttcttatgttttaagcatttatgatcattgaagttccttccttggatcttgcgttagatagattagtttagttttcactgaatttgatatcatggtagaaaattgtttggatgacaccttctgttatctcttggaatccgtttttataatcttatgttattctatgcattaatgttaaatgtttgctagtgttattcctttcttctgtgttatctcttgaaaatatttttgcttaatacttggtgttgttgaacacttgaccaagtataaagtttgcccttgatgtgaaatattaatgtttcatgctattttcaggttttgcttctcaagtcattactcagggaaatgagataggttttggttcggaagtcccagccacagtcgaagctgtcaaaacacctaactcaaagattgtctatgacgaccataaccatgagcgttacccacctggtgaccctagcaagcgggcattcgcctattttgtcttgtcgggtggaaggtttgtttatgcctctgttctccgcctgcttgttctgaagcttattgtgagcatgtctgcaagtaaagatgtccttgcccttgcatccctcgaggttgacctagggagcatagaaccaggaactaccgtgacagtcaagtggcgtggaaagcccgtcttcatcaggcgaagaacagaagatgacatcaagctggccaatagtgtggatgttggatccctgagggacccacaagaagactcggttagagtcaagaatccagaatggttgatcgtggttggagtatgcactcatttggggtgcatccccttgcctaatgctggtgattatggtggttggttttgtccgtgtcacggatcacattacgatatatctggaagaattaggaaaggtcctgcaccatacaacctggaagtaccgacctacagcttcttggaagagaataaattactcattggttaatgaataaagcacaacagtccgagtgtcatggtctggatgatcttaaatctgtttttgtttttatattttccggcattttagcgtgcaagttcgctttcctcacactttgggctcagcaaaaattggcttgttttgctgaataatacaaacttgtcattgtatgacttagtatctgtctcatctggtgaaaatacattgttcatacttcatagtctctgtttattatttgaaaagagttttgaatagtatcatccctatttttcttatgtttgtaattttgtaacatatcgtttgtaagagagtttcctttccttaaagtctgtagccattatcacaattgagacaaaaacttggtaaggttcaaggtgtgttataaaactttcgtgttcttactggagacgacatttcgaagaccttcaattctcaactaagccataaaccttctcttccatagtgagaaatccaattgtgaacctcgagactactactttgatgaaagatgtcatattctggttgtggatcttagcctaattttcttgttcagattgttttcatcgatgactacttctttgatgatgtccttctagctctttcttctagtattgaaaagttcacacagatgtaaaacagtctttttgttggaaatcttgtttaaacattacaacaacaaaatatatcctttaccaagtatagaccccctattattattattaaaaattacgatttttatacaaataaaataatttatcttacaaatacacacacacaaaaaaattatatcgtaaaaccaaaagattttattaattaaaattagaaaaaaaaccatgccatcaaaatcctgaagtaaaaaaatatcaagtaatacgcaaaaaccaaaaaaaacaaaacaaattgaccttttctcaaagacaatttttaagggacttactagtaagtagtctcttatgttttgttttgcatcggccgtcccaaacctgaggatttctctgttcagctagagcgaaaccctagattcacatttgagctgagagatg

SEQ ID NO: 35115 - DNA, 3003 bp, Unknown; identical to SEQ ID NO: 28389
  misc_feature (1)..( 3003): 2750-1469P.txt file - cDNA_ID_3084842; gDNA_ID_2926261; Annot_ID_204739

SEQ ID NO: 35116 - DNA, 3003 bp, Unknown
  misc_feature (1)..( 3003): 2750-1469P.txt file - cDNA_ID_3084846; gDNA_ID_2926261; Annot_ID_143220
ctttcacgtaatgctcaaactgagtatcttagaggtttcctcaacggtcaagtcgataagcagaacttcaagaaaaacgtacccgttgtgacctacgaagatattaggtcttatatcgaccgtatcgctaatggagagccgtctgatctcatctgtgatcgacccatcagtgtactcttgaccaggtaccttcaaaacagtttcaaaggttgcatgttaaagttaaatccttaaatgtaagatcttgacttgaagttcagaagaaacttgaaatctaggctcttacataacctaaattatattcgacccatttggttcaaaacttgttgatacatgagtttgtttaggcttgataatgtagattaaattaaagtatagtttattataaaatctgaaaagccttaaggaaaccattgtatttgcagctcgggtacttcaggaggagttccaaagttgattcctttgacaacagaggatttggaacagaggatttcgttttcttctctctatgcacctctactctacaagtaaagagttaaaaactccgagttttgtctctttgttgataccataaacagtaagtagtaaaaccccgagtccgatgttgttactgtttgcaggcacatcgatgggcttagcgaaggaaaatctctcatattttattttgtgacccgagagagcaagactgccaatgggttgatggtcaggactatggttactagttttttgaaaagcattaaacagaccaactcatttctttggttagtcaataaaacccttacttgcacgttacattacataattcagtctttccacaagtgattaaccgaagtgcctaacaaacaagcctcttgatactactcgtgtttctttactgtgtttgttctattacttgcagggatagcttacaggtaagcccgcatgcgattactacttgtgcagacactactcagagcatgtactgccaattgctttgtgggcttcttgaaagagataatgttgctcgcctcggtgcaccctttgcttcatcattcctcaaagtaatcaagttcttggaagatcattggcctgagttatgctcaaacataaggactggccgtctcagcgactggatcacagacgcgacctgtacttcagggatcggtaagttcctcactgctccaaatccggaactagcaagcctgatcgagcaagaatgcagtaaaacatcatgggaggcaatattgaagagactttggccaaaagcaaaatgcatcgaatccatcattacaggcaccatggcacagtacattccattgctggaattctatagtggtggtcttcctttgacttcatcgttttacggcagctctgaatgtttcatgggtgtcaactttaatcctctgtgtaagcctagtgatgtgtcgtacaccatcattccatgtatggggtacttcgagttcttagaggtcgagaaagaccatcaagaagctggtcatgatcccacagagaaacctgtggttgtcgatcttgtcgatgttaaaatcggccatgattatgaacctgttgtcacaacgttttcaggtaactcttttctcttgttaaccataaccgtttcaaaataaatgtcgttttgaaattttattgcagtcttcggttttttaaatgtgtatcaaaattctatatgtttctgcctaccaaaaaaataaataaaaaatctatatgtttcttcaagatctatatatgattttacaggtctatataggtaccgtgtgggggacgttttaagagcgactggtttctacaacaatgcgccacatttttgtttcgtgggaagacagaaagttgttctgagcatcgacatggacaagacctacgaagacgacctcctcaaggcagtgacaaacgcaaagctcctgcttgagccacatgacctgatgctcatggatttcactagccgtgtagattcgtcctcgtttccaggacactatgtaatctattgggaactcgggagcaaagtcaaggacgccaagtttgaacctaaccgcgatgttatggaagaatgctgcttcactgttgaggagtctctcgatgctgtatacagaaaaggacgaaagaatgataagaacattggaccacttgagattaaggttgttaagcctggcgcttttgacgagctcatgaacttctttctgtctagaggctcttctgtgagtcagtacaagacaccgaggtcggtgacgaatgaagaagccttgaagatattggaggccaacgttatttccgagtttcttagccggaaaattccatcgtgggagttacatgagttacactccggcagataaacccgcagtcataatatctgtgagatttgagggcaggggaggagaacaatgtttacgacttttcttaatttaaacctctctgtttttttccagccaacaaatgctctgttcttcaagtttttatctttacaaatgcatcagagttaccaaatgcatgtttataagtcatttcccacattgtaaataactttaccaaatgcaccatagtcgagccattaattttaaatttcgaaaaaaaccgaaaccgtcaataatcatgttgctcacagttactacaactgggctaggtcaaattactgttttttttttaacttgaataattataaaatcacaataagacgggggtcaaaactcataattaaactgggatatctacaaattcgaaagaaactttgtttggtgtcaactgaatccgtaatgcttaacttgcttccgcggccctgtcggaaactcatcctcaatttccggctcacgaactttttgccacatgacaccttttatctgcacagagagagagagagatgggtcagatccaatccactgcagccagcgcaaaggtttcttctctcactcttttgtaagcaatttcgtgatccacaagtgactagacttgacctaaaccgtaagtgttttgctttttgtttttgttgttgcagacaatagaaaagcagcaatcatg

SEQ ID NO: 35117 - DNA, 3003 bp, Unknown
  misc_feature (1)..( 3003): 2750-1469P.txt file - cDNA_ID_3084846; gDNA_ID_2926261; Annot_ID_204738
catagttctgaagcttcgagagagaggggccagaaggtcacccagaacagaggttttgcagacaatagaaagcagtaagcaagcatgttaccaaagttcgatccaacaaaccaaaaagcttgtctgtctcttcttgaggatttgaccaccaacgtaaagcagattcaagattccgtattggaagcaatactttcacgtaatgctcaaactgagtatcttagaggtttcctcaacggtcaagtcgataagcagaacttcaagaaaaacgtacccgttgtgacctacgaagatattaggtcttatatcgaccgtatcgctaatggagagccgtctgatctcatctgtgatcgacccatcagtgtactcttgaccaggtaccttcaaaacagtttcaaaggttgcatgttaaagttaaatccttaaatgtaagatcttgacttgaagttcagaagaaacttgaaatctaggctcttacataacctaaattatattcgacccatttggttcaaaacttgttgatacatgagtttgtttaggcttgataatgtagattaaattaaagtatagtttattataaaatctgaaaagccttaaggaaaccattgtatttgcagctcgggtacttcaggaggagttccaaagttgattcctttgacaacagaggatttggaacagaggatttcgttttcttctctctatgcacctctactctacaagtaaagagttaaaaactccgagttttgtctctttgttgataccataaacagtaagtagtaaaaccccgagtccgatgttgttactgtttgcaggcacatcgatgggcttagcgaaggaaaatctctcatattttattttgtgacccgagagagcaagactgccaatgggttgatggtcaggactatggttactagttttttgaaaagcattaaacagaccaactcatttctttggttagtcaataaaacccttacttgcacgttacattacataattcagtctttccacaagtgattaaccgaagtgcctaacaaacaagcctcttgatactactcgtgtttctttactgtgtttgttctattacttgcagggatagcttacaggtaagcccgcatgcgattactacttgtgcagacactactcagagcatgtactgccaattgctttgtgggcttcttgaaagagataatgttgctcgcctcggtgcaccctttgcttcatcattcctcaaagtaatcaagttcttggaagatcattggcctgagttatgctcaaacataaggactggccgtctcagcgactggatcacagacgcgacctgtacttcagggatcggtaagttcctcactgctccaaatccggaactagcaagcctgatcgagcaagaatgcagtaaaacatcatgggaggcaatattgaagagactttggccaaaagcaaaatgcatcgaatccatcattacaggcaccatggcacagtacattccattgctggaattctatagtggtggtcttcctttgacttcatcgttttacggcagctctgaatgtttcatgggtgtcaactttaatcctctgtgtaagcctagtgatgtgtcgtacaccatcattccatgtatggggtacttcgagttcttagaggtcgagaaagaccatcaagaagctggtcatgatcccacagagaaacctgtggttgtcgatcttgtcgatgttaaaatcggccatgattatgaacctgttgtcacaacgttttcaggtaactcttttctcttgttaaccataaccgtttcaaaataaatgtcgttttgaaattttattgcagtcttcggttttttaaatgtgtatcaaaattctatatgtttctgcctaccaaaaaaataaataaaaaatctatatgtttcttcaagatctatatatgattttacaggtctatataggtaccgtgtgggggacgttttaagagcgactggtttctacaacaatgcgccacatttttgtttcgtgggaagacagaaagttgttctgagcatcgacatggacaagacctacgaagacgacctcctcaaggcagtgacaaacgcaaagctcctgcttgagccacatgacctgatgctcatggatttcactagccgtgtagattcgtcctcgtttccaggacactatgtaatctattgggaactcgggagcaaagtcaaggacgccaagtttgaacctaaccgcgatgttatggaagaatgctgcttcactgttgaggagtctctcgatgctgtatacagaaaaggacgaaagaatgataagaacattggaccacttgagattaaggttgttaagcctggcgcttttgacgagctcatgaacttctttctgtctagaggctcttctgtgagtcagtacaagacaccgaggtcggtgacgaatgaagaagccttgaagatattggaggccaacgttatttccgagtttcttagccggaaaattccatcgtgggagttacatgagttacactccggcagataaacccgcagtcataatatctgtgagatttgagggcaggggaggagaacaatgtttacgacttttcttaatttaaacctctctgtttttttccagccaacaaatgctctgttcttcaagtttttatctttacaaatgcatcagagttaccaaatgcatgtttataagtcatttcccacattgtaaataactttaccaaatgcaccatagtcgagccattaattttaaatttcgaaaaaaaccgaaaccgtcaataatcatgttgctcacagttactacaactgggctaggtcaaattactgttttttttttaacttgaataattataaaatcacaataagacgggggtcaaaactcataattaaactgggatatctacaaattcgaaagaaactttgtttggtgtcaactgaatccgtaatgcttaacttgcttccgcggccctgtcggaaactcatcctcaatttccggctcacgaactttttgccacatg

SEQ ID NO: 35118 - DNA, 3003 bp, Unknown
  misc_feature (1)..( 3003): 2750-1469P.txt file - cDNA_ID_3084850; gDNA_ID_2926261; Annot_ID_143219
tgtaacctacgaagatattaagccttatatcgatcgtatcgccaatggagagccgtctgatctcatctgtgatcgacccatcagtgtactcttgactaggtatcttccaaacaatttcatagatttgtatttataagtttaatgcaagatttgaaagaatttagaccagactagaatatgagaagagactttaaatctaggctcacataacccaaataagatctacccactttggattttcttaattcctctgttttgcctgaagaattgtggttaaaaaattattgatacatgagtttgtcaatcttttaaaaaaagtacattaaggaagggattgtatctgcagctcaggtacttcaggaggagttccgaagctgattcctttgacaacagaggagttggaacagaggatttcgtttgcttctctctatagacctctactctacaagtaaagagttttccaaactccaacttgtgtctgttttattgatgataccaaaagaaaaagagtaggtaaaaccccaaactcattgtatctacggtttgcaggtacatcgagggtattagagaaagaaaatctttcatgttatatttcgtgactcgagaaagcgagactgcttctgggatactggtcaggactatgataacttgtgttttgaaaagcgtgacgccagctaactcttttatctggtaaatctataaaaacctttgctcccacgttacattacacaattcattctttctgctactatttctttattgtgtttgttatatgacttacagggatcaatcacagataagcccgcatgcgattacgacttgttcagacactactcagagcatgtactgccaactgctttgtgggcttctacaacgagataatgtaggtcgccttggtgcaccatttgcttcatcctttctcaaaataatcaagttcttggaggatcactggcctgagttttgctcaaacataaggactggttgtctcagtgactggattacagacccccaatgtgtttcagggatcggtaagttcctcactgctcctaatccggaactagcgagccttatcgagcaagaatgcagtcaaacatcatgggaagcaatagtgaagagactatggccaaaagcaaaatgcatcgaagccattgttacaggaaccatggcacagtacaatccattactggaattctatagcggtggtcttcctgtgatttcaacgttttatggcagctctgaatgtttcttcggtctcaatctcaatcctctgtctaagcctaatgaggtgtcgtacaccatcattccatgtatggcttatttcgagttcttagaggttgagaaagactatgaaagtggtcatgatcccgcagagaatcctgttgtagtcgatcttgtcgatgttaaaatcggtcatgattatgaacctgttgtcacaacgtttgctggtaagtgttttttcttgtttactctctcaatttcaaaactaaatgacatgttaataattttcttaatgtgtatcaaaattctttatacaggtttgtataggtaccgtttaggggacgttttaagagtgactggtttctacaacaatgcgccacagtttcatttcgtgggaagacagaaagttgttctgagcatcgacatggacaagacctacgacgaagacctcctcaaggcagtgactaacgcgagtctcctgcttgagccacatgacctaatgctcatggatttcactagccgtgtggattcctcctcgtatccaggtcactacgtgctctactgggaactcgggagaaaagtcaaggacgccaagcttgagcttgaccagaatgttttggaggaatgctgcttcaccattgaggagtctctggacgcggtttacagaaaaggacgaaagaatgataagaacattggaccacttgagattaaggttgttaagcctggcgctttcgacaagctcatgaacttctttctgtctagaggctcttctgtgagtcagtataagacaccgaggtcggtgacgaatgaagaagccttgaagatattggaggccaacgttgtgtccgagtttcttagccagaaaactccgtcgtgggagctacatgagctgcattccagccgataaaaccgccctcacaatttttttttctagttgagagtaggatacttaagaagggtgaaacaatgtagaacctaaaataaaacttagcaatgatgagaaaattttactctcacttgtcctaccattcaaagctatataccattgatgggatatcaaataagagtataccattgtaaccatccaaaaatctttaactcctctactacgcaagatttttgaccgaccttatcacatggattttgtctttgttgtttcaaaagcttgtcaaaaatagttacacaaaatatgggaaaatcacaaaatcatgttttttttataatattttaaatagaatttttctaattaagtttaaatatttaaaagactaggttaaaaatacaaaactacatttttgttatgtttttggtatcttattaataaataaataaacccgaaaaggactaaaaatacaaaagctaaaaaggctcaaggcccaatataaaagaaacgaaaagcccaataacgatttttttttgttaaacaagttacttttttgagaaacgaaaaaaaaatctaaatatttggacatatgcagtaaaagtctaaaatgtatcagactttcaacaacgtgtcaatactcaatacccaataaaagcttttatctcctcgtagtactcaagttggatttgttttctcatcctttgttaaatcctctttatgagaaaagaacaaaatcaactcatacatacacaattgccggtaccctaacatttcgccacaccacaccttttgtctcctttatccaatctctcctccatagttctgaagcttcgagagagaggggccagaaggtcacccagaacagaggttttgcagacaatagaaagcagtaagcaagcatg

SEQ ID NO: 35119 - DNA, 3003 bp, Unknown; identical to SEQ ID NO: 35118
  misc_feature (1)..( 3003): 2750-1469P.txt file - cDNA_ID_3084850; gDNA_ID_2926261; Annot_ID_204737

SEQ ID NO: 35120 - DNA, 3003 bp, Unknown
  misc_feature (1)..( 3003): 2750-1469P.txt file - cDNA_ID_3084854; gDNA_ID_2926261; Annot_ID_143218
ccaactcatctctttggtaaattaacaaaaactttttccccacgttacattacacaattcacttttttgtgaacatgctcattggtgcttactactgtttgtttttcgtgtttgttatattacttgcagggatagattacagataagcccgcatgaaatttctacttgtgaagacactactcagagcatgtactgtcaattgctttgtgggcttctacaacgagataatgtagctcgcctcggtgcaccctttgcttctgtcttcatcagagtaatcaagtacttggaaggtcattggcaagagttatgctcaaacataaggactggccgtctcagtgactggatcacagaccctcaatgtgtctcagggattagtaagttcctcaccgctccaaatccggacctagcgagccttatcgagcaagaatgcagtaaaacctcatgggaggcaatagtgaagagactttggccaaaagcaaaatgcgtcgaagccgtcgttacaggctccatggcacagtacattccgttgctggaattctatggcggtggtcttccgttgatttcatcgtggtatggcagctctgaatgtttcatgggtgtcaatgtcaatcctctgtgcaagcctagcgatgtgtcgtacaccatcatcccatctatggcgtacttcgagttcttagaggtcaagaaagaccaacaagaagctggtcttgatcccatagagaaccatgtggtcgtcgatcttgtcgatgttaaaattggccatgattatgaacctgtcgtcacaacgttttctggtaagtatttgttgcagagtctttgcttagagaaaatgatagaaagacaaaataatcattttaattgttttcttaatgtgtaacaaaaaatgtctctctcaagatctccatatggtttgacaggtctgtataggtaccgtgtgggtgatcttttaagagttactggtttctacaacaattcaccacatttccgtttcgtgggaagacagaaagttgttctgagcctccacatggccaatacatacgaagaagacctccttaaggcagtgacaaacgcaaagctcctgctcgagccacatgacctgatgctaatggagttcactagccgtgtggattcgtcctcgtttgtaggacactatgtgctctattgggaacttgggagcaaagtcaaggacgccaagctcgaacctaaccgcgatgttatggaagaatgttgcttcaccgttgagaagtatctggaccctctctatagacaagaacgaagaaaagataagaacattggacctcttgagattaaggttgttaagcctggcgccttcgacgaactcatgaatttctttctgtctcgaggctcttctgtgagtcagtacaagacgccgaggtcggtgaagactgaagaagccgtcaagatattggaggccaacgttgtttccgagtttcttagtcaggaaactccgccgtggggataaaaccccgtcattttctcttttttttacttgagggcagcagatagtttagaaaacttttcttgatttttttaattactaaattagtcttccatatcataatctaaaaattccttttaatgtttggacaaatactggaagttccaatatccctaaccttaaatctatatcaaaggtagttgtaattcggattcggaaaaatccagatttgtactttaattgtgcacaaaccttattattatatataattaaaaattaggaattttgtagactacatttttatgtgtacttattttaaaaaataacatgtgttgaattttcagtgttaaaaaaaacatgtgttgaattttttggaaattgtctttttcttttaatgcctaaagtcaaatatgtatcaccaatccgtttcacggtcatttcccgtagatcagtccaaattttaaattactagtcaaaaatttgttactttagacattcaactattttaaagactacaaaatgtctgattacaaaaacaaatccattcactcattttatcttacaacaaaataccaaactagtcaaaattttgtttttataaacattcaactattttaaagactagtttttctcattgtctttttttacgtagttgtctgataaaaaaacaaatccatttactcattttgtctacaaatggataccaaactaatatgagttcaaattatgaatcttataccaattttttattttacaaatattactctgtacatgtgattctgagtttaaatatatatgaccaaaactacaaaaataatctatattaaattaaatttaattaaaacgtactttctaaaataagaaatctcgtatgtatgtgcggatcaaatcgagtttgaaattatattttcacctataatacattatatttatgttgtgattcaatttgattttttttttaaattacatttttacagaaaaatgtttctataagtgtccaatgatatccatagcatctttcctgaaattgggataccataatctttccgaaaatgtgatatataccatccacaatctaaaacacttgtaccacaagattgatgaccgtagtagtaaccacatggtttttgtctgcattcattgtttctaaagattgggggaaaagacaaaactacttaatcttactttcaaatcttcaacgtgtcactgatttctccatttaaaatgtttttatctcctcgtagtgctcaccaaaaggttggactctctatgctaattgaccctcttcctgaaaaaaataccaaatctggcaactcatccacaattttacgccaccgaacatttcgccaaaccacacattttgtctgctttctacttcgccagggaaagtggccagagctcatctacttcgcaagaactaagcaatctcttgtaaggtttgttctttcactttcttgtaagcaatttcattggaaggacttaaaatcaggattttctttttggttattgttgccgacagtcaaaaggcagcacaagcaatcatg

SEQ ID NO: 35121 - DNA, 3003 bp, Unknown
  misc_feature (1)..( 3003): 2750-1469P.txt file - cDNA_ID_3084854; gDNA_ID_2926261; Annot_ID_204736
ttaaatgttttgcagctctggtactacagcaggaattcaaaatttgattcctttgacaacagaggatggggaacagaggattatgtttggatctctctatagatctttactctataagtaaatatttctaaactccaacgtgggtttgttttattgatgtgataccaaaagaaacattcattgtaattgcaggtacgtcgaggggattagagaaggaaagtctctcacgttctatttcgtgaaccctgaaagagagactgcctctgggatactgatcaggactatgataacttgtattttgaaaagcgtaaacaaaaccaactcatctctttggtaaattaacaaaaactttttccccacgttacattacacaattcacttttttgtgaacatgctcattggtgcttactactgtttgtttttcgtgtttgttatattacttgcagggatagattacagataagcccgcatgaaatttctacttgtgaagacactactcagagcatgtactgtcaattgctttgtgggcttctacaacgagataatgtagctcgcctcggtgcaccctttgcttctgtcttcatcagagtaatcaagtacttggaaggtcattggcaagagttatgctcaaacataaggactggccgtctcagtgactggatcacagaccctcaatgtgtctcagggattagtaagttcctcaccgctccaaatccggacctagcgagccttatcgagcaagaatgcagtaaaacctcatgggaggcaatagtgaagagactttggccaaaagcaaaatgcgtcgaagccgtcgttacaggctccatggcacagtacattccgttgctggaattctatggcggtggtcttccgttgatttcatcgtggtatggcagctctgaatgtttcatgggtgtcaatgtcaatcctctgtgcaagcctagcgatgtgtcgtacaccatcatcccatctatggcgtacttcgagttcttagaggtcaagaaagaccaacaagaagctggtcttgatcccatagagaaccatgtggtcgtcgatcttgtcgatgttaaaattggccatgattatgaacctgtcgtcacaacgttttctggtaagtatttgttgcagagtctttgcttagagaaaatgatagaaagacaaaataatcattttaattgttttcttaatgtgtaacaaaaaatgtctctctcaagatctccatatggtttgacaggtctgtataggtaccgtgtgggtgatcttttaagagttactggtttctacaacaattcaccacatttccgtttcgtgggaagacagaaagttgttctgagcctccacatggccaatacatacgaagaagacctccttaaggcagtgacaaacgcaaagctcctgctcgagccacatgacctgatgctaatggagttcactagccgtgtggattcgtcctcgtttgtaggacactatgtgctctattgggaacttgggagcaaagtcaaggacgccaagctcgaacctaaccgcgatgttatggaagaatgttgcttcaccgttgagaagtatctggaccctctctatagacaagaacgaagaaaagataagaacattggacctcttgagattaaggttgttaagcctggcgccttcgacgaactcatgaatttctttctgtctcgaggctcttctgtgagtcagtacaagacgccgaggtcggtgaagactgaagaagccgtcaagatattggaggccaacgttgtttccgagtttcttagtcaggaaactccgccgtggggataaaaccccgtcattttctcttttttttacttgagggcagcagatagtttagaaaacttttcttgatttttttaattactaaattagtcttccatatcataatctaaaaattccttttaatgtttggacaaatactggaagttccaatatccctaaccttaaatctatatcaaaggtagttgtaattcggattcggaaaaatccagatttgtactttaattgtgcacaaaccttattattatatataattaaaaattaggaattttgtagactacatttttatgtgtacttattttaaaaaataacatgtgttgaattttcagtgttaaaaaaaacatgtgttgaattttttggaaattgtctttttcttttaatgcctaaagtcaaatatgtatcaccaatccgtttcacggtcatttcccgtagatcagtccaaattttaaattactagtcaaaaatttgttactttagacattcaactattttaaagactacaaaatgtctgattacaaaaacaaatccattcactcattttatcttacaacaaaataccaaactagtcaaaattttgtttttataaacattcaactattttaaagactagtttttctcattgtctttttttacgtagttgtctgataaaaaaacaaatccatttactcattttgtctacaaatggataccaaactaatatgagttcaaattatgaatcttataccaattttttattttacaaatattactctgtacatgtgattctgagtttaaatatatatgaccaaaactacaaaaataatctatattaaattaaatttaattaaaacgtactttctaaaataagaaatctcgtatgtatgtgcggatcaaatcgagtttgaaattatattttcacctataatacattatatttatgttgtgattcaatttgattttttttttaaattacatttttacagaaaaatgtttctataagtgtccaatgatatccatagcatctttcctgaaattgggataccataatctttccgaaaatgtgatatataccatccacaatctaaaacacttgtaccacaagattgatgaccgtagtagtaaccacatggtttttgtctgcattcattgtttctaaagattgggggaaaagacaaaactacttaatcttactttcaaatcttcaacgtgtcactgatttctccatttaaaatg

SEQ ID NO: 35122 - DNA, 3003 bp, Unknown; identical to SEQ ID NO: 35121
  misc_feature (1)..( 3003): 2750-1469P.txt file - cDNA_ID_3084854; gDNA_ID_2926270; Annot_ID_205107

SEQ ID NO: 35123 - DNA, 3003 bp, Unknown
  misc_feature (1)..( 3003): 2750-1469P.txt file - cDNA_ID_3084858; gDNA_ID_2926270; Annot_ID_143419
tttatgttaagctattttcaaaaaatccttctttgatattgacttggacgtacggtatctctgacaagcgagacttttagcatgctttcggcttcgaagattcaaatattgcggctgctttgctttgattccgctgagagtggaactccccccagataacaatgatgatcttcgcatgcacatgaagatcgcaactcttatgtgtgaatagatttcgatatacactatattcatttacgtgcatctttaatttatctcatatattcatcctttgtggggtatgttcgtagactcgtagcaatcaaaacattagggtaaaatgttatcagtagtaatgagtttataatgtggtcccaactcccaattgcagactttaaaaattatttttttcagacttgaactgcacaatttagaaaactaaatgttacctctatctatttgtttaagttttatggtttattcttaaaactcaaaagaatgctttgtgtattttgtatagtttctctttgtcaatgcttatatgtatttaaaatacatgagaagaggaattagctcatagaagtgtcaaagtcttcttacatagtatatagcttactcaatttctaaaacttttgtcaagttttgtaatagacattctgatttctagaaagtatatatactgtgcattttctaaacttctggtattataaaacaaaaaaatcgataaaacaaatcatattatcagatttttaacaacatgcaactttttctaagtaaactaacaaaaaaaagaaattacaattattcctcacatgttaaaacaggcttttgatcaggtccggcccaacccgccagcccaaagcccgccagagctattatcaaactttaccaaactgatagatgcttctttccaaagattaactaacatagtgaagcaacaagctctatgaagggtcagctagagaatgttgtctgtgcttacttggatgagtcaactcctcaactgtatcttcctattctctgatacaagaagtcaaaagtttcttcagactttgccttcatcaatgtttctttaattataaacccatgccgaaatgcagcttggatcgtgatctgtttccatttgatagcttgctggagtttctaatctcttcttcttcttccagcttctttctccttgcagcctcctccttctgtctctgcaggagctccaattctcgatacctttcctcttctttacgttgaagttccattgcttctcgcctttgagattcttcaaccctcctactattttcttctaacatcttatccagctcttctctttctctcctagcttgttccttttaattaatttccaaactttttagtttcagcaagtattccaaagccagaaaaccaaacaaatagagcggcaaaattgaacaaacaactagctagacttacttcttttcttcttgcctcgtttagagcagcttctttttctttcttcagctgtatttccacgtcaagaaacatcttctcataagcttcctttgtccgtctttcaatttcttctttaacttcttcggttttcatcctttcctctacatttttccttactgcttcctcaatccgctgtgcagtctcttcttctagtcgcttgagctccgcctcatgctgcaatctacatttagtaagggaaaaaagatttagaaagaagataagactgataacactagccaataaaaacttttcaagatcatataaacgcacaaattgatcagttattcttctattcatgtccaaacagtattcaatttagataaggaaacaaagaggttgatcaacaatcacagaggcgataattcaagaaatgtatttttgccctttcgtgcatgtcaacttgctcactagcaaaatacattcccctaatgtggaaaactatattgcttcatacacaaaataataaagtataatacaatctgaaagacaaagacaatgtttaatcaattaccttgccttgtcttcctgttctttcttcacttcaatcgcaattctatgctcggaaggagacaatgaactacttctatccctttggtgttgccttggtgcaggagatctgctcttcttatgcctacaaaaattggaaacctactcttatgaaaatgtgttgaactaaagcagctccttcttcactagcagctggacatcgaacattaatgtccatagaaattcgtttgcaaaacagcaacgatccaaagtgaagtaacaaatttgaaatttgttctcgacaaaatcgctaaaccctaaacctattctctaagccctaatcctattctctaatcccaagtatctaaacgtaattcccccacatcaccataagatacgagattcgatttctccacattaagcaaggaagattgttgcagaccttgatgtgtagggtgagcggctgcggtcgcgcctggtacgacggctgctacgatgagtcacaggcgagcgagagtaccgtcggcggtgagacggcgacctagatcgcgagtcgtttcgagccattttcaccaccgcaattatttgattggtcaaattgatttctctctttcggagcttttttatgcgactgctctcgtacgatttatcgatcggttcaatattttgttaaccggacagacgcaagttgaaccgaccttgtttgcggtttaattcaaaaaaaaattatcctaattaattagggttaatgaataaatttatctttctaaaaatgggattttctttacttatgctttgtcagttaattctatttatggaaataagaacaaatcatacggcaacgaacatatcgtcacaccacaccatttgactgactgctttttctaatctctccttacaaagctttcaagcatagaaagacacaggccaaagctcatccatccacctcgccagaacaaaggtttgcttgctcttcactcttttgtaaacaatttcgtgatacgacttagaaggttttttttttttgttgttggcagacaatcaaaagcaagcatg

SEQ ID NO: 35124 - DNA, 3003 bp, Unknown; identical to SEQ ID NO: 35123
  misc_feature (1)..( 3003): 2750-1469P.txt file - cDNA_ID_3084858; gDNA_ID_2926261; Annot_ID_204735

SEQ ID NO: 35125 - DNA, 3003 bp, Unknown; identical to SEQ ID NO: 35123
  misc_feature (1)..( 3003): 2750-1469P.txt file - cDNA_ID_3084858; gDNA_ID_2926270; Annot_ID_205106

SEQ ID NO: 35126 - DNA, 3000 bp, Unknown; identical to SEQ ID NO: 28457
  misc_feature (1)..( 3000): 2750-1469P.txt file - cDNA_ID_3084862; gDNA_ID_2926261; Annot_ID_204734

SEQ ID NO: 35127 - DNA, 3000 bp, Unknown; identical to SEQ ID NO: 28457
  misc_feature (1)..( 3000): 2750-1469P.txt file - cDNA_ID_3084862; gDNA_ID_2926270; Annot_ID_205105

SEQ ID NO: 35128 - DNA, 3003 bp, Unknown
  misc_feature (1)..( 3003): 2750-1469P.txt file - cDNA_ID_3084864; gDNA_ID_2926270; Annot_ID_143417
tttttccttatatttttgtaacgattattatttggatcaacccattgataaaaactctcttcttgttctgtttaggcatgtgaaaggtgtggaagaaggaaaagggatgatgtttcttttcactaaacaagaatccatgactccttctggcttgcctgctcgagtcgcaaccagcagctatttcaagagtgactatttcaagaaccgtccatcgaactggtattactcgtacaccagccctgatgaagtcatcttatgccctaacaacaccgaaagtctatactgccatttgctctgtggcttagtccaaagagacgaggttgtgaggacgggttccatctttgcttcagtcatggtccgagctatcgaggtccttaagaattcttgggaggagttgtgttcaaacatccgatcgggccatctcagtaactgggtcacagacttgggttgtcaaaactctgtttctttggttcttggagggccacgtcctgaattagcagacactattgaagaaatatgcaaccaaaattcttggaaaggtatagtcaaaagactttggccaaacaccaaatatatcgaaaccgttgtcactggttcaatgggacagtacgttcccatgttgaactactattgtaacgacttgcctctcgtttcaacaacttacggttcttcggagactacctttgggatcaatctagatcctctgtgcaaacctgaagatgtttcttacactttcatgcccaacatgtcttactttgagttcataccaatggatggaggagacaagaacgatgtggttgacctagaagatgtgaaacttgggtgcacttatgaacccgttgtcacaaatttcgctggtgagcttaaaaacatcgatcatgaattcaataaaatgcatacttttttctacatggtttaactaatgtttgtgaaaatgttttttttttcttcaggcttgtataggatgagagtgggagatattgttttggtgactggtttctacaacaacgcgcctcagtttaagtttgtaagaagagaaaacgtcgtcttaagcatcgattccgataaaactaacgaagaagatctgtttaaggctgtgagtcaagcgaagctcgtactcgagtcatcaggtctcgatctgaaagacttcaccagttatgctgacacctcaacatttccaggtcactacgtggtttacttggaagtagataccaaagagggagaggagaaggagacggcacagtttgagctcgatgaagaggcactctccacgtgttgtttggtaatggaggagtcgcttgataatgtttacaagagatgtcgattcaaagacggatcgatcgggcctctcgagataagagtggtgcgtcaaggaacgtttgattctctcatggacttcttcatctcacaaggtgcttccaccggtcaatacaagactcctagatgcattaagtcagggaaagccttgcaagtattggagacatgtgtggtagccaaattcttcagtatttgattgttcttccttggttttatataggttcaagtgatttgtcttctttttttttccataaagggtttggttcaattgatttgttgtgatttgagagtgtactaatttgtctgaatgtttgtttatatttttttaatatatatatttgattcagtctttatctgattttcctctttaaacggaaaacaccattgagaatttccgagtctttactcagaaacagagtattttattccattgaactgaagttggcaaagacttggaagatggccaaacaactttgagatgaaaccaaacccttcgttacacttcaccaccctgagccatgagtccatgactaacaacaagtaccaaaataacaatccggtttcgttttctttcggttcgtgtgtttttcaaaaaccaggtaaaccatgtgtagtttggttttgttttggttatgatgattttagcataattttagtagagtgtccaaaacacaaaattttatatgcagtttagtacctgactaatcttgcagcttttagaaaaataattgcaactttgcaaaattctctccaagcaaaagaaaagattggactcgtcaatagaagcaggcccggtccaaaaggtggtacatacaggcgacggcccaaaggcccaatttatccggaattaatataaaatatggttaactgtaaatatatgattttcaaatggatacactcatacaagctttgattcctaaaattagattacaaaaattatttttcgtactttgctgcatatataataattgatttgtacataacaaatcaattatacgatcgaatttcaaaattttaatagataatatactggaacaaatacatatacaaatataccaataaaaataaaactgacccaattagtttattttattttttagtaaaaaaacagatgaaaaattagaaatgttgggtccgcactcattccttatttgtgcataacactgctgccaaaacatgcgaagctaataagctcccaaaaaagtttaaagattgagaaaaagaaaaagagaactatgaactcaaagaacggtcctaccccgcaccattccaaagattttaattaatatttttatcatctattttttcttgtagatccttctctttataaaacccttttgtcacctcttctttcctcataacatcacatcatagcctaaaccaaagaaaacccttatttgcgatccccacttgttgttcatcaccaagccaagctccatgtcctagtcactccacagattccctatcatcatcaattcgtttcaaacttagttcctttcaaagtcttgtacatatatacacacacacctattattctcttggtgtgtttgtgtgttacatatacgtgtgagtacatactttgttgtaaaagtggatcggaggtatggaaagggaccggttccaccggaaacatcggcggcggcggatgataattcgtcttggaacgagactgatgtcaccgccatg

SEQ ID NO: 35129 - DNA, 3003 bp, Unknown
  misc_feature (1)..( 3003): 2750-1469P.txt file - cDNA_ID_3084864; gDNA_ID_2926261; Annot_ID_204732
actatggcctcttgtttctgcgtacggatgcatttataaaatgttgttttttcatttcgctaatttgacatttatggtagatacgtgtgtttttggaaggacacaccaaaatactagtagacgaagacaccaaaccccacttggtgtgcatatcaaagtcagaagatggagactacttggaagtttatttgatcaaaactcgtgtttgacgttgtagcttattaagaaatgacttttaactctcaaggtttacctggaacatcgttttctttttccagcgaatttctgggcaaatatccctccaggcccacacttcataagctccattaaattataagtttttaattttatgtcaaacccaaaccgttttggttgtctttaatccgttaagaaatttcagggcaactagaagcaatccataaatattattacgattacaaaatttgcttaagaggattaatcaaaatatttttgtgaaaaatatttcaaatattaactttcattacaaataaaggatttttaccccccaaaaaaaaaataaagtacttttataattaaaccaaaatattataattacctaattataaatgaatattttatgattatcttacataaaagatcgatgtttacaaaacaaatcattttcaaaagaaaaataagtacattaaataataagatcccctttgatttatggtttatttagaaagtcaaaacgcgaaaatgttcgaaaatattataaagccatttattcagtagatgtaatgtcttatacggcccgagaagcggatgcgttccgcgtagcaattgctcgggcttgcatggacgctacttaaatcgacacgattcatactatattgtctgtcaaatcgatagctcgtgggacgtatcagattcattaagaggcgatggatggcttgtcctttctcgctagaatattgccctcctcgggttaaagagctaccacagataaatgtcaccctacacacatagttcgaatatctcttttgggcaataaaatgtcatattttgtcctctttagctagtgtgatttttgagacataattgtaaagatttaattaagctaattggcgttctagatgaatggtcatcctttggtatttaagtaagaaaattcaaacttttaaaaatttgattttttttttttctttgaattatttttttctagtttgtactagtttttctaggcgattttttttaaaaaaaatcaatggatgaatttgttttgttgcaaaataaataaataaaaaaaaaaaaatatatgtagtagggttgctggaaagattatcataaaattaaatatttaacagtttatggagaaagaagataaagaacggaagagattaacaagaaaatagttttggtttttccttttagggcatttgtatcaattgaagacgaatgacaatgtttggtttggtttggtttggtagaagtaaaaaaacatatagtaccgttgggcaggataagactagactacgattggagcttaagcgagaaccatatataatatatcagtgataccattggatcgtactattgtctttgctgttgtattattgatctttatttttggttttgtttttgtttaatgcaatttcaaaaatttccaaatcctttgtaattaaattgagtgtaccaatctggagaaaagatacgagactctgttgcaggtgagtctaaagtctcttgcgttcaatttcatgttcttttctaatattgaaacttcgtttgtaatttctagtctccatcactttcatcacacgactcactcaactaaataaatagtttttgttgactcccattgtagagtcttttgtggtctttgttgtttatgaatttaactatatttttaatcattttcttaatatttatatttgactcgcagcgtagagtcttgttgtggtctggtctttgtgtatgagttttatttttcttgcgcgaaagttttaacttgtttcggaagtaccaaattttgcagaagttccttgtggatttctctgcgttttcctgacttctcatgattcatgaaacagacaccaaaagaagaataaaaaaactgatagttgcataatgttgactattaaataatcgacaagatgatacttgctgaacaattcgtcacaagttaaaacccaaggaacaaataaatcgtcaaaagttattttaaactagattacatacgcaaattttaattttatcacaattttgcatggtactagtatactgcataattgcatttaaactttcaaaatttgaaacctaagctggtattacttgtattcctctacatattacacataatacttatttattatattaagcttaccaatgtcctttgagttattttaccaaaaaaaataatgttctttgaattagttaaactaattttccatgaaacagttagctaataaatattttccatgaagccttagatcgatgtcaaagtctcacatcatgaaaggttctcacagactctacacgttttttactaagcattgctttggaaatttacgaaagaacattttccacgaaaccatattttcgacgaaattacattttccatgaatatgccgacaaaagaaaaacattttccatggatattagttaaacaaactatttatcatcagatgtctatattcctatgtaatcagctaattacttcgctcgtatattaatctattcctagttgttggaatacaaacaaaatgaagcatttgtgtgtcacacttcacacgctaaggtcagtattctataatcaactaaaacattatcaaattgtgttactcggtcgagactttttatacagttaaaacattgacccagactcacgaactgccaaatccatttaattagttagggtttctcttgctatatatagagccaagtgttaactctgttttcatatcaactatcaactaataaccaaactatccattcttttcttcttattttttcatatcaacttaaagagaaccaaatatg

SEQ ID NO: 35130 - DNA, 3000 bp, Unknown; identical to SEQ ID NO: 28456
  misc_feature (1)..( 3000): 2750-1469P.txt file - cDNA_ID_3084868; gDNA_ID_2926261; Annot_ID_204730

SEQ ID NO: 35131 - DNA, 3000 bp, Unknown
  misc_feature (1)..( 3000): 2750-1469P.txt file - cDNA_ID_3084874; gDNA_ID_2926262; Annot_ID_143238
cactttcttttttccttttttgagaagtaaaacgacgtcgtttaccatattaccaaacgatttgtttttgagtcaaccacctctttaaccagagtcattcttcagttcttcttctttttcgatctgcttcgtagagtcgatagagggaagaatcaaagaaggaagtctgtatcttttgagctctccaaaggtaaaaacactcagagatttgatttgtttttttcggtctttaccttggatacgtcattctcagatggtagcgaatttgtagatcttaaggcttgaatctatttcatatgatcaattacttatagatgtgatgatgatgcaactctttctttatttactgctatgagattcaatcaattttttatttttatttttgtgtattccatgtttttgatgttatactcatgtctggatttcgtcaaagttattttcttttagtgattttggtaaagaaacttgttcctgacgtatgaacctaattgtgttggactatgtgctccatcttcatagaaaatgatgttgaaagtgtagattggtgggtgatttttaacaagttttgtctaagtctgataccaagcttctcatattgttaattgtgtgtggtgttacagatgtttgacgaccaagacctcggcttctttgccaattttctggggattttcatcttcataatggtcattgcataccatttcgtggtggcagagcctaaattcgaatgagaatgaggtttcatctttgttagtttctacaaaaaaaaaacttataaatgtgttggaatcaatatgtctttagcattctataggtcgtgatgtttcgccagtagatgagtaatcaatgtattttgacaatgtggttttggatggattaagagttaaaagacttcatttttcgtagtgtttcaatcattcaagttttagtatgcaagttttctgtttagagcatattgcatacatgggcgaatatggtatacctggatttcccagttcttcaggtcttctctgtagctctgttacttctatcacagttatcgggtatttgagaaaaaagagttagctaaaatgaatttctccatataatcatggtttactacaggtttacttgattcgcgttagctttatctgcatccaaagttttttccatgatgttatgtcatatgtgataccgttactatgtttataactttatacagtctggttcactggagtttctgtgattatgttgagtacatactcattcatcctttggtaactctcaagtttaggttgtttgaattgcctctgttgtgatacttattgtctattgcatcaatcttctaatgcaccaccctagactatttgaacaaagagctgtttcattcttaaacctctgtgtctccttgctaaatggtcatgctttaatgtcttcacctgtctttctcttctatagatatgtagtcttgctagatagttagttctacagctctcttttgtagtcttgttagagagttagttgagatattacctcttaaaagtatccttgaacgctttccggttatgaccaatttgttgtagctccttgtaagtagaacttactgggaccagcgagacagtttatgtgaatgttcatgcttaagtgtcgaacgtatctatctctactatagctctgtagtcttgttagacagttagttttatatctccatttttttgtagtcttgctagttgagatattacctcttctcttcaaagtatccttgaacgctcaccggttatgaaatctctacactatagctctgtagtcttgctagatagttagttctttagctctctttttgtagcctagttctttagctctccttttgtagccttgctacagagtaagatgggatattacctccttgaacgctctccggttatgaccaatttgttgtagctccttgtaagtagaacttaggatagagtgagtcaactttaagaaagaacctagtatgtggcataaccagattgcaggctctgtctcggctacagtaacgtaactctatagctctttgttttgttcagaaagaaccagtgattggatgattcgtccttagaaactggacctaacaacagtcattggctttgaaatcaagccacaacaatgcctatatgaaccgtccatttcatttatccgtttcaaaccagcccattacatttcgtcccattgataaccaaaagcggttcaatcagattatgttttaattttaccaaattctttatgaagtttaaattatactcacattaaaaggattattggataatgtaaaaattctgaacaattactgattttggaaaattaacaaatattctttgaaatagaagaaaaagcctttttccttttgacaacaacatataaaatcatactcccattaaaaagattttaatgtaaaattctgaatataagatattttttacaacaacaaccaaaaatatttatttttttccttttttacagcaacaagaaggaaaaacttttttttttgtcaagaaaaggggagattatgtaaacagataaaacagggaaaataactaaccgaactctcttaattaacatcttcaaataaggaaaattatgatccgcatatttaggaagatcaatgcattaaaacaacttgcacgtggaaagagagactatacgctccacacaagttgcactaatggtacctctcacaaaccaatcaaaatactgaataatgccaacgtgtacaaattagggttttacctcacaaccatcgaacattctcgaaacattttaaacagcctggcgccatagatctaaactctcatcgaccaatttttgaccgtccgatggaaactctagcctcaacccaaaactctatataaagaaatcttttccttcgttattgcttaccaaatacaaaccctagccgccttattcgtcttcttcgttctctagttttttcctcagtctctgttcttagatcccttgtagtttccaaatcttccgataaaaatg

SEQ ID NO: 35132 - DNA, 3000 bp, Unknown; identical to SEQ ID NO: 35131
  misc_feature (1)..( 3000): 2750-1469P.txt file - cDNA_ID_3084874; gDNA_ID_2926262; Annot_ID_204773

SEQ ID NO: 35133 - DNA, 3000 bp, Unknown
  misc_feature (1)..( 3000): 2750-1469P.txt file - cDNA_ID_3084878; gDNA_ID_2926262; Annot_ID_204777
gtagcgatgtaatttttttgtaaatgtatgcatatgcatatgtgaacctgtgataattgcagtgagattagttgcatcaatcccttgagtaacctcttcagctgttgaagctgaaccaaatccacttggtcctcttcttcctgtgattagtgaatataatcccatttttaatagattgacctcaagaaacaatgtagaagagagagagcgagagagacaagagaggaagaagaagataggtttgggagaataaaatggtactatgagagaatcatatatataagtggcaaagagtcattaatgcttatttttggtaccttctagtttcatggaccttattgtgtgaatttatccatgaattataaatacacattaaacccatccccaccaatattgaatatagatatgtacagtatgtatattagttttttcttgtgacggtcgattctcgatagtgcatgcattcgaaatctaattaagaaaaagttcgtatttttcttcgatatagaaaataaactcgctgttgtcaacttaagcatgtctatttctaaataagttgttgttaaggtctctaaacttttaagtcctttttctctaaaaaaacccttctaatattggttctaaattgccgacaatggcgagtgttttccctctcttattattcgaaaatgttactataccataaaagtttattaatctttacataatttacacattactttccccttttcaaaacgaacaaaataaatcgtttgctatcaaacatgttaatgtacgttggtagtaatgtcccctccttttttaggggtatttaatgtcctctcgtttttcgaagattaaaacaaaagaatatgatttgtgtgtatagaaaaatgaacataatctaagtaaacgttacatttggggattgatgattaatcccaatttttgtttttttttataaaaaaacactgaaaggtattaaggtgctctaagctattgaaaaacaaaatgttgaataaaaatatagggatgaccaaattattaatgaaaggttggtgagaagccgttggttactatactgagttttcagctacttgacatcctcctttcttcacatgtttccagtgaatgtgttaccacttacccaaatccctcctaatttaggggcgagtttcatttaattaaccatctaattagtttcattttttccccaaaacttagggaggttattatgcaactaaaccgatgactatagtctaaaccaacaaaatcaaagtggtgtgggtttgtttctttcatgtagagacgaaaatacttgactttgtcatccatattcaaacctgcattggatgttcttgatagaaaataaagaagaaaacctaacataactaaacaaggtctcgtacaaattttaaacaactgaagagcataaatcttatactaaagaaaatcattaaaactctactcaagaatacttcatcggtcgtttacagagtttttgaccggcagataaagaaagatatatacttatttggataaagaaacaatacagaatgtataaaattaattcatagcccgtgctcatagatatcgatgttcctttcacatcccgtttccaagttcagagaatccaactacgagatttggatctttcttttttttgccttgcaaaattgattgctgagagagcctcataatgacattgttaggtggtagatttacacaaaggtacacacacacaccactatcgagattaatgccatatttattattgttattattgtttcaacatactaattcgtgatttaaacaatcaaaacctataatgctttatgatgtaaaactgatagttgaacaaacttgtcgtggtagctgagagtatattcttttcaaagctgaacttatatttagcgattattttgtttgtttagtactctataaccggttaacattattttgtttggcatgcaacgaaacaaatctaaatagaatggaccaacctacatttgtaactgcttcagtaaaaaaaaaaaaaaaaaaaagaagaaacagaagagattatattgctagatctagcacctatatattaggatagtcgaattatgtaagtagaataatgaaggcatttactctatctatcatgtttttagcggcgactggcacatgacatccggctcattggctcatttgtatggggaagtgatgtgaccatgtgagactataacgtctaacgatattgactatttatttccttatattatattactgccaaaaaaggcagctcaaaaaatactattgtgcaacggttattattccatggatcaaagatatcaataattttttgttaaccacattttgtttttatcaacatatttaaatattttgtatagtaattaatgtgtcatcatttgaatacaaatctgtatatcatataataaaaaagtccacttaaccattaaaaatttcataattcgtctagaattctacataaaatcttctggtcaggttataaagatgtctttaacactcatggtacaagtaatttgttaaatagcaaggcaagatttgttttccaaattgagataaacaaagaaaaaaaagggttgacttactaatattaatacgtgaatgtgtatgtacgttgtgatacagtcacatactgtgcccatacaggcaatgcgtgtgcttcacatgtacttgtccacatctttgattatgacaatggccggagggaaaaaaatataataagttgaagtggacaatgaggatgggccactggatttttatgagtccaaaaggcccattaagaactcaggggtctatttagtaaaacgtaagagtttaagggcaacaaaacaatattgattaaagctgaggtgtttatcgtaattctccgagaagataatatctgtttctctctctctcactctcgcggtgcgtaattccatctttgaaatctcagagcaacaaaaccctagctacatttctcgatatcggagaaaagatccggcgaagatg

SEQ ID NO: 35134 - DNA, 3000 bp, Unknown; identical to SEQ ID NO: 28687
  misc_feature (1)..( 3000): 2750-1469P.txt file - cDNA_ID_3084891; gDNA_ID_2926243; Annot_ID_204160

SEQ ID NO: 35135 - DNA, 455 bp, Unknown
  misc_feature (1)..( 455): 2750-1469P.txt file - cDNA_ID_3084891; gDNA_ID_2926262; Annot_ID_204796
ctttgacagattgtgtgtctcatctttttgttatctgtttttcgttgttttttttttttggtaaaaagatttcgtagtttgttgacataatgaatgtcaaaaaaaaaaaaaaagtccataccataacaaaagtaagcttactttgttcgttttaattttaaatatttaagaattagcttaacaaattcggtaaaatttgggatttttcaatgtaaaatatgatcattatttttgtttgtgaatattttatacgaacgttacaaatataatgtattatagaatgtggtattgaagagggagagtgtttagagggaaagcgtgagacgcacgtggatctctgtccctcttttttctcgaaagcttgctttcctgttctttccttttgtttcaatattcgttgaaaacataacagagagaactaaacggaaaaaaaccctgaaaattagataaaaatg

SEQ ID NO: 35136 - DNA, 3003 bp, Unknown
  misc_feature (1)..( 3003): 2750-1469P.txt file - cDNA_ID_3084895; gDNA_ID_2926262; Annot_ID_204793
ttggaactatgcttgaaacagttgatttcatttgttgtttaatctcaaaactatatctatatatacatatatgaagctacggatatttgaaaacatatacaaaacactaggaccaacctaacaagtctttagagagtctgtctccactgatccaaccctagcttccactgttgagattcttcagagagagtctgtctccactgatccaaccctagcttccactgttgagattcttcagagagagtctgtctccacagattcaatgtccggagcatttctggttctgcgctgtaatccccagtaaaagacaataatgtgtggctgctttgtaataggtttctcttagttcccagtttccacaatacatagatatcttcccagatttctccaaccaacaggtctttgtcaccttcttgcttctgttgttgctagcacactcaccattcttaggcagctgagatgctttcaaaaccgatgactggattctgccaactggtccctggaagcaggaagctgttgagattctgcagagagagtctgtctccacagattcaatgtccggagcatttctggttctgcgctgtaatccccagtaaaagacaataatgtgtggctgctttgtaataggtttctcttagttcccagtttccacaacacatagatatcttcccagatttctccaaccaacaggtctttgtcaccttcttgcttctgttgttgctagcacactcaccattcttaggcagctgagatgctttcaaaaccgatgactggattctgccaactggtccctggaagcaggaagctgttgagattctgcagagagagtctgtctccacagattcagtgtccggaacatttatggttctgagctgaaatccccagtaaaagacaataacatttggctgctttgtaataggtttcttttagttcccagtttccacaacacatagatatcttctcagattctccaacaggtcttgtcacctttgtaataggtttcttttagttcccagtttccacaacacatagatatcttaccagaatctccaagcaacaggtctttgtcaccttcttgcttctgttgttgctagcacactcacaattcttaggtagctgagatgctttcaaaaccgataactggattctaccaactggtcccaggaagcttccattgttgagattcagtgaggtgtaatccccagtaaaagacaataatgtgtggctgctttgctctgatgggtttggatcacaaaaatgccatagacttcctgtatttcaataacatgtggaacaaagcaaaggctacagtcacagactatgagacagaacacagaagatttcgtatccccaaagagttgaaccaaaagatgggaagtgggtaacttgatcagaagacaacggaaacgtgacttaacccaaccactgagatgttcctgattagcagccgagaggtgtacatgtgtttgcatacggatagagctcaaacaaaattcttcattctctgcagaagcctgagatgttctccacgcaacctgcatcatctgttgcaatttccaataagctagttagcctctgtgaagcattatgtcgaataggtgatatgcaacatttttgttcttgacacttggtgacctcctcatagtaatccgagccaattccgatgtgggtttttcttcgtggtgaataaagaacctatcaatgccaaaaccagagagtaaatcatcaaaaattaggacatgtgattgtgactgtaatcgaaatccaatggtgaagaaaacaagtccacgatgctccttgaaagatcgaattctcaatcttctgttgttggagaacacaaatctgtcgctaaggtcaaagctttttcctcctccttcgattgctgttctagacatgatgaatcagagtctgtaatcgttactttctgtggctaggagcagcgaatcctgaccgttggattggtttttctttttctttttaatgtccgtgatattattgtctgaagaagaaagagagaccagttttgacttttgacttcgagtaatgagaagaaaaagcacagtgagattgctgttcttgacgttgagtcagagtctgtggctaggagcagcttcttttgttttttgaatcgacaatggttgaggaataaacgaaatcctgaccgttggattttttcttttcttttcttctacttaataatgtccgtgatattattattgtctaaaggggagacccgagaaagagcgagaccagttttgactttttggacattgtgtgttttcgattcgatcttttttttctgaaggtatgcttttgaattcgatttttttttttttttctcgagatctttgcttcgtggtgtttcctttggacttcgtttggtgatatttctgggtttcgtcttttgacgttttttttttcttctcgatgaaatgtttactcagctgccaaatttctctgtttgatattgagtgagagagatttgttactttttacaaaatcaactagttttaggttaccaaatttggtttcggtttcgatgcttaaacaataacttggtgtagtcggtctctgtatgaatgtgtgtgtgtgttgtttttgctgctgatttggatctgtgcttttgttatagcgttgaaaatgcctcgttatgatgacctttgaacacggactcgttatatgctaatttggaactttgcttgaaacagttgatttttatctggatttacatttgatgttttatgcttttatctcaaaactctgtatatatgaagctacggatatttgacctctgatatcctattttgaagtctcagccttgagtgcaccacctgcatgaggatgtcatgagatttttttttttagtggtttttgaatcttgtaactactagttgttttggagaaattatgagattgttcctaaaatgtttggtagcccttgtaataaaggtgtcagctttgctcttgggaaatgttttcgttggtcttagatgttggtaaatg

SEQ ID NO: 35137 - DNA, 3003 bp, Unknown
  misc_feature (1)..( 3003): 2750-1469P.txt file - cDNA_ID_3084901; gDNA_ID_2926262; Annot_ID_143254
atgaagctgaatcgatctcgatgtatctactgctgacgagctacttcgtctagaatcgagtcttcgacgagtctctcttgctacggctaacagacctgtcgctgcttctcttttcggagaactacacaggcgagcttctctcatttcatcctcttgtctctggttgatactgagattataatgattatactattgaagcaaattgtttctccagtgaagtctttgttgagttataaacgaaagatgtgaagtgtgtcaattataatggcggattgtttttgtttctctgttatgttacttcgattagttgatcgttttttttttttttcggatattacacaacaggtgtctcaaattggtgtcaatcttcaaaagcgtggtgtttggacaagtagtaataggtcctcctggatcgggcaagaccacttactgcaatggcatgtctcagtgtcagtgcatctctctaatgggcaggtttcatcttctttctctttttggatcaaagaaagaagcttgcttacttgtgtacctgtgaatctctttgtattgattgttttgctgtcccttgctttgtaaagtttaaaaagttgcaagttcagttaaaaattagttgtgaaatgtttgttgccttgtctttatttttgctagagatatttgcagattcgtgagaacttctctgtaagtataatctcgttgtgttactttttgttgttgttgttgcaggagatcctgcaaatgatgcattaccgtatccatttttaagccaactcttacaaaatggtaaaaagaaatcaggtgtatattgtttcttgacattgatcttagtttgtcttggtttgtctcatcttatgactatgatgtggtagcttgcatgttgtatacggttgatacacacaagcttgatttctctatgtgcacttcttgtagttgcgtatgaagaagaacagtgctatctatctagattctagagtaatttgtatataataatagagtactaccaattgatactgagccttaatgggagcatctacttgtcttgtgttgttttctttttctcttcaatcattgttctgttatcgtcattagtgtaccttccttgttaaagccggattgtagatatcactgaatccatgtttcttatatatatggctttattgctgcagtgtcttttattatgataataatcacttgatacgtggtaatatctatctataggatgttttcacttcttgtctaatgtctacttactatttattacgtggggttttcttgcaggaacttgcggctacttgtgccactgcggttaagtcaagtaagcatgtagatggaagaatagtgaccagccgttgagtcaagagtgcagacaggtagatccttgcgctctcttggtcaactgcagctacttactatcttggatccttgccctccaaaactgctctgctaaaacgttggtagctctctgggaagatgaggaactaaagtcattggctcctctggctccctcagctatacatggaagaccatgaatgaatctagaggagagaagctcagcaacggtcaacagagcataacaaatgcgtatggcttcagtgacgatcccgggccatttcttagatttctgagagagacagagtggctgaatgagaatgatcatagacattgtttctctcttggtatcaagagaggagatggtgaaagtaatctgaatgtttcttggatcacaagattcaagtactctacgttatgtagatcttcttctgtgattcaagtatataccgattagaactattttttccttgaaagtacagaacaaaagtgttgttgaattattttacttgtaaaaccaaaaacataaccaaggaaatgaagattatgccgttaaaattcttctcttttggtcgaacgttggagtttttttcctgataaatagtgtgcaaggcacgtgagggaaaagagaaggaagcttgtggaagaagtgaaggctcatttgtttggtatgatgtgtaaataaaaaaaaggttgatttgcgcagaaagagacttcatgaacctgatggtgtgcatgaagcacagaccctctcactgacctatcaagactctagcggccaactccatgtaccgaccgaaacaggggaagctctgttgagaaagctggagaccacaatctcggacatagtttcaggttgtttttgcaatgtaggacaagtgtttgttgacagctgtagaagtgagctaagaggacctcctcctcatcctcctgcaaatatgaacaactcaagatgcgagtaagtgagtttgcaagaaactgtcccaagctgacgagctgtgacacaacccatagttattgtcttctcacgagaatggaaaatcaaagaaagataaggtttggaaatgctctgatacaaatgtgtctggctctaatggcttgcatgatcacttggtttcatcatagaggtgacaaattcagcatttgtgtcgtcttcacttgtactaagggtgtctgagcaagaaacctacctacagaactagtgaaggctaatatgctctgcaaaatgcaacatgttcatataactttcgagaacaaaacgggtcacaataagataacacaaagatgagatcgatcttttgtaaggaaacacaaaactaaactagagagcatgaaaacccttatctaatgtataattcaatttcacaatgaccaaggcgaagaatcactcattagtagaaccatgaaacaggaacaacactctatgaacattcaattttcccatgtaaacttagtccgtttttgatcagattcctctgtattttttgtattttattttcaagaaaaaagaaacgaggactttaaattcaaaataagcaagagcgagccaggccacgtgtcagcgctgatgtgactaacgtctttttgtgtttcctctgatgatatatattcatcatcgttcacgctctttctctacttaaaagaaagaaagaaaacctcaagaaaccctcaaagatg

SEQ ID NO: 35138 - DNA, 3003 bp, Unknown; identical to SEQ ID NO: 28403
  misc_feature (1)..( 3003): 2750-1469P.txt file - cDNA_ID_3084901; gDNA_ID_2926262; Annot_ID_204791

SEQ ID NO: 35139 - DNA, 3003 bp, Unknown; identical to SEQ ID NO: 28402
  misc_feature (1)..( 3003): 2750-1469P.txt file - cDNA_ID_3084913; gDNA_ID_2926262; Annot_ID_204787

SEQ ID NO: 35140 - DNA, 3003 bp, Unknown; identical to SEQ ID NO: 28265
  misc_feature (1)..( 3003): 2750-1469P.txt file - cDNA_ID_3084917; gDNA_ID_2926262; Annot_ID_204786

SEQ ID NO: 35141 - DNA, 3000 bp, Unknown
  misc_feature (1)..( 3000): 2750-1469P.txt file - cDNA_ID_3084919; gDNA_ID_2926262; Annot_ID_204785
caacgtacaaagccgtttcaccggactggttttgctcggccaacaactctttcagctccacgccgtcgtgttctccgatcatctccaaaagaaggtccgttttgccttctctaaccgccgtgtgtaacggcgtgtcgtcacgtcttgccgtcatctgcttcgtcatcgtcttcttgatctctttcatgattgatgatgattctgtttaaagaatctttgggattaaaaaaagtttggcggaaatttagatcgagatagggaggtctacatgagtagatttgaggaagattcagacaagagtaacatgaattctctggacaagaaacaacaaaatatattattacctcttaactatgctcgtggttttggctgcttgtgttatatcacatagacatatcttaaaactatcttaatacaacaaacaacacatgatcaaaccttagtgtccactcgaagcattatttttgtttgtttttctatttgaaaacaaaaaacaatcagatttaggtcaacaaacaaatcatgagtatatttgaataaaatgtttatcaaaaccaacagaatcaactttaaatgttctccgtgccactaattcactaaaatgaaatttgcgatggatttagtcatttagacattttttcaaagaaaaccaaaaaacaattggcgatagaaagtgacatatgaagaaaataataaatgagtctccattattggggttttctgtgtgaacgtggtaaaatatccgacgattatgaatttatgataccaaccaaccatgaaaataacactggtccaaagtgaaaatagatttcacattcacaagctccaagtctcgaaatccaaatatgaatcaacaaatagtgtttgagacttgcatattcgtcttgaccgcatagcgcagtggattagcgcgtttgacttcggatcaaaaggtcgtgggttcgactcccactgtggtcgtttaagactttaagtacttgttcttttctttttcctgattttatctattttggccgatacgtatcagaaattctccgtataaatcaaccatgttcgtttacaatccttcattcaatcgtcccttaactctaaacaaccgaaaaatcaaaatttaccaaagagacaacaaaacccagaataaattcaatatttatgaaatactaatgattttagagaggttgtgtgataacaaaacttcagtacaactaaaattaataaggttggacaaaaagagaggagataacataagccgataatcaaaggctgaatcattcatttctagaagctagagctgggagaatgaaactacactttgatagcgtacttcctcactgggaaatacatctccttcttcttctcacgctctgtcttcaacgaagcctgttaccacaaacaccataagttattatgattgctaatttgctatccaattcaaaagaacattatataattggaaatggtaattcgggtaaagacctgatgcttggtgagacgtctacggatagctcgtgttttcttgggacggagatcaagaggcaagagcttcttgttcttgtatgcctctcttaaagcagatttctgcttctgggagatcactgtcaacacctgagcaatggatttcctcacaaccttgctggatatcaataacacacaactttcaatcaatgacttgtcaaaccgaatccgactaaaccaaaataaggtgttcatcaactacatacaaggcccaaatttgattgatctaagatacatattcgagtcataagctaaatccacatccattctactgatgatatcccaaatgatgatacaaatgcaaattccaaaacagagcaccatatgttctcttactccaaattcttcaattactctaaatctaagtgaaatgtctccaaattggaaagtaacactaaatcctaacaaatgaggatatatatacacacatttcatatatacgtataagtagatatataaaagacatacattttggagagcttgttgggagcgcctccggtgactttagcgacacggaggagagcgagttcagccttgaattccttcaactgattctgaagatcggtctttgatttatctctaagctcatgaaccttaattctcgctatacaacaaaatcaaaccaaaacaaaaacaaatccaatcagaatcacgcaattgaagaatcaaaagaaacgaacacgaattagattaaggattataaggatctgttcttcgtcatacccatcgtgagtgttgagaactgatgtgccgcctatttgctcttttctggctccaaaccctaattttgttgaagaagaaaatttatacgatgcctttgtgaaatcgatttgagttagaaaaccctcgtgattctcttggcaaatataatgggccgtgtaatagcccaatagttatttccacaaaacatgggctttttattaaagaacatttaattgggtcgtcgtatgccgaaaagagaaaaggtgtgaatagtgaaagctaatacgaataaattcgtcaataaaacccataagcatcagattctgattattttttgtttgtgagaatgagattcggaactatcattaagggttggcaaaaagaattggcctttctattttctttttggtgttttaaaaaaatatgattttctaacaaaatgattttttttttcttcttcttctatctaaaagagagtaaactacactgtatttatttgtagtagatggtccaaaaatcgtcagttcaatcgaatcaaaataatttcacacggtttctaggtctactagcaatcaatctctcacacattggtttgataagaatacgaataaacttacttttttctaaagtcgattccatcacccaaaaaaatatctttaactcgaacctaaaaatatgtacatttttaattgattttatatgtgactatagaaatctctccacattttcattgcaaacactaaagactttttcttaaatttcttgtaaaccatacaaaacatg

SEQ ID NO: 35142 - DNA, 3003 bp, Unknown; identical to SEQ ID NO: 28400
  misc_feature (1)..( 3003): 2750-1469P.txt file - cDNA_ID_3084923; gDNA_ID_2926262; Annot_ID_204784

SEQ ID NO: 35143 - DNA, 3003 bp, Unknown; identical to SEQ ID NO: 28396
  misc_feature (1)..( 3003): 2750-1469P.txt file - cDNA_ID_3084934; gDNA_ID_2926262; Annot_ID_204778

SEQ ID NO: 35144 - DNA, 3003 bp, Unknown; identical to SEQ ID NO: 28395
  misc_feature (1)..( 3003): 2750-1469P.txt file - cDNA_ID_3084938; gDNA_ID_2926262; Annot_ID_204776

SEQ ID NO: 35145 - DNA, 3000 bp, Unknown
  misc_feature (1)..( 3000): 2750-1469P.txt file - cDNA_ID_3084945; gDNA_ID_2926262; Annot_ID_143237
ttccagcttacttcaacgactctcagcgtcaggctacaaaggatgctggtgtcatcgctggtttgaacgttatgcgaatcatcaacgagcctacagccgccgctattgcctacggtcttgacaaaaaggctaccagcgttggagagaagaatgttcttatcttcgatcttggtggtggcacttttgatgtctctcttcttaccattgaagagggtatctttgaggtgaaggcaactgctggtgacacccatcttggtggggaagattttgacaacagaatggttaaccactttgtccaagagttcaagaggaagagtaagaaggatatcaccggtaacccaagagctcttaggaggttgagaacttcctgtgagagagcgaagaggactctttcttccactgctcagaccaccatcgagattgactctctatacgagggtatcgacttctactccaccatcacccgtgctagatttgaggagctcaacatggatctcttcaggaagtgtatggagccagttgagaagtgtcttcgtgatgctaagatggacaagagcactgttcatgatgttgtccttgttggtggttctacccgtatccctaaggttcagcaattgctccaggacttcttcaacggcaaagagctttgcaagtctattaaccctgatgaggctgttgcctacggtgctgctgtccagggagctattctcagcggtgaaggaaacgagaaggttcaagatcttctattgctcgatgtcactcctctctcccttggtttggaaactgccggtggtgtcatgaccactttgatcccaaggaacacaaccatcccaaccaagaaggaacaagtcttctccacctactcagacaaccaacccggtgtgttgatccaggtgtacgaaggagagagagccagaaccaaggacaacaaccttcttggtaaatttgagctctccggaattcctccagctcctcgtggtgtcccccagatcacagtctgctttgacattgatgccaatggtatcctcaatgtctctgctgaggacaagaccaccggacagaagaacaagatcaccatcaccaatgacaagggtcgtctctccaaggatgagattgagaagatggttcaagaggctgagaagtacaagtccgaagacgaggagcacaagaagaaggttgaagccaagaacgctctcgagaactacgcttacaacatgaggaacaccatccaagacgagaagattggtgagaagctcccggctgcagacaagaagaagatcgaggattctattgagcaggcgattcaatggctcgagggtaaccagttggctgaggctgatgagttcgaagacaagatgaaggaattggagagcatctgcaacccaatcattgccaagatgtaccaaggagctggtggtgaagccggtggtccaggtgcctctggtatggacgatgatgctccccctgcttcaggcggtgctggacctaagatcgaggaggtcgactaatttgttggacattgacctctctctttctcctatctctatctcttttacttgcttttttttgatctgttaagactttttatgttgggcttttttaaagaagcccattttgtggtgttttttggttagtactattttgaacaatggttggttctataccagtttagctacgatgacggataaaattaaaagtttgccattttctctcttattttggttatggtgtttgttcccttccaatctcgtaggtgaaacatgacttgttgtttgaaatgggaagtatttcccaaatggcataacataaaaattacttagagaaggaaccaacgataataattaattaatcaattacgagaaacccattttttattatgacatttgttgaatttatcatttctaacacagactaaagtcaattttacccttgttttgttgaaaagaaaaaaatctaaatctttttcccccacaaaatcctaaaacaaaattgatctctccatgtagtgttctccacgacgagatctggtgacaactccagtttaagcaagaccaaaagacttgaagagataaaaagctattaaatcaatctctttttctttgggtttttattagtgaaaagaaagtagaaaaaaaatctcaaagctttcatgaattggaagtttcaaatttggtttagatttgaagagataaattggaagtttttattaaattaatgttgatcaaaagcctagtgaatcttaagcattcaatttagttggtctatgtgaatgtgttgttgatgcttatttattttatttttttggtcaaccttgatgctttggttatagctttggatttgtgattttatctggattttttactttgatgttttatgctttatttcaaaactatatacgaagctacggatatttgaaacatatacaaaacagtgaaatcagtaggactgtgaattttcttatcctcaaagcctttgtagtgtaacagacaaatcaaataaatagcttcgcttatacctatgcccaatcagtaaaaagaaaagcctcacctcggcccacagccaatgacagcctttagtatgtcttactggcccattactctactacgaaatcttacgtgtcaagtaataaataaatcgaccccacatatgaacgttatagagcagttttccaattttcaacacgcgcttttcagtttttggacaatatcactttttcccttttcaaaatttggacaatatcagttttttcctctttttttccaggaacatatttgcctaggatttggaaaaggaatctatcacttagctaccgtcagatcaacctcaaacataatccaacggttataaataattacagaacattctggaaactcaagtctcagccttataaaaaacaagacttcaacgctctttcttcacaaacctaaaaacctagctctattctttctctttgctgctcttaaactttttcttagctttttctatcttcgtgtgataatg

SEQ ID NO: 35146 - DNA, 3000 bp, Unknown; identical to SEQ ID NO: 35145
  misc_feature (1)..( 3000): 2750-1469P.txt file - cDNA_ID_3084945; gDNA_ID_2926262; Annot_ID_204772

SEQ ID NO: 35147 - DNA, 3003 bp, Unknown; identical to SEQ ID NO: 28416
  misc_feature (1)..( 3003): 2750-1469P.txt file - cDNA_ID_3084983; gDNA_ID_2926263; Annot_ID_204836

SEQ ID NO: 35148 - DNA, 3003 bp, Unknown; identical to SEQ ID NO: 28415
  misc_feature (1)..( 3003): 2750-1469P.txt file - cDNA_ID_3084987; gDNA_ID_2926263; Annot_ID_204835

SEQ ID NO: 35149 - DNA, 3003 bp, Unknown; identical to SEQ ID NO: 28412
  misc_feature (1)..( 3003): 2750-1469P.txt file - cDNA_ID_3084991; gDNA_ID_2926263; Annot_ID_204833

SEQ ID NO: 35150 - DNA, 3003 bp, Unknown; identical to SEQ ID NO: 27704
  misc_feature (1)..( 3003): 2750-1469P.txt file - cDNA_ID_3084999; gDNA_ID_2926263; Annot_ID_204829

SEQ ID NO: 35151 - DNA, 3003 bp, Unknown; identical to SEQ ID NO: 28409
  misc_feature (1)..( 3003): 2750-1469P.txt file - cDNA_ID_3085003; gDNA_ID_2926263; Annot_ID_204828

SEQ ID NO: 35152 - DNA, 3000 bp, Unknown; identical to SEQ ID NO: 28408
  misc_feature (1)..( 3000): 2750-1469P.txt file - cDNA_ID_3085007; gDNA_ID_2926263; Annot_ID_204827

SEQ ID NO: 35153 - DNA, 3003 bp, Unknown; identical to SEQ ID NO: 28407
  misc_feature (1)..( 3003): 2750-1469P.txt file - cDNA_ID_3085011; gDNA_ID_2926263; Annot_ID_204824

SEQ ID NO: 35154 - DNA, 3003 bp, Unknown
  misc_feature (1)..( 3003): 2750-1469P.txt file - cDNA_ID_3085041; gDNA_ID_2926264; Annot_ID_143299
aattatatataatgtagaggatcgagcactaatcatacacttttgtcctctgccccttacagatggcaatcaagaaactgaaccattagatgagaaactaatggatgggtgagggcaactaacaattgtttttaacatcattcatgatccaacttgggtggcagcgaacaagtaaaactaatctctcacttctagtgtgcagaatcgaaatgaattgcagttggtataaaaactgacaagcctctcattgacgtgcaaggaatgtcgaatataaaccatcgagatcataaccaaatagaagaagacaaacaacacatggtctctccaaattttacgacatagcatcatcttctgtacaaatgtgaaagatatattagacaagtagaaaaactgaaatcataattacctctttaagatttacccattcccaggtttcattcgcagagttaatatcatacactaaagcatgacgcccctaatcaatgttgaaaaaaggaaataaatgatatcagaaaacggagatttggcactaaaacactaatatatagcaatgaaagataagatacctcaacagggttgtagtcagttataacagcttcgtagtattggttgtcatcaggccacttcgtccataccttccttccaaccaacgggtcatatgatcccgattcacctggttcatttgttaaagcgccagcctggggccttccagcaatgcctgtagatgggtactgcatcgacttcatcgagcacaaagaatgaaatattcttataccttagtcaatgaagaatataagaacaagattgacggtaccaacaattagaatcaagcagcatcatgacttactgtctttggcttcttggtctttggacctggtggaggacctccccttcttagtgcagatgacgatggttgcattgaagggtgcaaagaaggagatggtgggcccatcgctaatgaggcgattgattgtgatgtcttttgcttcttacgtgatcctgatacagccggactcggagcatcatgaaccagctgaggaacactagactgaaggctgtttgcctttctccattccctgacatgatttaaattaaccttgttggcttacttttgattgattgcagagatttatcagtgatcaattacatatacaacagaccttattcgcctgatcatttcatcagcgttaacccttgataacagctctctgtgttcctcatcagacactcgaagttcttttctgagttcagtgatcaaactttctttctcctgaatattttttttccagccgaaggaacaagaataaaaaaaggacaaaaggtaagcttgtgaagttacataaacatgtactaaactaatgaagaagacaagcaaaatagtacccaggtaatagcatcggactgggctttaaatgcgcggagtatcgagctataagcttcttgctcaatgagatgaatttgagtttccatttcattgtgcacccgtgataaaggagcagaattgagaactgaaggccttccattcccggtaggtctggcgtttctttgatatctaccttgatgagatggaggcaggtcatcatctgtacctgagttcccgcataaaaaaacatatcacaaaacacacggaaacaaatacggaagtaaaataaacttagagaaggaacgaatgcttctaactgaaaaagcacataagactcaccactactatcagaaggtcggtaatccatctgtgtactctcctgattattctttacagtgaacctaagaaatcaaaacgtgggatgtggcctgtctagttgcaccaaagcacgagctgcaagaccaagaaaacaacttcaaaggaggaaaaagccaaagcattcactcacatgcagagcatacgaagacgaaaagcaagaactttgaactttaaaccttgacacagaaaattaaactatccaaaacactggtcaaagttcttaaactcaagctaaacagacaaacatgttgccttctgcagattaaacaacagaaattgaatttctactaaacttgtgaaaaaattatttccaattaaagaacaacactttcctaaaccctaaaattcccgacgaaacctagcacatcaatgctagctttcaagatgaacaaaacttaaattgcgcagaaagaatgtaagatcgaaaagcaaaataccttctttggatctattctcgaaaaattcgaacagccatcgagaaaattactccctaaagatcatatagatttgagcgagaaagcagacaacacaaatctataaattagaagatccgaacaaaggacgattcttataggcaatctctcggctccaatccgaattcaccaacgttagatctccaggaagcagaaagaacgccgtggaattgaagaattacagaacaaatcgtgatgaattttccgagggatctatgagtcgcggacgtgaaacccacattattttgtgccctaattttttctcagttgataggttggtttgagttacacgaacgacggcaagttttgtcgtttcactctcatctttctatctcttttggttctgtcttaaacccgaacttcggtacactttcataccaacacttctgtttttgttttttttttgtttttaacatcatattttctgtgtaataattaatctcaaaaaagcatgttataattcagttttatttaccaacaagaatcgatttggctgcaaataaaaaagacaaaataataaataaaccgacattgtgaaaatgttctgaaccggaaaagtcaaagaatgtcggttcggtccaaaatcgaaaattaaacaagttccaatagaaaaatgtgaacaaagggaaaaaggaagaagaaatgttgttgcgtgtgtgttgtccgtcgtctttcttctacctccgaccgcttcatctcttcagttcaactgcgaaagttcctttttgtccctctcttcccagacaatttcgattaagcccttctcgatcttcttcctttcgtcggatg

SEQ ID NO: 35155 - DNA, 3003 bp, Unknown
  misc_feature (1)..( 3003): 2750-1469P.txt file - cDNA_ID_3085041; gDNA_ID_2926264; Annot_ID_204876
tctgatatctcccggagatatctatgatatatatatatataaagaacattcagaatcatatgtaaccaagtatccaagaatgagatgagctcttaaaacatacttttgagatgatatatatatatatatataaagaacattcagaattatatataatgtagaggatcgagcactaatcatacacttttgtcctctgccccttacagatggcaatcaagaaactgaaccattagatgagaaactaatggatgggtgagggcaactaacaattgtttttaacatcattcatgatccaacttgggtggcagcgaacaagtaaaactaatctctcacttctagtgtgcagaatcgaaatgaattgcagttggtataaaaactgacaagcctctcattgacgtgcaaggaatgtcgaatataaaccatcgagatcataaccaaatagaagaagacaaacaacacatggtctctccaaattttacgacatagcatcatcttctgtacaaatgtgaaagatatattagacaagtagaaaaactgaaatcataattacctctttaagatttacccattcccaggtttcattcgcagagttaatatcatacactaaagcatgacgcccctaatcaatgttgaaaaaaggaaataaatgatatcagaaaacggagatttggcactaaaacactaatatatagcaatgaaagataagatacctcaacagggttgtagtcagttataacagcttcgtagtattggttgtcatcaggccacttcgtccataccttccttccaaccaacgggtcatatgatcccgattcacctggttcatttgttaaagcgccagcctggggccttccagcaatgcctgtagatgggtactgcatcgacttcatcgagcacaaagaatgaaatattcttataccttagtcaatgaagaatataagaacaagattgacggtaccaacaattagaatcaagcagcatcatgacttactgtctttggcttcttggtctttggacctggtggaggacctccccttcttagtgcagatgacgatggttgcattgaagggtgcaaagaaggagatggtgggcccatcgctaatgaggcgattgattgtgatgtcttttgcttcttacgtgatcctgatacagccggactcggagcatcatgaaccagctgaggaacactagactgaaggctgtttgcctttctccattccctgacatgatttaaattaaccttgttggcttacttttgattgattgcagagatttatcagtgatcaattacatatacaacagaccttattcgcctgatcatttcatcagcgttaacccttgataacagctctctgtgttcctcatcagacactcgaagttcttttctgagttcagtgatcaaactttctttctcctgaatattttttttccagccgaaggaacaagaataaaaaaaggacaaaaggtaagcttgtgaagttacataaacatgtactaaactaatgaagaagacaagcaaaatagtacccaggtaatagcatcggactgggctttaaatgcgcggagtatcgagctataagcttcttgctcaatgagatgaatttgagtttccatttcattgtgcacccgtgataaaggagcagaattgagaactgaaggccttccattcccggtaggtctggcgtttctttgatatctaccttgatgagatggaggcaggtcatcatctgtacctgagttcccgcataaaaaaacatatcacaaaacacacggaaacaaatacggaagtaaaataaacttagagaaggaacgaatgcttctaactgaaaaagcacataagactcaccactactatcagaaggtcggtaatccatctgtgtactctcctgattattctttacagtgaacctaagaaatcaaaacgtgggatgtggcctgtctagttgcaccaaagcacgagctgcaagaccaagaaaacaacttcaaaggaggaaaaagccaaagcattcactcacatgcagagcatacgaagacgaaaagcaagaactttgaactttaaaccttgacacagaaaattaaactatccaaaacactggtcaaagttcttaaactcaagctaaacagacaaacatgttgccttctgcagattaaacaacagaaattgaatttctactaaacttgtgaaaaaattatttccaattaaagaacaacactttcctaaaccctaaaattcccgacgaaacctagcacatcaatgctagctttcaagatgaacaaaacttaaattgcgcagaaagaatgtaagatcgaaaagcaaaataccttctttggatctattctcgaaaaattcgaacagccatcgagaaaattactccctaaagatcatatagatttgagcgagaaagcagacaacacaaatctataaattagaagatccgaacaaaggacgattcttataggcaatctctcggctccaatccgaattcaccaacgttagatctccaggaagcagaaagaacgccgtggaattgaagaattacagaacaaatcgtgatgaattttccgagggatctatgagtcgcggacgtgaaacccacattattttgtgccctaattttttctcagttgataggttggtttgagttacacgaacgacggcaagttttgtcgtttcactctcatctttctatctcttttggttctgtcttaaacccgaacttcggtacactttcataccaacacttctgtttttgttttttttttgtttttaacatcatattttctgtgtaataattaatctcaaaaaagcatgttataattcagttttatttaccaacaagaatcgatttggctgcaaataaaaaagacaaaataataaataaaccgacattgtgaaaatgttctgaaccggaaaagtcaaagaatgtcggttcggtccaaaatcgaaaattaaacaagttccaatagaaaaatgtgaacaaagggaaaaaggaagaagaaatg

SEQ ID NO: 35156 - DNA, 3003 bp, Unknown
  misc_feature (1)..( 3003): 2750-1469P.txt file - cDNA_ID_3085049; gDNA_ID_2926264; Annot_ID_204874
atttaaggcctaccatctgaatcacttcataaataggagtcacaactttcctcaagaatgcatcttcctcgcctccataagctggcttcacattttccccagtcataggactaacattcccagccagcataccatagagttcaaatgccatctgcgaaagcatgaaatagagtaggaagtataagaatatcacatctaggaacgcatactagcaaaaaatctgtgtatttatcaaaagaaagcatggtaccctgagcacaattgacatttaaccaacattctaatttctaaggggaataatatcaattgacattttctcatcagaaatacgtcaacctgagcacatatacacatgttttgcctcaaaacaagactcagatgacaattttattactgtgcgtgcaagttatagctccttagcagaaatataaacaacaaaagatataactttcaaggattaagaatgacagtaaagcataagattatcattggcggacaagcataaaaatacaagaatcacgcacaaactacggaagaccttacaaactgaaacttacatgatgataaatgtagcagagacactctggcatgaatctcaagttcgctgcttcaccccaaattagaagatacagggccatatacaatagtttgcgctgctgcatttcctgctgtatagttggcaacctacaagaagatcatactttaaaacagattctccacaccagagtttgcataaacatttagacacacacacgaaatctaattcctgtacatgaacagcatacagaaactctctgttgctacaattcccttaccaaagactactctttcgaccaaggtatttgcaccatttcttatagttcttgaaaagcttcttcatcacttctgtcaatgcttgatcatctaactgtgagggcacaatgagaacaaacgaaaggataaactgaaagtacattcattaaatattatgctcatagtaggatgcagttacatatatattccatggaaaaaaaatgtactgcgcagaaatgtcctacatgcatggacacacgaaacctatataaaagtggtctttcaacaatggtaaaattaaggtataaacctttggctgctgatcaggcttaggaaattgtcttatatgcacattagcaagtaataagatcagatgctccctttgattagccacattgtctttctgcagaaccatagcataaacaagaaaaattgcatgttagcaagtaataagattaagtgctcctaagattagctgcattgtctttccgccaaaccattaaagaatttatagattactctcaacaaaagcttaatgacaattggcaagcatcacgaactagaaaaattacctgaaatccaaacatttcttgaagccaatcaagcatgtcttcatctttctttttcttgtgaccttctggccaaggaagacctctagtattgcggagagcaagaacagcagcttggatctgcagtaaggattacatcacccgctgataacatattacaaataataacaatgcccaacaagaagaggactaacctcaggatatctcataatcgcttgattggcactatcaggatcgagaggtaggatattataggggacatacaactgtgtcttttctgcaaccttatcttgagcttccagaatctggaaccattcaacttcattgtaaagttgcacaagagatggaaaaaaaaaagagacaggactagaaggtcacaatgccttacctcccggtcaacctcaatggactgtgtcagattaacagccttcaacacctcaaacaaaacattggcagtttggtatgcctttgtcagctgggcactgaaaattaacagcacttcaaagtatcattaagagaatttagtgctctcaaacactggcaaaacacaaattagcatcttaaaaagacaatttaagtaagttagacataccggtcagccttatcagcagcattgtgcaaagcttgaatatacttcttatagtagtgttgataaaagctttgcatttcacgggcatcacttttcttaaccctgcccatcagtgttggatcatgttcctgcaaaaaaatcaaagcaacagtagaccacatttgtcaaagaaaagtactaaaaccaagattccttctaatagctatccaaatctgccacatgcaagaatcaagcagagtataaagaatgctcactctttcaagacgctgtagaagtgcagtcttaaactgccgaacacctcttccactggaggtaggatccaatctatgtgctttctcaaatgcataaaaccgacctaagggagaaagcagaaccaaaaaccagataaacaaccaaatgacagagaaccaaattaagaaataagttttagaagaacttacagagatacgcaaccctaggattactagattcaacttcattagcaacccgaagaatgggggcaatctcaacaagagatgatggaacaacttcactatcgaatgactctccaagattaccagcagtctgagttcgtataatccgccgctgctgaggctgagacggcccttgatcaggacctcctctcgtagcagacattttgtctaccctataacctccaggttttaaatcgttttaaggtttcctcagcctccctgaaaacaaacaaaagtcattagacgaagatggttaaaaatcaacagtgacgaacagagatgcaacattgagaagaacatacagagaaacggagatccagaaaccctaacaatggcggagcaaaggagccacaactttttaagctacttagctgctaagtacgcaaagtgaaagggagagagagagagcagtctgaaatgaatgtttttttgtatttatcttccttttttaagcaccgctttaatagacacaaaaataaaaagaaattttaaaaaggacactttcgaaggtcgtgtccagaaaaaggctctaccttccatttaattacagtaacaccaccaagtttaaactgtggcaatg

SEQ ID NO: 35157 - DNA, 3000 bp, Unknown; identical to SEQ ID NO: 28420
  misc_feature (1)..( 3000): 2750-1469P.txt file - cDNA_ID_3085053; gDNA_ID_2926264; Annot_ID_204873

SEQ ID NO: 35158 - DNA, 3000 bp, Unknown; identical to SEQ ID NO: 28419
  misc_feature (1)..( 3000): 2750-1469P.txt file - cDNA_ID_3085061; gDNA_ID_2926264; Annot_ID_204871

SEQ ID NO: 35159 - DNA, 3003 bp, Unknown
  misc_feature (1)..( 3003): 2750-1469P.txt file - cDNA_ID_3085069; gDNA_ID_2926264; Annot_ID_143292
ggaacatcagtcagtgagttctggtactaccattacctgactttagtctttggttcattgtaacatgactttttgttttaagttctaaccatgatttgggaatggtaatattaggcaagatcccaagagaatggcgactgcactgcaaactgaaaacgaggaatcatgtactacttataacatgctcaaggtaggattttaaacttttccccctctttctatttgctcaaggtaacatactaacatatcaacacttgtacaatttcaggtctctaggaatctgttcagatggacaaaagaggttagctatgcagactattacgagcgcgccttgaccaacggcgtgttgggaattcaaagaggaacccagcctggactgatgatctacatgctcccattaggtaaaggtgtttctaaggctgtgacttatcacggttggggaacaccttatgattccttctggtgttgctatggcactggtaaactcttaaccacaattcatctggttttctacatttttgtaagatacaaaagtaagataaattttgagggtctttttttgtttctgtccacaggaattgaatccttctcaaaactgggagattccatatattttcaagaagatggtgcaactccagctctttatgtcacccaatatatatcaagctcacttgattggaaatctgctggtctttcaatatctcagaaagttaatcctgttgtgtcgtgggatccgtacatgcgtgtgacattcactctttcttcttccaaagtggtaaaacttttgcacaacttgatgcaacatgttacattgaagaaagagtctgatggatccaattttgttgcagggagtggcgaaggagtcgactttgaatctaagaattcctgtttggactaactctataggtgccaaagtatctttgaatgggcgacccttaaacgtaccaacttcaggtgatttgagcattaggttctaaaaagcagaactcgcttgactgttacagtctctagtttgtgaaatgagaatcatattgtacctgtctttttctttgcaggtaatttcctatcaatcaaacagaaatggaaatctggtgatcaagtaaccatggagctaccaatgagtatcagaaccgaagctataaaaggtataaacacacagttttgcttttgtagactggtacccttactccggcaatctataactagcagtatatgtataaattgtatgcaactctgttttgacattattttgtgagtatttcagatgatcggccagagtacgcatctcttcaagccatactctatggcccctacttgttagccggacacacgagcagggactggagcatcacaactcaggctaaacctggaaaatggataacccctatacctgaaactcaaaacagttaccttgtcacactctcacaacaatctggaaacgtatcttacgtgttttcaaatagcaaccaaaccatcacaatgagagtatcacccgagccagggacacaagatgccgttgcagcgactttcaggctcgtgactgataattctaaaccacggatttcgggtccagaaggactaattggaaggctggtcatgcttgagccgtttgatttccctggcatgattgtaaagcaagcaactgatagctccctcacagttcaagcttcttctcctagtgacaaaggagcttctagctttcggttagtatctggacttgacgggaagctaggaagcgtttcgttaagactagagagcaaaaaaggttgttttgtgtacagcgatcaaaccctaaagcaagggacaaaactaaggctagaatgtggttcggatgcgactgatgagaagtttaaagaggcagcaagctttagtttaaagacaggaatgcatcaatacaatccaatgagtttcgtgatgagcggaacacagaggaactttgtgttatcgccattgtttagcttaagagatgaaacatacaatgtgtacttcagtgtgcaaacttgaagaaagaaacccttattgggtgaaaatataagaaagaaaagtctcatttgaaatatagacatgtgtttagatgtttagcctcttaggtttgtttgtgattttgtgttctgcaatgtcatctaaaaatgtatgttgctgttacaataaatataaacaaatgtgtttttataaattgtgctaacgatgaatccatgtctttctttatattctaaatatagagtggagaatagtgtgttgccttgagctttcatgaaataatattctcatatgtgatctgttgcagaaattagaataccatagttattgtatcaaaatatccaacacatgaaaagtaaaatatccaacaaaatcacacgcataaacattacttacgaatacgatagttattgtgtttatgcgtgtgattttcactttggtggagataacttctatagaagaggggagaatattatacagtattttggaaatatgttataattttggagaaatcacaaatcaaagtttataattacattcagggagattttacaagattatagaaaaactttataagattttggaaaaactaatcatagaaattatacaaaattctctagtaatcatttaaaatctttgacatatctactttctatattttttaaaagtcattaaaattctttcaaaatcacaaaccaataacacccccttaatctttttttacaacaaatcctcctctgtttttatccaaatcctctctgtttttatccaaatcctcctctgtttttctctttcacttgattgaattctttttttagcagacattgcttcaatcgttagaaaatctatttttggcacacattttctttagaaatcttttgctttataaacatctcttctcattattttcttcttccatttcaaatcccctctccctaacagttttgagtctcttggattctgaacgtgggatctggggatttgaatagttacacttttttgtttatgaaaaaacatacgatg

SEQ ID NO: 35160 - DNA, 3003 bp, Unknown; identical to SEQ ID NO: 35159
  misc_feature (1)..( 3003): 2750-1469P.txt file - cDNA_ID_3085069; gDNA_ID_2926264; Annot_ID_204869

SEQ ID NO: 35161 - DNA, 3003 bp, Unknown
  misc_feature (1)..( 3003): 2750-1469P.txt file - cDNA_ID_3085073; gDNA_ID_2926264; Annot_ID_143291
taacaagtttgtgtgcaaagtatgctttgaagcatcctattagttaaaaatattaatggtccatgctgattgtaaaatttctagtaataattgtttcaacgtaactggttttagacaaacgtattgacatatgcttacaaaagcctgtttcttaagtgttgaggaagactttctctcaaagtattcttgtatgagctttctatgttctacaataatttcataaaactcatcgattaactattaagtattccaattattgtagggtaaatgtatttaactaccatatcgttgaaaagataaaaaatatatatatatatggtcttacaattagagacttgctcggtcttggtcttactaactaatcccccttccactatatatgtgcaataagtttcttagcaagattagtctcaccaactcgaagcattggaatggataaagatatacttttgacatacttttgaactattagtatgagtttaaataaaatcaattcttcgacaccaactagagttgagttatatacatatgcattgacacacaaaaccttagtcctatacagtatattctacatagcttatcaactgaacaaggttactgcctttgtagcaatccaataaggcacaacaacatagtatttacgttttctcactacaacgttgctaaaatgttttttttttttatataggtattcagtaggtttattttttataatatcattcattttttatttctcccacagataccagatctttttaggaacattgtatttatggtacatgtatttttaaaacggatctaagatcggatccaaatatcttagttttaaaattaaggtatccgtatctaaatccataaagtctaaagacattaaattctagatgggttttcagatcttagatatttgattcacctctaatttctagaaggagtatatggcagtgtacaagtggtaagaaaagtaactcgtgtatcctttgcactatactcgaaaaagagacatttggtggttaagattgacgtgtacatgatgctcctttcttgaagcaacaaactaaactcgtcatcctaaatattcatttccttaaacttttttgaaccactgatttcccaaccaaaaaaaataaaaatctttagagagaattgatctaataattgacggcagcaaatatcttagccacctatgaaaataactaaattgtcggaatgtcgaaaagacttcatcttaaaattgacaaatgacgaatacatctaactaaccatccatcactcttcataaatacacaactactctttcagtgtatatcctcttattcaatattttggttaaatcttttattcttttatttacttttacactcataataattgcacatcagggaatatcgatattgatagtgttttgaggattatttagtaagtaaaaacctaattttagtttagtaaacagtaaaatatactaagagtgttaatagtttttctaaaaagtccataatatagatcgtcgaactataaatgtaatttgtacaaagagaatctcccttgaaaaagagaagacagaaacctcagaaggaatatatgacagtacaaacagtaaatgaatctcttacccactttagatatataattggggttgaaatagtcttcatttgtcgtaatatgtacatatgttctccaatctccatataccaaatagacatgagagaagagtgaagactatttcagcccagttcaacaaattgagttatagaatcatgtattgttatgctttgtaaaatgcatatgtataatatagttttagttttgcttagtaagacaagtttatcattcataataatacttttgtttgcatgctattttacaaaagagtttctctgatagatttgtcttcatttacatgtcatccttttcactatctctctttatgtcttcttcaagcatcgaagatatcaagcactaaaaaaagaaaagaagaaagaaatcaagcattgcagtcacatcgttctcacacaccaaatgatctaccagatgccattttattattaattacaaaactattaactactcatattaaatatttttgaataatgataatgcttttttatagtgcaaaattagaaaactagaattacatgtcatcctgttccagttagttgtgttccaaattccaatcattcaagcatatatatatttttcaaataggataaaatgaaataagtttctagtttaaaaataatgttaaaaacagttaaggttacaactttagtttataaacaaacagttaaggttacaaatttagtttataaaaaaacagttaagaatttaacacaccaaaagcacataaattagtgtatttatttagacggcatgcaaattaaaataattcttttagtttattataatttgtatgaatctccttcaaccttttttccccaaaactcctctcttcttctctgcaacgaaaaacctcttcttcttcttctctctctctatccattttcactaattagcgattaaaaaggattctttttgtgtgtattaattatcgcttaaatcttaaataattctcctaatcgtctctgcacgttggtgatggtgtttagttgtcaattctacatctcgaggaaatccagaaacagctcactgatctatcgaaacagttttttttctttttacagagtcaatagaacaaaaccagataacagagatagtgacaaaccatccgtgacctcctctgtttttatcctaatctctctgctttctctttcacgtgattgaattctttttctttgttagacattgcttaaatcttcacaactcttttgctttatatatgtctcttctcacattatcctcttcttcatattcaaatctcctctccctaactgttttatggtctcttggattctgaatttgggatcttggggtttcgggttttgaaccatctctttagactttagttacacttttttcattcttttttaagacaaaagagatacgatg

SEQ ID NO: 35162 - DNA, 3003 bp, Unknown; identical to SEQ ID NO: 35161
  misc_feature (1)..( 3003): 2750-1469P.txt file - cDNA_ID_3085073; gDNA_ID_2926264; Annot_ID_204868

SEQ ID NO: 35163 - DNA, 3000 bp, Unknown
  misc_feature (1)..( 3000): 2750-1469P.txt file - cDNA_ID_3085079; gDNA_ID_2926264; Annot_ID_143289
gaatttatttccgacgagatctaaatgtctcaagaaagggagattctcaatgcaactaggaatcacaccggagattcccttccaatcagcgatgatgataccggagagacgagtgagcttacatatagagggcgaaatggagccggtcattagtccgctccgtttcgccttttggaaaagcgggtcttcggattcacctcggagtgtaatgccggcgactcgacgggtgttgggatcgcagctcacaccataccagcctttgcaacagtctagacctttccatgtgttgaaaactccaatgtagggctcgttgagctttgctcggaactctagaagcgccgctcggtcggacggtaagcaagaatggacagtcgtggagagaagcaagaagacgacgacgttagtcaataggatcactaacgatttcttagtatccatagtgtagagaatcttttgtgtgatgtgttttttttttagctttacataggttgaagcacgttgacatggaagtgtgacttaactatatggttttatttatagtcacatattgatgggagtaaagacgacgaaatacttctttttgttgcttcgttgaaccttctcattttttgccacgtcgtcacatactttgcatgctcatttgtttcattattatcagacttttctttgtgtgtggtcaagattggatcattatgattcattacaaataacatggttttgtttgtctcggtcgcctggttgtactatctatgtcacaactcagaaggcctgagcatgttcttggttcgactctcccgagtctctccatacgtactggaatataagaattacagatttggctatatgagaccataatatttgaaaaatgagattaaagtaacaatcgtggcaagacatatattagtattagttcttttttcttgtctacattgaattttttggacataataatgagggacaacattcaagtggcttaagctacagcaattagtattatcctagctagtttcatatcttgtccataatactgtactttttgactagactagttcctactagtttttatttatgtatagatgcatgatttattaatatactgtcaaattcattgatcttatcgttgtagatgagcatgtgatctttgtccttggtagcaatttgtacataaataatatgaacccccatgtaaagatgtttattttttcgaccttcttgttcaaccttcgagtcaatgaataataaaaaaattgttttgttaattttttctacagtatgacacaatcctaatcattgtttgcaaattgcctccatgaaccataatttacctttgattggcattttctgctacggttttgattattatgtgcttgttttcgttgctgtctagtgacataaaatctgacgagcaacgactcaaattttttatttttttttgataaagaacaacgactcaaatatgtaaggttttattttgtcttgttcattttatcgtccatagaccagcggaagattaaactgttcgtttgttttcgtcaaacagaaacgctaatagattcaacctttagtgaaattatgtttgtagacgttgaaaatcaacttcttaattcaacaacgtagtttagcgtatttagttatttcccttgagatatatcttaaaattcatggtcggccctaaaaacaggacaggtttggagacagcagctagagtaaacgtgattcggagatttagtagttgttataattgtatcaagagatttagaaggaagtgtcaagtcagaagggtgacattaatggctttgattattcaaaagacaactcatgtgcccgcgcatgtgcttgacgttcgtttgccgtgtattagaactttaaaaactgattcatataaatcatcggtcgattgaaatatattaacatggattatgatgacaacaatcattatacaattaagttttatgaaatgatcatccacaaaacataacttttgtcggctatttttttgttgacgtgacaaactaaattagtaaactgtgttttgagtgcaaaaagatgagaaatttgtgggattgattgcatagaataacacttacaaaaatgtaggtagtatgcaggggagtcaacaacagacgacttttcataattcagaaaacgaagaaaaacaaaaagaaaggtcgatttcccaaggactagggcatagcacgtgtctatatcactggaggatatatcacttagaccgttagacgtcacgtgtaatcgtgtattaatgcttgcaaaatgtggttcaatcaaatacccaattaagggttatgagaactaatacaaaaatgtggttcccgtaaataatgcatgagcaagcacatgactgacatgagagatagaccagcgaataaaggttaagtattgacgcaccatgcaaagcgtaacggtgaactggagctctactggctgagataattcacaaggtgaaggtgagatatattttaggagagccagaaaggtagaacccaagacaaataaagagagagaccaagtgagttttggactaatgtttttcaaagaatgtgtctataactatttattaagttccaaaaaaagacaaataaaagtatgatttttctatataggactactcgattaatcttaacaaaaagacgaataagcagaaaacatatatgtttgttttttcaaaacaataaccttggaaatcaaaacaccagaaaaatgtggctgtgaagaaaagtacaagagagacagtaaaaagaaaatgaaccaaaaaggcaaaaaaatgaatacgtggcttcaatgtagacccagacgatgaacgtcgcatcaccttccttacgggggaaatctcacattttgaaattacagaaaactccaaagaacccaaaattgaatattgaatattgaaaattgaaaaaatctctctttgaagaattgaaatctctctttgaagacgaacgaacctcgttgattcctccattcctcttcggctcgtccatg

SEQ ID NO: 35164 - DNA, 3000 bp, Unknown; identical to SEQ ID NO: 35163
  misc_feature (1)..( 3000): 2750-1469P.txt file - cDNA_ID_3085079; gDNA_ID_2926264; Annot_ID_204865

SEQ ID NO: 35165 - DNA, 3000 bp, Unknown
  misc_feature (1)..( 3000): 2750-1469P.txt file - cDNA_ID_3085107; gDNA_ID_2926264; Annot_ID_143280
gtctttgtttttttttttaaatataatattttatacattttaaataaagaataatattttaaattctttggctagtggctcgactccaccacccataagctatgacttcgggttcgaatgccataaaaagtggggtttgaagaaaaagttaacaagaaaatgaaatttggaaattttcttcgtattagaaaaagaatccttatgcataccaatgatcgagtattcttttgtatgtcaaaagaatcctcatacacaccaatgatcggattgacaccagtcttcaatcacgtacgattgttattttatttggagtcgtacgttgaagtgaagtagatagtattatttcttgtatgttaggacttaggtttggtgtttatatatcgtgaattctctttgatttgatgtatatatatgtgtgtgtgtgtgtgtgatgcctattttacgattcgtattttaaaaagcttggttttgtgggtgtttatcactgcatgaattaaatgacgtacttatatgatgcatgtgacaagactatgaatcgacatatgttggataattatcatatgtatatgaaaagttaaggttggggaaaaaaaaagtcagtatgcgtgtatcaatgtatgatttgttgtagtatgtaatatagaatctaaacggattgcatgtcagtaccacatggatgtgcgggttaacgtttgttgtttcccacaaaaccgcgatagtaatcaagaaagttaaacggattgcatgtcagtatttactagttcgaaacttggttggtatgaactgcatgttaattatatttttaatgacttcaaagtgtttgcttaatgtttttagttatgattttatgtttaaattatagataatctctagaacaaaaccaaacgttttagcggttattttgatcaacaatatgattgatatatactaaagatggcatatctatagatgattataactaggtatacaaaataagtaaaccatagcatcttaaaaacaattctactataaacgatatttttgtttgtttgtgtagacctttgatattcattgatatcatcacttactgaaaaaataaaaaattgaataagcaaaaagctgaataccgacgactgtcgatccttaaactcacgaatcacgattgtcaaacgcacgctcacggctcacgggaagctttagccgctatgataaacggtatcttttatctaggcggccaaaactttgttcaccataacacttcaaacacaaatgtagaccattacacatatataatcaaatggtttccacttaatatatgttagtattcaaaataacaagatattttaaaagcataacaagagttagtgtctctattttctccccaccttctttctaaatataaatattgcgtatgattcatcattttcgcctttttttaatggctaacgttcggtggttgagtgtctgagtgtctgagtgtctgagtcatatgctatatattatgctttgtcattttccatatcatatttgtgtatccccttgtccatgaccgattaattaatttcgctctcacaacaaacacttcactagagaaaatataattaccatctgttcccctgaaacaatacataatcaatgatgatatcaacatcaagtgttatagtgagaaatgcacagcgaaatttctcaattcggtttagtattccaacaaataaatcaattattgttcacaaagacgatctggccaaaactcatataaatgttatgtgttatggatcctttaatctccgtaataacaccaaattactaaacttcgaacgtattttaccttttgtaaccatttaatatgattttaataaacttttcatagtttttttttttacctacaattatttatggaaaatatttttttcagttgtattattattattattttcttaaaacaactatatttttttcatgaagggaaaacactttatattattttgtgaaagaaagaaattacaaatattgaactaattaacttatttctttaacaaaaaaaaatcttttaattgtttttgccaatagggtccccacattttacaggtgtccctcgtcccagcccatcacttgcgtgtcacttggacccaaatttctcctgttttttaaaagaaatttaatttctttctagtatataagaaaaaacaaaacaaattaaaaatgaacctatgataacgtcagccggagaagatcccagatctgcgcgcgctggcatctttcatagagcgccacgtggcaaaaagatttttcactttcgtaagtgatcttatcaaatctcggtcttttgtgtaaattcatcatcatcatataacttactctatttcgatttttcaataaattacttaatatcaaaaaccacaattctggcaaaaaagaaaaatccccaaaatctagggttttcttctcgcccaatttcacttttcttctacgaaattctccattcctgccggctgtcgggttttctgaatcgattctccttcaccaacttcttctctggttctgttcgattctgattttttttcaaggtcaattttttcttctctttaaactctgcaaaatcgtgatcgattaaattcacctcagggttttttgatttctgaaagaagttaatcttcttcgaaggcgattgcaaaagagtgctctgctgtgaatttccactggtatgttcaattttttctgtttttgaaattttgtttgctagaattcgtgaagggattgaaaaaattgatgcaggtggctaaagaatctcttgaatattacgagcttatgtaggtttagagtgtaaattcgagacatgtgagattttggtgctttctcatatttttgcatgcttctgcattgcttcatagccctaaaattgctctcttttttttgtagttggagtctgtatctttttcacggttttagtgatgaatttttttttttgattggattttgaattggttactgaacatgtgttgacttgattatgtagagatg

SEQ ID NO: 35166 - DNA, 3000 bp, Unknown; identical to SEQ ID NO: 35165
  misc_feature (1)..( 3000): 2750-1469P.txt file - cDNA_ID_3085107; gDNA_ID_2926264; Annot_ID_204854

SEQ ID NO: 35167 - DNA, 3000 bp, Unknown
  misc_feature (1)..( 3000): 2750-1469P.txt file - cDNA_ID_3085111; gDNA_ID_2926264; Annot_ID_204853
agtgatgaatttttttttttgattggattttgaattggttactgaacatgtgttgacttgattatgtagagatgcaatcaaaaccgggaagagaaaacgaagaggaagtcaataatcaccatgctgttcagcagccgatgatgtatgcagagccctggtggaaaaacaactcctttggtgttgtacctcaagcgagaccttctggaattccatcaaattcctcttctttggattgccccaatggttccgagtcaaacgatgttcattcagcatctgaagacggtgcgttgaatggtgaaaacgatggcacttggaaggattcacaagctgcaacttcctctcgttcaggtttgagttcttggtctttaggcctacttggtgtattgttcatattcatcatttctgcagtactgttttactggatgacctagtgatcactgtcgaaagtgatgttgttccacgttcggaatgttgcaacttggtgaagagttgttcctcaagcaggcagggaaattaaatgggcatttgtgtgattcggcactatagggcgtgtcaagttcatgaatctggtccttgaaatatacttgcattgtaattgtagggtttcatagttctatccatgccaaggagattctgtctcgttgatatgtgcattgtgatttctttattttgtttgtaatggtgtctttcttcaacttcagtagataatcacggaatggaaggaaatgacccagcgctctctatccgtaacatgcatgatcagccacttgtacaaccaccagagcttgttggacactatatcgtatgtggtttcctctcattccttaatatatatatatatatgctttatgagttcttgagctgttaaattgacttcttattggtccctcaaaaggatttatcttgtataacgcccttttcatatgtatgataaactcaaaacttccttacaggcttgtgtcccaaacccatatcaggatccatattatgggggattgatgggagcatatggtcatcagcaattggtatcttgtcgaaacctctttcaatctctacaatagttccatatggtgcagtgtttatttgatgtatgtgcgcttttgccactaagtacccgtttgtggtgattttatttactgttggaatgtgtctgggttcagcaatagtcagtgagatgcttttaaagttcatttctgaaataactgagaatccaaagttatatctgaaattatcgagaacaactaatggggattcttggggtcttataagttatatgtaaagttttcgatgatctgagtctatttgttgcatttattttgttcattggtttaaacagggttttcgtccatatcttggaatgcctcgtgaaagaacagctctgccacttgacatggcacaagagcccgtttatgtgaatgcaaagcagtacgagggaattctaaggcgaagaaaagcacgtgccaaggcagagctagagaggaaagtcatccgggacagaaaggtatttttttctcatttatgaaaattgtacttgattggtgtcctggtaatctaaggatggtgtagagtccataatagaagtggacccatgctatatgaaggattgataatgagcattaagaatttgcaagtttggtttgtcgctcggtaaacttgtattgactatgtttgaaatgcgacagccatatcttcacgagtcaagacacaagcatgcaatgagaagggcacgagcgagtggaggccggtttgcgaagaaaagtgaggtagaagcgggagaggatgcaggagggagagacagagaaaggggttcagcaaccaactcatcaggctctgaacaagttgagacagactctaatgagaccctgaattcttctggtgcaccataataaaaaaagccaaagctctgagaggagagagagacacacactttggctaatataatcattgcctcaaaccggcaaatcattcttggctttttcgtttttgtgtttgctagttgttcttgtcagagtctcatattgtgtgggtttaacagttatgatgaatgtacaaagagcgagttatgttaggtgttagattttggagacaagagactaaggaatagcaagtaggtcttgtttttattctttgaccttttttttctcttttgcaaaattgaaaaatacgtttgcttaatcgtttgcctttctgaccacaaagtgttaacaaggctataacaatgcttcagatttgtagtcaaattctctgttttcgccaacttaaacattatttgaccggaggagagtgattagaaagtagaagaaacctattaaacattatgttttgcaaagaaaaaaaaaacagcttgcaataagttgcatagtttgctcatggaagtttcaagtttgcatataaaccagatttgaaaaggacagtgaaaaaaaagaagttgttaaatctacaacgggcagatcgattatttatatcaacaaaaaacacgaagagcatatgaaagagaatatggaaacacataaaaaattaagagttgtcattctttgaatccccgcaagcaagaagaagaagaagaagaagagagtcaatttgtgtgttttgtcatttgaagaagagagagaaagaggaagactttgactcgtcttcttcctctcttcttctctctctatcactgcatttgtttttcctcacagcgtatgatgacttttctctttaatttatcctttttagctacatatcttcttttgcttcaactgatttatacccatttaaatgtttctacccattataagttctgaggtctgtgttttccctctttcccttgtctttgatcttagctagggtttactaatctggtttgagtatattagattagggttctgtttgatttaggatatgttgttaattagaaatagttattggcttaagttactaatggaaccttgaagaacagtgctcaaagttttaatctttctgggtttttcaggaaccttgagatttgattagatg

SEQ ID NO: 35168 - DNA, 3000 bp, Unknown; identical to SEQ ID NO: 8906
  misc_feature (1)..( 3000): 2750-1469P.txt file - cDNA_ID_3085127; gDNA_ID_1971919; Annot_ID_58538

SEQ ID NO: 35169 - DNA, 3000 bp, Unknown; identical to SEQ ID NO: 8897
  misc_feature (1)..( 3000): 2750-1469P.txt file - cDNA_ID_3085127; gDNA_ID_2926147; Annot_ID_197809

SEQ ID NO: 35170 - DNA, 3000 bp, Unknown; identical to SEQ ID NO: 8906
  misc_feature (1)..( 3000): 2750-1469P.txt file - cDNA_ID_3085127; gDNA_ID_2926265; Annot_ID_143305

SEQ ID NO: 35171 - DNA, 3000 bp, Unknown; identical to SEQ ID NO: 8906
  misc_feature (1)..( 3000): 2750-1469P.txt file - cDNA_ID_3085127; gDNA_ID_2926147; Annot_ID_139143

SEQ ID NO: 35172 - DNA, 3000 bp, Unknown; identical to SEQ ID NO: 8897
  misc_feature (1)..( 3000): 2750-1469P.txt file - cDNA_ID_3085127; gDNA_ID_1971919; Annot_ID_177169

SEQ ID NO: 35173 - DNA, 3000 bp, Unknown; identical to SEQ ID NO: 8897
  misc_feature (1)..( 3000): 2750-1469P.txt file - cDNA_ID_3085127; gDNA_ID_2926265; Annot_ID_204901

SEQ ID NO: 35174 - DNA, 3000 bp, Unknown; identical to SEQ ID NO: 28523
  misc_feature (1)..( 3000): 2750-1469P.txt file - cDNA_ID_3085140; gDNA_ID_2926147; Annot_ID_197798

SEQ ID NO: 35175 - DNA, 3000 bp, Unknown; identical to SEQ ID NO: 8902
  misc_feature (1)..( 3000): 2750-1469P.txt file - cDNA_ID_3085140; gDNA_ID_1971919; Annot_ID_177156

SEQ ID NO: 35176 - DNA, 3000 bp, Unknown; identical to SEQ ID NO: 8902
  misc_feature (1)..( 3000): 2750-1469P.txt file - cDNA_ID_3085140; gDNA_ID_2926265; Annot_ID_204890

SEQ ID NO: 35177 - DNA, 3003 bp, Unknown
  misc_feature (1)..( 3003): 2750-1469P.txt file - cDNA_ID_3085160; gDNA_ID_2926266; Annot_ID_143323
gtcaatccatagagaaatagaagataatgagatcttatagatttgagtttctgtttccgtttctatgtgctcttcttgttttctccataaaggaaaataaagatataaaaatctttattattattacaaaagagagaacaagataagaattgaaaatatattagctcttatcctaagccaactcactccttccttgatgtatgcatttttgttttgccataaaatcttatacccatttgcgggatgggatctatgaggcccattcaggtgtaaaaaattgtaatattttttagcgggaaaaagaacgataaatacaaaataatagatagcgataaagacaaatggtggtatcattttttctgtattactaaattatttcggtgtttttttgtttatgattgctaaacatgaaagttatatacatcttgtagttgcgaaaaagtgttactaatcaatcaaacccaaaaatggaggtatagttatttaaaggataatatagctatctataccgagatgaatcaaaaattatgattataccaatgttttctatataattagttctctctctataatttatgtaagttagacaaaaacgcccttattgcatatatcaaattatttagcaatgtaataaaatagttatcgatatttttgtcatcaatttcttcaagaataatatattatgaattagatgattatctatatgataataatatatatatgcctgtaaataataaaaatttatgttaaaacatatgatatcgcgataagaagaatgttaaggagatatacaattagtaatgtgttaaatttatttttaacatactaaattatacaatatattatataaacttgtcaatatattttaatctttcattcatcatgacataaaagtacggtaaaaataactgtaacgtactaatgtttcatttagcaaagtatctaacgtaataatatagcaaaaaagtcttaatcctcttttattgtgctgaatatacatacataaaaatacagatttataattttaaatcgataaatatttttcaacaaaggatttgtaaacttatcgcgatatcatagtttttagcacgttaaacaaatagttatatacttatcatcaatatattacgattatttttattcaatggcatttttgtaattaatttaaaagaaaaggatatttttggtttatatattatttctcctttatacttacctaaataactaatagttatgcatagattcttaatttcttcatcttctatgcatagatattaatatagcccttatttaaaagagatataattagagataacattactttgaatcttttttcttcccgctaattctttttgcttgtttaattggtatgtcagcggaggcacacgcgtaagtacttgaggaggaaacaatttagctcaatcgtcccctgatttccggcttttgagctgaggtcatatgtatgcacaataaaattgaacctcactatctcattctcagccttactcacaaaacaaattctagactattgatcaaatacagatgaatatgaaacaaacaaaatgtgaaagagtgaagaaagcaccaaagtttttacgagttatgactcgataggtataatcgaatctacgtctaaaccagattaattcaacaatccactatacgaaaatattacacatgtaggcatgtagctcgtacaacaagaacagagctcgcaacagcaagcggaatcaattgatgaagttaaacggagaagatagcaaactgagtacttatactcttatcatactaaatgataaaccctctatgagatttgaagaacttcctttgttttccttcaagaataccttttgcggttagaatctttcttcaactttccccgttaacacatccagctcacagcctaattgaacctcgcgatcttttccttactcacaaatgaaactcaaaataattcatcaaacacaaataaacatgaaacaccgaaatataaaagaatgaacaacactaaggattacacttgaatctagatttgggaaatctaaatatccaacatatgatagtgttacaacaagaaccgagctcaaaattcaaaagatgaagttaatcggagaagatagcaaagcgtaattatactctatcacatactaaatagaaaaaactatgaaatatttagagacttctcatatgttttccgtttagcatagtctctttgattagagtctttctttaaccttataactcaaccgaaccaagaaacttaagtttccgctgcacgattataataaacttaagttaaattgggttatatatttttttatttaatttttttgaatactcagaagatttgatcatgaactactgaaacaacgtttttggccaagaaataagaatttctacatcaaatttgtccatatagatcttatgatcattttcacaaacaaggtttcaatgcttttgggtacgttgaactttttccacggacgttgtaataccgtgtgaagttttattcatgtcctcttgttttttccaacgaaatactaagttacgtctaaccatccaaagaggaacaatgtatgatctaaattaattgaaaattcgaagaatccaatcacctttttttaggatcttaaaaattagaaagaaaaaaaacaagacagaaaaaactagtgaccgatggatgtgaatctctaagtcaagattagtaaacctaaacttaaccttctacgaaaaattctattataagttcccactaatcgtcccgccattttaaaaagatataaaaccgtggggagaagtagaaataaaaacaataaaacaattaacaaaacaagaaaaaacgaaaagcatgcaattgtttttcgttttttgttgaaacaaaaaacaaacttaacttcaccaaaaaaactacagaaaaaaaaagattcagtttccttttctttgtctccacttcttatataagagttgggcatttttattacaaacataacttttgaaatcatg

SEQ ID NO: 35178 - DNA, 3003 bp, Unknown; identical to SEQ ID NO: 35177
  misc_feature (1)..( 3003): 2750-1469P.txt file - cDNA_ID_3085160; gDNA_ID_2926266; Annot_ID_204942

SEQ ID NO: 35179 - DNA, 3003 bp, Unknown
  misc_feature (1)..( 3003): 2750-1469P.txt file - cDNA_ID_3085259; gDNA_ID_2926267; Annot_ID_143346
tttagttataaatatttttattggttgggttttattttcaaattaattttctcttgctttgctcttctattctctcaaaccttgtcctcccaaagatatgttatgtaaattaattaaaggaaatcaaattctgttaatgattatctgtaactttgtttttgtcaaacaatgattatctgtaactaagttcgtcgtattatacgcgtaatgatatatagtcgtgtctagtgtgtcatatgactcgtgttatacgcttcaacttatcctacatgtacctaaaggcgtgcaagcaaaattttgtttctaagcttatttgtgtagaaaaatacaaaagcaataaataatttgggtaaacttttgcatgtgatcaatggatggatatagtacacattgctacttatgttttcaagaaactctagtacgcaagaatagacacgagttcgaatattttgataaattggaataaacttgttgaatttgtagatagttatccattttatatattaggtgtcatacattgacacccaaattcaaaagtttatgtgtactttgtaattgtatgatgcatgtatttaatatagagtagattatagtgtcatttgagtcatcgttttcaaaaaagaagaaggtaaattgttaatgtcttcaatatatagctctattggtaagtgtaaagaaattggtgataaaaacgtagactaaaacattaagagcaattagcaacttaaaacctaaaacaatagcaaatttcatgatatgtaagaaatcgtttgaaaatagattataaaacaacgacaaatattaatatcgtagcttcggtggtttacatttgaagtaactttagatgacgacctaagtatcattaataaacaataagattacctgctaatcttggttaacggatagcttgatgctacaactggaaccggtttgctatataaccggttattggttaagaaccggtcaggttaggttagattagacctgatgttagtgtcaataccctacactttgtttgtgttcaagagttcaccataaagagattcgacgaatccaacggctcgtgagtgaagggtgcatagagatcggagagtagagaatcgaagcaggcgtaggatatttgttttgttgacgtcaaccatagaaagatatacacgtggaggtattgagaagagcgtcttaagaataaatgcttttcttggttttcttattaaaacagtaaaaatgcttttcttgttaaagaaaaaaaataaaaattccttgactaatccttcacgccgcgtctagcccattaaaaattttcggacaacaacaacaacaacttcgctttcctatctctttcagctttgctacactaaacttggcttatcattgctaatatggctcgactcggcttaattttgactaaccacaaatgttttgtaaaaatttcagtaaaaataaaacaaaaattaagcgaaataaatatctagggaaactatattacgcaatgtctaattaggaaactaaatcattatatttatcccaaagatattccaaaagatgattatccactagatattatctgattcgttgtaggtgaaaaaagaagaatgagaaagaacgtgaagactgtaacaagcacacaaaaaaagattgttaaaaacaaccaaataaaacgttattttcaatgtatgtatatccattttagtcggtgttaatgcgtttttatcgtttcctttttctcacgcaaaaactttttatttgggggtttttaacatctgtactcacgctaaagttctatcttctaaacatttggcatggggaatccattcatttattaatttaataaaaactttaagataattgatgaagtataaaattctgtattatcaacacaagaagagaaaaaaaaaacaaacataattcgccgatcgaggagcagccaggatccaacgactgcagtcgcgagtccgtaaatgtatatatatatccattaaaaaaaggaaattgtaatcctaatccaacggttgagataaaagctcacaccgtaacgctagatccatggcagaaacagcgtagcaaaaatctttttctttctctcattgttgttttgtcttgtttctaccattcatttttttttccttgttgttgcgtaatccaactaaccgaaaaaaaccaaactctttcttttctccatttctctctctcttggagggagtgccggaatctaatcggagttatcaccggaattacggttttgcttccgtgcaaagtttttacttgctcgtttggaattcacgacgtgtccgtcagaggaagcagaatttgaaattgaagcaccgattcactttttttttgttttggaaattatatatagatataattctctctgctggttatgatgatgattggatagaaagaaacaaaaaggaaagccaaagatataagaagaactctttctctctctgtttctgtctctctgctccttttgccacgtgaagtttagagaagaagaaggtttacgagatccgtttcagtaatttttagctgcttcaatttgcttttggacgaattacgaagagaagaagcacaattgatctggtaagtttttgtctttgtttgttgggttaattgttgattagggtttttgttattgattatctttgtgctcaacttttgaatttggtaggagttggttcttctctgcttctattaaaagatctgaatttaggctaattgtagttttatggcgtttttaattccgaattttgtgtctttataatatttttttctagtcaaactaattcttaccctatagattgcttgaatttgcttaatttggtgtctttgattttgagttggattggttttgtaatagaaagctcctgttttatccattgaattgtaatacattctggcatttgagactgggttgggtcccttatgtttgtttctggaggtggtaaaactagaaagttaaaaagtctcattctttgtaatttcttgtcagctggaacaatg

SEQ ID NO: 35180 - DNA, 3003 bp, Unknown; identical to SEQ ID NO: 35179
  misc_feature (1)..( 3003): 2750-1469P.txt file - cDNA_ID_3085259; gDNA_ID_2926267; Annot_ID_204977

SEQ ID NO: 35181 - DNA, 3003 bp, Unknown; identical to SEQ ID NO: 35179
  misc_feature (1)..( 3003): 2750-1469P.txt file - cDNA_ID_3085259; gDNA_ID_2926269; Annot_ID_205030

SEQ ID NO: 35182 - DNA, 3003 bp, Unknown; identical to SEQ ID NO: 28433
  misc_feature (1)..( 3003): 2750-1469P.txt file - cDNA_ID_3085269; gDNA_ID_2926267; Annot_ID_204974

SEQ ID NO: 35183 - DNA, 3003 bp, Unknown; identical to SEQ ID NO: 28432
  misc_feature (1)..( 3003): 2750-1469P.txt file - cDNA_ID_3085273; gDNA_ID_2926267; Annot_ID_204973

SEQ ID NO: 35184 - DNA, 3000 bp, Unknown
  misc_feature (1)..( 3000): 2750-1469P.txt file - cDNA_ID_3085297; gDNA_ID_2926267; Annot_ID_143335
attacgtatgagaaatttatagtttgtattgactaatttcattaactatttcaaattttcactcaagtttgatcatatatacatactaactagtccacacaaatctaactcatgttcactaacttttgacccttaaaataaaaaactcatgttcactaactgtccgatattaacaacagtaaccacaaaactgatcatatatatatactagaccacaacagctaacgcagcacctcgtttattgtttcgacgcaataacaataaaaacatttaagaggaaacatagtaaaaaataattgaattggtctagtttagactactgtagaatgcgtacagattggtcttcttacatattagagccatgcaccgttcgagtctaaaagcctagagttgcttatacagctgaacctccacaagacttatataaatcttgtggatatacgagcccccgtctccttttacgtttttgtggatttacataaatctttatggtcaccgagtctactgatataattttactgtcgcagtttgtttccactacttaagtttctataatttcacagtttgaaagaaaaattactggttattcagctaaattacaaagattagtttaattagtttagccagtataatgttttagtaaagtattaaacggcatttttcgttgggagaattatgttatggtataatctactaatacatacttttacacatatatcaaaaagtttgaccatagtaggtagtacaacatagaagaatcaagatcggaaccagcaaggaagaagatacggtcggtccatattaagctaagaggaccaacgtaactcgatatatatttttctgttctctacgttaccaccatataaattttaatattgaaaaaatcatcttttggcattgtgtttgatgtcggattcggaatatggaaagaggagagatatgagattttggcacaaaggaagctgccaaagcattagggcaaccgagtagtaacgagatcaaacatcgtttcaatcggacggtcggggtttgaccaatatttctcggatatcttttggaccctacgttctgacttgaacttgatcagtcacttcagtaccttagttttcattttcaatgtgatcatgagtttttttttacatgttagcttcaaaacaaatactaatattcattaactatggatcggcatagttttcatgtaatcagctgagcgtttatcatattgattgaagctaacatgtaaaattctcatgatcacattgacttttgcctacaaattttaaaagagtatacaaataattgcttaatgaagatagcttccatagagaaagagtaacagctttatacggaggcatagctttagacacgatctctgctcttgtgttttttgtttaacactgaatccacagtgaaattactgctcattttttttcattttttattacatttttttttttacttttttatttattacaatctacagttctaccaacttattcaacctagtggtaccatatcgaccccaaaattaatcaatctaattacaaggtagaaatagaaagattttatcaaaggagacaactctgatcgataatatgttgcaataaaaccatgaaaaactgtaaaaaatattgaaagctgaagaaaaattttcaaatcgataaaaggatagtactaaaccaatccggtttgtggcatctttttcacccaatcactatcaaagcattaactaaaaatcacaaggaagagcataatttgattctctacatcgcagtccacgataggatttctctatccaccgttggatcaaatttaataatgatgcacgcgcgcgtcaacgggattttacccagcaaaggaatgtcttttcaccggactcttaaaagacgttcttcttttttcacctttgcattggaaaacggcgtttcttcttagaaccgtcgccgtcaaatcatacggcctaataaatctccgtttaacgccgttactttaccgttaagtactaaaaaaacaaaaaaaaatcatttcgatcactgtctcattaagatgatcggagatgttttagcagggtttaacaagtgatgatagtaatgtatgtatatatgttactgacattattttgtcgttgtctaataggagggtactaaagtttctctctctcatggcgtcggagctcagcctctagtaatgtagactgtcctctctttctctctctcttctttaaacatctctgctctgttttccttccagttcacgctaatctcctgtgtcggtcccctctctcttttcctttggtctctcccaacaatggcagaacgactttgtacccttcttttgctctttgtttgaatttcgtttcttgctacaaagcttcaaaggatctgacttttccctaaacagaaaaagaggtctttaaccaaaaaaggttgttacttgttttctgggtttcgtggtgttactcttgaggaagaagaagaagaagatgagaaggatagagaccatgaaaggcttgtttttttgtctggggatggtggttttcatgctacttggttctgtttctccaatgaacaacgaaggttctagctctttcaaaatctcttttgtttctctattgttccatgagccagagagatttctctcttttttttccagagaacttgaatttttataaatttgtaacctttcttccgattttgaagatatcatatctgtttatctgtctatctaaacagtgactgttcctgagagagcaaaagtcatttgattcgttcttaaaaaaaacttactttagtgtttttggaaatatgataataatttgtgacctagctcacttcacagttgagtttattatactaatgatctagtggggttttagtttttggcatgtggttcatattttaccatttgactatcatcagtgtcaaatgattaaataagctttttttgatttgtttattgacttcaaaaagcttttgattttgcacaggaaaagcgttgatg

SEQ ID NO: 35185 - DNA, 3000 bp, Unknown; identical to SEQ ID NO: 35184
  misc_feature (1)..( 3000): 2750-1469P.txt file - cDNA_ID_3085297; gDNA_ID_2926267; Annot_ID_204963

SEQ ID NO: 35186 - DNA, 3003 bp, Unknown
  misc_feature (1)..( 3003): 2750-1469P.txt file - cDNA_ID_3085320; gDNA_ID_2926267; Annot_ID_143330
cacaatatacatagttacatatgacctcaaatcagcataagagttgttttgtatatggacatgactgaatcgaataccttgatctgctcgtactccctgatggcaacatttttagagtcttcagtgaccttgatggtttcttttaactcttctatcttcttaatccttgatttgtcaccgccaaagacctttgatgatgcaacttctagcttttctgctcttgcttccagtgaagaaagttcagatagaagcgtctgcactgtcaataaagcactagatctatctgcaaaggcgccctggactgccatcattaggccaaggtaatcgtggagtgtgtcctgacatgaataattcagagctcttagtgaaactaaatcccagctcaatgaaagtggaatagattcttcatatctctacaagtatctagtttaccaaatgcttgaccgtctgggaattcaactctctgtaaaatctgcttgctttcacagctgaagtggctaaattcttcatatcattggcacgagctctttgagaattgaagacagcttcttcgttctcgaatttcgtcagtttaatgaatgctaatcccaattcccccatagtctcccccatgtcttgctgtgccttcacgagggattcagcctacaaaaaacaaaaaccatgaaaaatactgatcttttgtgaagtaacaagtatgaaatctctctacctgctgtgaagcattaatgatctgttgctcaagatcatacattttctccttcttctccaaaaactctttatcttcttccacaacaggtggttttgatccaccccagtcattagaaactgactgtctaagttctttaaacattctcagaaaatctctacctcctctacccggctgaaccacctcaaccgaagaagctccaccgccttcaccaaacaactgtttcggcagcttcacagcaccatccaacatcctagaagccacatctgtgctcgtagcaagcggtaacttcccttgcgcttgaagaaaaaccttcaattcatcactgttcctgatcacaggatgtgcaacaagcctacgcaaatacttctccaatgcaactcttctctgctccacaaactcttgcttttgcatcacttgactctcaactatactcttatctggcctcggtggaatgcagaaacctctataagactcagctaatctatcagccaatgtaacaatgtctctgaatcttctcctcacgctaaactccgatccaccgtagtcagagagattcgttctagttgtaatctggtaagtgatgtaagtacttcctccaggaatcattgaatttgtggcctcttgctctttctgagggttagaaacagtgatcttgatgtaatcagagctcaaagaagacggagatctagataatgaatctgacgactgactatgaccatcttctgagccattgatctcggagatatcatcgaaagggctgaagataacatccgcgtaagacggaggctcgaggtaagagctgactctgtcgccgccgtttggtttagaacgaggactccgagattcgctgtagtaagacggtggcgcaaaaagtggatcggaatcagctggagttacgacaatcgacgggtgacgcgagtcgaagagagttgacatagcgctgcgataattagagttggatttatcgccgttgacattgcttttggtcaagggatcgccatcttcgcggagaaagagtttctccatctcttctttggatgagtggagatgggactcttcgtcattctctgagcccatcatctctggtaaatctataaggtgagctaattttagtaataaattcacaggaatttagggatttttcgattcggttcgagataacggagattacgaggatacggtggtcgtgaactgcaataaataagcggagtggctaagtcacggcggtgttggctccagatattgaatgtagtagcgtcaagtctcgtcaataactaattggggaagatgagatggaaagagtaatatctttcgggtcacgttaaagtgtttagctgggttttgacccgacccgtagcagcccagcccagcccaatatgcaaattattcttatacttaaatgtggtagagatatctctgcatccaaacgacctgactataggtctacttggttctttcttccacgaccgtatcgagtcaactactgtaataagatttccgatgaactcagggactcgaaattggggttaccgggtccgagccatttgggaaactatcgattctatcttcaccttatgctcttctgtattcttcggaaatgagaatgtagtagtctcatggagtttccaatggcgagaagcttaaagctctgttttctattggagaagagcaaaacgcatgattatgatacggagacacttctttcgtcatatgagagaagagtaaacagttctcgaggttttagagaatttttatcactttcagtaatgtctttgaagcactcaaagtcactgaaatttctggagaagctgaggcagcagatgtctcatgtctaaaaaaggtagctgttttcattcttattcttcgttttttaaaacacattgatgactgagaaaatcaaactcaacttggggacaagttgatgatgattgatgacgcacgcagcaatagattcggtttatagattttgggatagtttattaagatttctgatgcagtaatcttaattgggaaatagtaaagattctggtttaaggagaggatccaaaagcttttagagatttggtgtccgaggatgagaaaaaatcaaagaaaaggtactaaagtaggctggtaggggttcacctacatcttctggaacaagaatcatatttaaaactagaaagtagaaactgtttgttttgttgtttagttgttacaccaaatggtgtgtgctggttagactataagctctctgtctcctgcctataaaaagtatcaactttctctttctcttcgagtaagtgagcgcaatg

SEQ ID NO: 35187 - DNA, 3003 bp, Unknown; identical to SEQ ID NO: 35186
  misc_feature (1)..( 3003): 2750-1469P.txt file - cDNA_ID_3085320; gDNA_ID_2926267; Annot_ID_204957

SEQ ID NO: 35188 - DNA, 3003 bp, Unknown
  misc_feature (1)..( 3003): 2750-1469P.txt file - cDNA_ID_3085346; gDNA_ID_2926268; Annot_ID_205019
tagacaacgattcaacggtcaagatgatttagtgtctctttggtttctgtgatatataatttattgaaccctttataaattttgttttgaattttttctcttaagaaaatatttctgtgtaggtgctttgggaaaatatagaatcaaacacttatttgtaattttttttttttttttttaaatttattaggtatattttgttttgccctataaacattttcttaacactcaaaagtaaaccaagctacatcttcttcctcttttcataagaaagtaacagtaataatgataaaaataaacaagtcaagtattgtaaatattacatatctaaactcatgttgtcatcatgggtcggggatccgatacatccattgtgggagaacgagcaagcaacatcgtatatgttgggtgagtactctcataagtatcggactgttacaggaacttataatgctattctgcttggtatattctaattcactgtggatcacaaaatttccattgagtaagttaataaatagcaaagtttggtgtttcgaactccaaaagtatgctatattagcatcaaaagggtcaatcgttagcggtaaataatcgaaaggagtttcaataaaagtcggggagatctcagatactaattgccattctccactctttagcctccatacacataacttagcatctaaaccttcatcagagactatgttcatatacatgagaaatccttgactagttgtgcatgttcttatgaattcgcgatgcttttctaaatcagggaaatgagtaacccgacacttatcagaatttgtttcaaaagcgtaaaagtcgatggatataacaacttctgtatcctcactattgcgaacgagccaatgaagattttcgtttaagctaatgggatggtaaaaatcacgattgaacgaaaaagagaaaagaaaatggatagtgttgagactcgacaaccgtgtctcggacgaatatatctggactgaaaacttattttcgttattatggatcttttttgcctttcatcaaacataacaactttgtaactcaaaacgacgccgtttttagtttgtgttactattcccaagggacagaaaaaattatgctcgagagcacgacgattgatttctaagcattgatgtgaaattggattagctaggtataacgattgatcctgaggatagactcgacatcgatcaaaataaaccccatatcggtgttgtaaggaacaactttggcttctcggtatatgttcatttcgaatttatcggtcataaaagacgagatgtaagagtactggtacgattaaatccccaagtgttgcatctatgatgagccacaagttctatcttgtaacgcctacacatgagcgaccatgaagaagaatggtgcagagacatgaacatgacacgaaaatgtggagactcgataatagatttccactgcttacaaaccagtttagaagtcgtgatcatttttagtggtaattgtgcaagtataattgtccatagatcatctgtgaagaaacatattcttattcatatgtgttattgggatttactaaggtgtatttaaatactgaatttcacataaatttatttctcaataatatctagcttttgctgataaatctacgtaacataatggtatgtaaaaaaaaagtagattataaatttaatatatgtgtacataataaacagtaagagatttgatcaaattatatcttttcatgctatttagtattgtaattttctgaaataatcaattatcctaaaacaagttcataaataaaaagttaatatcctaaacaatatttacgtttaatatattttctctattaatactagatttgatggaaattttatctattttagttattttatataaaaagtttttttggtttataataatgaaaaacgtgattaatgataaaatcataataagagcgaagggcccattataacagcatttatttgggccgttgttggtctcaggttcccgctcttttttatcgatcgaggcgccaaaacacaaagaatcgattatatgttgtcatctttcagattgtcaattcaaagaagacgatcagatctaattgactcgagagagagagagagagacgtatgtttgggaggctgagaccaccgccgtcgccgccggattgtctggagagatatccggcgaagatcatcaaagacgatcctctctccgtctacggtataataaatacacactctttccattttcatgtgattctgattgtccaatagaaatctctaggttttgaaatccttggtttcttttgatggcattgtagagtcaacactgttgaaacttaagcaagggtcaacaagacaggacactacttcatcagaaacagaaggtgaagagaatctgtcatcaacatcatcgtctcatgtcttgtcttcggatacacaattaggagacactcatgatgcaatggctatagactcgtgtgaaagctcgaaacagataaagagcaagaacccatcagtactatccatgtttagcaagtacaagaatcaagctcaagcacgaaacatgaagacagagactcaggaatgatttgtaaacaaatgtatcccaagttcatgtgtgttgtactttgattatgtacaatttaactacattgttagtaaggagtctatatagatgcctgtatcaaaacatctctcaatcatgtgtttattactttagcctaaacaagctttatgatctttaaccaacggtgttgatagtactggtcatgtaggggttcatccataactaaacgtctaaaccttatattaaaatgggtctaactgatcaatcaaaaacatttggggtcaaaacaatatattggataaatataagggttcatcaaaaaaaacttaacatttcttcttcactgtaaaatgaaataaagcttatccatactcaacttcttcactctctcttaaaccttcaaaaaccctgaagagtgacgaatgaatcatg

SEQ ID NO: 35189 - DNA, 3003 bp, Unknown
  misc_feature (1)..( 3003): 2750-1469P.txt file - cDNA_ID_3085350; gDNA_ID_2926268; Annot_ID_205018
tattgcttacgtactctaggtaacctacaaatgctttggaattcagttttttccgtagcttggagtctaaatacttgcacttgattcttctttctgacctcccacggcgtgtgcattcgtcatagaaacaaggagcagtcaatttgaatatctccaactccttggttcgcttcggtttcgaaccacacttactcaaggcagcagcaatatgcttccaacacgtcctgtggtgtaaatactcatcttcctcacaatctgtaaaattatagacacatgttgatcaaacttgaaagttagcctcttccagagccagaaccaaaactttcacaaactacaaaaccagaactaaatatatatacattttcaagaaccatagatttcattgtcataaaaatccaaaatctaagccaattactagagagaatttcaaaattacacatggtaagatagtaagcatcaccacgacacaggaatagaaacaatctcgtcactttgaaaattccagaaagaaaaaaaacacaaactttcatcgaatcttcaaaaccctaactcccaaaattgcgttaaaccaagaaattaaaaatctttcaaaaacccccagaaaaaaaaatgaataaaaatcgagaaggaaattggaatttaccatcaataatagtaacacgagcaggactgctgacgtatttactattagtatttcgaacacgattacttcgtcttcttgacattgaaatttggtacagagagctctgagtgttttgtcttgccttgctttttattttccctcttctcttgtaaactttttgtttcgcttaatattagcagacgaattacgtaaagactcttttggccgttgattttacttactttttaatagacaacgattcaacggtcaagatgatttagtgtctctttggtttctgtgatatataatttattgaaccctttataaattttgttttgaattttttctcttaagaaaatatttctgtgtaggtgctttgggaaaatatagaatcaaacacttatttgtaattttttttttttttttttaaatttattaggtatattttgttttgccctataaacattttcttaacactcaaaagtaaaccaagctacatcttcttcctcttttcataagaaagtaacagtaataatgataaaaataaacaagtcaagtattgtaaatattacatatctaaactcatgttgtcatcatgggtcggggatccgatacatccattgtgggagaacgagcaagcaacatcgtatatgttgggtgagtactctcataagtatcggactgttacaggaacttataatgctattctgcttggtatattctaattcactgtggatcacaaaatttccattgagtaagttaataaatagcaaagtttggtgtttcgaactccaaaagtatgctatattagcatcaaaagggtcaatcgttagcggtaaataatcgaaaggagtttcaataaaagtcggggagatctcagatactaattgccattctccactctttagcctccatacacataacttagcatctaaaccttcatcagagactatgttcatatacatgagaaatccttgactagttgtgcatgttcttatgaattcgcgatgcttttctaaatcagggaaatgagtaacccgacacttatcagaatttgtttcaaaagcgtaaaagtcgatggatataacaacttctgtatcctcactattgcgaacgagccaatgaagattttcgtttaagctaatgggatggtaaaaatcacgattgaacgaaaaagagaaaagaaaatggatagtgttgagactcgacaaccgtgtctcggacgaatatatctggactgaaaacttattttcgttattatggatcttttttgcctttcatcaaacataacaactttgtaactcaaaacgacgccgtttttagtttgtgttactattcccaagggacagaaaaaattatgctcgagagcacgacgattgatttctaagcattgatgtgaaattggattagctaggtataacgattgatcctgaggatagactcgacatcgatcaaaataaaccccatatcggtgttgtaaggaacaactttggcttctcggtatatgttcatttcgaatttatcggtcataaaagacgagatgtaagagtactggtacgattaaatccccaagtgttgcatctatgatgagccacaagttctatcttgtaacgcctacacatgagcgaccatgaagaagaatggtgcagagacatgaacatgacacgaaaatgtggagactcgataatagatttccactgcttacaaaccagtttagaagtcgtgatcatttttagtggtaattgtgcaagtataattgtccatagatcatctgtgaagaaacatattcttattcatatgtgttattgggatttactaaggtgtatttaaatactgaatttcacataaatttatttctcaataatatctagcttttgctgataaatctacgtaacataatggtatgtaaaaaaaaagtagattataaatttaatatatgtgtacataataaacagtaagagatttgatcaaattatatcttttcatgctatttagtattgtaattttctgaaataatcaattatcctaaaacaagttcataaataaaaagttaatatcctaaacaatatttacgtttaatatattttctctattaatactagatttgatggaaattttatctattttagttattttatataaaaagtttttttggtttataataatgaaaaacgtgattaatgataaaatcataataagagcgaagggcccattataacagcatttatttgggccgttgttggtctcaggttcccgctcttttttatcgatcgaggcgccaaaacacaaagaatcgattatatgttgtcatctttcagattgtcaattcaaagaagacgatcagatctaattgactcgagagagagagagagagacgtatg

SEQ ID NO: 35190 - DNA, 3003 bp, Unknown; identical to SEQ ID NO: 28443
  misc_feature (1)..( 3003): 2750-1469P.txt file - cDNA_ID_3085355; gDNA_ID_2926268; Annot_ID_205015

SEQ ID NO: 35191 - DNA, 3003 bp, Unknown
  misc_feature (1)..( 3003): 2750-1469P.txt file - cDNA_ID_3085359; gDNA_ID_2926268; Annot_ID_143369
tagtttttcgtcaaaagtctttttcgtattattttgtattcaaaacaaattggtgtaaacactcatatcctttattaatagtttaataaactaaaacgattttctctctaattaataagctaaaaataggaataaaactattaaactaaggtttgatttaaaatcattgaaaaatacaaaacgcgattattatgaaacaaaaaataagtctcgaaacgacaaacatgttgtgaaacggatgaaatatattttaatgaggcctcctattaaaaagaaaaaataaataactcattgtaaaaaggaagaagcaattactgatgaccccctcgagaacgtaaaacactgcatgatctaacaccgacactggtcttaaatactccatgttatctctaatctgaatgggttcgaaactccatacttccaagttactaaacttggccagagcgaccactacactaaaagattaaaaaagacaatgcatttatgatttaacaccaatgagacctctccctttgacgtagctttcattaagatctctatcattatcattcagctaacagcttcagctttttaaaaaaaacttgaaacaagattaatgggttcacatttaatgtacacactgcgccaacacgtgtaggttatgaaccttatggtcgctaagaaaataaattgtgacagcaaaatgtaaccgaccaaagagagaaaaaagatggtccaacatatggtttctttttcttatatgattgatatagcatcagcaaaattagaaatgatattggaagtgtcttttaatacattgggtgttgctaactatcatactagcaccaagatataaatgaattgaaactaacgtcttataagtgttacaatcattgattcattgtcaggagatacaatatatactataataggtatgcaacttactgcatatatgtaaaaatgtcaaagaaaagattaattattcggttttgaaaaataaaatttgtgaaagacagtttttctttcaaattagttagttgctacgggaaattaaatcttagagtattttaaaaaaatcgaaaataaaataaaataaaattatgtggtcaaaatggcacggaaaccaaatttatgaaaatgttaaaaaaaactctgcaattaagggaatctaaaggtgtgtattcaatcttctactcattgagttatttagagtttttttttatgattttgaagaatttgggtgaatttatgaaagttgttatgatttattgtaaaatcctctcaaattccacttaaaaccatgagataattctgtatttttaactaagaaaatccattaaaattcacttaagtctcttaaagtcactaataacccaatctttaaaatcttttcaataacaaaagattttaaagtatacaagttcaataacattagatttcatgagacttttaaaaattcatgattgaataatatagaatttgttattttaacataaatcacttaaaatgtttgattgaatagttttaatagattttgtttaacaatttcaaacccacaaacaagtgtgtactttgaattgcttttacgttaaacattttttgtttgttatccaaggtatgtttttttttttactttgaatttcatcaagattttgtttgaatcataataaacaaaataaaatctttcatcaagtttttgtttgttttgatttgtttaagattgaaatcttactttcaaacctaaaaaaaaaatcttattttaccgaccatggagtacatttcaatcgccgaacttcttagctcccgcacgtagcgagaattttcatgagaggtggctgagacatttaatggctgactaaatatctttccccagccaactacattaacccctccatgcatgcctcacctactttatcttctagttacttcgtttatattttatgattttgtccaatatgttttcccatattactgttttaataatgtaatagctataatattcatttttccccatattattgtttaattattgcaaatatataactgaacgctaggtccaaacctaagtaaaagccatgaccctttttttttggtgaaccaaagctatgacagtttttaacatgcattaataatgaaattctttattttgtgttggatgatatcaaagtaaacaaaaattactagttaaaacttctttttacatttcagagaaataaatattttgattatcttgttaaatattatttacaaattacaagtgtaaacaaatttttatatttgtttacatttagttttggtgcaaatgtttgttctgttttattccagtgatttattcatctaatgaatccagtatattcctataagtagttaccatttgtacattttgtaaattgaaaaaaaaaactaaaatattaaggttttaaaatacaatttaacatatatatatataaataagaacaaaaaaaactttaaaatcaatcatattaaaaaggtatacatgtacacaccacataaaataattatcctcagcaccacaaaaatacaatcattcaattctcaaatatttgtggggtttaggcttacacatgttagctaaaaataaattaaaaacttatacaatttttttttttttttttacaaatccattaaccacaattttcatctaaaaggctctaaatggttagtggttactctgggatttagcggggccaataaaacttaccaaaaacgacaatatatttctttttcctttttatttttggacaaaaacgacaatatattctggtactaatattttgtggtacgaaataaactatttaaagcttaaattattcttcacgacaataaataaaattttatctaaacttaaatctcatctgccaaaattcgattatagtttatgtatatatataataatataataaaaaaaagaatgtatatagtttattctcaccactacatgtatataacacaaccattttcattagaagctcaaatttcaaatctcacttccttatcacaatg

SEQ ID NO: 35192 - DNA, 3003 bp, Unknown; identical to SEQ ID NO: 35191
  misc_feature (1)..( 3003): 2750-1469P.txt file - cDNA_ID_3085359; gDNA_ID_2926268; Annot_ID_205014

SEQ ID NO: 35193 - DNA, 3003 bp, Unknown
  misc_feature (1)..( 3003): 2750-1469P.txt file - cDNA_ID_3085364; gDNA_ID_2926268; Annot_ID_143367
acgtgttttgtcttgagcatgctgcggaagtggaacagcaacttcgtccttttggggggattaacttaatgttactgtgccatccaggtaacatcaaaactacaagattcattttattagtatttctgtatcagttatgcaattctttagtctttttcatcattttgacgcacaacatttgcagagtaccccaggatagaggctgaagcaaagatagttgccgaagagctcgtcatcaatcacgaatggaatgatactgaattcaggaatgtgacccgagaggatgaggaaacgattcaggcagcgttggataatgttgaagctaagggtgggaacagtgattggaccgtaaaattgggtgttaacctttcttacagcgctattctcagtcgctctcctctgtacagtaagcagatgccgtataactccatcatatacaaggcgttcggtcgcagctctccagtagcgagctcaccctcgaaacccaaagtctctggtaaaagatcgtccagacagaggaaatatgttgttggaaaatggtgtggtaaggtttggatgtcacatcaggtactattgtctaacctgaatccatactaattcagacattagtacacttctgtttggttcaatttgcttttctttcttcaggtgcatccctttttgctggagcaggacttagagggggaagaatctgaaagaagttgtcatcttcgagttgctatggatgaggatgccactggaaagagatcgtttcctaataatgtttccagggattcgacaacaatgtttggaagaaagtattgtaggaagagaaagataagagcaaaggcggtgccacgcaagaagcttacttcttttaagagggaagatggagtttctgatgacacatcagaagatcattcttataagcagcaatggagggcttccgggaatgaggaagagtcttattttgagacagggaacacagcttctggtgattcatcaaatcaaatgtctgatccgcacaagggaattatcagacataaaggttataaagaatttgagtcagatgatgaggtttcagaccgttcacttggggaagagtatactgtacgggcatgtgcagcttcagagagctcaatggagaatggctctcagcattcaatgtatgaccatgatgatgatgatgatgatatcgacaggcagcctagggggattccaaggagccaacagacaagagtttttaggaatccagtttcatatgagtcagaagataatggcgtttatcagcaaagcggaagaatatccataagtaataggcaagctaatcgaatggttggtgaatatgattcagcagagaattctttggaggaacgaggcttttgcagtacagggaaaaggcaaaccaggtcaacagccaaacgaatagcaaaaaccaagacagttcagagttcgagagacacaaaaggtcgctttttgcaagaatttgcatctggaaagaagaatgaagaattggattcatacatggagggacctagcacacggcttagggtgagacatcagaagccgtcgagagggtctttagaaacaaaaccaaagaagattggtaagaagagaagtggtaatgcttccttctccagagttgcaactgaaaaagatgtggaggaaaaagaagaagaagaagaagaagaagagaatgaggaagaggaatgtgcagcataccaatgtaacatggagggttgcacgatgagtttcagttcggaaaaacagttgatgttacacaaaagaaacatatgcccaattaaaggctgtggtaaaaacttcttctcacacaagtatttggttcaacaccagcgtgttcactcagacgaccgtcctctgaaatgtccatggaagggatgtaagatgacgttcaagtgggcttggtctagaaccgagcacataagggttcacacaggcgctaggccttatgtttgcgctgaaccggattgtggtcaaacattcaggtttgtctctgacttcagccggcataaaaggaagaccggtcattcggttaagaagaccaacaaaaggtgatttaggctctaacatggaatctatcatgaagaagattactccattgatctattagaagaaaattggattgtacgaatattaggggttttctaagtgtgtatgtctctctggtcctctgtcaattcgggattataaagtcaaagtcttaacatttggaatagccattgtttgttgcagacgttttcactttcagacagattctctctttgttgtattctctatttttgcagttgaatgaatctgtaacaacaacaaatcctggtgtaggaaaagcattgtgttactcaagtatttgacatatatggttgtatacgtggcttatcctggttggttgacagtcagagttcatcgccgtggacttcatttgactttgataaagactcaaacctaccaaattgctaatgaatgacattacctgtgtcaactaggatgtaaaactctctgacttcagcacacggcacaaacgaaagaccaaatgacttaacatttggaattgccattgtttgttgcataaagattcatctctttgttgtgttctctctcgtcttcttcagttagtctataataacaatcctggtgtagagagagactttgatttgataaataaaggagctgcttgtacaattaaaagctatgttgcataattatgaaatatcaaaatacgataaggacttagttgcaattctcaaagaaatatctgaaacgcataattttaagttaaaaaagtgtgcatgaaatgtgaactattggaccttgtcaacaaattaaagcaacggtttctttgagattctcattcgtgacgctataaacgacaaatgtaataaagtatccataaaggaaacaactttattcttcttcttccaccctttgatcttcttcttcaattacctccctgaaaattagggtttttgtaatgtgatttcgtaagaaaccaaaaaaaaaaaaatg

SEQ ID NO: 35194 - DNA, 3003 bp, Unknown; identical to SEQ ID NO: 35193
  misc_feature (1)..( 3003): 2750-1469P.txt file - cDNA_ID_3085364; gDNA_ID_2926268; Annot_ID_205011

SEQ ID NO: 35195 - DNA, 3003 bp, Unknown; identical to SEQ ID NO: 28442
  misc_feature (1)..( 3003): 2750-1469P.txt file - cDNA_ID_3085368; gDNA_ID_2926268; Annot_ID_205010

SEQ ID NO: 35196 - DNA, 3003 bp, Unknown
  misc_feature (1)..( 3003): 2750-1469P.txt file - cDNA_ID_3085372; gDNA_ID_2926268; Annot_ID_143365
gcttcttggtgacccattcaggttaggatcactctctccataaccaggacgatcaaaagacacaatgtatatcctcaattcctccacaagagcctaagcacaaagacaccatttttccccattagcttcactaaaagacacaaattttgacattttttctacatgctatcgatgattcaacaaatgggtgatgttagatttggccggaaaacttaccggcgataagaaattggcgaaatgcgagtctcgcatacaagaatcgaagccgtggatgtttatgatcttgaacttggcttcgtctctagggattccgaattctgtgtaagccagatgtcttccgtctctcagtttgatcctcggtgatgtcacggtgggtccaccgggagagccgacgattttggcgggtggtggttggattgtttgataaacccatgctaaaactccgacgaacgttaccaggagaagcgttttcagataaccttcataattgaagaaacaagtcttctaagaccatttagtaaaccgttttcggcccattagaccagcccattaagcggttttattaatatatatatttgttacgagaattttgactctttaattaattcattggtttatgaaattatgattagagaattaatttcataacatgagattattcaaagacaaaaggggataactctgtgaaaactatacagaaattttttattaaaaaggtaaaaaaaaacacacacattattctagttttaaccaaaaagtattacttcttttcttctgacatcccaaatatatttatttacttaaaaagatgcatagagcactacccatgctttaaagtctaagttggtgttaccaagaaaccgtatcaactttaatgaattgaactgaactaaaatatctgaatcgaaactgaaatgattctctgtttacatttgtaaaatcaattacagtttttgtcaaaatcaaatttggtccgatcaaaactaaccgattggtttggttcaatttggactaaaatgttaaatgaacaaacaattagcgaacaaacaagactagcgttctgatctaattccatcaatcatcccatccaagcaagaaattgtgagctctacacatcagttaaagatagatgtcttttttcaacttccataattattctcagcttagcaaaagagagatagtctcagattttattgcaaaagtgagatcgaacataaacaagaacataagaaagatgaaaaaaacataaccgagattttttagttaccagaagaagaactttgttgagtgttgtttctggtgtgagttcttgcagatgctgcagatttcttctccctctctatttcttctccagccattctctctcctctttctcttggaaattttctcactctctttccggaggaaaatttggtgaggcagtagcaatatctttgtttgagagctaacttctttatgatttttttgtccttatatataaacatgaaattaatgattaaactggttttaatatatttttgtattaaaatagtgaaagcttatcagtggttgcaaaatttatatgagaaaactctaaagcatcaatcttctaggaacatatcgagaaattgcgataggagcttggacaattcgaagaataatgggaaacccaaaaaccaatcttgatattgtgttgtgcatacaacttttcctcaattataaatatagctaatgacggacccgtaaaatgtttttaccgaggttataaacaaaataaaattatattaacaaatagagaaaaatgttgtttagtacgccaactttcaaaattggtcatttaatacgtgaattttgtatgtttccaaataaaacatgacaaaaacgttgaccggtcattttatacatataaaaacgttgacaaagccaaaaacaccgcgacgttttctgtcgtttacagaaccgataacaggcgttaatcatttcgttattactcaaaacgacgttgttttgtacttaacacaaatcacaagatctcaatttgatttttaaaagtctaaaacacacgtcgattccgagaaaccaccattgttaacactaaaagcagagattttcttctactcatccattgagcttctcttgattaccccagattttgtatcccaaagaagaagaaaaatctaagaaacttagaacccccttaccttgaaattgcttaaccgatgactaatctcagaaagacacaaagagaattaagagtgagaacaaggaaatctagaaaaactctagatctcagaacataaagaggaaaacaaagataaaagcttgaaactgaaaaatcgatttggaaatttagggatttgaagatttgggggtttctgagatttagagattaaaaaatcgaattgggattttgcggtttgtgtttaagcacaaaacaacgtcgttttggataataacggaatgaataacgtctgctaacgtctgttatcgattatgttaacgacagataacgttgtggtgtttgtggcatggtcaacgtttttctatgtgtaaaatggttggtcaacgattttgtcatgttttatttggccacatacgaagttcacgtattaaatgactatgttttaaaagttggcgtattaaacaacattttttccattaaagaaatatcgcataataatattatatatctatactatattttgaaaaatgttgtggctttctagaaaaaaggagaagaaggaagatttaaagcaaaaaaaaaagtatttaagctgtcataaatagaatttttttaatcaaaagtgtctaaaaggttatttaaactcggtttaaggtgtgtcaataggtagagaaataccgaattagctaacccgacccgtactcgggtggctctttctttcaattctttcttattttgtggtcgttaaacaaagaccggataagttgaagacattcgcgaccgttatttatttcgcagagtgattagagataaagagagagacagagagaatcaaaacaatg

SEQ ID NO: 35197 - DNA, 3003 bp, Unknown; identical to SEQ ID NO: 35196
  misc_feature (1)..( 3003): 2750-1469P.txt file - cDNA_ID_3085372; gDNA_ID_2926268; Annot_ID_205009

SEQ ID NO: 35198 - DNA, 3000 bp, Unknown
  misc_feature (1)..( 3000): 2750-1469P.txt file - cDNA_ID_3085376; gDNA_ID_2926268; Annot_ID_143364
tcggtctttaaccaagacgaagcaagcaaaacatatgttgtgatagcatggaaagtgagtaacttactggatcaggtttctttttggggactacgtctcctgcgaatatcttgattttctctgctcgttctggtccaagcaagcatgaaactatagcagaaacctgaaatcaggcaagaaatgagaaaagtatttccgattatacagttcttctaagctaagacgatgctcgcatattcatgttaacgatgcagctgcgcgtagtcttgtttacgaaaactcatcaggatacaagattttgagatatatggttatggtctcaggaaactgaagtagtagaacctgattgatcataccgccttctcatttgaagtactgcacacagctactttgactccgtttgttaaagcttgatcaaccaacctgcaaagttttagcaagagggctcagaacaaacaagaacatgtatatgattagttgaaataacaagccttacaaacattcatagcatcatgattcaggagtatcaatcattagtaagtttgctaaaccttgttttgggttaaaagttttagactttaaaaaaatcaaactcaaaagggacattcaagtaatagcatcgagaatatagaatagaacattagaagtgacactaactttgcaacaccgggtcgaagcggaagcagctttttctcgataagaaccatgaaaagctcagtcttctgcttgtgaagtccagctatgaactctttcctctctgcttcatctttaggagctttctctggccaaccaaccttgttaaaatacgcagtcatcctaccaaaacaaagccactccaatttcattcaaacgagagactaactcaagatttggtatagtaaatgcaattttgattgtatacctttctttaccaccaccgattttaagtaactcgccgtataaatcaacatcccacgtaacattcaaatctctctgcaaaagattccaattatcatcaccgaagctaagagctaatgaccaaaaaactaaaactgagaaacctctttgaaagtgtcgttgaaggagatcctgtgaccgtccttctcggtatcaacaagaacgccatcgcaatcgaagagaagagcagagggaagagtcgtcagagaagatgaagcagagcaggtgactccaacggagcgagatgatctgtataccattggttttgctctcagggactttccattgaatcgcaacttcaccgcctttgcaggtgccgcattgggaatgaaagatggtgataacttagattgaattgaagaagaagaagaagatggtgatagcgaagccaaggaaagagagattttcacagtggccattgttttgattctctctgtctctctctttatctctaatcactctgcgaaataaataacggtcgcgaatgtcttcaacttatccggtctttgtttaacgaccacaaaataagaaagaattgaaagaaagagccacccgagtacgggtcgggttagctaattcggtatttctctacctattgacacaccttaaaccgagtttaaataaccttttagacacttttgattaaaaaaattctatttatgacagcttaaatacttttttttttgctttaaatcttccttcttctccttttttctagaaagccacaacatttttcaaaatatagtatagatatataatattattatgcgatatttctttaatggaaaaaatgttgtttaatacgccaacttttaaaacatagtcatttaatacgtgaacttcgtatgtggccaaataaaacatgacaaaatcgttgaccaaccattttacacatagaaaaacgttgaccatgccacaaacaccacaacgttatctgtcgttaacataatcgataacagacgttagcagacgttattcattccgttattatccaaaacgacgttgttttgtgcttaaacacaaaccgcaaaatcccaattcgattttttaatctctaaatctcagaaacccccaaatcttcaaatccctaaatttccaaatcgatttttcagtttcaagcttttatctttgttttcctctttatgttctgagatctagagtttttctagatttccttgttctcactcttaattctctttgtgtctttctgagattagtcatcggttaagcaatttcaaggtaagggggttctaagtttcttagatttttcttcttctttgggatacaaaatctggggtaatcaagagaagctcaatggatgagtagaagaaaatctctgcttttagtgttaacaatggtggtttctcggaatcgacgtgtgttttagacttttaaaaatcaaattgagatcttgtgatttgtgttaagtacaaaacaacgtcgttttgagtaataacgaaatgattaacgcctgttatcggttctgtaaacgacagaaaacgtcgcggtgtttttggctttgtcaacgtttttatatgtataaaatgaccggtcaacgtttttgtcatgttttatttggaaacatacaaaattcacgtattaaatgaccaattttgaaagttggcgtactaaacaacatttttctctatttgttaatataattttattttgtttataacctcggtaaaaacattttacgggtccgtcattagctatatttataattgaggaaaagttgtatgcacaacacaatatcaagattggtttttgggtttcccattattcttcgaattgtccaagctcctatcgcaatttctcgatatgttcctagaagattgatgctttagagttttctcatataaattttgcaaccactgataagctttcactattttaatacaaaaatatattaaaaccagtttaatcattaatttcatgtttatatataaggacaaaaaaatcataaagaagttagctctcaaacaaagatattgctactgcctcaccaaattttcctccggaaagagagtgagaaaatttccaagagaaagaggagagagaatg

SEQ ID NO: 35199 - DNA, 3000 bp, Unknown; identical to SEQ ID NO: 35198
  misc_feature (1)..( 3000): 2750-1469P.txt file - cDNA_ID_3085376; gDNA_ID_2926268; Annot_ID_205008

SEQ ID NO: 35200 - DNA, 3003 bp, Unknown
  misc_feature (1)..( 3003): 2750-1469P.txt file - cDNA_ID_3085383; gDNA_ID_2926268; Annot_ID_143362
agacagaaatgaagcaaggtaataattgtagttatgttagaagactatgctgggtagataattctatctgcaagattcagaacttttagttgcaaacttacttaatacatcacagttcatgagtaataaattgtgtagcaaacttatcattctgcagtgtcttagaaccattacctccacacaaaactgtgatcctttgtaaactcttattgcagcctcaacccttatgtgatttatgatatttgttatatggttctacctctatactttctttgcagtcgatgttagaaaattgctacacttgaggcttggtctgccactggatcgccctcttttaagaattgctaatgccttggatttgtctgtgaatgatgactcaaagagtaacatgaacagaaggggtaggtttgcctgttttcttaattttctctctgtgtctcaatatttgccgtggttctaattgttaagttgcatgggcaaatgccaggttccaccttgctcaaagatgtgcatattggaatccctagcagcggaggttagtactatttgtatgcctttgtttccgttgttcatccttcggtctctcgattcgtttattgaatttgcaatgttatgcagtttcggagggtgtggcatctattatccaaggttcttatgagtattatcattatcttcaggatggctttgatgactcggtatatcatttctcattcttccatggttttaaaacactgtaaaagtagattgctgatgacgtgtggagtgaaacaaaactaaagcagaaactagggattaaaggctctgtgctaatttattagaatcttttactgcattcataccggaaactggagttcgtaaatgattattggcatgatagtttgttgcgcttcaagtatttctattgtattttagaaaactagaaataccttctcaacatctaacactaattttcacttgccgtgctagggatggggatgtgcttaccgatcattgcaaactattatctcgtggttcagacttcaacactacacatccatatctgtaccttcacataggtatgaaacttctgtttctcatgaatataaatcagagctcctctttcctcgattcgctaagtatttttctggattctcagggaaatacagcagacactcgtggaaataggtgacaaggatccttcgtttgtaggatcgcgtgaatggattggtgccatagagttaagctttgtgttggataaacttcttggtgtaagtcttctgctcttaacttcttggtgtaagtctcctgctctgaacttgatgttgagaagctcgtaatgtcttttatttgcaggtaagttgcaaaattatgaacttcagatccggatcagagctcccagagaaatgccgggagttagctatgcactttgagaaccaaggaactccaataatgattggtaagtcaagccaaatcactctgatattatagcataagtgaaagcgtagaccctatatataaaggatcagtggaccagtctttaatgcggtttaaagaaacctataagaaggatccgtttaatcttttaaactttgtattgtgaattggttttacttgcaggaggtggggttcttgcatacacgctattgggagtggattacgatgaaggaagcggggattgcgcgttcctgatcctggatccgcattatacaggaagtgaagatcacaagaagatcgtcaatggtggttggtgtgggtggaaaaaagctgttgatagcaaaggaaaaagctttttcttgcacaacaagttttacaatcttcttcttcctcaacgtcccaacatggtttaattatcattttcctacatgtaacaacaattactttttttcttatcacagttttagcctgctctggtctcctgatagtgcaaaaaatggagttttcaagaaatttgaatttcagtcgaataaataaaccatattgaaattaatgtccggcttttagattcggtgttacttcttgttagatgaatcgtttggcaaagtccaatggaaaccttttttctcattgcatggcattgaggggtagttttggtaaatttgtaaaaacttttggataagaatggaaaaaagcagcgataggaacgattacgtgcgggagtgtagagcacgtggaatagaatcaacagaaatagataattaccaaaacttacaaaactacacaaaacccccacatttagcctaatatttgtatagaatgcctaaattctaattggattcttttaagagaaataatggctatgggtattgaaaaatatatgtatatatataaaattcgatttatttggattgaatgtctgtaagaaaacttctttggaaaaagaagatatttcaaaacacgtcaaccagtaaaactaattaggacctatctgaactaataaaaagtatagtgtttgatttagaattaaattacatttaatggcttctccacaatttaaaaagccttatatgatgacgtgtaccttccctttactttttatttgtttttcctttttccaattttgtaaatcgccgattctctctcatcgactagtatttatagtctcgtcgaacttagaaatcggcgacatttgaatcttctaagactctggtggaaatttttattacttacctgcggagttctgatagcttcttcttcttcttcctgtcttggcttgagatccgaagccaagtacagaagagttcgttcgattagtttggattcgtttcgaattaatcactggtatgtataattctattactggatttaggttttatatgttgcttctttgatattatacaaaccagtgtgtttgtaacttagaggtagtgttgtttcgtgttatttttctgtttaattaatgttatgaagccaagctataatgttatttgttctagaatgtagattgttgtgttctgttttgctcttaacttgttgttttcggatttgttttctaaatcattcataaatcttgaacgtgtttagatg

SEQ ID NO: 35201 - DNA, 3003 bp, Unknown; identical to SEQ ID NO: 35200
  misc_feature (1)..( 3003): 2750-1469P.txt file - cDNA_ID_3085383; gDNA_ID_2926268; Annot_ID_205006

SEQ ID NO: 35202 - DNA, 3003 bp, Unknown; identical to SEQ ID NO: 28441
  misc_feature (1)..( 3003): 2750-1469P.txt file - cDNA_ID_3085387; gDNA_ID_2926268; Annot_ID_205005

SEQ ID NO: 35203 - DNA, 3000 bp, Unknown
  misc_feature (1)..( 3000): 2750-1469P.txt file - cDNA_ID_3085394; gDNA_ID_2926268; Annot_ID_205003
atacatatatatatatatatatatatttgttttatttttagtatattattatattagtatgttcccgatagaaattttgctattatagcaatacataggtcttatcatcaataacccacttctgatgtcccactaataattaacaactagtataagttatcgtgtgtaaaatattttctttcggtttttgtatacgagtaaaccctaaagcaatcgatctagttaaataaattataatataatttagataaaatctccaagaaaccatttctgttgtttaatctcccaactactgaataatataattaaggtcgaatcccatgaaaataagttatgacggaagaacatattgtaaatgtaagtttggttaacttgaactcaaactatgtgacatccaaatcttttgtctcctcgatcgtatttactttttgttgccaaggtttcaaatccacaggctcctacttttgtaaagtcaaaccttttcatttctaatgatactaacattcatagcaaaaaaaaacacattgtaaatttattatttatatatctcataaggacgagtattaggatccaaatgagaccttttggtcctccacatatcatgcggacaggatcatcaatcatcactgattagtattaatgaagttggcttttagataaagtattcaaccaataatatggggaatggacatctccgagactccgaccaataatgagaaagttaatcaaatctatttatgggtcggaccgatcactatttttctgatgcggaaacttatcaacaaactttgaattttttagctttttgttttacaatgaatctatttgcattaattttaaaactgtgtttataattaaacaagaaaaatggtttgaaatgatgaattcattggcctaggacgtgagatcaaaacgccaactccaaatccaaccaagccaatgttcatttctccacgtggcgtttttaatggatcaaaatcattgcaccaaacctaatttccaacaaatcaacatttatgcggcgaacttactccccaaatccaacgtaacaatcgcactatacactttttttttttaattccataaatttcatagttcttttttctccaaatttataattatagacagggtccaaaatgtttcatgaaaattaagtaaaaaagtaattaatattaaaaatgataaaatataggtcaattacctaaaaacagagtttttctttgctataaatggtaggttaatttttctaccaacattaaaaaaaaaaaaacactattatttagtagtaaattgtagtcttacctagattgattgaggaatttaatgaaatacttttacaaaaaaaaataccatgaaacaatatatgtgattacaaaagttaatgatctatgcgattaggaagaaaatgttcgaaattcaaagctattactaagatagttaaaaatatatccaaaacggataagaacgttcgatttaaaagtcatgtattcatttatcttatggaaaatattttaatcgaacacaaaattccgttgacacagattgagtcacacaatggataaacaaaaggatcacaattggcaatacaagagggcgtgtaagattggatgagaacaaaatgccacgagggatgaggagaggtggctcttgggaagaggcaaaggtcggtttattgcaataaccggcttttctagtttttttttaataaacagctctttgacgcaaagccaaaaacaatattggtcccggatttgttcactttccacattggattgataagaaaacataaatctgcctacatggaacaaaaaggtcgtcttgtttttcggatcacaaacaaaagcaaccttataatagtcactttttttcaggaacgtaaattatgcaaatattttcattttttgttttcatcttattttcctaatgttgggaatataatacggacagtgttacacggtgtaacttacaccgttggtccagctcaatacacaaatcaaatagaacattatctatgttaaattcttatgcatgttacaccaagtcggtaatatatattaaaaggtttaaaacaaatataagcaattgaaattaaatacaaaattgagcttgttagtgggacattgtttaactaacttctcatggaaattaaactcatcactcttgctatggttgagacattgtttaactaagttctcatggaaaaaatggggcgccacttaaggtataaaccaaaatatttgcgttaaaccctagataagctaagatgccatggaaacaaaacactgggcgagttttcttctcgtgacaattatcatcaaaaattatggaacaagttgatcctaatcctaatcctcttatcaatatctttgattgtcttaaagtttttatttattttatttcgtgataattgcattgtcttaaagttcatagttgcataataactttatccccaaactttcatgatctccacggaccaaaaaaaaaaaaacttaggaattagtttaccaaaaactccaactacttaaaatttcagatatttgttgtcagtattcaaatactacactcggaagtttcgttcgactatgatacatattctcagttcttttttgatgattcatggaagataaatttgaatatgaattctcctgttcgttataaattattgtaataaagacttaaagagtgatccagcttcatctctttatccacaaatgctattcccgtcacataaaaatgccaaaaaaagaaaaaaaagagtgataatctaagtgaaaacagatcacgagcgtgttagataagaatagagagacgcaaaaataaaatagatatttgcgagacgccacgtaagcaaccaaaaggttacggtaggacccacctcgctaatgtctatataaccagaaatgtgccaaagcctttcttcttcaaactaccaaacctacagaaatctctcttcttcttcttctctacaaaatttcaatggaagctgttcttgtcgcaatg

SEQ ID NO: 35204 - DNA, 3003 bp, Unknown
  misc_feature (1)..( 3003): 2750-1469P.txt file - cDNA_ID_3085402; gDNA_ID_2926268; Annot_ID_143357
aagtgtcttgatcctggtaaattaatccaccaaggatagtgtcatataacttgatatctaaagctaagtgtgttacatgaaattacttactcttctaagctctttagggagacctagatcctgagatattgtaggttaaagtctggttgttttctagtcactggatgagatcaaggtagtatcattagattctttaagaacttggttttgccatccgatggcgggtttgtgtcatttttgtttctgctgtaactgacttgatatagatcgacacaagctgattattgagtagtttctttagccagaaatgaggattagcattcatcaacaaaattttaatggaggaaatcagtcaatcacacaattgggttgcttaggcagtgatcgtctagatataagattgacacgtagagtttcttgcttctaccattgagattacttgttgttccaaatctcttgagtgggtattaacccgagggtaatcagacctaatttcaagaatcatccttagaccattgtttcttgcgacttatgattcttcagctttctcaaagtttgttttaatacgtttgttttgttccgatttgattaccaggacattcaccccacacacagtgtttgcgaatataactaattttgagatatgttaacaacataaaactttttaaaatgattttgcaactgtacgatatataaaaattaagatggtaaattatatagatagattgtttcataaataactatatattaaaatgacacaaaagtattgactttagaggtgggaaaaaactcttgtagccaaaaatgtttctatcggactttttgattggaatcctcttcagacttcaattatttgaatctttcaaaagatttgggaatcttctaacgttttggatttaaaattggataggcttttaaggacagttcagacacgccagctgtttggatcggtccacgatccctagaaaaagaacacgtcattgtaaattaaaatttttgggtttcgaacgtataatattcataaccaataaaatagtagagtcacttccaagaaactaggaaacatcaaaccacgtcgttgcattttggggatcttatgaaatacacaagcttatacaaaaaaaaatattataaaaaaatgaacgtatattaattcgtaattacataggcttaaaaccaagataagatcggtacatgttgaaaatgaaaattattcaatctcctaatagaggtgagacaattatcaattcgaaactcatacatcaatcataaaagctacaatattttctcaactccatcaattatccgtgggagtcatacaaaaaaaaaattaaaaaaattattacatatatatgtatttttttttcagaaaagtgaaatctctttcgaacatatgaaattatgaatattcatcaattggcctaggattacgagatcaacgtaaattatttaaataacaaaaataaaaaatatgtttccttgcattaggaagcatcattatccaaccacgacgccgggtattaagccaagatccattccaattattcattcatatctactacctaaaacgacattagctttttataaagaaagtcttaacccacgatcggtgttcatatttaaatattacatttgttgttaaacaccaatgttatgcctaacaacttaaataaaaccgccataattgttttttattgtgtttttgaaaaactacttgcccgttgttatcttgtggcctgagttttttttctcttttgtttttaatatatgtagtatgaaaccacgtttcaacaaatgggctgcgccaaatgttcacgcatcttgccttgagaattttgaataacaactaattagagattaaggtatggaaatgtacaaaaatcgccacgagatcctttcgtagatccacatggtattaccgggatacatggagaaacatgttttcttaagatcagtacattactcattaaatggtcgatattagtaaattatttttgtacgtaattgctcggtgcatggtttaagacgtgtgttcttaaaagctactccaattaataatgatgctttcatgtggtgtggaattaaaagttttggatgcgtagtggctaatcaaaaaatcataaagttcatagtttaagcttcgaaaatgcaaatagcttggggatacaaaagctatctttacaaaaatcttagaaatggtggagtcttacataatcacgtgtgtgatccaaattatagatgtaatagaagaaatttttcttgtattttcatgtattatatgcatcgcctttatcgtctacacatgaccaaaattttttcccattttcccatttttaatcctatacaaaagaagttttttttattgtacaaggcattaggtcaacaatgccatggtgtgaacaactttgtctccacatttttggggacatatcttaatctaattatcgctttcattacttccctaagcaacaagttgcttcatcttaattttcccattattgtataaaactatccatcaaccctgacaaatttaaacgatgaaagcctgaattattgataatgatattgatatcattatcatccaaacgatgaaagcctgaattattcagttttaaaaggatattcagttttctctcactgtcagctaacttagtcaaatcaaacattcataaatatatattacacaacatatagatctataagcatgacatttataaaaccatatattataaatcttatgatttattatcctaaactatttagaaagaatatgatgggttccttattcctctcaaatgcgtgtcctagaagttccacaagtctaaccaagacgtatacacaatgatacacaataataattcattttccaaacgttgatggtatttgagtaatttcaaatctctacagaaaaatatttctctttccctatatatatccgataccatctcattgcactttcaacctcaaacaaataaccaatcaaccaaaaaaaaaaaaaaaatg

SEQ ID NO: 35205 - DNA, 3003 bp, Unknown; identical to SEQ ID NO: 35204
  misc_feature (1)..( 3003): 2750-1469P.txt file - cDNA_ID_3085402; gDNA_ID_2926268; Annot_ID_205000

SEQ ID NO: 35206 - DNA, 3000 bp, Unknown; identical to SEQ ID NO: 28437
  misc_feature (1)..( 3000): 2750-1469P.txt file - cDNA_ID_3085406; gDNA_ID_2926268; Annot_ID_204998

SEQ ID NO: 35207 - DNA, 3003 bp, Unknown
  misc_feature (1)..( 3003): 2750-1469P.txt file - cDNA_ID_3085410; gDNA_ID_2926268; Annot_ID_143355
ccatcctctttttcataaaacagaaaaaagggaagaaaagcaacacacctgcgtcaccaccgagacttccgttgataggaaaccttcatcaactcggtcgccaccctcaccgatcactatgctctctcagcaatcgttacggccctcttatgctccttcgttttggccttgtccccgttcttgtagtctcttccgcagatgtggctcgagatattttgaagacgtatgaccgcgtttttgcaagccggccacggtcaaaaatctttgagaaaatattttatgaggcccgtgatgtggccttagctccttatggagagtattggaggcaaatgaagagcgtgtgcgtcctccatctcctcaccaacaaaatggtcagatcctttcgaaacgtgagacaagaagagatcagtctgatgatggagaagatccagaaatcaagttctttgcaagtgaatctaagcgagctcttggggagtttaactaacgatgtgatatctagagttgctttgggacggaaatatagtgatgaaacggattttaaggagttaatgaaaaggctcacgaagctactgggcgagttttgtgtggggacttatgtaccatggcttgcatggattgattggatcagcggtttggatggacaactaaaaaagacaggtaatgatcttgatgaattcttggagaaagttgtccaagatcatgaagatggcgacgcacaaaggactgactttgtggatgtattgctcagaatccagagggagaagagcgtcgggtttgaaatcgaccggttaagcataaaggcaatcatcttggtaaaacagaaaagaagaaaataaattcatattcaatgatgttttagtatataaccgtagttcttgtgttttggtaacttttcaggatgttgttgtgggtggtacggatacatcgtacgcacttatggagtgggcaatgacagagcttcttcatcgcccagagtgtctgaacagactccaagaagaagtccgtacgatttgtaagggaaattcgagtgtatcagaagatgacatcaaagacatgaactacttaaaagctgtgatcaaagagactatgaggctacatcctccacttccattgatggttcctcacgaatcaacacaagatgtcagattaggagattaccacatacctgcgggtacacaggtaatgatcaatgcttgggcgatcgggagagaggctgcgacgtggggaccagacgcggagaagtttagaccggagagacatttaaattcgtctgtcgatttccgaggtcacaattttgagcttattccatttggagcagggagaaggatttgtccagcaatatcattcgctgtgatcttgattgaggtgactttggctaacttagtgcatcggtatgattggagattaccggaggaatatatagaagatcaaaccaatgtcgctgaatcaaccggtatggtgattcaccgtttattccctctttacgccattgtatcatctactacttgatggatgcattatacataaatgcttactattatgttatgtctacaataaacatgtttactcatttgaaaatgttgctaccaaagagaagtttgagattttaaagtctcaagttcctaaactaatttagaaagccaggtgagcttacttgatttattgttatgttcaacaagcatcattagtcccttctcaagtgggcttcaagaacacaagctgatatcaagaacacgcatacccggtttcaaattatttccaatcattagacgattgcgcataatagcactgcgcagaggtcagttcgagttgactgtaaattagtagcttgattggtatatttagttcaaattttgtgttttttttttgtgtgatgttattaaatattctgataagtagtttagtggctttgtagaccattattgaaaccagattgagggatagctatatactaaagtagctaactaaaactcacaacaataataagtgttgcaatattaacgaccaaagcaacgactttgaggaatccaacactttcaaatgacgcgttaataataaaattaaaaacactatagaaaatctccaaacttagagagaaactaaaacacgaaccaatttgatattttttcctgagtgattcgttcttaatttctcgttaatgagcttgattggtttgtttagttcaactttgtgttatttactagttactacttaggggttgttattgaattaatgtatttgaatttgcagttttctttgtgggttttattttatcaaatacataattgaataacagtggatatcgccttgactttaaaacacattcaattccattagttcagtagttttgcgtgactatgctatttgttactttgacgtgcttgcatgactgtctacctcacagtttgaataagtataagtggaaatattcatagttttacttggttgtatctgttctctctccattgttatgttgatgaccttcttaaatgtcatgattttccagggtttaattagggcgccttaccttgaaagaaattggagaaagaaattataaacgtgaaactcctcttctttgcgcatacataaaaagagcaatccaaatcgtaaaaggattagatgagaaaccctagagaacttgttcctcaaagagaacttgttcactaagacaatttgaaagattcaacgttttttttttctttgtcaaactcttaataagaacgtgtaatagttgaattttcttatccatgtggggcagagaaataagaaaattttgagtggacagagttttggtcccaggagaaacttggcttctataattgtatacattagtcaaacagaagaaaacgaaattctggcttactagagatattgtgtggttcattctgtatgcaatctctaattccatatgactcagctcatctaagttctaaaagaagaccacaaaattcttagatactctttacaagaaaatcttgacgaaacttgaagaatacaagcatg

SEQ ID NO: 35208 - DNA, 3003 bp, Unknown; identical to SEQ ID NO: 35207
  misc_feature (1)..( 3003): 2750-1469P.txt file - cDNA_ID_3085410; gDNA_ID_2926268; Annot_ID_204997

SEQ ID NO: 35209 - DNA, 3003 bp, Unknown
  misc_feature (1)..( 3003): 2750-1469P.txt file - cDNA_ID_3085414; gDNA_ID_2926268; Annot_ID_143353
atatccttcatcagctcagcctcacccacacagaaatctaaaacgattttcttaaaaaatccagtgatgaaaatgatgatgatgatcatacttctcttatgctcaataatactcataaccattctcttcttcaaaaaacagtcgagagggaagaagagcaacgcacctccatcaccaccgagacttcctctgataagaaaccttcatcagctcgggcgccaccctcaccgatcattatgctccctcagccaccgttacggtcctctgatgctcctccactttggcagtgtccctgttcttgtagtctcctccgcagatgcggctaaagacgttttgaagacgcatgaccgcgtttttgctagccgtccacggtcaaaaatctttgataagattttttacaacgggcgagatgtggccttagctccttatggagagtattggaggcaaatgaaaagtgtgtgcgtcctccatctctttagtaacaaaatggtacgatcctttcgagacgttagacaagaagagatcagcctgatgattgagaagatccgaatatcgagttctttgcggataaatttaagcgagatcctggtgaatcttacaaacaatgtaatatgtagagttgctttgggacggaaatacggcggtaagaccgattttaaagacttaatgaaaaggctaacgaggctactaggcgagtttagtgtcgggagttatgtatcgtggctcgcatggattgactggatccgcggtttggatggtcaacttataaagataagcaatgatcttgatgaattcttggagagggttgtccaagatcatgtagatggggatggacacaagaatgattttgtggatttcttgctcacaattgagagagagaagagcgttgggtttgaaatcgaccggttaagcataaaagcaattatcttggtaaagggaagatacgaaaacaaatttaaattcactgatgagttagtatataaccatagttcttgttttggttttcaggatgtttttgtgggtgatatggacacaacatacactcttttggaatgggcaatgacagagctactatgccaccatgagtgtctagacagactccaagaagaagttcgtatggtttgtaaagacaaatcgggtgtatcagaagacgaccttcaagacatgaaatacttaaaagctgtgattaaagagacactaaggctacatcctccacttccattgatggttcctcacgaatcaacacatgatgtcaaattaagagactatcacatacctgccggtacacatgtaatgatcaatgcttgggcaatcgggagagaggctgcgacatggggaccagacgcggaagagtttagaccagagagacatttgaattcgtatgttgattaccgaggtcaggatacggagctggtcccgtttggagcagggagaaggatttgcccagcaatatcatttgctgtggtattggatgaggtggttttggctaacttagtgcatcagtttgattggacactaccggaggaatctacagaatatcagactgatgtcgctgaatcaaccggtatggcggttcatcgcatgttcccactcttcgccatgactacttgatttagacattacagcatatagatatgctttgttagaagcgtacaatacgcatgtcagtggtaaagagatcttaagatttgagttcttaagtaaactatagactaatagtttgactcaaaaaaaagtaaccacactaattaagtaagccaagcggcataatcagttccctcgcaattatcaacggaatataacagatcgatgtttccttctcaattaggctcttagtataagttccactgtagacataaatgagtaaatataagatatagatagagaccatgtatgcatgcaaaacttaaaaaaaacaaacagaaatcaattatatattttaattagggtgggatcagattaaaacttctggaactttaggatatcctttcgatcttgtaaaatttttataagatttttatcttcctattttaagactatatattaaaaagtggaaaagattggattatatcaaccctaattcaccgtctaatttgttttcctctttatgccattacatcatctactacttgattaaggcattatatacattaaaatgatttatattatgttactagatcagaacccatttgatacatgggttaatcaataaatgtttttttataaagtttaataaggtttttttgcagttttatctaaatattaataggctatgaaaatataatatggtgaagattttaagattttatgaaaatataatagacttctggaatttgatgctttagttttattacaaaagcttgtctagaagacttgaagtattagacaatataattgaggaaaatgaaagacagtaaaacgcttttgttgatgaaatcgaaacaattaccaaatttccgaggctgaaaagagatatgtcaatgccttagattagaggtgagttactttttggtgtgttttcacatatttcttcaaagttattagctttgatatttaaatattctacatttacaaacaaataggtggtagaatcatacctaaaatttaaaaagttattaatatacaaataaggactatatattttaggagataaatagttttcttggaccttgtagctgtctaaaatctagcaaaataggtattaaaaaaagtaaaagatttcttttttgtttggtcaacttacttgtattgtggagagattttttacctttactatataggatttgagagaatatatatttaatgcaaatttactttcctactatacttgggcaaaacagaagaaaatttgagtggaccctcgttacgtaacgcatagaagaaacttggcttatatataacgcaagtggcgaagtccacaagaagaacacaaaaaacttaagaaactcttcacgagaaaaacttgaagaacttaagaatccaagtttacaaaatatgatcatg

SEQ ID NO: 35210 - DNA, 3003 bp, Unknown; identical to SEQ ID NO: 35209
  misc_feature (1)..( 3003): 2750-1469P.txt file - cDNA_ID_3085414; gDNA_ID_2926268; Annot_ID_204995

SEQ ID NO: 35211 - DNA, 3003 bp, Unknown
  misc_feature (1)..( 3003): 2750-1469P.txt file - cDNA_ID_3085422; gDNA_ID_2926268; Annot_ID_143351
atgctcaataatctttgtagttaccatcataattttcagaaaacagaagagagggaagaaaagaaacacacttccgtcaccaccgggactaccgttgatcggaaaccttcatcaactcggccgccaccctcaccgatcactatgctctctcagccaccggtacggtcctcttatgcttcttcactttggccgtgtccccgttcttgtagtatcttcagctgaattggctagagacgttttgaagacgcatgaccgtgttttcgcaagccggccacggtcaaaaatcttcgagaaacttctttacgataagcatgatgtggcctcagctccttatggagagtactggaggcaaatgaaaagtgtgtgcgtcctccatctattcagcaacaaaatggtacgatcctttcgagaagtgagagaagaagagatcagtctgatgatggaaaagatcaggaaatcgatttctttgccggtaaatctaagcaagatcttggtgagtttaactaacgatgtgatatgtaaagttgctttgggacggaaatacggtggtgaaacggattttaaggagttaatggagagactaaataaactattggggacgtttagtgtggggagttatgtaccttggcttgcgtggattgattggatccgcggtttagactgtcaactagaaaagacggcaaacgatgttgataagttctttgagagagttgtgcaagatcatgtcgatggaaacagagatatgactgattttgtggatgtattgctcgctattcaaagagataagaccgtcgggtttgaaatcaaccgtgttagcataaaggcaattgtcatggtgaggaaacacacttttgaatgataccaattcagatttatgatgttttattgtgtaatgtttttttttttttacaacatgatgtgttagtaagtatataacagtagttcttgttttggttttaacttttcagaatgtttttgtgggtggtacggatacatcgtctacacttatggaatgggcaatgacagagcttctacgtcatccaaagtgtctgaaaagactccaagaagaagtccgcacgatttgcaaggataaatcaagtgtgtcagaagaagaaattcaaaacatgagctacttaaaagctgtaatcaaagaggcactcaggctccatcctccacttccattgatggttcctcacgaatcaacacaagatgtcagattaggagatcaccacataccagccggtacacaggtattgatcaatgcatgggcaatcgggagagaggctgcgacgtggggaccagacgtggaggagtttagaccagagaggcatttagattcgtctgttgattaccggggtcaggcttttgaactgattccattcggatcaggaagaaggatttgtccagcaatatcattcgctgtggtgttgaatgaggttgttttggctaacttagtgcatcggtttgattggagattatcagtcgaatctacagaagatcagaccgaggtcgctgaatcaacgggtattgcgatccaccgcatgttcccactctacgccattgcatcaaatactacttgaccagttgacctaggcatcttatatatatagaatcatagaaatgctttgttctgttacgtgtacgataaacatacacgtttactcatttcaaatgtgcaaccataactttgcgagttctccaccatatagctgtgttgttgttgatattgcttggactccacaaaacaaattaccaatcaggacgaaaaaaaaacaagtatgtccaacgtatttatcaaacttcttttttaaaaaaagaagtagaatcacaattagatctattggttcctttcaaaacgattatacagctaactaggagatacagtactttcatattgtgaccgaaaccatccgaaaaaatgttcaagatctttttgtttctattctgagcttatgtttatatatataaaaaaaaaaaaaggtggaatgacccgaaataatcgtcttatctgtatgtgtttctaatttctattagtgttcaagcaaaactataggtggtctagtagaacgtctgattgtgttatttaaaaatttagtgttactagtagtacgtctaatcattttttgtattgaatatataaattgtgttatcttatttattatttaaaagcatgataaaatttaatatttgttatataattaatattgtagaaataaatgcaaagttggttatcattagaaaattgtgattaattcgatttcaaaatatacaattacgttaaaatcagatttatttaagatacaaattttggttgtcgtatttgttatataattatgtttagtttgtgcatccattaataatttgcactgtggatgtatatattacataaatccaaaaattgagtggtaattacgtaaagtgtaaagttgtgcataagtccaaaagatcaaaaagaactttaaaactcacaagaattttgtgtaaagaacttacagaatccagacatgcaaaacctttttactggataccttttatgactacaaagtaaggtattcgaaatatacaaattatgatattattgtatttaagaaagttatttgaaatatactaataaggtatataattttaagagataaataattctgtggctattaaaaaatcaaacatatagaagtagaagatgaaatatatttttttttggtaaaatattatttttgtttattttatctttgaatagcaaaatggattgtttcagtttaattgtgatgtgtgattgggttgtcagtaatattgtagagatttctttgctttttaggcataggatttgtccatttgagaggaaattttattttgcccattaaagcaaagaaagaagaaaatctgagtggaccctagtaacgtaacatacgtagaaaaactttgattatataaccctgtccaacagaacataaattaacaagagaaatctctaagaactgtgaaaccaaaataataaaaaaaatg

SEQ ID NO: 35212 - DNA, 3003 bp, Unknown; identical to SEQ ID NO: 35211
  misc_feature (1)..( 3003): 2750-1469P.txt file - cDNA_ID_3085422; gDNA_ID_2926268; Annot_ID_204993

SEQ ID NO: 35213 - DNA, 3000 bp, Unknown; identical to SEQ ID NO: 28434
  misc_feature (1)..( 3000): 2750-1469P.txt file - cDNA_ID_3085430; gDNA_ID_2926268; Annot_ID_204991

SEQ ID NO: 35214 - DNA, 3000 bp, Unknown
  misc_feature (1)..( 3000): 2750-1469P.txt file - cDNA_ID_3085487; gDNA_ID_2926269; Annot_ID_143400
gatcgatattggatggaattttaccgaaaggacttataccgagaggacgtatacgaagaggactttttccaagaggacttataccaagactgcctgcaccaagtgggtccacaccaagtggaccttcacttggtggagattcaacgagtggaccttcaccagatgaacctttacctggtggagataaatcaggtggtagttttccaagtggaccttcatcggatgcaccagcaacaggtggatcaatacttagtggacttataccgagtgggcctgcattagatggatcagcatcagatgcatctgccttggatggttcaatattgggtggacttataccgagaggactaataccgagaggacgtatacttagaggacttataccaaaactacgtataccgagcaggccttcactaagtgggccttcaccggatggagatgcaatgaatggacttgcaccgggtggacctacaccaaatgaacctatacctagtggagatgcatcaggtggaagttttccgggtggaggtatttcccaagataaaccagtgcctacgaaaacatcaaataaacctacaactaatccatcatcaactaaaccgaaatctaaaccatcatctaaaccgacatctaaaccatcatctaaaccgatatctaaaccatcaactaaatcaacgtctaaaccatcatctaaatcgacatctaaaccatcaactaaaccgaaatctaaaccatcatctaaaccgacatctaaaccatcatctaaaccgatatctaaaccatcaactaaatcgacgtctaaaccatcatctaaaccgacatctaaaccatcaactgtatcagcatctaaaccatcatcgaaaccaacatctaaaccatcaacaaaaccaacagttaaaccaacacctaaaccgacatctaaatcaacagccaacccatctactaaaccaataaccaaaccgataaataaaccaacatccaaaccaagaacaaaaaccatagctaaaccatcatcgaaagaagcaggttaaccaacaacaaagccaacaacaactaaatcgacatctaaaccatcatctaaaccgtcatctaaaccatcaactaaaccaacatctaaatcggtagttaaaccatcaactaaaccaacgaataaacctgtaacaaaaccgatatctaaaccaacaacaaaatcaatagctaaaccatcatccaaagaagcaggtaaaccaacaacaaggccaacaattgagccatcatcaaaaccgacaacaaaaccagtggcaaaaccaatatcaaagtcaacaacaaaaccaatatcaaagtcggtagcaaagccagttagaaaaccgacatctaaaccgacaaaaaagtcagaagcaaagccaacatcaaaaacgactgtaaaaccagtagcaaaaccgacagcaaaaccggcagcgaagccaacatcaaaaccaaaagccaaaccgaaggcaaaaccagtatcaaagccggtagcaaaatcgatggcaaaaccaacatctaagcccgcagcaaagctagttacaaaaccgacaacaaaaccaacatctaaaccgacgaaaaaacttgcatcaaatccaccatcaaaaccgactgtaaaaccgtttgcaaaatcagcagcaaaaccgatagaaaaaccgccagcaaagccaacatcaaaactgacagcaaaaccggtggcaaaacaagtatcaaagtcagtagcaaaatcgacttcaaaaccaacaccaatgccggtagcaaagccaattacaaagtcggcaacaaaaccaacatctaaactgacaaaaaagccggtaggaaaacccgcatcaaaaccgactgtaaagctgatagcaaaaccaactgcaaagcctgtatcaaaaccgatagaaaaaacagcaggcaagccaacatcaaaaccagtatcaaaacctatggtaaaaccagtatcaaagccaacatcaaagtcggtagcaaagccagttacaaaaccgccagcaaaactaatatctaaaccggtagcaaaaccatcatctaaaccaacatctaaaaaggtagcaaaaccactatcaaaaccgattgtaaagccgatggtcaaatcagcagcaaaaccggcagcaaagcgaacatcaaaaccggtatcaaaccgacagtaaaaccggcaacgaaaccaaaattgaaaccaacaacaaaaccaacatctaaaccaaaaccgaccgcaaagcccgcagcaaaaccaccggctaaaccaaagaaatgaaaagatacggaggacaatgaaagatgatatggatatttttaatatgcatgtaatcattagaattccaaaattaaatctagttgataattactaactacgtgttgaagaaactaaaattctcaaatatcattttattaatatacgagtcttctttaacatcttataacattccatttattggatgccgaaaattatcctatttgctctattgaagattcagatcgctatgtttgagagcactcgagttttcaatcctcaatatttcaattagttaatcatacttattcatttatttcactgtattcgatttttaaaacatgtaagctataatatcacaaccgaaacaaactcttatcaaaaccacagcaaattaaatctaattgaaccaaacgaaatatatagtccaaccgattaaaaatgactttgaggttataattcaatcaaattttaacgaaaactgaactaatcaaaccaaccaacggtacctacccaaaccgaaatccgaaaataaaccaaaatacctacaactattttttttacaagaaagtgtgaccattttcgcatgaagaaagaaagacgaagaggcattgacgtgacgtagagctcaacattcactcgcatcgtttcgcatggggtaagcaggtgccgtgcacgtagaccacaccactctctcttcattaaaatccactcttctaattcatgaaattccacaatcatccgatatcaaacaagctatg

SEQ ID NO: 35215 - DNA, 3000 bp, Unknown; identical to SEQ ID NO: 35214
  misc_feature (1)..( 3000): 2750-1469P.txt file - cDNA_ID_3085487; gDNA_ID_2926269; Annot_ID_205062

SEQ ID NO: 35216 - DNA, 3000 bp, Unknown
  misc_feature (1)..( 3000): 2750-1469P.txt file - cDNA_ID_3085515; gDNA_ID_2926269; Annot_ID_205051
ctatgttagagaacaaaaacaaaaaagagtaccacgtacaaaaaacaaaaaaacagggaagatatgtgatattttttaatcaattagaaaaaagaaagaaagttaagaataaattaactgttaggtaacttaacgatgttattacgtactaaattaaatatatagtgcaaagagaaaattagctctttaaatttagacgatcatatttgataagaaattaaattgactaaaaatgtctattgcataaagcttattcagtattttaatatatattcatatattattttattgtttttaacataaggacaaaaaaagaaaaaaagaaaaatgataagtgaagggttgcaagtaaaacaaaggatttcttaaaccttaccttagttaggacggtccaggtgattcagttcattagatgcacgtcaagaaaaaagacaaaatctgccgctatattttgtagatgcaatgtataagtatgacctaatcagtgacatgtaatacctgtatccgggtggattctctggccaaagatgaatccaacgatgaagaggatgtgcatagtgctttagaaaaatcctccagaattggatcgtgtccaaaccgtccttgagactcgtactgtaccgaaccggtgcgtagacatcgtttgacataaactgtttcttctccttcgccggcagctcgaagaagctattcgcaacctccaaggcgtcatctagtatgttctggttgattccatggttcactatctaatatattcatcggacaaaaagaatggaaaaaatgaatcagttagagtggaaggatataccggaaaatgttgaaatattttggagccaattaaccagaaactacatttagacccccggcatgtgacagccacgtcacgttactaacacagctgatattttgatttcaacgaatacgagagctgatttaacgtgattttaaataatgacacgaactatatgtatgttaatactatgttgaatccgtggttatcaaatgtaagcaaacttctacattacatatatcgttgataaaaagaaacaaaaagtggatgaaaaagcagtttccttgcaaccaaaatttcggaaaaaaactcaaagttatatgaatttacttgtaaaatagcttacttgaaaaaaaccaagatgttgacatgccaaacttagctcctgaataacccctcgacgttcatcatctccccctttcagccgagaaacatcgatagtgggtacgattccggaatttgagtcacatggtttgctagaaggcgggacgacgtaacagtcaggtacatacggtaaactcctctcttgtgcagaattccccattttgaatgtgcttgaatcctcacctttctccattattggtatttgaatttgagtgttgagaaatcggttaatattgtgaagggataactaaaatgaaagtgtgagtggctcctctatatataaggtttgtaggcttgtagtcgtttattgatatttcggagttatatattaaaatatgacggtcgaatactaaattattattcttcctttttggaatatctagagcatgtgtaactgtcaattgtttatcgtgtaccaataagaaactaaactttattatcaaaatgataatataatgaacatccatatgttgtacgaaatgtataagaatgtccaaattcatatatgacgagggatattaataagatgttgggatatagtaggaagtaggaacactaacatggatttaatttttaaatggagacttcgatctcattcatagtcccaactactaaaaaacaaaaagaagctttccgcaaaaaagcatcctcttgtccggatttcaagccttcataaatatgttggacacatatgtgaatgcatgtacagataaattcgatatatatgtcgtttgagttgtaacaattctgtaaaaataataatgaaattgttatatacggtcatgcgtaaggtctaggtaaaatgtattgcgccgggttccttcatgcaatgggcatttatcttcctttgggaaagacaaaaaaatgtctgatgtcacattgtcactgacattaaaatgagaattttcaatcataatttaacacaactagcaattaagaaataatattacatcgatttttcatcgaaatacaactacctagcttctagtgatatacagtattagtactatttttcgttgggtatattagttaatttataaatacgtaatacgtaaataaaagttgcaaacaaaatgttcatcctagaaattatattttaggacaaaaagaattgttttcttgtacatgttttaaaaattcgactatattttaactttttatcccaaaaggctaaaccatatatctagtataatttttcgatcatacatgttctagttctgatgctccaacaactataaaaagtgttacaagggaaattctctggacgcatattattaggtaggtttggtaaagagaaacactcaggattagtcgaggagttatggttcaacaccccttcaatgccaattccaagccctctgcaagtattttcgagaaaaggaaaagtacataacaactaatatcaccattccacaagatcatatataaatacaagcattatttactggccattaaaatcttccctatatttgtatgttgtgcaatcaagaacaaaaaataaatatgaattactgcttcaatatctccatcaagatttaaccattttagggttgtggactttaactaacagcatatgaatcatatgaattgtgaaacacgaaaaatttgttaagaacaaaaaaaaggctatagggaacaaagcagatcatatatgttgtggtggttgtgaagttaggttatccaccaatgagcaaccttaacctatgccttatataaaaacatatatatttccataattccattcacacatatgcatatagacaactatagcaatacaagaaaattaaacgcaatttattgagaaaatacaaacagcgtgcactatg

SEQ ID NO: 35217 - DNA, 3003 bp, Unknown
  misc_feature (1)..( 3003): 2750-1469P.txt file - cDNA_ID_3085522; gDNA_ID_2926269; Annot_ID_143388
gcagctcacctcaccattaaagtatgagaagcatatctatattcgttatacgttactacattacgttagagattaatcgctactaattaatttgattttgttatactatagaacactgctccaatgccgaaaccaggttcacagggacaagctctagcaatgaggatcaacgctgataaggcagctttctatagttgtagattccatggttttcaagatactctctgtgacgacaagggcaaccatttcttcaaggattgttacatcgaaggaacttatgattttatctttggaagaggagcttccttgtacttggtaaccttaaaattaaatattagacatcttttaacatggtacacatatatatagcatttttttgatattaatagtacatatatttgtatgtaaactcgatagaatacgcaattgcacgctgttggagatggattaagagtgatcacagctcaaggtagacaaagtgcaaccgaacaaaacggatacacgttcgtgcactgcaaagtcactggaaccggaaccggaatctatttgggcaggtcttggatgagccaccctaaagtcgtctatgctttcacagagatgaccagcgtggtcaatccatctggctggagggagaacctcaaccgcggatatgacaagtacgtaacatttcatatcatctcatttacatatagaactacattttatatatatatttgattataaactgaatttgatattgtgtgttgtataaatacaggacggtgttctatggagaatacaagtgtttcggaccagggtcacacttagagaagagagtgccttacacacaagatattgacaaaaacgaagttacgcctttcctcactcttggttacattaagggctccacatggctacttcctcctcctaaatactgaaatttttcttaagacaacttatttgttgtaacaccgttctttaatttataattgaaatgttcccatctttttagtttctttattttttttttgtattgcttaagatatgaattgatcaatattttttctacatatataaatcttccaattcattcatttctatatataccggatgtttgtggtgtttttgttttcctttatttagaaattcctataggatatatatacaaaatttgtttttgtaaaatatcataattatgttcacaccctattgagttaatgatttgtttttgtttttcttatgttaaacgttcatggtatatatgtttaaagtaccaacaaaaagaaagagtcaatgtctatccatgatatatatgcttttattaaacattttgattattttaaccaaaaaaaagtagaacacacacattttctagatctcatcattttaatagttctagttgcaaatgttaaacttcaatatttttcgtatatatatgaatcagcttcttctttctttaattttctcggcgaattagtatattttaatccataagagatgcatgcataaattttattgaattaagtgaagacccaatggtcaaaagaaaaaaaaaatatagatatgcaccgacgaagccgccgcgagtagccgcgtcacagccaggtcagcaaaaagtcgccatccaattaaagaagagaaggatagcaacttctgcaacgtgttctgctgagtctgacttagattcggaatctggttcttacgatttaatgaccatccgattttcaacggctaagattgtttagaaccattagtacaatattgtcacatccgcagagaatccacgcccctaaatgagctttacttccatgtttttcgcatctcctcgtgataacatcgacgatcaattttttttctttcacgttttgttgatatatataaatacgttttcggaaatgttttaaataaatattgttggtcatattctatagtatattcggattaaaatcatttttaatttcactaattatggagagatattcctaaaatgccttagtatttaaagaatgcgagtcaattgcactagatgcatgtttttattttgtttctaacgtggaccttatgtaagcaggtctgaagtttatccacaatttgctgtactaattgataacatttgtatatgtattccaaatatgaaatgtcattaaatgtctcataaaagtgataatacaatactgtatttgggaaaaataaatgagtcatacaacatagtaatcaacaaggtaaaaagtcatataacgccgtccccaaaaacagtctgtcccagctccatcctaattgggtatccacgtcccgatcctgtcacaggacaccagtaagaaaacggaaaccgaaaatttcaagaaaccaatatcgttttcttttcctcaattaaagttataaaaaaaaaaaaatccctgaaaatatcacatggttttttaaaacaattagtgttaaaatcaaaatttactaccttctccaccgttatttacgaatttaccatgttggtatattcttaaaaacttttgtagttcttgtaattactaaattttttttccgtaattttttcgattattatttataactttccaactcaagccaatatttttttagtaaattttaaaggaatgttaatcttctaaagatatgtttgacttaaaaaggagttaaaaatgatgagatagccaaaaaaaagattagagaaatccaaataaataataaggggtaaaagagtcattgcagtcgataattagtctccgtctgacgtaggatacgtcaaaaatatccgatctcattcaaattacgctttctcttctttcccctacaaatactcaattctttcttcttcaattcatcacaacaaatcaaaaactccaagttcttacctttttcccatttacaatcggtaaatttctccgatcacgagatacaaatttcactttctgatatcttggatcttccgatcactttgaattttttggtttgttgattttttttttttttttgttccataaagttcgaattttttatagagaagaaaccatg

SEQ ID NO: 35218 - DNA, 3003 bp, Unknown; identical to SEQ ID NO: 35217
  misc_feature (1)..( 3003): 2750-1469P.txt file - cDNA_ID_3085522; gDNA_ID_2926269; Annot_ID_205047

SEQ ID NO: 35219 - DNA, 3003 bp, Unknown
  misc_feature (1)..( 3003): 2750-1469P.txt file - cDNA_ID_3085526; gDNA_ID_2926269; Annot_ID_143387
gggttacatatctctagccctagttgcattacttgtattttttgcctcgccggtggttctcgccgacgatataaccccaattccggcagacagagcccaaatcccacaatggttcatggccaacgttaaacccttttcccagagacggggcacgctagaccccgaacttgaagctgcagaagcatcgcgacgtgtcatcatcgtaagtaaatcacaattttatcatacctataagattgattaatgtattgaatccagttttcgtttttgagacaaagaaacctgataaaaattgcacaaattaaaatactttaaaccgttgtacttaaatttcagtatagttgtatttgctgggataaaaaaaaaaaagtaaaaccataatcaatttattctcttaggattgattcttgtatcgttttctttggtacggttttattgttttaactccgttcatattactttatccgaattggacaccaagcaatgcatactattaattccaatgcaggtgaatcaaaatggaggcggcgattttaagacaataaacgcggcaatcaagagcattccattagcaaacaagaaccgtgtgatcataaagttggctcctggtatataccatgagaaagttaccgtcgacgtaggccgaccatacgttacattgcttggcaaacctggtgcggaaaccaacttgacttatgccggaacagccgctaaatacggcaccgtggagagtgccacgcttatcgtctgggccacaaattttttggcagccaacctaaacattatagtatgtatacaaatttaaatctcagttactagtatacatactatgttacggattagttggacctaattaaattttctatctcctatagaacacttctccaatgccaaagcctggtacacaaggacaagctctagctatgagaatcaacggcgataaggctgctttctacaactgcagattctatggttttcaagacactctttgcgacgatagaggcaaccatttctttaagaattgttacatcgaaggaacctatgattttatctttggaagaggagcttccttgtacttggtacgttgtatactttgatctcctttttgcacacacacatatatatatatatagcatgaccgataagtaagtcatgttttatttatttgatccatagactacgcaattgcatgctgttggagacggattaagagtgatcgcggcacacaatcgacagagtacaactgagcaaaacgggtattcgttcgtgcattgcaaggttactggagtcggaaccgggatctacttgggtagggcttggatgagccaccctaaggtcgtctactcctacactgaaatgtctagtgtcgtcaacccatctggatggcaagagaacagagtgcgtgcgcatgacaagtaagtgtatcaatttcacattatatgattatgtgataagaaaccaacactaatatataagcataatttagtcatttccaattgagttaaacagtcataatttctcacatagagatattgcaatagtttcagtttgccccaaaaagaaaagatattgcaatagtttttacaagtttaaaatgtgatttgtgacagtgcgaaccaaccattaataagtaatattttttatataatgaatgataggacggtgttctatggagaatacatgtgcacgggaccaggatcacacaaagcgaagagagtggcacacacacaagacattgacaacaaagaagctagccaattccttaccctcggctacatcaagggctccaaatggcttctacctcctcccgcttactaaacagacccaatcatcactaaaattctgtatatgttacaattgtacgttttgttttcgaagtatcctctcttcctgtatataatggaggagtagagacttgtgtaattttggtttcatgataataaaatactcaatggttcacaaatgagaagcggataagaattcaaacatactgattattgtgcatggatagagtgacgcgactgattaatgttatgaatgacagtatatttgtatgcgaaattgcgaacacattaactataaatattttctagttaatgttaaaatgattggggacaatttctaaacaaaaaataatatggacattactttctatcattttttatgtttgatattagaactcgtattttggtagaaaattgttaacttgtgatttaaaaaaaaaaactgaagaatcacatttttagcagatggttgtgaaattacgtttttggttaaaaattgtagattcacaattttgtaaaggaaaatcacggatagctttttattggtggaacattttgtaatctttttctattattataaaaacttgataattgacattaccggtctagtagaaataaaacacaaaatttgaagagatatatataagttcgatcgaaaatcacggccaaatgtgggaagcgtcattgacgtaaagcaaatccaaatttaggaagtgtcattttaattaacattgaactactaaccactcctgtcatgtctagcaaatttacattcaaacataaattgtggtttaggtccttttcaggtaaatctatagatagatatatagcaaattaacaacatagttccttttggatgagtcaatattcaacatgttgattttgccaactgtaaattttccttttcgttgatggttacagatgaatgtgcgaatttatctccattcaaaattactgaatttgtaataataacaaaatcagatattcaaaaatgcttcaagaaatataaaccacagacgagaatagtaaaaatgagatatgtccggtcagagatcaacaagcaagacaagtataaaaaccccttcaaggcttcttcatttcttccatttttaaaagtaaataagatagtaatattaacacttagtttttcttttccttttcattattttcttttattttgtaacagaaataaaagaaaataaaagaaaataaaaagatg

SEQ ID NO: 35220 - DNA, 3003 bp, Unknown; identical to SEQ ID NO: 35219
  misc_feature (1)..( 3003): 2750-1469P.txt file - cDNA_ID_3085526; gDNA_ID_2926269; Annot_ID_205046

SEQ ID NO: 35221 - DNA, 3000 bp, Unknown; identical to SEQ ID NO: 28448
  misc_feature (1)..( 3000): 2750-1469P.txt file - cDNA_ID_3085542; gDNA_ID_2926269; Annot_ID_205039

SEQ ID NO: 35222 - DNA, 3000 bp, Unknown; identical to SEQ ID NO: 28447
  misc_feature (1)..( 3000): 2750-1469P.txt file - cDNA_ID_3085546; gDNA_ID_2926269; Annot_ID_205038

SEQ ID NO: 35223 - DNA, 3003 bp, Unknown
  misc_feature (1)..( 3003): 2750-1469P.txt file - cDNA_ID_3085550; gDNA_ID_2926269; Annot_ID_143377
aatagtcattatatcaaagacttcgttcggtcgtggagtcagagtcagagtcaactatacttgtaaatcgtaacttggatcttaatgtataaaaagatagttttagaagaaacaacaagatcataaaactattacaaacaatagggatatatatacttctcgttagagaatctacacatcaccggaaaaataagagaaaacagaaagaaaaattaaagagaaaatacgaagaagaaaggcgtagccttccctttgcctctgttgacttgccgtttgttttcttccttgatctgttgttaaccagaaccagagaaagataacggaaccgagctaacttccattagccgtagctcgacgtgcttcttaacgtcgtcgtcttctttctcggtttcttcctcctccatatctctttcccttccttagattaatgaaaacgaagctaactgttagtggttgctttagtcttctacgtctctcttcaccccatttataatgcttcatctggtcccatatccaaaaccttatatatataatggcgtatattattatcgtattattgtttaaacaatatattttaaacatgaattatgtcttgttaagttttcgacccatggaatctttttgaaagttatacctaacgtcggtaaaaatttaataaacatttttataacgtgcatctacttttaaaagaaatccatttgcattattgcattaaagatgtttaagcatttggctctccccaacagtttagttcaaattgtttgatagaaaaagttgtttctttttcttttcacgtacaagtacaacgcttgattctaaacattttaagttaaatttgaaccatagtttaacaaagttgtcgaaaaactcaattatactgcaaatgaacgatttgaacaatataatagtgttgaagctagtggaataagatatattcagacaaaggtatgacaagaagtatcgaggtggtttctgtagagggatggaattattctttaattattttttcgtcggcatagtttttgctatatatcttccacttgctggaattatattaatgtgttatctaaagttcgcagcataaattattgttgttgttactgtttatcgttaatactttttcttgctttattattagtagggctactttgctaaataaagaaaaaaaaatagaagtttaactcgtaaaaatgattaagtggtagtcgtaaataagtgattcataatgtaaaattaatatatagtgtcaaaaaaaaaacatgctatttatttttgacttctgcatgactattagcacacacaagaatatatattatatagaaatgtcgtcattccactagctataatatatacatttttgatttttttactaaatagatcatatattttcgtaaaatactaattttctaaggagctgatctagtttagtggtcatacgaggaccacttacctcatcagctcaacccactaatattgagtttgtaccagtttgacaaaaaaaatacttaacttttcagaaaataaaatggaattagttattttcataattacattttcagttaataaaactaggataacaaaaacttgagttttctttttcttcttctgaaagttatgacctacgtagctaggttttagtttacagtcgtggttaacttagagactctttgatcatcaatcagttaagaccaatgcttctttaagccatttagtttattcttgatgataaaagtacgtaacatcatttttaaaaaattgtggtgagtgagtaaaagtcacgatacaaagaaaaatattcatagtttgaaaagaacgtaaagtagagatgaaatgtgaatacgattatatatattgtttacatagttaatgtataggcctttctttctttatataggattgtaaagctctttacaccgctttatttataacaaaaatagaaatgagcaaataattacgtcgaataagcactaattccattaaagtgggagctagtaagcaccaagcacactagttcaactcgtatcaatttattgtatttaaatcagtagttaaaacttgtttaatttcctcattgagaaagatttgcccactttagttaagtcttatcccaaatagcactttagttaagtctttatcccaaataacttgtttacttttacttttctattaaaattatgaatagtactgaattcactatttaaataaaggcactatgaaataaaaagaactccataaaaaatgcattaattattttatatttcttaaatatagacaaactttatagaattaatggctacaataaatattacgttgaaaatgtcgttttaatatttctccatcttttttacataatatttatatgaatttaaatttgaatgtcgatacaacgataacacgaagacgagaaaatataactattttcattagaattgacaccaaacatatttaatctcttcatttttgtcttaaaaacaaaagaacatactttcgtgacataggttcatttagtacttgatggattttcgtgccattggttcatttactcgatgcaaggcacggttccatcgacacagcagcaatgtgattgtcacatgtcgcgtggtaagacgagggttgctagagcttaccagtaaaagaagatacacaaattttggtcttatccattaggcatacaaatttaaaatataattaatatctcatatttttaattttgacagaaccaatgaaataaaacacgcgcattactgcagtgaatcccaattataaggaatctgatttgacgtggatcttcaagacacttccacgaattaaactgcatgttcttaaatgcttacacgtattacttctacaactctcttctctactccagatgtctccatcttccttttatatccgatatctaaaacgctctcaagtatagcacaatccacaacaacaaaaagtacaaatcttactcttcttttcagctagattttactaatcactcgccaagaacaaccaatg

SEQ ID NO: 35224 - DNA, 3003 bp, Unknown; identical to SEQ ID NO: 35223
  misc_feature (1)..( 3003): 2750-1469P.txt file - cDNA_ID_3085550; gDNA_ID_2926269; Annot_ID_205036

SEQ ID NO: 35225 - DNA, 3003 bp, Unknown
  misc_feature (1)..( 3003): 2750-1469P.txt file - cDNA_ID_3085554; gDNA_ID_2926269; Annot_ID_143376
tatcaagtttatacatacacaatttcctttccaattttattggactgttttgggggatctcttcagtcagtttgaattcaaaaaattactacgtgcgtgtaatagtttatggcctggttattcgaaaacaccgtagactttagttagaattaatgtcgtatagttttacgtttgttgacaaaaagaagtgtatcttgatatatatattacgaagtcgttatatcagggtttcaaaagtactttgttttatattatatcttgtataacgagacttttactagcaattttctaagttcttgaagatagagatactggccttagaagtaacaactaacaagtatgaaaacttgaccaaaacagattccccgagcgtttgttttcaaatccttgacttttgtcaatccaaagaggttgactccttttgacttaatttttctgtatagtatacttattgaaacaattcctaatatgtatacgttattttcaatatataatgatataggaatgtgtcacagattcttaaatgtatatatacataggataatacttaaatttagaagacaattagaattcaagtagtagttaatgtaataatgttgtcattgtgtcacaattctatttcaaacctataattgtatgatgtgaaaaaataaaatttatagagcatcaacaactagaattagattcaatgtacatatggatttagaaatgaaaaatcatttcgttttgaaactgaaagactcatttttcttatcatcatatcaattgaaatgatggttacgatgataatgaatatcgttattatgaaatactttccgaccaacgcgttatctcctctttgttgtcttaaaagttttgcttatagatttttcgtcttttatgcttgtttcttcattttttacatgcgtgttagatcattagcgtaaatggttagtgcttaaaacttattggtatgcgaatctcggccgccgacaaatatttgtacttcaacttcaagacattcgtggaacttcaaaaacaatctttcgttttttcaaacaaacaaaataatttgaattcgtttcgcgaatgaggcgcgtgtatgacacctctgtctctgtgactatagcgaagctaggtttacttatgatgaaaaaagttcagttcaaaaccagttttttgttagtcgtgaaagtctattaacctgtttttctttataaaatttcccaatatagtattaatatatgaaattaacaaatcgttgaattgaaaacttttaactatcagtcaaagatgaatattagcctgaatatgttaagtgatcaattaactaattaattagctaggcatattaactgtgggatctcctctgggctttgggcggtttggataaagtaacatttgtcgggaaaacagtgaacaagtgctacacaatttttcaaatgtaaagacaaaaagttccattatgttgcaaacacgagacacaaatatttataatagaagagttgtttgaacaaattaagacagccagattatcatatgttttaaaaagaattgttatcgaaaaaacaaaacaaattttgtagaaagttcatgttctttcaacatgatacacaattccaaatactcaaaagtctttgatatttcatatatagatacgattacgaatatggaccgtagctaagaaaacagttcaaataactaaacacaaatacagctattatataaaaatacatcccgacagaaagaatatagttaaaagaaaatcaagagattaaaacgttgacaaaggaagggaaattggggatggccgcacgcacgccggcctcaccgccctgtcaacctttgcggccttctaagctatcgcaaatctcaaccactgcctttaccttctatttcaaacttatcggcccaaagacgtatgaatacgtgcatgtataccatatatacacaatattaaatcatttaaaatacgtatgtatgttcacgttcagggatgttcaaattgcaccgactcactcagtttgtaaatgtaacgcagcccaattctgtttcactaatagtctggcccatttcacaatcatccaaagcgagtttttaaaggtgatttcatgatttgctaggtaggtcagattcttttgagatttcacattccagacagtatagagcgaagagaaactgcaaaattgtacaaagaatggcaaaaaaaaaaaaaaaagcgtttttgtgaaaaaaatccgacctgccggaatcgaaccagcgacctaaagatttgctgtcacagactacagtcttccgctctaccaactgagctaaggtcggttattgattactaatacaaagatttgttaattaacctaagtaatcttggtagtcatgtcctctaatttccaaaccggagacaaaaccggtgagaagatcgctacaaaaattaccaatctctaacaaaattatttaaattaaaaatctccataaacttatttttccctctctgtaattttggataggtttttaatacggtcaaacgcattttttttacttctactaatcaagcacatttgaccatttccggttttggttcaaaccggaaaacgcacgatttcaatttgactgattcgcacgtgtcgtgtgggaatagcacgtggagaatagcaaaaggtcagggggagggaagatagagagatatgttaccgtcacttgcggttgacagatgacggagccggattttccttcaccggccatccatcgtttatagccactgacccacaacaacaccattaaccctttttgcttctgactccaatagtgaagtaaatttccaaacttttgtgtttcttcttcgacgtgaagactctttcggtggtgtgttgtgttgtgacttgtgaggtcttctttctcaaaacccaggactcactctctgtataataaatacgcaagaagatgaatgatccttagaatcattcaattctcttgtaaagcattctaatttggggcaatctcgatattgatcgcgaatcagcaatg

SEQ ID NO: 35226 - DNA, 3003 bp, Unknown; identical to SEQ ID NO: 35225
  misc_feature (1)..( 3003): 2750-1469P.txt file - cDNA_ID_3085554; gDNA_ID_2926269; Annot_ID_205034

SEQ ID NO: 35227 - DNA, 3003 bp, Unknown
  misc_feature (1)..( 3003): 2750-1469P.txt file - cDNA_ID_3085561; gDNA_ID_2926269; Annot_ID_143375
tgcttaacttcatttgaaaaacttcttgaaatagattcttacaaggtttatgtattggttgtttgtataggtactagatggagataaaggagagaaattagagagctccagtggtcgaatagcatcgcgcgatatcgtccagtttgttgcattacgagacatacaatgtgagtctcgtgtttcttgatttgtcaggcagagttttggtctctgatcattgtggttgttgttgttgttgttgcagatggagaggtctcagtggtagaagcacttctagcagaattgccaacacaatttttgacgtatatgagaaaccgtaatattactcccaccaccactactccatcttctacttgatccacactctcaacactgtacatacatcagtcagtcacagctataaacgctgtcgtcttatcttggcttttatttttgtttttttcgattttatattgtctggaatttttccgttttccagtattccacgtcaaattatatctcatcactcttcattattatatttgttgtcaaaaacataatttattatatatgccaaattattagttggtttgggcgtattcacatagatatgtactgtttcaacggtcaacatatatagttgttgactttcttaatttggttgggatttaggtggactttctaagtctaacttttattaaacgtgaccgttgattattctttaccgtacttgtcgctgaaacagatactgtctattacagcaacaaaacgagaccttaaaatataaatattctattatatagtatctatttttaatctcataatactaaatctgaaattttgtttatatatacgtattgtgttataattatcataaaattgaaagtaaattttttaaaaaagttgtcaagccgttttatgcaaaaaagattttttttttaaaaaaaaaatttacattatgtgacgtcgttaaactcattttccctgcttggcaaattcacaaaatgttgtttcttcgttctcgtcaacaaatctgaaaatacctacacatgccatgtgtatatcctgttttaaagtttaattttttcatttaaattcaaattcattgacatgtcgttgtaagatactctcaaccttttttctatcagattgactttcttattaaaaaagtcactttcttttctcgtaatcttagctatataatgtcatttttgtataatttagacgtagaaaagttggctaatttaatagatcataataatatcaaatcatatttatccatagtcaaatgagtacgttatacatcctgaacagcaatcctgaacagaaattattttttcgtcgtcccgtcaaaacgtgttatcctacgttttatcagatgccatgctatatgttatgtttttatttcaatgtatttataatcaagtttgaatattacatattttttactttaatagttaatacattacaaagaaacaaaaaaagcatgttgcttgttgttgagaaagaataacaaacaaacacatgtgtcatgtgtgccacgtgcaaacatgactaaaaaaagacaacagtttctcgattgcaactctcttggtttctttcctacttccgtaatgagaaaaaaagctctgtctatacctaaaaaaagttatttcttagaatatcaaaagctagattttaggaaattaaatatttgagatcaacaaatatcgttagttgtgaattgcgacttgtcaagggcccatacaaaatgtttttttttttgtgtgtgtgagcatatccttataataatttgtttgtttaataccaaaatggtgctttaaatgttaatatattactgtaaactttccctagatccactaatttttctttttatcgtttattaaaaaacattaatagtaatctaacccgttatctatatatacattttaagtgagtatgaaaatttactccaattttgatctcctgaattgtgataatcttatctctttttttctttctaaaacttgaatcttggacttggtgtttgcatgtaaaaatgttttttcattactcatttaactgaactatttctagatatagatgaaattagaaatcctcttcgaattatctatcaaaagtagaaagagcctcaataacaacatttcacacgtttttacttgagttagtgatcaatgtgtacacatttctcgaatataactaaatttgtctttcaatctctatccaaatattttataggggagaaaagaccccactctcgcgtaacgtaaactccttttctatatcacaacatatatgtaaaacaatttgattattttcttattccttaacttttccagagaatgtcggtttatagttatacacgaagaatatctatgtttctttgtatttaaatcaaacttccaaaagaatataattatttttcttttctcttcttcgattccatgcatgttttctcaaaaaagcaattaaacagaatatgtatatatgcatgcactccttctttatttttttctttttgtcatcttggagctttacatagcgttcatattattttacattcttctattagagcttttctactaatctttattgatatccatttcttaacttgttcagattcacacgtacacattttttgcaataatcaaatcaaaaagcttttttcacgcgtctctacagttttagcagggtacactgatatagtacatgattttctatatcgaaaattacaatagctagaaaaatatataatttttttaaaaatatgcaaaacttctgcttgacgttaaattttgttttgtcatttgtcttatgttcacacagacgaaaaagcttctataaaaccgtcaaaatagctcacccctaaaaccctaattatatattccctctttcattctccttcttcgtcttttctttgtttctcatattcaagacatcctcaattccaaatcttaaaccctaaatttacagacacaatcgagatcacctgaaaaaagaggtttaaagattttagcaaagatg

SEQ ID NO: 35228 - DNA, 3003 bp, Unknown; identical to SEQ ID NO: 35227
  misc_feature (1)..( 3003): 2750-1469P.txt file - cDNA_ID_3085561; gDNA_ID_2926269; Annot_ID_205032

SEQ ID NO: 35229 - DNA, 3003 bp, Unknown
  misc_feature (1)..( 3003): 2750-1469P.txt file - cDNA_ID_3085565; gDNA_ID_2926269; Annot_ID_143374
tagtcataggatctcccataaatcaaggatcccatcgtggtaacctcaacttatggagtaactctaacagtcagcaacataatcagtcaagtggcatgatgtggcctaactcaccatctcgcgtcaacggcgttccctctcagcgcatcccacctgttactgcattctctagagcatctcctttaatggtgaacatggcatcatcgcctgtgcaccaccacattggatctgccccggtattaaactcacctttttgggatagaagacaggcatatgtagctgaatctccagaatcttcaggatttcacttaggttctcccggtagcatgggatttcctggctcgtctccctcacatccaatggattttggttctcataaggttttttctcatgtcggtgggaatcgcatggaggccaattcaaaaaatgctgtattacgatcatcgcgacagatgcctcacctctttactggaaggagcccaatgctttcagtgtcaggctcatttgacttgcctaatgaacgatacaggaatctctctcaccgaagaagtgaatctaactctagtaatgctgaaaagaaactgtatgagcttgatgtagatcgcatattacgtggggaagacagtagaacaacgttgatgataaagaacattcctaataagtaagtgaattcaccttttctccctattattccctgttttataacattatatgttgctcatttgttcctatttgtctttgttctggtaatggtttaggtatacttctaagatgctcctagctgctattgatgagtactgtaaaggaacatatgattttctttatttgccaattgacttcaaggtatgcaggcctcttacctgttttttcatctaatggagtctaatgcagccttatagcttagggtattttctacatcgatataaatgaaccttccttctatttgcagaataaatgcaatgtcggatatgctttcatcaaccttatcgaacctgaaaatattgttccgttttataaggtataagctttgtacctttttatgatcaatttgtgtagatgatgtatcattgttctttagaaaaaaaggaaaaaagcgtttggttacaagtttaaaaccttaacaggcattcaacggtaagaaatgggaaaagttcaacagcgagaaggtggcatcgcttgcatatggtcggattcaggggaaatcagctcttattgcccatttccagaactcaagtttgatgaacgaagacaaacgttgcaggcctattctcttccacactgctggtccaaatgctggtgatcaggtaaggaagacaagggctcaattgatatccttattcaaactataacctctttctgttgcaagtaatcatatcatctggtagttatgtattcactatagcgtgacacacataaattaggttcatagttggtcctaatgagagaacctatttccctttcaattagctgtttttgatgagagattactgcatttgtaaatgtgcaggaaccatttccaatgggttcaaacatccggtcaagaccaggcaagcatcgaacaaatagcatcgagaactacaccaactttagcagtagctctgataaccgagacgaacctgcaaatgggaacgactccatgtaaccgataagccagacagttttcatgtcgtaagccagactaacccttttaggcgtcttgtatcagaggtaaaagaaaagagacccaaaagattaacacaaggtaaaatatatatatatcgttgacaaccccacagctctgtaaatccttgggggtgtggtaaattacctgagaaaactcattttgcagaggagaaagtttttgaagtcttggtccctttaaactccttcaggttacttcacaagttttgttgtatcactaaacctcccagagaaaaccttgcttgatttttttttctttttgctttctaagtttttatttttctgttttacttaaaaaattgttgggttgtgtctacaaggatctttttctttgtactttgcatacaaatgtaacaacctagtacgatgtgttcagtttcttcgcccgtggcttgggaccatataatatcatttatgtaaacccttttgagggcgaagtttttggcattgctttcttctcttttggtttttagtgtttctttgaatctttagtcggtcactttataagcttctgacacagtcagttgtttaaggcttcctcttggaataaataatactactaagacacttggtctctaaattttcgactatcagaattcttggttggatacatttttggcccctgagagtaagtggcccatttatggcagtggaggacctccttggctccttctccagtccagctcttgtatccatccattataaggctttggaaagaaagaagcaactgggtttggtctgcaacacatacttgatgattctcttggataaggaaccgatctcatgaactatattctataatactatatagttattcttgttatatttatagaaacaaaaagttactatatatgtagtccagtagtaattatgcttttgaaaaagttttgttagcctttctggtggcgaaatcttttttaattggtcattacgtaaaattggtgtgtcttattattcacgtctccctctaaaagatgcgttctctctttctttgttcctatttcaattacagtcacaccgcattataaaatatattttttttaaaaatacttttattcccatagaactataaacaaaattatctcttaaacgtcggcttaattcaaaaatctgatactaagacaattttccgatgtggaccaaaatatatacaagtagaccggttgtagtaaatatattcacgtgatcttacagccaatttaatacatatggaccatctagttttccactaatcaaacataaacctacactaattaatttggggaatacttaattctttatgttgtcaataatttcaaaacaacaataaaaggaaattaaatg

SEQ ID NO: 35230 - DNA, 3003 bp, Unknown; identical to SEQ ID NO: 35229
  misc_feature (1)..( 3003): 2750-1469P.txt file - cDNA_ID_3085565; gDNA_ID_2926267; Annot_ID_204978

SEQ ID NO: 35231 - DNA, 3003 bp, Unknown; identical to SEQ ID NO: 35229
  misc_feature (1)..( 3003): 2750-1469P.txt file - cDNA_ID_3085565; gDNA_ID_2926269; Annot_ID_205031

SEQ ID NO: 35232 - DNA, 3000 bp, Unknown
  misc_feature (1)..( 3000): 2750-1469P.txt file - cDNA_ID_3085569; gDNA_ID_2926270; Annot_ID_143403
tggaagcttgagatacttaacatgcacaaggcccgatattttatatgcggtcggagttgttagtcgttacatggagcatccaacaacaactcatttcaaagcggcaaaaaggattcttcgctatatcaaaggtaccgtaaactttggcttacattattcaactactagtgattacaagcttgttggatatagcgatagcgattggggtggagacgtagatgaccgaaagagtacaagtggttttgtgttttacattggagacacggctttcacatggatgtcgaagaaacaaccaattgtcactctatccacttgtgaagcggagtatgtagcggctacgtcatgtgtatgccatgctatttggttaagaaacctcttgaaggagttaagcttaccacaagaggaaccaacgaagatctttgtggacaacaagtcggcaatagctttggcgaagaacccggtcttccatgatcgaagtaaacacattgacacacgctatcactacattagagagtgtgttagcaagaaggacgtgcaattggagtatgtgaagacacatgatcaagtagccgatatttttaccaagcctctcaagggtgaaaactttatcaagatgaggagtttgcttggagtagcaaaatcaagtttaagagggggtgttgaaagttaaacttgattttgaatcaagtttaattattggatcaattatccaataattaattatggccaaatccaagttctagagttttctctagaaatatcatcatttccacctccttaaaagattctagaaattttctagaatcatcttccacctccttaaacataaaaatctagatactctaatagaataatctagatactctaatagaataatctagataatttgaataatgtaatctagatcttatgtaagaactctctagacttaggattaaaatattttagatattttgtagtttggaggctataaatacctcctccccctctcaaatgttgcaatgttgtgaagttgtattcaaagtttaaagcaaagtaataaaagttctatttcctaaaaaactctctcaaaacacttaaacactttctccattacctctaaaagaattttactctaacagttttaaccagacacagagccgtgtgcggtttgaaaatcggagacactggtcagcagatgatgcgtagccttctcataattcacaaaacccatgaaccagaagtcatgaccatccaccgtcgtcaactgaatatacttctcaggtggagtctctttcaccaccaccggattcaccgtcgctacattcgccaaaggtacaaccacctgccacaaaaccaaacaccaaacaacattagacctacgttaaaaacaatctccaaattcattcttttacaaaagcaagactttacttaccctgtagtagctccaagattcttgaccagaaggtgctgtgaagtacagaggacgatcgctacaaaaagcgacacgagcattcgaaagatagacagttccagcaacaggacctgtcgtcgtcgagagataacaagcgaaagttttcttcagcgtctcgtttggctctgttccgaaaatctgtctgaaaagcgactcgaatcctccttttgttatcgctttggccgtcaaattaaccttcccccacgccgtttccgacatagacggtcctgtcttcactgcaaaaaaaaaaaaaaaaaccaacaaaattcgtcaaagactcaaacttgctttgtccaaatgctccaattaagtggaaggagacttacgattgtgccagaggttacgtgcgacggtttctgccttgcgactccaggtatggaacattccgatgactggctcgagagggttgttagttgttggatgttcgacaggagagtagatgacgtacggttggtactgcgtctgctggttatctccagcgacccacgccgccgcctgttggttatcgggatgagcaactggagctgccggagctcccatcacgtgagtaccccatttcttctgatccggagacgatgaagaaggttctggttggtgctctgtttctagagttttgggttgctcttgatcaatgatgatcttaggttggtcttcttgtgatcctgtcatggctgaaattttctgaatttggttgatgattctgaaacgttcttcgtcttctattgaaatggatgtgatggattgtgttgaacttggttttttaatttataagattggattatacatatataaaacgcggttttgatgatgttacctttgggattaagagttggactattttaggctgaattttgacatttagtttaatccttaaccaataagataagaacacataatggttttagaatgttcttgataaatacaagattttagaaaagtctctgtgtcattcaatgattacattttgctgaatcttcttgtaattacagtaatgaagaagataataaataaggtgattgtgacatggactctctgctatgtcggcaaagaggcctaaacaacacgttcttcttttgtagtccaacacgttcttcttttgtagtccatcgcttgtttgttaccgtcaaactcaaacttcacttttaaaaacgaaccttgcaatttagacgaaagctagaacgaacaggtctaagacaattattaggccttttgagcccaatatctgtattaagtatttaagtttataaacaaaaggcccattaagtgtggagtctctatcttctagaggaaagaaagaatcaaagaatcgttgaaatcaaaattgcgattaatctcaaattaagtacacacgcgtaatcgtcagagatttggaactttccttgaatctccatcgtcttccgcgtaatttccctgggaattttcatagcggaaagggaattaaataaatactcttcgaatcagcttcgtctgtttctctcgttgtgattgatttgctttatcttcgaaatcgttgagtttgaccgtaaaaactaaaaacaaaggagatg

SEQ ID NO: 35233 - DNA, 3003 bp, Unknown; identical to SEQ ID NO: 35129
  misc_feature (1)..( 3003): 2750-1469P.txt file - cDNA_ID_3085585; gDNA_ID_2926270; Annot_ID_143416

SEQ ID NO: 35234 - DNA, 3003 bp, Unknown; identical to SEQ ID NO: 35129
  misc_feature (1)..( 3003): 2750-1469P.txt file - cDNA_ID_3085585; gDNA_ID_2926270; Annot_ID_205102

SEQ ID NO: 35235 - DNA, 3000 bp, Unknown; identical to SEQ ID NO: 28456
  misc_feature (1)..( 3000): 2750-1469P.txt file - cDNA_ID_3085589; gDNA_ID_2926270; Annot_ID_205100

SEQ ID NO: 35236 - DNA, 3003 bp, Unknown; identical to SEQ ID NO: 28455
  misc_feature (1)..( 3003): 2750-1469P.txt file - cDNA_ID_3085601; gDNA_ID_2926270; Annot_ID_205096

SEQ ID NO: 35237 - DNA, 3000 bp, Unknown; identical to SEQ ID NO: 28454
  misc_feature (1)..( 3000): 2750-1469P.txt file - cDNA_ID_3085609; gDNA_ID_2926270; Annot_ID_205094

SEQ ID NO: 35238 - DNA, 3003 bp, Unknown; identical to SEQ ID NO: 27696
  misc_feature (1)..( 3003): 2750-1469P.txt file - cDNA_ID_3085613; gDNA_ID_2926270; Annot_ID_205092

SEQ ID NO: 35239 - DNA, 3000 bp, Unknown; identical to SEQ ID NO: 35232
  misc_feature (1)..( 3000): 2750-1469P.txt file - cDNA_ID_3085623; gDNA_ID_2926270; Annot_ID_205088

SEQ ID NO: 35240 - DNA, 3000 bp, Unknown
  misc_feature (1)..( 3000): 2750-1469P.txt file - cDNA_ID_3085629; gDNA_ID_2926145; Annot_ID_197673
tataagagaaacccgtcttatctaaaataatgaccagaagcaaacttctcccaagctttacaaatctcttaaaactcatggtaagtttcataaatgatttttatttgtttaaatcccataagcttaacattaagagtagcgagtagggtgtacctctgggataaaacatcagcaactacgtcttttgcatcggatgtgtgcgcgttatttttccatttatagttgtatgttgtccatgatatttcatctttgccgcagttctttctgattggtataagcatctcaatctattagatagtggcaagtacaacatcctcttatatggtactcatgttcttccccaatatgttgatatcttggcttgtcacaaaatagacattcattcagattttcattatatccccaaaaaatcatgcaatagtcatggcatacatcaatcattttttatggtaacccaagacttgaaaccaacttcagtacttgagcaaatatattatttgatggcaaatattttataattagttattaccataaatccatacaatgttcatttaagttattatcatctcctgttatatccatgccaacttctttggtcgggacagggcagaaccgtgtcattgatgcttcgttcattgtcatctgtgaaagggcaaaactcaaagtatatattgtcttattaaggcttatcatttaattaatgttttcttttctttctgttataggaaataaatagattatagaatatattgttttaaggagagttagtgctgacacctatgcaaaagctacaacagctcttcttggagtaccactaagtcacaactcttcttttcttgaaggcccaaccttggctcctcctcatgtaagggaagctatttggtgtggtagcacaaactccacctttgaagaaggtataacaaacttgtatttagaatgttggacaatttcatgttttgtatagcaacaatcataatattctaaacttcaaaaattatcgcatgattcaaattctcaaaccacattctgcaactcacatccgactatgaataatatgaatcaaagacagaaaataatacaaatcttaattaaacgagaactgcaataatacaactaatatgcccaagtttttgtggtctagtgatagaaaaatctttagtgaaaggtgaaactgccagatccaaattcgatttttcctgaaaacaaatatgggacgtctgttacttggatgttcgcccaaatgtttatctagtagtcagaaatgtaggtggcctaactaccccctgacattaatttgaaagcatttcaaactcggatcatgcaatgtggtggcccaattctacatggatcgggagaaattcactctgtaaaacatcggggcattcttcctatcgaagccgaccggatcagcaaataagatatatgagaaagaaaaaaaacagcaacaacaactaatatgtaggtgtagatatcatcttattgcaaaaactattgtccgtcaattttcaaccatgcaatgtatagctcagatttgttctttcaataataagtgttgtggtcctagatttcttgtggagagaggtttcaatgcatatttctgaaagcctcaacctaaaaataataattttgagcctctaatctaaaagaagcaaagagtgttacgttattggtttggtattatctagagaagtgcgcgcacgtttttgttgttattaccctagcattccatcgacccattactctatattttccacataaaaaaaatatatacttcttctgttttactttaaaagttgttataggaaaaacatttttattttaaattaattctcactatcctatacaaaaatttattatttcttactttttaattattcttattttgaagagtgttttgttagtggttgaaaatattaattttaaaaaattatatgatttataatgaaaaaaaaacaatttacgcaacctatggacttttaaatatgtgtagatatcttaaacaatgggtgtaagtaacgataaccacgtttaaacgagacggttaaaatttttatagcagttgtaaaaaaagcggttaaaaatagtaggatgaaaaaggtgctatcataaaaaagaccggttaaatatttagcttgaatggtagcattgtagcggttgaataatttacattataataaattaataaaaaatgaaattaatttagtaaaaaataaataaatgtatggagtaataaaccattttttaattcataatatgaaatattaatatatttaaataacaattgttataatattgaaatagtaaaagtaaaaacaaatgtattcactattgtttctcttcttatgtcacataatggcaaaaacaaagagcaaaatgacaaaataaaaattgtgcaacttctaaataaaaaaagatgtaaccataatttaaaaaaatgtaaccatattttccaatgctatcatgttatttgtttcaaccaccgacgaaaagaaaggtcctacttaattacaaattttacaatctcttttttttttttttttgttgaaacaagtttctcatgtattattagcaatcaaccctatatagggctgaatacatatatccatccataagcacaagatctacaagttttcatttccggccacacgtagttgcccgaagtggcgaagttacaatacattacattagtaaattaaatatatatctaactagcaatcttaattcttttattattcattgaaaaattattacgactataaaaattttgaatacacaaataccatatatatatatatatatatattattcgtataaagcttataataaatatgtagggtaaagattttaaacatgttttaaacaagtgttacaaatttaactgataccagcttctaaacttcactaagatatcaaagtcttatcattttcttttagtatataagaacatacaatcaaaaatgaataacttatacctcactgacttactacaaatcagatatg

SEQ ID NO: 35241 - DNA, 3000 bp, Unknown; identical to SEQ ID NO: 35240
  misc_feature (1)..( 3000): 2750-1469P.txt file - cDNA_ID_3085629; gDNA_ID_1621187; Annot_ID_57439

SEQ ID NO: 35242 - DNA, 3000 bp, Unknown; identical to SEQ ID NO: 35240
  misc_feature (1)..( 3000): 2750-1469P.txt file - cDNA_ID_3085629; gDNA_ID_2926145; Annot_ID_139069

SEQ ID NO: 35243 - DNA, 3000 bp, Unknown; identical to SEQ ID NO: 35240
  misc_feature (1)..( 3000): 2750-1469P.txt file - cDNA_ID_3085629; gDNA_ID_1621187; Annot_ID_174461

SEQ ID NO: 35244 - DNA, 3000 bp, Unknown
  misc_feature (1)..( 3000): 2750-1469P.txt file - cDNA_ID_3085636; gDNA_ID_2926145; Annot_ID_197670
ttttgtttgtctgttttaagaaattgattacttagggcctgactggtttaaacgcagcgggtgcggttgcggttgcgggagtttgcggaaacgggcggttgcggtttcaagcgttatcaagcgttttgaacgactggttgaacgtttgataatgggtgcgtttgcgggagttttatgactggtaaaccagcgagtgcaatagtaattaaataaaaaataaccaaaataaatataatatattactattaaaagaaaaaatacaatatattattatgataaattgaaaatattagaaaaattaaacatgcttaataattaaaaccataaataaaacattaaattcaaaaataaataaattttgtaagaaaaagcttaatactttatgcatttggtacatcaccaaaaattgcatcaagtagtgtgataaactgtaaataacgttgaactcgcgggttttccggattgcctctatacatatgataaagttgtaacaagaaacgggtcatctcgtctgaccaaatgattttctaatcgagaaaacaaattaaaacatgtattcaatcaaaaaactcaaaaaaataaaaaataaaaaaaatgacgatgccatgaaatactcagagaattacactagctaatgaatggatgaaatgatagatcatacttacgttgattcttgattttgattttgattttcgtcagtttgggtggatgtcgtaattgagagaatagagttttaatatattgattagggttttctgataagaataagatatatagggtttgggtggaagacataattcttttaattaattaaaaaaaaaaaaaatctaaccgctaccgcccacaaacgtttgtgggaaggagattttgaaatctggcgatttcgaacggtccaaagcggtatctagcagtttgtatgattggtgccaatcgctaacaaccgctaccacccgcaaatgcagcgtttgcggatggcagagggaaaaccaatcaagcccttaattgttccttaaaaacaagagaaaacgcgttacaaaagctcaaaggactgttttcctcttcttccttttttttatatataataatcttattttaacagaattatattgaataataaaaacgaaaactaaagaagagatgacatacgtgatatgtcatagaataagaagaatatgatattaagaagagttaattaaaaaataaaccataagatgttcttaaaattataactttttatgatgtaaaaataagtatcagataatacacaattcggattttcaacgaattgggttattgttaactttttatgagaatgatttcgttatggattataaatttttggttttatatgcgttttaaatgattgaatagttaggattttgatgatggtcgagatgattacaatttacgtttgaaaaattaagtgttcgtgtaaacaatggtggagcttttctttctcggccaatagagtcacgtaaatcttattacctactagtcatgcaagctaacctttgttattcagtcttcgcactaagtctatacctcaatcaatcaattcttctattttttgtcaagtttctagttgtctttgaatttcttttctaattttgtctggcttcttctatacgaaaatgacttggtttcacacattattttccaaagaaaattataacgaatgctatcttaataactatttaggatttacatacttgaactaagaaataatatattaacaattcaatacaaagaaaaaaaaaacatacaatacaataagaaggtccatgagattacattgaggggaccagttgattgtacatgaccataccttgtgcaagacttcaaaagtcaatcctttttgtcgtagatctcttccctaaaagttgaatttctattatttttaccaaagtatatttgacaaaaataaaactaaacctcttttgttatttacagtgataaggaaattcgagattaaaaaataaaaaaaaagaataataataataattcgagatgttaaatctacatatggtgatcttgactcttgaggcgtccgtgttttatttaagtttcgtattttttaggtttgaacttacgttaaagggacttccgctaagcattctagtcagtctgaagatctttttttcccttactgctcttgtttctagccatgttctgcttaggtgagtcttttttatcgagttgattcttaagtaacctttactacttaagaatttagtgatgatttgattttcgaatgtatatactttcataattctttagcttttttggtatgggacggtatgggaccatatttttagaatttactttgtaatttctatatctttcattttttgaaatgatatttacattcttataagaaaaatagtttcttattttatggtacaagttgttaaaaaatcacacaataaagttaagagatatttttaagaaagatttgtattatattactatactaaaagtaacatcaatgcattttcccattgttgaaaaaactaattaatcttatcgtccaaatgaacatgactaacccatattttatttgctaatgaaaaattgaccatcgttgtcagtccatataaatccaccaatcctgccgtcaataacttttatataagtgtttttttttaaatacattataatataacattcaaagaactcatacattatctttatacaaaagtagaaaacaacaacttaaacaagtcagtaaactatttttatattaatgtgaatgtgtgtgtgaagtgataatttccgaagattttgtttgacaaagtaaacggctaataattaaagagagaattcaagatattgacttatttgtcctctattaacaagtgacaacccatagtcaactatcacggactagtcaacgaaatcaattttcagtttataaaagaccgtagagagataatctgcaactgtatgaacaaaacaaacccagaaagaaaaatatcactaacctcattcaaagagagaatg

SEQ ID NO: 35245 - DNA, 3000 bp, Unknown; identical to SEQ ID NO: 35244
  misc_feature (1)..( 3000): 2750-1469P.txt file - cDNA_ID_3085636; gDNA_ID_2926271; Annot_ID_143435

SEQ ID NO: 35246 - DNA, 3000 bp, Unknown; identical to SEQ ID NO: 35244
  misc_feature (1)..( 3000): 2750-1469P.txt file - cDNA_ID_3085636; gDNA_ID_2926145; Annot_ID_139068

SEQ ID NO: 35247 - DNA, 3000 bp, Unknown; identical to SEQ ID NO: 35244
  misc_feature (1)..( 3000): 2750-1469P.txt file - cDNA_ID_3085636; gDNA_ID_2926271; Annot_ID_205143

SEQ ID NO: 35248 - DNA, 3003 bp, Unknown
  misc_feature (1)..( 3003): 2750-1469P.txt file - cDNA_ID_3085658; gDNA_ID_2926144; Annot_ID_197652
attaaatttatcgattgtatctctttttacattggtcccaatttggaatcggaaaaatatattaatttatagagtattaatatatggaggttttactgtatacttgtcttttgtgatttgttttaacagtaattgttgggaaaaaagaaggaaaataattgtcttttgtccaaaaaaataaggaaaagaattgtagaaaataaggaaaagagtggataaacttgtaaaattatgtatggtatattaaaaattagtcatgtaacacacgacgaatatttgatatttagtagttaaaccatttggttactgaaaatatagagattttagaggatactgatctgcgttagaaaggatctgctctccaaaagaacgttaattttatttagtcttggagagatatacgagtaacggtttctgagcatcctaactattaaaaaaattgaatcatgtgtctaaaagtgaagaaaacacatagaaagaagcaaagtgcatgtctttacttatattggttttgttaggcaagaatataaatatgaattgaaattgtaaagatgaaaatgcaaaaagttcttagaaaatggggaattaaaaaaaacttagtgctagcacatatcaatacaaaaacaaaacatgtgctagcactaagttttttttaattccccattttctaagaactttttgcattttccacataaactcatctatattgattattaaaagacgactgaagttgatgacctagtggcaagtccttcgtcgtatgacacaaaaagtcctagattcgaaccaaaaaaagaggacaatggagtggttgagagacccacgagactaataatgaaatgaaagaaagtttcatggtttgacaaaagcaagccgggtgctagtcaaaccaaagaggctgctagtgatatcattcgtcaaaccaagggggctgctgtaatatgtgagatttggtacttagtagttgaatcatagatatattaattaattgaaagtacttacaagaaactttcactacaaaaacattattcgtaaactaaagagaagaaaaaataacattttttctttgttttggtaaatgatttatgttaatagagtgttttctggtaattctaattaaactaattagaataatctaacttttaccctattacagtgtgcatttttttgttccgttttttttatcaacaatatttaacatagaatccaactacaacgtatatataaacaataaatttggaattccatgatatatatacccttgtatcgaaaagaaaaatccatgaaaactatactaactattatctttaaaatacacaatcttttttcttgcactttcagaataatacgccaaacagttgaaagacattaacaaaacgttaaatctcatacattttttcaatttaaaaatttatactaactattaatcaaaaaattgtgagtgtctaccagcatttcagaccttggcattatcaccaatactaatagttccggaagtttttctattttcttgggtctatgtaaagataaattattgactttggagaacactttttttgggttctttagttctaatttttcttggatcgtacggtatatttagaaatcacggaatgaaaaacttcacgagaatattaatcgagatccaaggaacattctcccattaacggaaaacgaagccaatgtttagacgttagctcaattggagccaatggcagttaaatcggttaatataaatccttcaggatatcattgtttcattgattactcctgtaaagaaactgataagtttttgcgcatgggatggttttatacattatcaaatacggacatccaaccatgggtgttgccaacctacgtagaagtttcacatgtctacacacaaaagtggaagcatttgtctaggtaataagatgtatgattggccaaaacaaacgaaaaatgacgttctatacaaattactcagatctagtgaaaatggtaactaataaaattgtcgataaaaaaaaaacaaaaaataaaaacaaagaaaaaaaaacaaaaacaaaaaattatactaaaattaaatttacccacatataccattaattaaagcattacctcgaatagtaataacgccaaaaacaaaggaatgtcgtctcctcacactctttcgctcctcattccttctctaaacatctcctattctctcttgacaccgttgattccaaatcgagtagctagaatatagtcaccgctttttatgtgtgtttgtcactttcaaacatcaagttcgtcatcacggtataattataccaaaactataagctttcgttacgttactatacatacccgaactcaagttttttcatgttcatacccaaaattgtagataatgtcgaaaatctacattgatcgatcgtcaaatcattatcaaaccataaacaatgccaagtcatctcctgagtcacatatatatgatgcgtctagctagagcattgttgttactatgttgcataaaaacggtcggttcaattcttcattcttctcttctactaatgttgttttgctcaatttcttactctaaacacctagttttacaaaagaggtctagtaacctgttaacactaaaaaaaaacatccacaactctatgtttttcttctcaagtcaaacactcttgaacattgttactactatgcttcttattagacattccaagaaaaatttaattatcacttgtatagcataggaatcaaattgagcattgacaattaaagtgttgtagactttaaaacctagtagccgaaagaaaaaaaacagatgctttaaaccactttgtacaattccatatgtaatagactattaacgtatacactacttgaataaaaatatctcataatccacaaaagtaaaagccgccaagctagattattctgcctatataaggaatcgttacgaagaaacctaaattcactcatatctaaccataaccaaaaacattctcttagagagcaaagaaaatg

SEQ ID NO: 35249 - DNA, 3003 bp, Unknown; identical to SEQ ID NO: 35248
  misc_feature (1)..( 3003): 2750-1469P.txt file - cDNA_ID_3085658; gDNA_ID_2926271; Annot_ID_143428

SEQ ID NO: 35250 - DNA, 3003 bp, Unknown; identical to SEQ ID NO: 35248
  misc_feature (1)..( 3003): 2750-1469P.txt file - cDNA_ID_3085658; gDNA_ID_2926144; Annot_ID_139061

SEQ ID NO: 35251 - DNA, 3003 bp, Unknown; identical to SEQ ID NO: 35248
  misc_feature (1)..( 3003): 2750-1469P.txt file - cDNA_ID_3085658; gDNA_ID_2926271; Annot_ID_205136

SEQ ID NO: 35252 - DNA, 3000 bp, Unknown
  misc_feature (1)..( 3000): 2750-1469P.txt file - cDNA_ID_3085677; gDNA_ID_2926144; Annot_ID_197646
ctacattaaattgatgggttctttgtagctcaataaaagactgacgagtccagtggaactagataggttcaaaggtcaggggagatgatcgaacctggtattgatgtagagagcttgcttaagcaagaatgagatgtgtgttatagtcttgcatagtgatgcatactatatgagtgttgtgtctttttctatgtgattgctgattgtgttttaaaggtagaatcgcgtatcgtacttccactgggcggaaaagatcctctcactgagtaattctttactcaccccttttcctccaggtcacggtgagaatcgtgtgtagtcgcgcaagtccgtctcgcttatggtgtattttgggaacctcgggtttattttctttaattgttatcttcttatacgatttattaaagagttttcaatgatttaaggttatttttaagacgattttatatttgaattaagaaagtggaatagaggaaaaatataagcaaggtgaaagtacgccgtctcaacgttgagggagacgggcgtgacactgatggcaagatttcagtttcttgtactgtcagttgcgcctcgtctggtgaggttgtcgtccgcgcacgccaaaactctagtgtgggtgaagagaactttctgtgagcttcaacaacagtcaggcccgtaacgcttgttaattaaatccaacacatgtggatgtggcacaaccatctctctatcttggtccatgtttgtttctctatgtctattacctattccaattttattgatgtttcgacgttgtgatttgtacgaaaaggcattcgtcaaaattatgtgtcgacatccttactttggatctctgtttataattctcaaaccatggtcaaaactttaatccaaaactcttctgtctaagagtataagagcaagaatccttagtatcgtatctatacattcgagtcagtttcaatgtgacaatgggcatcaccttggcatgtttctcttataccgatcaatagcttagccgactctttgccaaataatctcgcatcctccagatttgtatccagcttagcaagacattaaatgaccttttgtcgagagatcccgaatcaacgtgaaaacaaattctacctgttttaaaagttttctctaatccatcttctttgaaatttgaagaacattttttccaaccctcctcctatatggagagaactctctatgaaacttaatgtcgttggcttcaggctactaagccgagcaagcacccgagctccacaatcctttcactacttcgtgtagagtgtcacgcatcagcgagtatcaaggttttggatgcttttcagtgtcactatgtctaataactgtgggtaatctctcactgcctgaagtgttcgttgtcatgatcccgactaaccgttttcttgcttgtggcaacctcaacaattgtctccaagatcttttagactcatcgtttgtctattcatgttctttttatgttgcatccttagatgcttgtaatcttatttttgtattatctaaacttgtagaacttgtcatctttagcgtgcttagagtattaatgaaaacatgcttgacactaatgtcaaagcatgtgggcccaagcccgtgggttgaaggttcacttgacactaatgtaatccatctctttggaaggaagaactctacgtttttcgttggaaggaagaactctacgattaccacattatgacaaaacctttccaattatacgacaatcaaaaattcattgacatttctaccacattttgtggacaattgtacccttgtgagaataaagatgtgttggagagagaaacggaagcaattgcattaattgcaatcgaggacaatttttgttacactcgggacaaattttatatcgggacaagatcgtatcgaatgaataataggatgagatcagagacaagtttagatcgaatgaataaatagaaatagatcgagacaagttcaaatcgactaagtcaaacacaaaagtagatcgagataagttcaaatgggggacatatgtcgtggacatggaacagaaaattgtggaccaaaaccacattggcgtgtagccaatttatctttggggacaaaaaagagatcttttcttatatttctcaaaatctagattcaaaatcgatattgttagagttttggaattagatctaaagtttttaagaagatgaaaaagtagtacaaaaaagatgaagaaaaaaaatactaatcaagaaagagaaagagaaaaacttaataacttagtatttgctttgggtaaaatagtattttgaaataaaaatgtagtagatttagaaaggaggaaggttttttgttattttggacaaatacttgttttcatttattcaagaagtggtgattcaaagatcacaaagtttaaaacatatataaaagagttattccctaataccatagtaagatagataaggtaaaaggacatataggttctatgagagctttgaaacaaaagctattaagcattttgatacttgtgaggtcacgactatttgattgattttccacgagcgaatcggtagatgacaagttggtcactatcaaaagacaaggtgacattgaagaaggtttcacgtccgagattttcggcgacacgagaggggcgagcttgaattgttcgtcggcaaggagatgggtaattgcggttatatcgtcgggtgggattggagataaaaagttaagaaagctttggtaaacactgtttcttggagacgggatcataatgccgttattcctcaaattttcattttcatgaataataactttaatatggtattttggaaaaaatttagaaagatgtggtatttttgttagttttttctttttcttattatacccttaaccagaataatacataaataataaaaataaaaggaaatacaatttagacctaaaactgaaaaatatcttacgtagtagctctttagggttcgctcttctcttttcttcttatcattctcaatg

SEQ ID NO: 35253 - DNA, 3000 bp, Unknown; identical to SEQ ID NO: 35252
  misc_feature (1)..( 3000): 2750-1469P.txt file - cDNA_ID_3085677; gDNA_ID_2926271; Annot_ID_205130

SEQ ID NO: 35254 - DNA, 3000 bp, Unknown
  misc_feature (1)..( 3000): 2750-1469P.txt file - cDNA_ID_3085687; gDNA_ID_2926144; Annot_ID_197643
gcggccgcgatgttgatcctatatggtgaatcacgttccttacccattcttggtgctttctccctttatcggtaagattgcatccatgggcgacccttgggtgtgttcggatgcacttatccttgtgcttcctcgaacacttttctcgatccatcccatccgacgatcggtctgtccgacccgatccgtcagacgatcggcatgtcccatccgacccgtccgacgatcggtctgtccgatccgtctggccgatccgatccgtctgacgatcggtctggccgatctgatccaacgatcggtctaccagatccgattcgtctctaagccgaacggtctaccctctccatcctctacactccatcgaaccgttggatcgggaggtagcatgcgcatcagttcggtcgagttatactcgccgagccgcaccccctttccgaccaacaactctaggatgtgttggaactcctttaagaatgttttatggtgttttgcatgttgtgagatgatgtgagatgccttgggcgtcctcccttatataggaggcgaatggatgcttcccgaagcatcacatccggtccttgcacccttccgaaaggtcacatccgttctttgcatcctttcgaaaggtcacatctgttccttgcatcctttgggcgatgcaaccgttcgttggtacccgctcgaccttacaccttttggccgagacacctcttcacccgtgagctaccacagtcgaccagctcgagtgtcagctgaccggaccacccagctgggtcagtacttgattagctcaccgagctcagtcgagctgtcggtcagctcacctagctgagctagctagttttacagctggtttagctcacctagcttagctagctagttcatccagcttgtccagctcacctagctggttcggcttgaactttctcgttcttcctactaagtattttggtccgttcctcgaccatgatctagttttctcttaaaacaaaccggccttttttatgaacgcgggacgcggtcgttacaagtctaccccccttaaactgaattcgtcctcgaattcggcgggtgagagatcttgtttactccctaacttgggacacgggcgttacaagtctaccccccttaaactgaattcgtcctcgaattcagcggatgtaagatcttgtttactccttaacgttttcccatctttagtctctccgagactttagatatcatatttgatcaaatctctatttccgagcttgatcaagtttcctgatctttgtctcttacgacactcgatcaaattcctgatcctggtcctttcccggactcaatcattattttcgatctttgtcctttcttggccttgatcaatatttcccgatctttgtcctttcttggacttgatcaacgttttccaatctttgtcctttcctggacttgatcaacgttttctgatctttgtctcttccgacattcgatcaaatttccgatcttggtcctttcccggactcgatcattatttcccgatctttgtcctttcctggacttgatcaacgttttctgatctttgtctcttccgacattcgatcaaatttctgatcctggtcctttcccggactcgatcattattctagacttaggtctcttttcgaccttgtcgtttttttcatgatcttggtcaatctccgataagatcaaaaccccagaaatagtcaaatcccgactaagtctgtacccgatcttagtcaagttccgactagatccaaatttcgttgatatcggtccatctccgaatatatcaaccaacttcccgtcatgttaaaagctttgactaaaaggataatatcttggttcccgatcatgagttcggtaacaatttccgtttccaaacacatcgatccctcaacttccttatccgccaaactctcactatgacgttttctcgagcacctatccatcctaggatcaagaatgctctgataccaacttgtgagaccccgtcccggacgtctcggcgtccggcgacgttgtactcaagttcgcgcctcttcccggccgaacctcttaatttttcgctatgcaacatagaattgcctttacgaggctaaaatctataatcgctctcttattacacagcggaagtctttctaaccttggtttaattctaaccaactcttgtaccggtttcatcgtctttgttccttagacatagatcgatcctttactcggtcaagacatgcatatgttcgctaactattctaaggaaaacaatcgcatattcctttatcctactttcacggtcaattaccaaacgtctatcttaactaataagctagatcgttacataccttggtcaatatgcggatttgattccttagcccgtttgtcgccttactccattcgttcaacgactcgtcatcggtcgtgaattgatgaaccaatccctatcgttacttagccatacaaccaaccaaccccactggtctaagtacaatgatagagattggggatcgtacgattcccttggttcacgatggccgaatcaagctcttggcttattggtccattcgttctccaaacgtacgcccctccggctacatggtggacgattgagccatcggcttatcgaaccatccatgtttccgttccggtcgtttaacactacgaccgcccacggtttactaaccgtttacccgtccggtccatggtggtcgataaagctttcggcttaatgatccatccatgcggtccgaacgatatccttatcacacccaagggtccgtggattcatccactggatcatcgtaggctagcccatgaaatctttcttccgtcggccttaggtttgctcgcgggtccaacatccgttttgtccatcggttcccaccgtggactttcccgttggttatccgtcgagtcaccctttggtcttaccgatctctgatcggtttcaccatggctgaggagatagatacatgaaggcggccgcgatgttgatcctatatg

SEQ ID NO: 35255 - DNA, 3000 bp, Unknown; identical to SEQ ID NO: 35254
  misc_feature (1)..( 3000): 2750-1469P.txt file - cDNA_ID_3085687; gDNA_ID_2926271; Annot_ID_205127

SEQ ID NO: 35256 - DNA, 3000 bp, Unknown; identical to SEQ ID NO: 28459
  misc_feature (1)..( 3000): 2750-1469P.txt file - cDNA_ID_3085697; gDNA_ID_2926144; Annot_ID_197640

SEQ ID NO: 35257 - DNA, 3000 bp, Unknown; identical to SEQ ID NO: 28459
  misc_feature (1)..( 3000): 2750-1469P.txt file - cDNA_ID_3085697; gDNA_ID_2926271; Annot_ID_205124

SEQ ID NO: 35258 - DNA, 3000 bp, Unknown
  misc_feature (1)..( 3000): 2750-1469P.txt file - cDNA_ID_3085705; gDNA_ID_2926271; Annot_ID_205119
cggcgccgggttttctctcctctccgacaactcgttttcaaacactctctcatctatttctttctttttcatggctttcttctacttttttcgaagttgtacccttatatccaacattatcacgaccgatgcaaatgaaatctttatcaaaactgtctctagatcaattttctttaaaatcttcgcgattctcgtcgttcgtccctctcacaggttctcctcgaagtcaagaccagcacctctatgctcctctttctgggactcagatcccctcaccaagtgttttgcttggttgcgacaggaacggagctctgcgttgacgctggagccgatgaagtacatgacggtagaagaatcatcccaaaacggcaccacaaccacagatccgccgccgcagtcagaaaagaagtcaaaggaagggttaaccctaaccctaattctactatttttcactcgtaatgggcctggcccaagaagtttattttctccatccagcccaccttacaatctatcccagctcagacataaactaaggggcataagcccatctattataaggcacaggtttgttttttctcttcatcgtgctaagtacaattctgaagatctcttacttatttggactcctacctaagaaagtagcgatggatttagattggacttgttattatccttctcgaaacctggtggattgatttgctcgttttgtattcgatgtaagattaatctcgaaacgttttggattgtggttagacatgtttgaattcaagctgaatcatcttgcgtcatttgctttgaggagcaatgcatctcaactctttcaaaccttactaaagaacacgcctccaatctctcaaaccttaccgaagaacaagcctcaacgctctctaactttattgaagaacacgcctaggtactttcaacctcacactttctcaagcctttttgaatcattgatttgtggctgcgatttgattgaacgacaccaatctagtctcccaatgttcctttggttatggccttgtgattatctttggcgatttcgacaaatcttatccggcatttggaatatctttccaccggcagtctcctcgatggagcattctaccaaaagctcatttgcgtcaatcgcgcaagccgtctatcaccaccagttggtcgggattttctcgaagcttgtcttcgaatttgaatctcctatggcatcaaaagatttttcaaacattgcaagcttctccaagttgagcatctttttaaaaacacattgagcctttagctttcttttccatgcattatcttaatttcagtttgtatgaattttcctctttttgaggttttaagtgaatgaaagttcttttgtccaaaaaaaacccgacatattatgtttctttcctataattgtttcaaataaatttaaaatatatattttctaaaggttatgaatcaagataaacacaacaactaatcaatctccacaataactagtatatagtttgacaaaaaaataaataaagataaaagtactttttacggggctttatagatttgggtacatttaagttaaaaaagtcagaataaatcactttttgtttggtttatagagataagcattttctgttagacaaaattaccattttgccctcaatctccttcttctttctttattctttctttattctttctttctttcttcatcgcttatttctcttcttaatatttccagaaaatctcaattttttttttggtttttttttgtttttgatcacaaaaatccaataataatgaaatctataccctaagggatagtaaaaagtgaacccaaacaaaataattaaaccgatttgataagaatataagaacgctaaaacaatttccaaatttgataaaagtttaagattttgagattttggttttgcaattttgttggttcgttgtctaggtttagagatttatttgggttttgtctaatctatttatttttgaaatttatttcaatttaatttgtttgtatgttgttgatgaattttgttggaaatttccggattttcttctatatagaaaattcttcaacatgaattagctagagaatccaaaatcataacaaaaatatcaattttcagttccttaatccaaaacaaaagaactgctattaaaaatcagcttgaattttgatctggttcgggaagggaaagagatagtgatataatttgtaggtggaaaagatttgggggagactaagattaaaacggtaaaacagaaagtagaaaagtacatgaagctgtaaggcacaaaaaaaatgccgatacttacaaagggacaaggttttaagtgtttttctcataattgatcctactttatacaactataaacaaggagaatcacaagtatctttaatttgaaagatgatatatgaaatattttagatctacaactatgtatctatatatttatttagttattgatgttaagaaaatactttatttagttttattttaggtttaaaatttaatattttattggatatcatctaagttacaatttacactttgaatatatcatttaatattaatataatctaatttaataaaattaattaatatatttatctatatatatatattacgcttatatatatatatatttttaataattatatattttatttttaaagcctgcaaataacccgtaaacacacgggtttgaccctcaccaacctcacggtagagcagtcagggtgggattagaaagctttagttctgacaaacctaacaattaccactaaaattggaaaaaatgtcaaaacaaatcacaaattttaaaatttgggacgaaaaaaccatgaagttttgacatgtcatttaaatctcaaagtttaatttgactttacaataaaatggttaagttgtgttgattgagtcattttaggcatgccgtttttttgttatttaaaagataacaaagttaattttctataacatctaacaaaaagtaacgacaatg

SEQ ID NO: 35259 - DNA, 3003 bp, Unknown; identical to SEQ ID NO: 28473
  misc_feature (1)..( 3003): 2750-1469P.txt file - cDNA_ID_3085725; gDNA_ID_2926272; Annot_ID_205174

SEQ ID NO: 35260 - DNA, 3003 bp, Unknown
  misc_feature (1)..( 3003): 2750-1469P.txt file - cDNA_ID_3085733; gDNA_ID_2926272; Annot_ID_143453
attgagttccaaaacatagaaattaacccatggtggttttacaatgcagctctgcgttcatgtctctagctgctcgattccctccaaaattaagcagcagccgagaagatgaaaggaatgttagaagcgtagttgttgaagatccagaaggatgcattctgaacttaaatgaaattccttcgtggcaggaaaaggttcaacatccatctgacatggaagtttctggggttgatagtggatcaaaagagcagctaagggactgttcaaactctggaattgaaagatttaatttcttagagaagagtattcaaaatttagaagaggaagtattatcatcacaagattcttttgatccggcgatatttcagtcgtgtgggagagttggatcctgttcatgttccaaatcagacgcagagtttcctacaaccaggtgtgaaacaaaaactgtcagtggaacatcacaatcagtgcaaactgggagcccaaacttgtctgatgaaatttgtcttcaagggaatgagagaccgcatctatatgaaggatctggtgatgttcagaaacaagaaactacaaatgtcgctcagaagaaacctgatcttgaaaaaacaatgaattggaaagactctgtctgttttggtcagccaagaaatgatactaattggcaaacaactccttccagcagctatgagcagtgtgcgactcgacagccacatgtactagacatagaggattttggaatgcaaggtgaaggccttggttattcttggatgtccatctcaccaagagttgacagagtaaagaacaaaaatgtaccacgcaggtttttcagacaaggtggaagtgttccaagagaattcacaggtcagatcataccatcaacgcctcatgaattaccaggaatgggattgtccggttcctcaagcgccgtccaagaacaccaggacgatacccaacataatcaacaagatgagatgaataaagcatcccatttacaaaaaacatttttggatctgctcaactcctctgaagaatgccttacaagacagtccagtaccaaacagaacatcacggatggctgtctaccgagagatagaactgctgaagacgtggttgatccgctcagtaacaattcaagcttacagaacatattggtcgaatcaaattccagcaataaagagcagacggcagttgaatacaaggagacaaatgccactattttacgagagatgaaagggacgcttgctgatgggaaaaagcctacaagccagtgggatagtctcagaaaagatgtggaggggaatgaagggagacaggaacgaaacaaaaacaatatggattccatagactatgaagcaataagacgtgctagtatcagcgagatttctgaggctatcaaggaaagagggatgaataacatgttggccgtacgaattaaggtaaatctactaatttcagttgagaccctcatcaaatctgtcagaaggcttgaacatcagtaaattatgtaaccatatttacaacattgcaggatttcctagaacggatagttaaagatcatggtggtatcgaccttgaatggttgagagaatctcctcctgataaagccaagtgggtaaatcacatttttagtgactgcaacactagcacgatcgatttactcaacaattacgtcaaactgagtattaacaagttgctcatgaacatttcacagggactatctcttgagcataagaggtctgggtttgaaaagtgttgaatgcgtgcgactcttaacactccacaatcttgctttccctgtgagtcagactattccattatctactaaaaacttagaataactccggctaactaagctggaacttgtattgatgatatgaaggttgacacgaatgttggaaggatagcagttaggatgggatgggtgcctctacaacccctacctgaatcacttcagttacacctcctggagctgtaagtttctttttgtttgtcatctaaacaacgaaatttttatgcaagtcataaccatgctgtgttttcacagatacccagtgctcgagtccatccaaaaatttctttggccaagactttgcaaactcgatcaacgaacactgtatgctcataaactctaacaaatcatctgtctgaaaaaccaatatttctttggtagaattctattgtcattactcattactaacagcgaaattaattaacgttctttttcttactcaggtatgaattacactaccaactgattacgtttggaaaggtattattgctctaagctttgaatttatcatatggtaatttcaagcattgtaggcacctgatcaattatgtgtctaaatcatgtgaattcatgtcaggtattttgcacaaagagtagaccaaattgtaatgcatgtccaatgagaggagagtgcagacactttgccagtgcttatgctaggtaagcaagctttcatgtacttatatgcaataattaaagataaaatttaggattatgggtaagtaacaaaaaattaggctcagtttcatggtagctagctggaaatagtattacaagaacaacataaagatcaaagacagaatcatggatccatatgcactatcattttagctcttgtaatccatacatgaacactatatgccaaagtagggatttcaaatatgagattcgatgactgatgccattgtaacagtgcaagacttgctttaccggcaccagaggagaggagcttaacaagtgcaactattccggtccctcccgagtcctatcctcctgtagccatcccgatgatagaactacctcttccgttggagaaatccctagcaagtggagcaccatcgaatagagaaaactgtgaaccaataattgaagagccggcctcgcccgggcaagagtgcactgaaataaccgagagtgatattgaagatgcttactacaatgaggaccctgacgagatcccaacaataaaactcaacattgaacagtttggaatg

SEQ ID NO: 35261 - DNA, 3003 bp, Unknown
  misc_feature (1)..( 3003): 2750-1469P.txt file - cDNA_ID_3085733; gDNA_ID_2926272; Annot_ID_205170
accatccaaaaggtcgaacttatataaaacaagttaataactaaacaatacatgtgatcacaatcaatgacagttttgatcttaaaatagaaatgattgagcaaacctcaaaaatgtcttcttaggatcacaaaatctttcctttagcttattaaagccgggagttcaactctctctcccttgtagactttttgttttcaaatctttttctttcaaaaaatcaataattagttaatgggcataatatttggttttaattaagtccatagattttttaggaccatctctaatcacgacaaatatcctaaattgtaacacatttaaaacttaaaagtattgcattcacaatccttaaaatatatatatatatatatatatatatatatatatatatatatgaaagttatatagaaacgataactccttactcaacaattagcccaaaaaaacatccataatgcatttaaactaggaattttaacaaactcaaataggttggtagttaaaaaaaaacaaatagtagatgtacatacgtacctttaaaaatatatactcatatcgaaagttttaaattttgcgaaattaaatacatttatctatcaattaaaatacatttaataatgcataattctgtaatatctatctttaatttccatatagaaccaaaacaaaataaacatatcaaatagttttaacttaacaaaaacgttagggaaaagttgacctaactagcttgattgacgttgaacttgtcaatgcgaaagcgatatttccaatatatactacatgtagtattatttatatggaagtttctaaaaaggtgttgagtggattgttacttgttggaggatgctattttttccttcttgccataatattttacgagtatgggataactacatactcatgattatgaaacgctcactttatttgaaaaacctcctaatacaccaaatatgtcactagattccaaaacgtagaccaattgtatctaatctcaaattctcaatcaaagtattaatttaccgatggtaagaaaagttaaccgatataattatcaaaagaaagaataagtcaacagattcttaatctctttattttggtatatgaacatttgtacaaaaatctcaaaagatatgtaactgtttaaaatataaattcactgagattaattcttcagactcgtgttagctataataatgtcaagagttcttcttgtttcaaggaaaaaccttaaagatatgtatattttctgtaattatgatgatataatttgctattcattgtcacaaacattactttaaaaaatcgtattttcattactacaatgttgactaagaacaaaaatacattgattattgatatatcgtcaactgaattttcttccgagggatataattctcaaacatagcaagaatctcataataatgtttcgtgactacctttagacgaaatttttttaagattcgtaacgtgacttatggtctcttgctgtgggggtcaatgcgaataaatctaaatgtatgggagtcaaataaaataccaagaaaaataaaggagcagcacccaataaactatatgggaccagaaatcctttcattggtttaaaataggattatcccgaaagatgaaggactaaattgaaactgattgggggtaggaagagatccgtcacaatcattaatggcttccacgcggaaacttgtcgtttatacaatttcattaactttcgggtcgggtttatattccaaatgggtcaaataatattagtttaatacactaacggagtaattaattggtgactacaattttatcagtttggtgcaattagaaacgaacatagtcgtaaaatacgagttcggtgttatacctttatttacgttaaaaaaatacgagaattttgtgtcaaatttcaaattaatttcatgaatatatggaaattattagatactctagcgaaaatagtgattatgagcgttttacaaaaatacgattttagcattgaacttcctttatgtaattcggtcaaatgttggcatgaagaagcaagtttgcaacattaaatttcatttaaaaatcgtgttgacatactttaaaatctaaatataggaagaagaccaaaacattaaatttagtaagattctaatgaacatttataagttataacttataaccaacaaaagttgggtttagcgttgttgctttatctgaaaacttgcaaactaaaccattttaataggactaatgacaattaacaacaaaatacacttaagcaacaacgtcctcgtgaatataatttgggcctcaggcccatattgctaacgccaactgatatttcactttattccttcttcatctcaccacactctctctctatctctatctctaacggcatagctgactcagtgttctccggcattgactcgcctgagaatcagaaagcttagatcggtgagcttttagctccattttctgtttatttacatattatttcctttttttctctctcccttttttatctggaatttgttctgctaaattttccagctgttacattttccgatcacgagaagaatcactgggtttttatgttaatcaatacatgttcctgttttctgatcataaatctcagctattaacacctgattttgattctgcgtaataaaaacctctgatttgcttttatcttcactttccccataaacattgcttactttattcgctcttcttttaccgtttccagctaaaaaattcttcgctattcaatgtgtttctcgttttgttgatgagaaaaatatctgacaaaaaatcatttattgcattttatggtgcagattcttagttaatgtcgccttctctaaccaagtcagattaaaaaggagtgttcgtccatgttgctttgttttggtgtttggagagagttttcggagagttaggtgagtgttatttggggtgaggtagtgataaggtttgaagggggagtgattcatcaagtgtgttatg

SEQ ID NO: 35262 - DNA, 3000 bp, Unknown; identical to SEQ ID NO: 28469
  misc_feature (1)..( 3000): 2750-1469P.txt file - cDNA_ID_3085741; gDNA_ID_2926272; Annot_ID_205168

SEQ ID NO: 35263 - DNA, 3003 bp, Unknown
  misc_feature (1)..( 3003): 2750-1469P.txt file - cDNA_ID_3085753; gDNA_ID_2926272; Annot_ID_143445
caggtctgcttttcgtacttgcgtggccaatcttcaggtattgctttctctctatgtttgtaaatctctctgtaccttttaaacatgtatagcattctgatttctttttactcatctttaagtttagcggatcgaccgaggctcgatactttgctgcttttgttccgttagtgaatggcttaaggcttgttattaacggactatccatttccccaaattcgatgctaatcaaatccgtcacaagagaagggagagcagagtaagttgtctagtttttttttccaactttgatatgatttttcaacaatctgattacacatttcttgttttccaaccatcacagagagttgcttaaaggtcctttgttctacgttctagctcttcttttctctgcggttttcttctggagagagtctcctatcggtatgatctcgttagcaatgatgtgtggtggcgatggtaaattttctgtcaagtactactgtataactattactacaatttacaaaatgcgcataaatgtactaactaagtgctgcatcaatatgtctatgtaggaatagctgatataatgggacgtaagtttgggtcaactaagataccttacaacccaagaaagagttgggcaggaagcatctccatgttcatcttcggcttcttcatctccatcgcgtaaaaatattaccaatcccactattaatcatcaaaatgtctccttcttgacgacgaacaagtcttaagaactgagatgagtttgctactaaacctaaccgttttcttttgtaattttgcagattactttactattactcaagccttgggtaccttcacatgaactgggaaacgaccttgcagagagtagcaatggtctcaatggtcgccacggtagtcgagtcgctacccatcaccgatcaattagacgacaatatttcggttcctctggctactattttagctgcttatttaagtttcggatattagattaatccctcataaaccgaatgtgtatatacgtatttttttaatgaatccgaccttacaaatgtttccacgattacggtactagttgcatagattttacctccgagtctctgacctctgccatttacataatgattcaaatattcatagctaatcttgtttcgggttagtatactatacttagtagtagtgttcgatacatagaaagcaaaatggaacaccaaaaagattataggacatttagtatgatgttttgaaaacatagtgttagctagaaactatatgggtgatgtgaatttcctagaaaatatataggtatagttaaactatagtgctatcaatgtaatgtattcaaatcaagaaaaagatacctaacaacaactattatgactttgagattcacgagaggttagcattgaagcattgttgacaatttacgatattttgtaaatgttttcactaaaaaaaacatttaagaaatactttttctctttttttttttttcttttttttttcatttaagaaatactacattacaaatgttaggaaacttcgtcgaaaactcaaaatattctctattgtgcatgacatctaaaatgggcaactctgtatttgtgtccaaatcaatgaacccagtctatgagaaagaaaatctgtcttttgaactattttgttgttacctaacaattgatttgaattcgtgatggaatccaggattcaagtttcttccgaaaattgatcaatattgggtgcatctgatttcaattattaagtcatgaagacagtaaaaagcaaagatattttacgaaaagatgaattcaataatttcaaaattcaaaaagtttgtgtttccatgttggaacataattactattaagggaatcccccttaatatagtatctgagtcattcacagatacacaattatatccgattgacatattgccatttcggtaaatacgattctaacatctagagagaaaactacatctgtaaagaaaccatttagggggtatgtaggagcctagcagatttaataaaacagtttttattttatttttttgggtaatctttactattgtagtgtgaattgttacttgaaaagttttgaagacttttattctgtaaacgctctaattgataagaatttttcatatttttgtattctaattgcaatttttggatttcttgctatatatactcgtgatcaaatttagaaatggaaatattaactatgaaagaaaagaaagacgatagtgtatatagacttacaccaacaatgttaactccttttcacatggcactataattttactgtgaatatgaaaagtttcttgacaaaaataaaacaaaatgatataaatagatcatcaacatctaccattctatttttagatcggatacaaaaacagatcacacgacctatatattctatgcccaactttaatttgaatcttttgaacaaaaaaaccttaatttgaagacttagaaaacgtacgtcccctaaattaaatgcgtatttgatagtatccaatgtacttattaatttgtagtacttacttttttttgtagttcgcatgtatccaaaaaattgcggtgaaggacatatagaattaaaccggacaaatactgacgtaatccgaagcggccggttctggtttacacgcgtggagcggtaggtttaaacgtgtcactcaaaaagcaattcaaaaggggtactttagtaaaatagacaaacatgccaagtaacgtttccgcttctctgcattaaacactcgtcacctttataattcctctgcaacgcagcgagaatgagatctctctctctaaccttaaatggaaacaatcgatataaattaagtagagaatacaaaatattttgtaattaaggaatttaattagtaaatttttgaattcgtaattaacaaaaaaaaaaaaattaggaaaagaataaattttgtacggcgataattacacggtttcgccgccgagaggaggaagaaaaattcgttttctgatgatg

SEQ ID NO: 35264 - DNA, 3003 bp, Unknown; identical to SEQ ID NO: 35263
  misc_feature (1)..( 3003): 2750-1469P.txt file - cDNA_ID_3085753; gDNA_ID_2926272; Annot_ID_205164

SEQ ID NO: 35265 - DNA, 3000 bp, Unknown; identical to SEQ ID NO: 28468
  misc_feature (1)..( 3000): 2750-1469P.txt file - cDNA_ID_3085757; gDNA_ID_2926272; Annot_ID_205162

SEQ ID NO: 35266 - DNA, 3003 bp, Unknown; identical to SEQ ID NO: 28467
  misc_feature (1)..( 3003): 2750-1469P.txt file - cDNA_ID_3085761; gDNA_ID_2926272; Annot_ID_205160

SEQ ID NO: 35267 - DNA, 3003 bp, Unknown; identical to SEQ ID NO: 28466
  misc_feature (1)..( 3003): 2750-1469P.txt file - cDNA_ID_3085766; gDNA_ID_2926272; Annot_ID_205158

SEQ ID NO: 35268 - DNA, 3000 bp, Unknown
  misc_feature (1)..( 3000): 2750-1469P.txt file - cDNA_ID_3085770; gDNA_ID_2926272; Annot_ID_143437
ccctatatataacaggtgaacaaagtttctgagtattagatatgactcagattgcagtagtttatgcgtatggaatatctagttccttttaagttctagaatatggcattgcttttatgtttttttccaaggaatactgatttcagttgtactgctgtcactaaccctcaagacatttctttctttgcaaaaaggtcattcattgaggaatctaaagctggtattaagatatcccctctggataataccttttatgggttgagcgataggttagtgacattatctgggaccttcgaggagcagatgcgggcaatcgatttgattttggctaagcttactgaggacgatcattactcccagaatgtgcattccccatattcatatgcaggtatatcaactcagtacttgcttagttaggtttgttatcctccttgaagcttcttttgttatcgtgttctgtatgtctttgattgcatttattcatgttggaaagcaatatagtaaatggttagatcatttccggagtttcctttgacaattgaattgacactatcaaattatttgttttaagactgtttagtcactacacatggacaggcgtagataggctagaaatcacagtacaaggtttttgatttcttgttttagggtcatgtgaacaatctaagtgtcaagtgtagatgctggatcatatcccttgataaaaatgtaagattagagtaggattttctactgagttttagattgtcagatgtcaactaaggtatagtaatggcatttagtatctttcatctcacatggaccttctttccattttgagggttgtgtatgatggttgtctgttgtagcttaattctcttgtaagttcctttaaactcggcattttaggtcttttctactctggttttcatggtcctccatatgcgtatgcgcttccttctgttgcaacagcgggatacaattcggttaactacgcacccaacggttctggaggcaagtatcaaaaccacaaggttagcctcttctcacaatcttccaccctattagtatttatgcgtttatatgaatcaatctctatttgtgttactactatggataatatggtgttacaagtcatatcttccaccctatttatgtaaacgcatatatacatgaaaaatccctatcgatgttattactatgattgtttggatcaattcgtactacagaaactttaggagataccaatgtgaaatctacatctgatatttgttaggaattaggcttattaaaaggattggtgatgcttttaatgaaccaaactacgaaaataaatttgatcggagatgcaattcctgtcacgtcttactgtgataataagatggcattttggtatttaaacagctagagattcgtttttttctacattacttaagctgtgttttgacatatattccaggaagaagctagtaccacggtgacaattggtgttgcggatgagcatataggattggtgcttggacgtggaggaagaaacatcatggaaatcactcaggtatttggcaacccttagttaaaactctttcggtccactgaaacttaaaacccacttttcttcccgcagatgactggtgcccgaattaaaatatcagaccgaggtgattttatgtctggaaccactgataggtaaagttacgattattggagagttacaacagaacaatgtgtttgatacctctcatgtctaacttgatataaatggaaaatatggacaggaaagtgagtatcacagggccacagagagcaatccaacaagctgagacaatgataaaacagaaagttgattcagccacagagagaaccaccgattgaaaccgttaagagaatccatctcggttcctatctttggtctgttgacttcatttgtggaggcttaagctatcggatggggatcattaatcatctttgagtgaggcagagatttctctctaggagctctctttcgttttatttatatgtcgacattatataatgtgtttttctctgggagagaagcagatttggagttagagaagtactattttcatttgttcttttaataactttgttgcaatttgttgaagttttgtttcccttgagttctttctgttgtaacaatttacaataaccagccattacattgcatttgcttctttcttttatcaactattttcagttcatgataccaaaacgtgttgtgtcggtataggacttaggaggatggtaaatactaagctcttcaaaaatcaactccgtaaaagttttatcttctgctgtttacacatcagacccttacttttctctatttacataattcagatcttgtaaattttctcccagactcttcagtaaatatcaagttatggatcctgaaacttttatttaactacaagtgctcggatcttttactatttacaagtaagacttgtatcttctgataattatatatatgacgaggaacagttttctattttctgaagtacccctaatatttgggtactaaacacagaagcacccatatcctttgctagtgtacgtaattgacccaaactttttaattagtatatacacttggagatacgatctcgcttctcacaatccttctccctctccggctccgaaccattcacgttctccggcagctctggtcatcgccgccatttcggtttctaactttatgttggtgtttctccttccctttatttctcagttatcacttaattagctttcgtgaaatcactttcaaatttagtgttcagatctctgtatgattgcaatgtccccaactttaatttcgtgatcgtctccgagaaagactaggatctcattgttggaaaatgaaggatcgtgataagctcaattctggattttagaagtcgtttctacttgattatggagtttattgtatccaattgttagatcgaaactcttttgttctcaaaaatggcagagtgaagctgtgacgtggtctctctggtaatg

SEQ ID NO: 35269 - DNA, 3000 bp, Unknown; identical to SEQ ID NO: 35268
  misc_feature (1)..( 3000): 2750-1469P.txt file - cDNA_ID_3085770; gDNA_ID_2926272; Annot_ID_205155

SEQ ID NO: 35270 - DNA, 3003 bp, Unknown
  misc_feature (1)..( 3003): 2750-1469P.txt file - cDNA_ID_3085809; gDNA_ID_2926273; Annot_ID_205218
attaggcatgaaatttgaagattaaaagagaatcacctaaaggaatctagtttttcagttgccaagcattagaaaaaagtggtgaggactccagaaattgtagttacgataagctatgttatcggggaaggagctagttgatgtgatcctttggatttaggctcagctagacgtttagataatagcttggcatcgagtggttcagacgcaacattatctttcgtcttcttccttttgaccaacattagacaccgtttgaaacaatgaaaaaggcggggtactttgaagtccaaacagtctaaaatgagtgtcgtcttaccaaactaaaaacgacaggctgtgttgataacgtgggctctcttgggctttgaatataagttaatgggcttatatgaaacctgtattttctattttgaaaagaaagttataaaggacggtgtggaccagaagacactcttcgttttctctccacgtgggatatcacaggttcaagttccaacggtccatttttttgggtgcaaaattccaatggtccattaatccacgcatttaatcttacgacgttgtttagcataattaattaatttgaaatttagaacaaataaaaacgcaagagaacacaaaccacaaaatggaaactagtcaattagaagatctcaatatttcgacactactacaaactaacacaccaaaacaaaacaataacaatcatccaattctaaattaactaataagattaaacgtaaaccgtaacactctaattcccagtttttaacaaacagcatcacaaagaaataaaaactcgtcgaaggaagacaatggcagtcttcgtaattaaggttttgtttataacaagagagatgtggcggcaatagtgaccaatgcggtgaacaacgcaggagcgttaacgtgaaacgccgcgtttttcgcattactgttctctgaacttgtcggcgagtctgacggagctccttccggtgaagattcatccaccggtggtgctggcggagaagctgcggttggagaaggtgcttccacaggagacggtgacttagccggggtcggtgtcggtgcactcactggctccggtgccggcgccggcgatgaagattttccgaaaagctcagcgggaaggagcacattatccacagtgaatataacaacaggtgtctcatcgaccaccgtgtcggcgagtctcgacggaccaacgccggtatggagaataacctcgtcaccggaagttgacgtcgttaaatcgtatttaccggcgccgttagtggctaaagtggagatagcgtctttgttagtctttaacgatcctttgggtttgtattcagcgagggcgtgatactctaggagcgagaccacctcagcttgtgtgagattcgtcagatctggtacacctctagctttaaaagcttcatcggacggtgcaaaaaccgtcaagcctttttcaacggtggattcgaatgttttaataacaccgctcgatacgagcaaattcgcgaaggttttgcaaccggctttctcgagaagtccggtgatgttgctaactccggcggaagaaggagcaggtgcggttaagattccgggagcgatgatcggagcgttgatttcgagaacggagatgttgtaagggatttgtttaacggatttggtgtaagaggaatcgagcttggagccaggagcggcggagccaaagccgactttgcctcctttgagatcggtgacgttaacgaatcctaggttcccgagagcgtgtccggtggtttggtaaagcgtggtggtgagagttgtgcctttagagagctgatggagttttaaaggatcgtagtagtcgaggaggacgaggaggctgagagcatttttgacgacggagagtgggtgttttccggcgagggaagacattgcgccattgttgagaacaaggacggtgattgtagtgcggctgttgatttcgtcggcgagttttgtttgagaaaggtagttgttgaatgaggaatattccggcgtatcagagaggatttgagtaatgttatggccggagacggtagaagctacggtgaggagagataatgtgaaagcgaagagagtgaaagctcgtgatgtcgccattggaatttggaaggttgagttgaactgtggagaagagaaagtgagaagacaaagagagtgatgaagttaataagaagaagaagaggttaaatgttaaccatggttatattgaagagttaactatggttaatttgagaacacgtgctgcttccttttgctaaaaagcctgtaatcacgaaaatgggtgggctttgagcttctttctttatggttcgtcctcttccaaaagcaaccgaaccgaaccgttatatcattatcaatttatcatccttgttagagttaaccatggtcaagtagctaactaaaatttgagcttatttatggatgctcattagataatcatccaaaattttgtaaaaggcactcagataaaaaggatttagatatttttacttgacaactagtaatatcgttagtacttagtagactcataaataagtgtcgttatcagttttaaatacttggtcaatagttggtaacatcttttagaaatggaaagaaggttctaattgcccgacacagcactgataaagaaattattattttttataaaaacgacaaatcaaaatacgtagtttactactgtcatgtaaaaatctgcaaaagttttatcatttgattagaaaaaaataaaataaaccttcacaaatcagtaaactattactccgtattaattaatgggcggagatgaggctttaattccttactttgagcccaattatgaggctaataacaatgtgtgagcacgtgtcactcttcagcttcacatgattatgtattgggcctgtaataagcccaaacttcgtaagctggtcaaaaacaacgacgaagagaaaaagctccgccgcagaatctgagatcggatctttagagagagagagaaagatg

SEQ ID NO: 35271 - DNA, 3000 bp, Unknown
  misc_feature (1)..( 3000): 2750-1469P.txt file - cDNA_ID_3085813; gDNA_ID_2926273; Annot_ID_143489
ggcaaagtcggctttggctccgccgctcctggctccaagctcgattcctcttacaccaaatccgttaaacaaatcccttacaacatctccgttctcgaaatcaacgctccgatcatcgctcccggaatcttaaccgcacctgctccttcttccgccggagttagcaacatcaccggacttctcgagaaagccggttgcaaaaccttcgcgaatttgctcgtatcgagcggtgttattaaaacattcgaatccaccgttgaaaaaggcttgacggtttttgcaccgtccgatgaagcttttaaagctagaggtgtaccagatctgacgaatctcacacaagctgaggtggtctcgctcctagagtatcacgccctcgctgaatacaaacccaaaggatcgttaaagactaacaaagacgctatctccactttagccactaacggcgccggtaaatacgatttaacgacgtcaacttccggtgacgaggttattctccataccggcgttggtccgtcgagactcgccgacacggtggtcgatgagacacctgttgttatattcactgtggataatgtgctccttcccgctgagcttttcggaaaatcttcatcgccggcgccggcaccggagccagtgagtgcaccgacaccgaccccggctaagtcaccgtctcctgtggaagcaccttctccaaccgcagcttctccgccagcaccaccggtggatgaatcttcaccggaaggagctccgtcagactcgccgacaagttcagagaacagtaatgcgaaaaacgcggcgtttcacgttaacgctcctgcgttgttcaccgcattggtcactattgccgccacatctctcttgttataaacaaaaccttaattacgaagactgccattgtcttccttcgacgagtttttatttctttgtgatgctgtttgttaaaaactgggaattagagtgttacggtttacgtttaatcttattagttaatttagaattggatgattgttattgttttgttttggtgtgttagtttgtagtagtgtcgaaatattgagatcttctaattgactagtttccattttgtggtttgtgttctcttgcgtttttatttgttctaaatttcaaattaattaattatgctaaacaacgtcgtaagattaaatgcgtggattaatggaccattggaattttgcacccaaaaaaatggaccgttggaacttgaacctgtgatatcccacgtggagagaaaacgaagagtgtcttctggtccacaccgtcctttataactttcttttcaaaatagaaaatacaggtttcatataagcccattaacttatattcaaagcccaagagagcccacgttatcaacacagcctgtcgtttttagtttggtaagacgacactcattttagactgtttggacttcaaagtaccccgcctttttcattgtttcaaacggtgtctaatgttggtcaaaaggaagaagacgaaagataatgttgcgtctgaaccactcgatgccaagctattatctaaacgtctagctgagcctaaatccaaaggatcacatcaactagctccttccccgataacatagcttatcgtaactacaatttctggagtcctcaccacttttttctaatgcttggcaactgaaaaactagattcctttaggtgattctcttttaatcttcaaatttcatgcctaatctgtgaaactaggaattgctgataatgtttttgtggttgacaatgtaagtataatgcttaaagatttgaatatttacatatcatagatagagacgcattatgcatgggagtgctactctagttagagattcacatatggtaccatcttgcagtaatgaaggggcgtggtgattttgatatggaccacttgtatgcatcaaaacaaaactcatcattgtagcaactccagaaattacccacgaaatcgtttgctatttatgattccttcttctgtgttttttatgccttagcttgtatgagatgaagaataactttcatctttttgtttgtggtggacaatgcctagtctaaaaatagtaaataatataggtagagaatcataacagctttgatcattttgaagcatgataataattccggatgttgactagctcctacaatttgcaatttagtctttattagtataagttttcttcccccttctttatttcttttcttgtttgtctttcaaatttggttgcatctcaaaaaaaaatatcaacacaagaaatgagtaagagttttatagtggtcctagtccttagatcaattatatttattttttactattcatatcacatgcttagatttcattttacataggaacaagatatatgtctctttggaaccaaggttttttccttaaaattagaccccaattatgagggaaacctggtttgaacacgagatgccaaaccgcgaatccaagacttcgacctttgaaatgggtttggtattaaggtaaaggagttttcttttgagcctcttttgaaaataaaaggtgcttatggattaactttttaaaatcaaattgtagtacatgcatagttggtccaaatttcatgtgatctttctctgtagttgattacaactaaagtaatcaattagtatgaaattgaatgatttggtatggtcgatttacgtatgtacctctcaagtgttttctactaagtttgcactattagtacagtaactattcaatcaagaacaagaaacagagagtctgagaaagagaagagtctgttttggtcttcttcttcatcatcttcgtcctgaactcatgcatatctctggcccctctataatcatgagtttccttttgccatcattaccttcaaaagccttgtctttcttcatcactctctatctcaaaagaaacaactacagctttatagatcgtctatataaagcttactcttccattgtgtttactcagttcgttttgtgtgataaaaccacaagaagatg

SEQ ID NO: 35272 - DNA, 3000 bp, Unknown; identical to SEQ ID NO: 35271
  misc_feature (1)..( 3000): 2750-1469P.txt file - cDNA_ID_3085813; gDNA_ID_2926273; Annot_ID_205216

SEQ ID NO: 35273 - DNA, 3003 bp, Unknown
  misc_feature (1)..( 3003): 2750-1469P.txt file - cDNA_ID_3085821; gDNA_ID_2926273; Annot_ID_143486
aatttcttctggaaagagaaattaaaacaaaactaaaatatgtggagagagacaaataaaataatacccctgggacttatcagtattgtcagagcaaagcctgagcttcttaataattgaaaataaaattaattaaaacaaaacacataaaaatttctgaaaaatctctctctctctctcttcatcgtcgccgtcgtcttctccgtctcctcctctctgtctcgctgctacttcttcttcatcttcctgatgaatactcacaaaaccgaagaaggtctgttccaccatcatgatcttgatccgacggctgacatactcgttcaatcaccaccctccattctccaccaccaccacgaccacaattccgaagtcgatcccgcgttttctctcccggaattcatactcttccgctcttctccttccggagattctcccggtctctcctcagacgagcaagacgattcccttaccggaaacccccaaattgctgattcgtcaaattctagggtttcgagtgcaggaagagatgggcttttcatcagccccgatcctcatatctcatctcagttctacacattcaacgcagcttctcactctctcatgtgtcgctgtctccgcgagggccgtctcgctactccggcggagatccgtatcgctacaccgaggtctgtcctcaagtcatggcgcgccgtttggaaggatcgtaacgaggaaacggcttacctcaccgcctggaaacggatccaggataagctcacctctcgcctcgacccagccaccggtaacgaatttctctgcttcaagaataattctcagcaattcgtctctcacattaaccagtggcaagatatagtcatggggtttcacgctgatggtgatttgaaacacttaggccagaaagagactattgataggattaagcaagtttggactgttggtgctaagctctatggaattcccgagagctttattagggtttgtgtagcggcgtgtcctgtttgcaatgccgactctggttctgcttcgaggaacaaacgccgtcgatttgagtatacggagtctcttgatgtgcctgccaaggaagttcccgataggttgcagcaactggctgctaagcacaaggttgtgctctgtataaggcagaagtatattaggtataagccgtttatggcagaggtgaaggattatgcttgtcacagagctggagagcctgtatcaattaagaagtctaggattttgaagagggagccttatcagtcaaagagatgcggttgtggttttaggattagagctattgttcccattgctaactacagtgaaaagaccaaaacttttgtatatcaggaagaagggacagctgtttttaagctatacgctgtccattcagggcatgagccgggggctatggatggaaatgcgagaatcatgcatcgggttgttggtcataagggttttttgatggatcaagagactgtctacggagtgcgggacgaagacgtggaaaccgaagggatgggattgactgggaaggatgaacgtgccgagatgcagtttactgtcttgcatcaggtgcaggaactaaggagcgaacttggcactctagaaggaaagattgggaatttttcacaagagatgttgggttcagtgtccacagagttgtttgagatgctcaacaagatcagaaatatcggcgttgagagtgcccaggatacaacgggcttggttgcagagaaatcacactcagatgaaatacttgttggagataacgatctagtacattggagtgaccatcaccacgagcatttatatggagatgggaaggatgcagaacttattgaagacgatgaggacagttttgagaggagccttgatgatgttgttccttgggaacagataacgccaccgtcagattgtacaaatcaaaaggaggatcttttgtctgagacatgtaagcctgagaaatggttaaagtgcaatgactttgatgagaatagcattctgaatagcgaagattctaaattaacaaaaccgatgagccacgatggaggtagtatagaaacagatgtaggtttagctggtatacaagtcgatagcttctatcaagaaaactcgaaatggtatgactctccttgtggtttggattcaaacacggacggtgaagacactggattcagcagacatggggagattttgtagaaacatggtaaggttcttcgatataaccaatttctaactttctatctcacacatctcgttatgcatacccttccccaactcataaatgggaaccagattgtatattttatgtgttctattacaaggtttcagggattttttttgtttggctgtgtttcttgtaggtgttgtttccttcttgtgttatgtaaattcaaactcagattgtttctatgcatatatctaagatcggaaagctttcaaggtgtctcactttttgattattgccaagtgatcatctcttggtttttaagactccattagcaaatttgtccaaatatttctaatttttaatcaagactcaataaactttatgaatttttgaattgtaaatatacaaatacgtatgatcttggaaataaaagtaactccagaccgggaacaggctacgaatttcccggcgatcaacagctcagaaacgtagtgatgtgaaatgtcgcaattggtgtttgaatttccttcaattacacaaagttgctgtggaagtccagtgtcaactgaagggtatttcggtcatataatagtgaattttcatttcgatggcagaaaaatcaaactgcgacgacgcgatctgaagtatcgtctcatctacctctttgctctgtaccctgcaatttccttttgcagcggcttgagtcagactcgttgacccaactcggatcggactcagagctccgaggcaattcacgggaagagactgtttcgttcccgttggtctatttgttctagatctgtgagtcgctgagctcgccgtgaaaattgggaatg

SEQ ID NO: 35274 - DNA, 3003 bp, Unknown; identical to SEQ ID NO: 35273
  misc_feature (1)..( 3003): 2750-1469P.txt file - cDNA_ID_3085821; gDNA_ID_2926273; Annot_ID_205213

SEQ ID NO: 35275 - DNA, 3003 bp, Unknown
  misc_feature (1)..( 3003): 2750-1469P.txt file - cDNA_ID_3085825; gDNA_ID_2926273; Annot_ID_205212
gagcataacatttctggagtttgtgcacatcatattatgtaaagaataagctgttcctaataatggtttaccagattctatagcttcaactgaaaagttttctgatttaagaacttcggtggccatgtgcatcttccttgatatttcctcaagctcaagcctcttcctcagtatcacctctttgatcttagttattttgatcttgctaagcctaatgacttcatcctcaacctgtaaaacaaactcacattataaaaaagattgttcctatactattataaacggatagactaaacaatacagggagaaaacacagaaaggtttggtcctgtgcactcacgcgtttaatggaagcaacagaaagtatgttggcctcagttatttcagactcagtcaaagcgatgctacatgtgacattgtgaaatatcttttgctcttccgcaggcgtgtccagcagattccagagctccaacaaggacactgcaagatcttgaacctagaaaaacaaagtgatgagagtcagaaaccataatcacgcagaaaaacttgcactacattacaaagaagagctcagacttgtaaccttctgcattcgctgtaacttggcctctcgtaaattcacaatcatcatatccaacttatcaagagtacttctgctcacatccctagtgttggaatcaaccagagatgaatgtatccctcttatcatgcctttgaaatcttcaccaagaaccgagcacaacgagttaagcgttttcagcaaacactctacctcttccaatcttttgctctacattttgaaaagaattcaaagttaacataaggaaaacaggtgcacatgctcttgtaatataagtcccatatcatgagatctaacagcaaaaccaaccttttcattttggagctcacccaactggctacgcaattcctccaacctctgaagcgaaagatcggtctcttcagcagcaaacttcttcagataatctgttggatttccaagttgcagtgacaacttcagtaactgatcgataacttcattaaaccgaatcattctctcagctttccttttgcgcagtccatccaattgcacattaacattctcaagctcctctttcaagttttctcctaacctgctgttagactgtaagaagaaaatgcaccattacttgccataactccagcagacaaaaaccaaatatatcaaaactgaagtcttgaatacacttacatgaatctcttgtccacccatagaagagccaatagctgcaatttctgctctgccaacagcgatttctttcagcaaattcgctttaccccgactagcctcctcgacctttcgcttataaaccgagagacactccttctcgatatcagccaaagaagcatctttttcatcctcagtctctcccatttcattccatatttcctgatatcatcaaaattggtaaattcccaattttgaacataaacaaagaaaacgaggatgtgaatcttcttcaagaaaagacctgcaattggcgaagtaacaatccacatgtagtctcgattctcgaaaactgctctgttgaattccgtatcatggtgattaaaacctatagacaaaaattcccaattatcaacatcacagctgaattgtttcgtgactccgattctcgattacacaaataccaaattattcggaaacagatacagaattttctctgttttctccgcagagttaaattacaaaatcgcgatgactcatgaaaagttcaagaagatttttaacatctacaagagaaaagagcgagaaattagaaactacctggtttgaggatcagcgccaagaagaagatgttgtgaagaattgatcaaagagagagagagagcaaaattagggtttataagtgttgtgagtataacggatgtgaaattgaaatttgaacaaggagcgggaggagggtccgttacgatccgagtctcacgatttattttgacgtggaatcatctgagccgttgtattaaattcctctttccgttttttgcttttctcctttttatttgacggaccagatttagtaagcaataaagccttgaatttcgaaatggatttttttgaaatataattggctccataatgatatcttaaataaaataaaaatgtaggccagttaaacaactaaaatatattttcaaaaagcacataaattatcaaaatcttttcatagtaaaaaaaaaaaaaaaatggataatgactgcattgacatctctattactttgacattgatatactctttgactttgaactgatccatgcatatgataagagaatgtaaagaataaacgcaaaataactatttttgcaactatagaatgagactctaatattttgtttagaacttttatttcgtcaacaaaatgttacagtaactacattgcttttaaagttaaaacatgcgttatctgtaatcataaaagtatgatacatcgttcaaataaacttaaattttgtgtaaaaagttttaaaaacctttcaaacattatgtaaaaaacagaagtggacatagtatatagtctatagttcaatcacaaaactaatataaatttaacattggttttggtcgtctatagtctatacatatggacaatggtcatattggttaacgtaagtaaaatcattagtaatcaccacatctattgtaatcgtacaaaccaaattgttaatgatgattggggaagtggataaaggacgacgaaccaaaggcttgtctgaatttcttctggaaagagaaattaaaacaaaactaaaatatgtggagagagacaaataaaataatacccctgggacttatcagtattgtcagagcaaagcctgagcttcttaataattgaaaataaaattaattaaaacaaaacacataaaaatttctgaaaaatctctctctctctctcttcatcgtcgccgtcgtcttctccgtctcctcctctctgtctcgctgctacttcttcttcatcttcctgatg

SEQ ID NO: 35276 - DNA, 3003 bp, Unknown; identical to SEQ ID NO: 28477
  misc_feature (1)..( 3003): 2750-1469P.txt file - cDNA_ID_3085833; gDNA_ID_2926273; Annot_ID_205210

SEQ ID NO: 35277 - DNA, 3003 bp, Unknown
  misc_feature (1)..( 3003): 2750-1469P.txt file - cDNA_ID_3085837; gDNA_ID_2926273; Annot_ID_143481
ccagtatctcttatccattccaaatacctaaacacgatgaatccccaaaaaagaaagccatagcagtgagggagaagagaaagcaacttaaaaactttgaagtgctacattcagatggaagaagaaactaagccaatgactttaactagctaacctgttcaaagtttttctttttaccgaggtcataccgccattttgtagtggttttcttctcatatgcctgttacaactcaacaccaagaaagtttcatgagaaagagtaaagagtctaaagacctaaattctcatttgagcaaaggaaagctcaaagcagcaatgggatgcacctcaaagtgtaaggagttgaaagatccaaaaatctcatttaagcaaaagttcaaagccttagccatgagatgcaccaaaactctaaagatccaaattctcgtttatgaaaaaggagcttctagctttggccacgggaaactttataggttcaagtcaaaagaaaaaggaaaaggaattacctctatagttgtggtattgccagctaccaaggaaatatgcataattaagaaacccatcacgctcaacgcaaatgccaagttcaaaactgttgtacgatgaaacaaggtgagaatgattaataaatgaaaccaagttacacactacataccatatatagtataaggaagtaggaacataccaaatgcaagaaaagtagtagcaagagtgcctggggttccaggtatttcttcatcactaaagaatgcaatgaagtgcggcataagaaccaaagtcacaagggtcgtctctaaaaatgtgtagaactgcatatgaacataagaaaaacacacacaagttatgacaagaggaccagattacaagctgaagaagattctataacattagtagtggtagaaaacaaacttaccaagaaaagaagaaaatacttatagttcagtgctcctacacagttaacaacccaaacacaatggtgatccatcttcaacacacaccgaccacctatattggaatcaacctcacaacaattcagtttcaagactcttaagtatacatggtaagaaaagaaaagagaaactgaggaagcttacaaacagaacaatgatgacaacgagaaggttttagttgattgcacttccgacaaaaccgaactcttgggtttgaagaagaagaatcggattgtaaaccaacaaagtccaaactatttaacggatcagattcacctctttcttcatcagtagatggtctccaattaggaggcacaacaccaggatcagtaaaaaccactgagaaatagctccacaaaagcattgccagctgcaccaagataaaaacacatccttgtctaaattcacaaaacttcaatctaaaacagaacaagacttcacatctaaagcaataaaaaaggaccaaactttattgacagaattgagtaaagcacaaagctttagtattttgaattggggaagatgattgacttacgaggaaatggaagaggattaagatagtgagagcagcaagagaatcaaggccaccttgagagagtgcaggaccataattagtcaaaacgacagcgtaataagtaacaccgacaacaccaagaaccaaaaggatcatgatcgatccaagacctcgtaaggcagtacagaacttgaatacgttccacgccattgttgtaccagatctatgcatagtcaaaagcaacgatcgaaagaaaacctttctggatcttccttccggagtaaaaggaaagacgcgtagtcaaggccaaggaagaaatgaaataagtgtttctggggagatttcgaagaggtcttagggtttctttaaatctggaaacaaaatcaaaacaaggggtttaaggaataataatatgagagtgctaaattgtaagatgcagagaccccatgaaggaggaatgatgcggagcttgaggaatgagactttttctccttcttggattcgttttcctcttttggagctaacaagaaatttcagacgaaacacttttaactttagatttgtaatttaatgacttttagtcaatcaatctttcagaagcccaaactcaaactgtgtaaataatatgtattttttactactagcgtcagaaaatgttacatttcggtaatttccccggttgattcaaagcaacccaagcatcttgcggtgaacatactttacatcttgaaaattccaaatttttgttttaaccttggttttggaagattataatataatcggaaaaattaattgagaaattgattcataagcatttttatgcttcgtgtggataaattagaatctcataataccaattacaacaaaatgatggtgaacatatacaatgaatttgatataaaaaaaattttcgtttcatggtcgaacggtgaatagtcgaagatgatgaattttttattaatcttaaaatcataataaataataaagtaatgtaaatttaaattaaggtttaaaatgttagcaaaattatattagtggtttataatgttagtggaattctttagaggtttaaaatgttaccaactgacattttgaaggttttttttttgtaaccctggtatgatgattttatttctcaaaggacttgacacttgactagtgaaggaaaaaacaaaaatgaaaaaaaataataacaaatcgcccaccgtggggctcgaacccacgaccacaaggttaagagccttgcgctctaccaactgagctagacgggcttcttgaaaatatttctacattacgctattaattaacttggtgtacctattaacaacattttacagctatcataaaaaaaaaaaaatcctatcatatcagtttggtagttatatgtgggttttctgttattgggctcctgaacgaacgagtaaaactccaatgggccaataatagattgatagtagtaagccctgtaagaagtaacaaacttcttcttcttcttctcttactccaaagagtaaagagaaatccgagctagtgaagatg

SEQ ID NO: 35278 - DNA, 3003 bp, Unknown; identical to SEQ ID NO: 35277
  misc_feature (1)..( 3003): 2750-1469P.txt file - cDNA_ID_3085837; gDNA_ID_2926273; Annot_ID_205208

SEQ ID NO: 35279 - DNA, 3003 bp, Unknown; identical to SEQ ID NO: 28476
  misc_feature (1)..( 3003): 2750-1469P.txt file - cDNA_ID_3085853; gDNA_ID_2926273; Annot_ID_205202

SEQ ID NO: 35280 - DNA, 3000 bp, Unknown
  misc_feature (1)..( 3000): 2750-1469P.txt file - cDNA_ID_3085877; gDNA_ID_2926273; Annot_ID_143467
ccactaacaatattctaaattatatctcgaagatcaagataattgtacaaaatctttaaaaatatatcaaacaagtttgatttttttatttttattttgtcatattcaagagttgccgcataagctaaatagagagtccatgtatttgtgtgttaggtgagtggtatagtcaaagaaagtacaaatgggagaacaacacatttgaaaaaaaaagatttgatcgacaatcctgaacaagcctcacggtcgaaaacgccataagactatcaaaggtatctaaaagatttaatagtatcaagtaactttcaaaatttgcgttgtcagcttaataaagaccagtatcagtggtttgtgttcaaaaccgatgagaataaccagactatgttcgaactgttaccattaaatttatcaaatattaatgtctagatgtttttttgtacaaactactgacaatttaaacttcaatgatatttattatcacttttttacttcacctaatctatttagatattgtataattgctaaatcatatttacaatcaccctgaatttattacattagatttactttagtgaaatattcatatatataataatatatttaagttaatttatatatagaacaaattttaatgtaccttttcattacatttgatattttatgaccatttgtatcatgaagtctcttatattattggttaaaaaaaataaaaaattagattatagtttttgatataaataaataaatcttaaaatatgtaagtatcctatattttttaagagaggaagtagtgaattagtgatgcaccttacatttaccgtgttcgagtatatgctgaaagtgaaaggtttttaagttaataatttgtgtaactttttgtaatctgatcccgctaaaaaaaaaataacattttacattgatacatttgtttattatatcattctgtctaaattccacaatgacatatagaaatagttatcttttttattacattgtgggacataaaatcaaatacaaagacaaaattgagggtcgtatgtcactttcccttgatttcatttgaccgtttggttaccaacgatttcggttgttagatcaaagtttgttcttcaacgacgtcggttttgactaaatcaataacaccaatcgtgctgttgtgatcaggaccaccccagatgttttaaattcgattaaggagaaatgtggatcaaccataacaaacaatcgtaagtagcccaaataaaggataaaagccccagcccatgtagatatcgtaaattgactaaaatacccctgatgatcaatagtaactaaaaggctaacgagaaaaggggacagctggatcgaaatcgaatcggatcagatcaaaagaaagcagtggcgtcgcattctttctctgcctgaggctgctgctgctgctcctccgtaccaactctgatccacctctctgtccctctctctctctctctttctatacatacactcatattctttttttttcatttttaaaaatttgtatgcaaaaattgagagattattttacttataataataaaatgaaaataataataggtggtctagtgaggtacgtaggtaagtttagtagtataagcaataactaataaatcccatcaactttgcactggttttcgagaacagtctacagctgtgacaatgggtcttagggttcttggaatttgctctctatttcttcctctattcaatgtatcaatcatatacttcatttagctattacaattatgttttcttaattattaatgaagcttatttttatttttttgtgtggatggtaatgtttttaattataaaacggtgcttagctttaatttgggtatttattctcacatttttactgaacgaaatacacgtagtagtaaaaagagaaatttgtttttagtaggttatattgggtttacgaaatcgccacttagaaatgatcaaatgaaaagtagactgttggggagagtcttgtcatttagcactttttcacagtgaaccagacagaccttctaaacaaaaacaacacatacaattatatcatgaagagacgatacaggaaaatcaaattggttgtataaagaaatctcgttttactttctttttaaaaacccaactcatattgttataagaaagagagttttttttttctgtctaaagaaagagagattaaaactctgaatttggctttaaaattttgatattgacgactgtcacataccagaggactgaattttttttaatactatttctgaagaaaatgctttcttaaatttaattattaattataatataaagttcatattcacacggtatataaaaaaaaggttttttcatatgacagtaaatataaaatttattattattgccaagctgaattctaataaatatacacttctgtttgtcaagttggaactgtatctgtcaatgaaaaggtacttaataatgataaataacccaaaattgttacttttcaacactcataatcgaattctgctatctagtagtagtcattacgtagtaagttagtaacgtatctaagtgaaccacttctctaactaatggataaaactaaatgagagtaaataatcaacaaaacaaattaattaacgaatactaaagattacaacacatcattaaggagagaaagaagagaagactcatttgaatttaagctagtggtcactctctccaggcgccgctctctctttccttctttctttctctctctctctctgagaatggtcagtcaatttcaccactgagagagctcaaaatcgcctgaccttgaccttactctctctatctcttccccgagaaaaccacctcccagtgtagataaccagaagaagataagccaaggtgggtcttctcaattttacctttttagtccaaaaaacatgaaattgaaacatgggtcttgattcatgtatgggtttcgtctttaaagtttactgttttttttttggtattttgcagatg

SEQ ID NO: 35281 - DNA, 3000 bp, Unknown
  misc_feature (1)..( 3000): 2750-1469P.txt file - cDNA_ID_3085877; gDNA_ID_2926273; Annot_ID_205195
tttagtggttaattgtttataattaattatgtcctatattccttttcgtgtaatcataacgcaaattaagggttgtatctttttcacatataccactagaaagaaacgatacttgtgttttttttcatctttcatcttttctatttttcttgtttaacaaatgtctttcgaaactcatctctcaaattcttgctttaattctttcttttttcttgacaatactttgtgatccttttaaccactaacaatattctaaattatatctcgaagatcaagataattgtacaaaatctttaaaaatatatcaaacaagtttgatttttttatttttattttgtcatattcaagagttgccgcataagctaaatagagagtccatgtatttgtgtgttaggtgagtggtatagtcaaagaaagtacaaatgggagaacaacacatttgaaaaaaaaagatttgatcgacaatcctgaacaagcctcacggtcgaaaacgccataagactatcaaaggtatctaaaagatttaatagtatcaagtaactttcaaaatttgcgttgtcagcttaataaagaccagtatcagtggtttgtgttcaaaaccgatgagaataaccagactatgttcgaactgttaccattaaatttatcaaatattaatgtctagatgtttttttgtacaaactactgacaatttaaacttcaatgatatttattatcacttttttacttcacctaatctatttagatattgtataattgctaaatcatatttacaatcaccctgaatttattacattagatttactttagtgaaatattcatatatataataatatatttaagttaatttatatatagaacaaattttaatgtaccttttcattacatttgatattttatgaccatttgtatcatgaagtctcttatattattggttaaaaaaaataaaaaattagattatagtttttgatataaataaataaatcttaaaatatgtaagtatcctatattttttaagagaggaagtagtgaattagtgatgcaccttacatttaccgtgttcgagtatatgctgaaagtgaaaggtttttaagttaataatttgtgtaactttttgtaatctgatcccgctaaaaaaaaaataacattttacattgatacatttgtttattatatcattctgtctaaattccacaatgacatatagaaatagttatcttttttattacattgtgggacataaaatcaaatacaaagacaaaattgagggtcgtatgtcactttcccttgatttcatttgaccgtttggttaccaacgatttcggttgttagatcaaagtttgttcttcaacgacgtcggttttgactaaatcaataacaccaatcgtgctgttgtgatcaggaccaccccagatgttttaaattcgattaaggagaaatgtggatcaaccataacaaacaatcgtaagtagcccaaataaaggataaaagccccagcccatgtagatatcgtaaattgactaaaatacccctgatgatcaatagtaactaaaaggctaacgagaaaaggggacagctggatcgaaatcgaatcggatcagatcaaaagaaagcagtggcgtcgcattctttctctgcctgaggctgctgctgctgctcctccgtaccaactctgatccacctctctgtccctctctctctctctctttctatacatacactcatattctttttttttcatttttaaaaatttgtatgcaaaaattgagagattattttacttataataataaaatgaaaataataataggtggtctagtgaggtacgtaggtaagtttagtagtataagcaataactaataaatcccatcaactttgcactggttttcgagaacagtctacagctgtgacaatgggtcttagggttcttggaatttgctctctatttcttcctctattcaatgtatcaatcatatacttcatttagctattacaattatgttttcttaattattaatgaagcttatttttatttttttgtgtggatggtaatgtttttaattataaaacggtgcttagctttaatttgggtatttattctcacatttttactgaacgaaatacacgtagtagtaaaaagagaaatttgtttttagtaggttatattgggtttacgaaatcgccacttagaaatgatcaaatgaaaagtagactgttggggagagtcttgtcatttagcactttttcacagtgaaccagacagaccttctaaacaaaaacaacacatacaattatatcatgaagagacgatacaggaaaatcaaattggttgtataaagaaatctcgttttactttctttttaaaaacccaactcatattgttataagaaagagagttttttttttctgtctaaagaaagagagattaaaactctgaatttggctttaaaattttgatattgacgactgtcacataccagaggactgaattttttttaatactatttctgaagaaaatgctttcttaaatttaattattaattataatataaagttcatattcacacggtatataaaaaaaaggttttttcatatgacagtaaatataaaatttattattattgccaagctgaattctaataaatatacacttctgtttgtcaagttggaactgtatctgtcaatgaaaaggtacttaataatgataaataacccaaaattgttacttttcaacactcataatcgaattctgctatctagtagtagtcattacgtagtaagttagtaacgtatctaagtgaaccacttctctaactaatggataaaactaaatgagagtaaataatcaacaaaacaaattaattaacgaatactaaagattacaacacatcattaaggagagaaagaagagaagactcatttgaatttaagctagtggtcactctctccaggcgccgctctctctttccttctttctttctctctctctctctgagaatg

SEQ ID NO: 35282 - DNA, 3003 bp, Unknown
  misc_feature (1)..( 3003): 2750-1469P.txt file - cDNA_ID_3085881; gDNA_ID_2926273; Annot_ID_143466
aagcaatatggaaaagagatctgcttttactgcacattccatgaatacaaattcaacgacaaaatggatttataacctaatgtccattatacagatgatcatgacgatatataggaaatatttttatttgttcctgtcaggaatggaacaatccgttttgaagaatgtttggttgaaaatgtatgcttactttttgttacgcaattaaaaatattgatcgttacgcggatgttaagcttcccgagaaacacacacatgtaaatagaaaaacgaggagacaaagttagaaaggtagcgtaaaaccatgcaaagtgtttaaaggcctcaacgtagagacaaagagttaagagatttaaaacctcttcttaagataaacaaataagcatatgcatcaaaaaccctaattctcccttttgctcgtttcgatgactagctagattttcgctccatttttaatgtaaattacataaaaaaatatatagataaaatcagtgagcggggtcaatctgagaatgctataactacgagagagaagacataagtttggtcttttctctttcgttaggtttctctagtttgggtcggtggattcctcagagacagaagagggggccactcaacaccatatctgaccttcactgctcttttcttcttcacacccatacatttgcatgttctctccttctcttctaccatcaacgactcattctctctctatctatatctgcatttattacacaatctctcttcctttagcatttataacaatcacgatacctttaaaccgccatatctttctctatctctctatatatatctacaaccgtctcggttataatctaagtcatctctttgatcgatactactcgtatggatatgttgaggagtgcttgtttctacttcctattaatagtgtttgtcatcctttcttggtctcttttatgcgattctcgccatcttggacacatggagaagaagcttagtgtaaatcttgatcttttaaataaggtaagcccttcgcttgtgatgttaagagtcatggttaatatggtgttagttttttcataacacgggcaattattttttgatcattgatattaagatgcgtatggtatatagtcttttaatttgtttatatatatgtgtgtgattttcactttttaaatgtcttttacatagatatgtagaagaattgaatgcatatttttccttttcaaaatcaaatatacctctaatttaaatttgtaggggggctccaaatacttttaaatgattccgtatgtatgcatgtatataaacactagatatagtgcacaactaagaagttcgagggtaaacactagctagtttcacttattttcataaaacaattcccatgtaaaatgggtttgtattcaacatactccacttttagtgtaatacttattaataaatgacaaaaaaaaactaaaaaactaaaaaacttaagtcatgaatactaactcttattccatggcacaggacaatgaagagattacaaaactagaagctccatcaacaaacaagacgaacaccttattgagccaatcacatgcggtagttaatcatggtgataatggtcagatcaacgggaagaagacgaaggaaattcacagagtaaaacgagcttcagacaaaaaggtgtcgtctaaaagagtctcaagaacttggaaaatccctaagtatccaaagaagcagcctaaatcagatcaagaacatccgggtttcaatcttgattatatgcagcccactacacacccgcctcatcataattgaactcttaatgatcatgtaataactccatgcataaacaaatttcatatcgtggtttatcaaatatcataactcaagtcacgaagaatttccactttttactcgtttgatatatcatgatgtatggtcagaaacgacctagttataataagcttttatatttaaaattaatacatatacgaattagattatagtgaaactgttatcggtattaattgttcaatactactccgttgggtttcttgatgttgctaccatatcacacttgcaagttgaatgcatatcatcatgatgtacaatatatactttactcctctttatatgcacatgcatgtgtatgatcatttcgttgctaaattactatatcaatatgtatttttgttgttgttcacaattgtgttatagtattagctaaggttaacaaatgtaatttaaaaagacttgcaggttaatagtaatacatgtggttttctgctaatcataaatcttttaagttagtctgttaattttcgtttctaatgttgacaaaactgatactaaatatgtatgtatataatatacatagtatcttgaacttggtggaccttaaaaatagtaatacagtacttgcaaatttgcaatattttcatccgattaaagaatagtaatactaccactagtcaaatgcattatttatagtttgtatatatagatgagtccgcgtgcaaagtcactgttaacgatgtccaaaaaggacgaagatcccgcgtatggttccaatgcaatcagatgtcccaaatccacgtatcttaaatttaaaattgacttgtacaaaacaatatactactaataattaatcaaagacaaaattgtctatctcatttcttatcaaaacgttctgttattttattttccataatttcttctttctcatatgtcataacgtaattttgttacatcgagaggataaaattcaaattttgcggaaaaatatataaggcccgtttagatatattagtacgttgaaaagagcgaacttattagtataaggcccatttagatataatagtgggtcataagcccataacatatcctgcaacagagaacaaagaagctgcgatctggctaataaaactttcccgccggaaaaagtttctgcagtttccaacttcttaaacctaagcgaagcagatagtctttgattgggagattgagagaggttagtgaagaatg

SEQ ID NO: 35283 - DNA, 3003 bp, Unknown; identical to SEQ ID NO: 35282
  misc_feature (1)..( 3003): 2750-1469P.txt file - cDNA_ID_3085881; gDNA_ID_2926273; Annot_ID_205194

SEQ ID NO: 35284 - DNA, 3000 bp, Unknown; identical to SEQ ID NO: 28475
  misc_feature (1)..( 3000): 2750-1469P.txt file - cDNA_ID_3085895; gDNA_ID_2926273; Annot_ID_205188

SEQ ID NO: 35285 - DNA, 1797 bp, Unknown; identical to SEQ ID NO: 28474
  misc_feature (1)..( 1797): 2750-1469P.txt file - cDNA_ID_3085899; gDNA_ID_2926273; Annot_ID_205187

SEQ ID NO: 35286 - DNA, 3003 bp, Unknown
  misc_feature (1)..( 3003): 2750-1469P.txt file - cDNA_ID_3085930; gDNA_ID_2926274; Annot_ID_143519
gactcaagtttttcttgttaatggcttcgtggttgaatttaccacttacattatatatacaaccgactcttattccataattcataaaatgttaaacatgctcacatcgaaagtattcagtatgaactctcacataaaatgttaaacatgcttacattattattatttcttggattttttaacatgtattattcgaatttgaacagagtgtttgatacaacaacaaaactatcaaacaatatgctacatttcattgtcttctctttactttttttttcctttcattttaatgtatatcggaccttcttcatctataaaaacaagcctatatgatactgttctacataatccttgagcaaattttatacatcaaagagaaaatttatatagaacatgaagaatactcgagtacacttctttgtattaaaatattatgcagttctttacaatcaccctccataataatatgttgaaagaccatgctatctggagggtatgaaagaaggttcaaaactataaatccgatcctctgccatcaatgtgctttatgttccttctaatgtcgaggaacctggaaatagatactaatttgatttctatatattttaaacagaaaaaaaacatagttaaaaaaataaatcaaacctaaactgaactagactgtagactctattgggttgagtttctcttacttttctctgtgtcattctcctactttatattatttttatagaatttatcgtttatgttaacacgattttcccgtgtaaatttatataaattgaagatttaaaggcgtgcaaaagatatggataaaaaatgaagagaaacataaaataaagtttagattccaccggccaatactttggaattatgggatgtgaaaagcgaaatgggcctcttttgcttctgcagctctctttcgtttgtctcttcctccgctaaaagatatagtaacaatcgtataaattgattcattcaagtaaaggttcacaatgttgtacgttcacgttacagtttatattttgatgagaatttatatatgtgaacattgatcgtattggctaaaaagcctaaaatatatacaacccttttttccagcagctagaaaaatctttgtgccaaataataatcggcaacgtacagcgtgatatatatttgcatgctctcgtttgttacattcaaaccaaagtgaaagtaactgaaattaacaatccaattttgattgtttcggttttgttagagagtcaattctgtagtgaataataccaaataattattaggaaactgttcaaagtatcgtaacacaaactattgatgatttgatggtcaaagattaagctcaaataagatatatgcatatatatattgtttttcacgaaaaagctaaggaagtaaaagaaaacaagtatattaattagttttacaaaagtgttcaaaaagagaattgctttcataaataatgaagtttgactgattcatactaatacaatgcacgtagatcaatcatagataacatattcataagcatttatatcatcaaaagttttgatttctactttttccaagcaaagcaacaacggtgcacccttctttttctcgtcgtctttgctcttttctgtgacgaaaatattattattcttctttttcttttccttttttaaattggtaataggacatataacaacttctagctttaatttttttagtgtaacgtttcggtagcaaacacattcccatattatagaaaaaggtgtatgctcacgcactttttctccatctttttcataatataatattactcttttgaagaaaagatatgttagatctttgatatttgtttgtatccatgaccagttctagtatatcatctcatctccaatacattcatatctctattttatataattggatcttcagaaaacatttatgtctacttgtctagtggtcaaaacattttatgcaccactggttttaaaacaaaataaggtatcaagtctcaaactcgatagaccaaggttattaaacctctttacagaatacagatgagttatgagatatatatggatcgtcaactttagttctgatattggaattatctatgaatctaatgaaatatctaatggatattactcttaatcaaaagataaatatctaatggaggtgtattaagatattgacatgtaacgtaaagtttatgagatgattgaagacaaagattcatgcgtgtgttaagaaaacacttgacgataaagagcaaaatctccattcttcataaaaaactgtattatggaaaccaatttgtccatttcatggttgtaacatcagtttctttactactgcagatgatcgatggaaaagtgttttggtcaaagaatccttttaaaaacataactatctgaaaatagcataagcatcggactcttttgtaagtgcacaacgaaaaaataaaattccaataatttgggcaatcttgtcgactatatatcattcaaataattgaagtatatcttatgttatagtaaattttaaaagatgaatgatagacaggttaattaggcattcaaaatcaaaagatttttacattgtctgatcaaagtataatcacatgtcataatctttaggtttgtctcaactctcaagggttcaaaacttgttgagtcgctcacgctagagatgtcgaatacgtacatacgatctaattatgaacgtctaaatctgaaacggtgtcgtttaggtatagaagatcacaaagtttgcgtgggcttatgtgtaagtcttatttggattttaagttatctagacttataatctactaaaccgactattttgggccttaaagaaacccacaagtaaattattgatgtgaactgcgttttggtttcaccttattctcgatattatttcattggttcggttcacggtatggtttacaccgtaccggaatacttaccactaaaaactctgtagtgcgacgaagaagaagaagataaaaaaaaaatg

SEQ ID NO: 35287 - DNA, 3003 bp, Unknown; identical to SEQ ID NO: 35286
  misc_feature (1)..( 3003): 2750-1469P.txt file - cDNA_ID_3085930; gDNA_ID_2926274; Annot_ID_205267

SEQ ID NO: 35288 - DNA, 3000 bp, Unknown; identical to SEQ ID NO: 28542
  misc_feature (1)..( 3000): 2750-1469P.txt file - cDNA_ID_3085975; gDNA_ID_2926274; Annot_ID_205252

SEQ ID NO: 35289 - DNA, 3003 bp, Unknown; identical to SEQ ID NO: 28485
  misc_feature (1)..( 3003): 2750-1469P.txt file - cDNA_ID_3085983; gDNA_ID_2926274; Annot_ID_205249

SEQ ID NO: 35290 - DNA, 3000 bp, Unknown; identical to SEQ ID NO: 28484
  misc_feature (1)..( 3000): 2750-1469P.txt file - cDNA_ID_3085995; gDNA_ID_2926274; Annot_ID_205245

SEQ ID NO: 35291 - DNA, 3000 bp, Unknown
  misc_feature (1)..( 3000): 2750-1469P.txt file - cDNA_ID_3086011; gDNA_ID_2926274; Annot_ID_205237
taagttaaaaatccatttcaatattgtacatgatagcattaaagtgagatggcatctaacgttttgactttctaagccaaatatgctaacactttttttttccatttgaaatggaacctgaaaaaataagttacttaagggacattttccatttataatttttttctttttccatatacagcttattattatattaccgatcaattcttcggtttataactaggttggagaaaaaaataattcatctttctatacacattttttcatgtcattaatatatacagcttattaatatatgagttaattcctctaggttagcttatacagtatatatgtcattttcatttattggattatttccaaaaaaatcccaaaaaggaaccttgtataaaccaaaaaaataaaaaaataagattgtgaaatgttaaaaaaaaaatatatataatggtgatcataattaagccataacttaagagtcttagatggtgatgccaataatttagaggtggttgattaagtgtaatcattcacttccgtaagtccgatcgtgaaatgtcttgtgctgctaaatgtgtatcgcttgtcaaagtcataaacaatgaaactccttggcccctttagattagcttattgtatgtcatttcaatttattggattctttcagagaattcataaaaaagaagaaaataaacattggatcattcatagcccataggaacaaaggcctataccttccatatatttacgggccttaaaatctaaatccaatatccaaatccatataaatgatccaatcaaacaatccataattttccatcacgaccatgttttattcattttctctcttttccatctccggagatcgactccggaattttccgacggaggttatgaactctaatgcaacttctggcagtatcagctataggctttgcactatgatcactaacagaagttttaaatccacctacacttttgcttattgtggtgttaatgaatgcataattgcatatagatcttacacggattaagttgtctacttgtcttgattcaaatcctctatactacaatagcaacaaaactaacaatgttctttgattaaacaaatcactataaccaaccaactttgaccattttatttacatttatatcaccaatccaaattcctaaaaaatgttctgtattaataacaaatgtaatttgatcatccataagggtttcataatcaaaacccaaagagtataaataatttacagtgcaaatcctttgacaatcactgctcattgaccagtctgcaccaaccacgaattattcaactgtgacatagccgtttccctaaaactcttgaccttaaccaaacagaaatgggtgcaaaccgtacccatacccgaccggacccgggtcgttttcaatagataacaaaccggcccagtatccgatcctcttccttgcgccacaatcccccacgcgcttgtatcttccccacacgcgccaccatcgtgatcatcatcatctgctatgtcaccgtctgcgagcttctccaccaatataactccttccggcgtcctctcttctcctctaccccactttccttccatctctgtccaatcctccgcctttggattcgttgccgtcgtcgtcaaaccaccattagcctccgcgtataaatgcatcaataacggcgactctctaagattcttcacgatctcaaccaccgaatctctcaaccacacatctagcttctccctcgacacaacagatccaccgcgtttccttccaccgatcctttcaatcttcaccgccgcagacggtggtgacaaatcctccatcgacatcgaaatcttcccgatcgcacacatattccgtcgattcgtcactggaacaacacatgacgatcgagaattcaaatttaacgtgcgacgatcacaacgaacggcgcatgcacttcctcctccgcaacaaatcctcgcagacgtcgccatcttcgcctaccggaagattcaattgcagagacgaataggaatcggagaagatatgctgcgattagattggagattgcttcacgctgacgaattctcttatagagtcaatcacaccaatggttgcttttaagaatacgttttactgacgcagccacacacaatccaatggcaatgatgaattattaaatacctaatttttttatttctccagcacggaagttgtgtaagttgtttgatcggacggttgagatttagagatggtagaaatcgcgtttatcttattcttcacgttatcctcaaaagtctgaggtggcttaagtaggtgattattccctgtaaagtgttgacgatatagactaattagatatcagatatggaccgttcgatgtaaatctaacggttgctattacgtgaagccggtacgagatggagaacgtggcgacgcggtttagctgtgtgcatggcttgggcgggcacacgctggtactggatttaaattgtggtgaacacgtgttatctctgttatttataatctagaccataagatacgccacgtcagattccacggtggacaatgtcttttagaatagattgggcccgtcgttttttatttttgaggaaagtttcggccttttcggtatggcccagaccactaaactattgttatacttatgtgcgttgatctttcgcatataaggattggatcattggactgaggtttggaatgttaggtgcgttttacgtttctcctgccataaactacacaaagacaaaagcacatgcaaaaacaacataaatatgcatcaacctaaggttgcgacacaaatcgagcaactatgcaaaacgcttaaagccatgaagccttagagattgacaagtagatcagtcaaagtttacgtggcttagtaaaattatatacttttgtttgctaagaaaatacttttatatacttatctgaataaatccacctctcgctttatttctattttctagtgtctacatatataaaaagatcatg

SEQ ID NO: 35292 - DNA, 3003 bp, Unknown
  misc_feature (1)..( 3003): 2750-1469P.txt file - cDNA_ID_3086037; gDNA_ID_2926275; Annot_ID_205299
ttatgactgagaaacagatcaacaaaagttgccaccaccagagcaacgaaagattactctaaagccctaaaaggttaaagttaatcacttaacgagttactttgaagctaactgaaacaaagtttgaagaaatgagacaaacagaatttcatgttctatatgaagatataaggtagcatttgattatctgttaaccatatggtttggtatataaatttttggtttaatgagacacagaaaacttccccaagtctattactctaagaaacatgaattagccatgaagttataacagaattagttgttgtgactaatgaaacagagtaaacagaaaagaaaaaaaatcgaatggtaagattttaaacctgcaggcgttctcaatcggaagccgtaggagagctttcatggtcccatcccttgatttgttctctactctacttgaaagaacatatatatatcttggcctacaaggctacaatgcaagacattaaaccatcagatcaaataattatagctgtcaaatggacgggtccgtccagggaccattgggcgtgtccgtatggacagttttttttatgggccaagttggacggttcataatggacaatggtccgaaaaatgtccatgcctaataaagaccatgtccatatgggcaagcccatgtatagcccattttattattgataaatcaaaaatcatgattttaaagaattgtgtttttgcattttgcatttttccgacaaaacggtaaaattgtgtttttccctcaattcatgcccatgggcagcccattgtccatatggtcaaacccatattatccgcggacaaaactggtcatatgcccaattggaccatttgttttatggtctggaatatagcccgtccatatgcatttggactgggcaagcctatgggccgcctgtccagttgacagttctacaaataatgtacctactaacagaacattgtaagaagctacagatatagtaattagtacatgtccaatgtaaatccactcatacatttcttctctctttgttttactttaaaatatcgattgagcaatttcgatctctagggatttaaagaagtgaaaccaaaattgtttctgacgagcgattaagaacccctcttttaccgcaattgacaatagataaacattatacatctcagagaaaccttctccattttcataaacccttttctacagtgatcgtctcgaagcagaaacactgttcacgattttttcaacgcgggaaaatttatttatcttagggatcatctaaatacagtgaacctcatcagattgggtccaaaaccaggttttagactgagtcaacgacaacgactgtattagcgtgttgatgacacatgtctctccgttgtcacgtataatcaccgttcatttatgaatttaagtacgttatttctattcgaattacccaaattaacctacgtacgtagcttgctccgcaagtgaatagaattggtctatagacaataaatatatatacttttaataataaagggtttgtaattgttgaaacatatgttaactaattatcttcagataaatttactaattcgttcgtaacatgttacaaatttctatcgttgttgtctacaaaatttcttacaaatttctgacgagaataataccaaatataccctccagcttctcccacacgttcttcgtataaccatgccctgaccaaaataaatgttagcgtaggggaaaaaaacaaaacagaacagctctgctctgtctctataaaaagctttctcactttctcgttctcattcagacactttttcattcagacactcattcagacacttttgtcacctcacttactctctctgtctctcccccctctccctctctcatatttctcttttttctataaacatatttcagaaatggagttattgtctcccaacaattccaggagaaccaaacaatggcttcctccgagaagaggacaggtcaagatcatgatcgtccgcaaactcctcaaatcgacggcctcgatcgtttcactgtggaagaggcgagattgtaaataactgtgtacatactttttgttgttgttttaatgttaattatgtacatactttgtaagatgtaatctcatgtatcacgtatgaaaaaaaaagtttttgttagaagatattttttgcttattaatctctatattatgtagacaaattttcttttcttccttgtaaatatttacaagttgttccatatattacatgccataacttaaaaatgatactaacgggtcttggaccaaaactgatatctgttgggacatgcataaagcctaacataacaattaacaagtgtcataaattttggattcacttgtagcgatgatacaacgaaagtaaaactacttattacatttgtcaaatgatactatataggtagctcataactatgtatagatctctaaaattcatctaaacccgaattctgccgtgtggaattaacaaaaaaaaaaaaaagaagagtaaatcatttgaacaattacgtgtgttacattcctgttaatcatatttatatatgtataggttaaagcttgcttatctactatggaacaaagaggatctataataacccttcagcaagtcagcgacaaagactgtagtagcgcgttacgatagtgataacgttcacacgtgtctccattgccacatctactcagacaccaaccaaaaaaaccttgtagatcacacatgttactgaattaattacgttatctctaataagaattaccaaagtaaccttacgtagcttgctctgcaagtgaaagaattggtcttcaaaagacttggtctgtgactttgtgagtgttgtgtgtctcaaagccttatttaataacctctctctcaactttatgttactcgcatttaaatttgtttctctgcttcactcttttgatttctttctacttctttttttcacacagatcttaagatactacaactgcgaccatg

SEQ ID NO: 35293 - DNA, 3003 bp, Unknown; identical to SEQ ID NO: 28546
  misc_feature (1)..( 3003): 2750-1469P.txt file - cDNA_ID_3086044; gDNA_ID_2926275; Annot_ID_205297

SEQ ID NO: 35294 - DNA, 3003 bp, Unknown
  misc_feature (1)..( 3003): 2750-1469P.txt file - cDNA_ID_3086048; gDNA_ID_2926275; Annot_ID_143526
agtgtgtcgtttctaaattatgttaatgatctaaacactattaatgtgttgtttctaaattaaatttgagttttaattattattttatgcttatccttaaatgatttttaacataattaaattcaatttaaatgaattttatacacattaaatagttggacacatgttaataagttaatcttttatttgctctcacataataagatgtcaaatccttaaagaactcccttcatcttttatataatgggcagatttggacagatttctcagttatggaactttaattgtgtaattaagagagatccttgtttaataaatgagagtgccaagtagttcaaaaaggtaagagaaaaactaaacttttaaacatataattataacaacatttagtgtaaatcttaataacaagtttaccaaacaagatcattaacaaatcattgcacaacataattattccgtacttgcttatatttagtgttcctctgcttcatctgttctctgtcatggctcgttcagtcgacacagaagcaatgaccactcgcgatccaagcagcaagcgcggtggctggaaaacgtttccattcatgatcggttagtgtattttatgactgttttggtttatgtttttgagcacacaacatagacaactgatagtgattattgtaaggctctatatggtgcagctacattgttaggactttccatagcttcattcggatgggtgatgaacttggtcgtcttcctaattaaagaattcaacatcaagagcatcgctgctacgcagaattctaatattgttaatggatgtgtgagcatgttgcctgttgttgcagccattctagctgattcttttttcggaaacattcccgtcatctccgtctctgccttcatttctttgcttgtaagtctgagacttaaatattctattgtcttgtgtgactcacaaagcttactagttgttaaacgtttccagggcatcattctattgaccatgattacatctttggaccacttgagacctccaccgtgtgaaacagggtcaattctatgcgaatcgccatcaaaactccagctcgggatcttgtatatagccttagctctagtgatcattggatcagctggtacgcggtttaccttagcatccgcgggtgcaaaccaatatgagaaacctaaagaacaaggaagctttttcaactggtacttcctcacactctacactggagctattactggtgcaacagcaattgtatatacacaggaaaatgctagctggaaacttgggttcggtctttgcgccgtcgctaatttgatcagtttcatagttttcgtctctggcaagagatactacaagcatgacaaaccaatgggaagtcccttcacaaatctgatccgcgttgtagtcgctgctacaagaaaaaggaaagctgtgatttcatctagagaagaagactatcaccatgggcttggaagagaaggcaagacatcttctgcaatgccctccaagagctttaggtgaaaaaacaaaaaaaacttgcttcattcatcaaacttaaaacagaacttaaaagagcttttacatgtgcaggttctttaaccgtgcagcattgaaaaccgaagatgactcagttaataacaactggaggctatgttctgttcaagaagtagaagattttaaagccgttttccgagttctccctctgttactagccatcatcttcgttagtactcccatggtgacgcaaacaagcttgattatattacaagctctagtcacagaccgcggtctcgggcctcacttcaaaatcccggccgggtccctccaagtcatagtaatcatcactgcatgtattgttatcttaatgaacaattgccttgtctatcccatgtaccagaagctagcccataagccattgacaccgcttcaaaaagtcggtataggccacgttttcatcattttaagcatggcgatatccgccattgtggaagcaaagaggctgaaaacagttactaatggccattccatgtcagtgctatggctggttcctccccttgtgatagtaggaataggagaaacgttccaatttccggcgaatattgaattattctatagagaattccccgagtctctgagtagcaccgcgacttcattgcctcagtggtgattggaatatctttctacctgagcacagctctgatcactctgatccagaagaccaccaagtggttaccaaatgatattaaccatggaagagttgacaatgtttactggcttttagtcattgtaggagtcttgaactatttccttgtctgcgcttggttttacagatatagaaacctgaatgatgatgatgatcaggaacaagatccaaaagacgatacaacctaagacacaacgtgttctgttcttgtggtttttgttgttttgatcatcttgaaagacccttttttatgacaataatcagacaacaaaaactctttcaacaactacataaccactctcactatcttgcttaattctaacagagtttgaaatgtgagaaacgtggtttggtttttttttttgttggagaaaaaggaaatcatttctgtatttcctgattcataattaataattttaaggtcttatcatacaaaagtgactcaatgattggtcgagagtatattaaattttaataaaatttatttaaagttcttgaatctttgtctatttatacttttcttatgcttgtggagtggtttactgctactgaagataaggcaagatatgggcgattgctttttagttgtttattacattcaccaacctgatattggcaaacgacactaggagatgaactgtcagaatctgatatgaaatttttgccaccaaaaaagatcactaccaacatataataattgatatggatttgcttatatatataggttacggttgttatctaaactgcattataacactcaaacacaagtcaaagtacctcctgcttccacttgttctctgccatg

SEQ ID NO: 35295 - DNA, 3003 bp, Unknown; identical to SEQ ID NO: 35294
  misc_feature (1)..( 3003): 2750-1469P.txt file - cDNA_ID_3086048; gDNA_ID_2926275; Annot_ID_205296

SEQ ID NO: 35296 - DNA, 3003 bp, Unknown
  misc_feature (1)..( 3003): 2750-1469P.txt file - cDNA_ID_3086056; gDNA_ID_2926275; Annot_ID_143524
tggtcgacgtaatccaaagaaccaccgcgtggttaccaaatgacataaaccatggaagagttgacaatgtttactgggttttagtcataggaggagtcttgaaccttggctacttccttgtctgttcttggttttacaaacctcaaggatgatgaatgatgatcatgaacaagaagctgcggtatctcactcatcatcttaaaagtaaactgtcctttgttatcgtttgaagtcttgagctttctcatgatcctaacgagcatattctaacctcaaagtattattcactctctagtcattgaaagctagtatttttcagttttttgaaactgtttctttcttgttctttccttttatatatcttacacaaatgacacatatatattgtataaatgatcaaacttctattcaatagataaagtcttctgaaattcgtaacaatctcactcgtaaacaccaaatcaaatcgtattttaatttaccttgtccaagaattcaatccatctctgacaaatttggttttggccaaatcatcaaaatccgtaattaaatttagattatgacaatttaaatgaagattccttaaaactttgtagtattctatgtttttctgatgattagtgcgtgctgctgttgaagatccggccaaatcatttattacattcgccaacttaaagttgacaaacgacaacagaggataagttttctttattcggttatatattgtacataaattggataagttaacatatcattacaccaacagtcataaaagcaagggggttgcatgagttggtgttttcattacatgtagattatgactcatgcaatccacaaaacgttagtggagactagggtccatttgatctctccctctctcgttaatcatgagagctagtactgtaccatttgatgaagaaggtgcaacctccaatattagattttgtgtcaacggtcttcttcctgtttaaatcatgggattgttgaatctattcttttaaaggtatattatcattactctgaatatcttaatatagaaagaaaaaaaaagaatatcttaatatagaagaattttctataaacggaaattttcatgtacgtttgtcttgaaaatattgtcatgaatatgtagttaatgaacgactacataatgactaatatcaaatagaatttgtcgattattcgttttagtttaagacgaattaaccactaatttgaattgctatttgacatattatatttatatttttttattaaattaaaataagaaataattctttaaaaatatattaaactcaaaattaaaatactaaattaagaaaaaaatgtctacaaattaaaaacccacacaagtgacagtaactcctgatccgtcttgttctctgtcatggctagtttagaggtctggtgattttgcaaacgtggtggctagatcattttttgcggccaagatgattattgtttatatttttgaacacaaaacacagacactgagacaaatgttgattattttgggtgttatatatgtttggtgcaactaccttgttaggtctttcagaatcataactttttttctctccatattttatttgaaaaaagtgatgtactattttacaaaatttcttcaaactaaatccttcagaagctaaactcatatgtcatgaaacaaattacaaattttgtttgatagactttaaaatcaccgagataagtttgtatgaggtaccgtaagttcttttgtgagttgacttatcgagagtggtttatgagaccatctaaagcgctactgttctggctacagtaagtaatatatacaacattggcgttggtaaaattagcaaagatcattaacttctaaaggtcatcatatgatcagaggctacggaatctaaagtccatttgctaatcttttttttttttgttaaacaacaagaaatatggagattctcacatagaaagttgtggtgacttgactaacaagataaaagaaacaaggtttcatggggttgctgttttcattgattgatcatgcagtccactaaatcttagtggagactccattttatctctacctttctcgttaatcaaaccaaccactctaccatctggtgaagaaggtgacccaccattagagagcttgtgagttgtgaccgttaagcatagtagctcccattgaaccacctgtaaattcagaagaagaagtgtcgttgttagttgttacttattcgctggaagaagataaaataggtttgttgtatacacgtatggtgtttagacctcctcttcatagttcgtatcataattttggaagcttttttacgtatcttgttattcatccatatagaggaagatatgatgagcctcaaaaaaatccctaatagcaaaagtaaaaccaaaagtaaaaccaagtgtcgttagctcaattggtaaagatcctaggcgaagtttaaaggttgtcggttcgactgacgcttgggacgaaactaatattacatgctgtggtttcggttctggaggattacgggcttcagtccagaacttcatgatattcaaaaaaaaaaaaaaaaagtaaaaacaaaaataaaataaaatttcacagtaactaataagcttcttctctctgatcaatgaaatagaatgcgtaaagacaaattttgatcataagatatgaatgtatagtgggcaaagtatactctctggccactattgatgaattagtggatactaaggaaaagtggtaggtctggcaaaatccttttctacatgtttattattacattcaccacgtgatttgggaacacgacaatagttgatgagatatcagaattcggttaggtaatattatataattggactaaacaagatcattagcaaatcattgcacaacataactactctgtacttgcttatatatacctatttagtgttatttatttctaactgcatcataacacataaaacacagtggacgtaactcctctgtttcctctgttctctgtcatg

SEQ ID NO: 35297 - DNA, 3003 bp, Unknown; identical to SEQ ID NO: 35296
  misc_feature (1)..( 3003): 2750-1469P.txt file - cDNA_ID_3086056; gDNA_ID_2926275; Annot_ID_205294

SEQ ID NO: 35298 - DNA, 3003 bp, Unknown
  misc_feature (1)..( 3003): 2750-1469P.txt file - cDNA_ID_3086066; gDNA_ID_2684116; Annot_ID_190815
aagaagagaataaaaaaattctgatcgaaaatagcttacttaaaaatcataattgaatagtatcttttgtttttaaactaatttagtctatataataataatattattaaccatcgtaaaccacacatgatattcaatacttataataaattaatcgcataaaatacaatacttaaaacgagtgttatataattttacgtaacgtaaaacaatacaaaattttaattcctgaacgaataaaacgagtatattaattaatttattgatcgtattaaaacgaatatgatccaattaagattacaattactaaaatccccacactattattgtcattatttaactatggcagatagatagatacagaaccgtaaaggacgttaggaagaggaagaacgttgacgaagtcaacaacgaacagaaaccgtcgatttgaggcggctctaatctcaaccacacgatcttctctgcctttccctcttctctcttcttcttcttcttcatcttcttcctcgcaattaccgcgaaaactcatctctgctcaatcctcaatctcagtctctctgttgactccgactgttatataaaaccatacaaataccttcagattcactacttcaaacctcaaagcaaccactgaatctcgactttgatcaattgagagagaaatgaacaccggcggtggccaatacacggattttccggcggtggaaactcacggaggacagttcataagttacgatatcttcggtagtttattcgagatcacatctaagtatcgtcctccgattataccaattggtcgtggagcttatggaatcgtttggtatgtttccttctctgagctttttcttaagttttattctttgagatcggagtttttaatttctggattttgattttgtgaagctctgtgttggatacggagacgaacgagctagtagcgatgaagaagatagctaatgcttttgataatcatatggatgctaagcgtacgcttcgtgagatcaagcttcttcgtcatcttgatcatgaaaacgttagtgtttttgttcgattttgtgaaatatctgtagaaattagtaaataaatcatgattagggttttttgatttggtattgcaacagattatagctataagagatgttgttccaccaccactaagaagacagttcagtgatgtttatatctctactgaattaatggatactgatcttcatcaaatcatcagatctaaccagagtttatcagaagaacactgtcaggtaaactaaaaactgttcttggcttttttctgggatttatatttgatagaagagacatgaaactgatacttgatttggtgtttttgttgtcatggaaacagtacttcttgtaccagctacttcgaggactgaagtatatccactcagctaacattattcatagggatttaaagccgagcaatcttctgttgaacgcgaattgcgatttaaagatttgtgatttcggtcttgctagacctacttcagagaatgattttatgactgagtatgttgttacgagatggtatagagcacctgagcttctgttgaactcttcagattacacagctgctattgatgtttggtctgttggttgtatctttatggagcttatgaatagaaagcctttgttccctggtaaagaccatgttcatcaaatgcgcttattgacagaggtaaaatattttagagagttatgtaattttagcatggtttaaagattctgccttttcacggaatatgtgatgaatttgtttgaatcttgcagttgcttggcacaccgacagaatctgatctcggttttactcacaatgaggatgcgaaaagatacatccggcaacttcccaacttcccacgtcagcccttagctaaacttttctctcatgttaacccaatggccattgatcttgttgacagaatgttgacgtttgaccccaacagaagaatcactggtaagtttcatacatgttctctgttggtttttcttaccatcactatgttttgattaaaaactgaaaataccatcttgtgcagttgaacaagctctgaatcaccagtaccttgctaaattgcacgacccgaatgatgagccaatctgtcaaaagccattctcttttgagttcgaacaacagcctctggatgaggaacagataaaagagatgatctaccaagaagccatagcactcaatccaacatacggttagaagtgcagcagccccgtgaatgcctggtattacccaataaccatccgaatggctacttagtatctttgcctgttcttttattcatgtacttcttccacatatgtaatcttgtaacttttatttgtttgttcatgttatttactgctagtgattaagtgtagctccaatgtaaagtactccagttattaaagaatatctatagacttttttacttcacatactcttgagtcttccctagtaaacaaagagaagagagaatataattttgtaatgtacagagcctcaatatttgtgggagacattatagagctagagccagagtcaatgctgtcgccgtgagttgtctattctcattcaatgactttcaatagattttagtgggattggctttaggtagcttgcattattgaagtagaaatggtcaattccttagcaataattaggcacaaatgtgtctttctttagtaatattgtaatatcctttgtctgacaatttagagttgacttctaaaacgttgggttggaaataatgttgtcttcacacaggctgttacgaagcagacagtgatggctcaacttgcatcaacggaaacctttgagtttttgttttactttcttaatgtttctttatttgaagctgctgcgcatggagaataaaatatcgtggacccgagaaagtcatcattgctgtattattacttatactgtatatatgtttcagaatttcaggccattgttgacaaaaatagtgaaagatttctgcttgattttgagacatg

SEQ ID NO: 35299 - DNA, 3003 bp, Unknown; identical to SEQ ID NO: 35298
  misc_feature (1)..( 3003): 2750-1469P.txt file - cDNA_ID_3086066; gDNA_ID_2926275; Annot_ID_205290

SEQ ID NO: 35300 - DNA, 3003 bp, Unknown; identical to SEQ ID NO: 28564
  misc_feature (1)..( 3003): 2750-1469P.txt file - cDNA_ID_3086111; gDNA_ID_2926276; Annot_ID_205335

SEQ ID NO: 35301 - DNA, 3003 bp, Unknown; identical to SEQ ID NO: 28563
  misc_feature (1)..( 3003): 2750-1469P.txt file - cDNA_ID_3086119; gDNA_ID_2926276; Annot_ID_205333

SEQ ID NO: 35302 - DNA, 3000 bp, Unknown
  misc_feature (1)..( 3000): 2750-1469P.txt file - cDNA_ID_3086121; gDNA_ID_2926276; Annot_ID_143555
taaggaggtatttgggaacattcttgacaaattatcactcatcatgattatgtattccacacaagatgcctacagaaaaaaattcaaagttaggacctcaatttcttcaatcatgatatgaaacatgaaagagagtttggtacttacgtataactctacgtagagaagtatctgaaatgtaattccaaacccaagttaagttaggatcacaattcacacacaaacaaagttaagattgattatttgaaaaataatcttacagagacgaggatgcgtccagtggttccgaatgcagcttgaccgatgtccgggtaagtgtggattccaggggagttctcgagacatctcttgaggagaatgccggtgtagaaagtgataatgccaaaggagaagagtatgaaaagccctaaccatcctccttctttaactgcgtaaggcattgtaagtaaagctactccacatagaacgttaattcctgcaaaaagagaatgttaagaatctcaatctaaatagaaaagataatcgtaaactcagtactctcgcactaatgctatactaaacgtaaactcagttcatcaatatatatcagatttggtttcagtttgattatttgactaatcttggaaaacagagaaaacctaaccaaaactcagattgaacattcctaatgcaattattaccgttgagaacggattgagagaatgtgcaactgcggttttcttggggagttaaaagatcccctgggactgatagctggagatgagaagcaagaaatgatttgatggaggacacaacagagctttggatctcgtctttgtctatgagaagttgctgtttgcttggtgaagaagtaaacgaaccgaaaacagagctttgtcgtctctggcgaaatgaagagacaaaacttgtactagtcggaggtgtaactccagtcaacaaatccatagattgtctgaaaatatccccaagaacaccaaaattattctctaaagaataatttcttcagatctcttacaaaaacagagcacttaaaaagaaaatgatttaccgataacttcgaggccacggaacgggaacgtcttcggatctgttacgagataaaggagttgagggaacggagctctctgtttggctttcttcatcttcctcatcgaacgtgtgatacaaatcttccctttcttgatcgaatgtctcgttttgcttcatctactttgtttgtattcttctactgtgctctgtttcaaaaaccaacaaaaggtctaaaaagaagaagaagaagattgagaagaagcaactaggggacgcaacgaaacgtgttctgttttcaagttctaaattattgtcacgtttctttatattctttaattagcagtctccttacctatgatgatgtctccctgaatttgtttttccccataatttaaatgtattaatgaacaaattcacgattttcccattattccaccaataagataaatttaataatgtcccattatcctatcactactaaatctaagaaacttcaagaacaattcaaagaatcttctactctgacgcgtaaggttcatttacaaaaaatttagtttttatacaataatactatttgcttgaaaaaatataaaaacgtttctggcgaggttatttataaaacacagaaatagacacgtaatgaagattagttgatatgcatgtgatgtaagaagccaatgacagttgggtcattaattggccattaaatgttcatctctaattacttatgcagcagttaaatttattttttgttcgttttattttggtagctgagcaccttcgtctataactgcttaaaaacttacaataatactcagacaatttcttacagaacaagaaagcaaagaaacttacacataaaaaagcaattgtatatatatatatatatatatatatccacccatctccaagcaaccattgatcattccaagctatctacttttgcagaggtatattgtagagaagaagaggaatgagaaatggagctttttacatatatatgaagaagacttatgatttatcaatctggttaagctttccgagtccattgcagttagcacaaacgatctgaggaagatccttccgtgcggcgttggctctcagagtcactcctcctttcctcacaaatcctgctccgtcacattccggacacctaaaccacacacatttcagagcttaaactcacaatgtacaatctctgattcagtttactacatcggctaagagtttatgtacgttttcaaaatccataacagaggatttagtccggttaagataattcgaatgttgaaccggacaataaactatgataatctgcaattgatcagtcaaaatttggtttaacgagcattaaaaccggtttaagtcacaaggtaaaaagatgagagtggtttacgggtcctttgcgtttgaagaggatcgggaatgcagttccgacgagtgcaacggcgatggctccgccgattaagtagattgttccgtcagaagagacatcaccgacggcggcgacaactacggaggaagaagatctcttgtttttgggaagaatcacattgttcggtgatggtgatccccacgaagaagaatgtttcaggaagttggttgatgacacgaacgtcgtctgcaatgccggtgcgatcgtcataatttagggttttaagtgactgatttcgatttgggggaagtaataagaagaagtgatttgatttttatggaaaggttttgaatttggatttgcttcgtgacgtgtcactctctcgaagtggataacgttttcacttgggatttttggggttcttcagttttcttttgtgtgtggataaggtaggccccttcaagatatttcgagttaacaattgggcctgttaagcccattattaagttagcgtgaacataaggcccaaactatttgtcattgtctctgactctctgaccttcgcagagtctttctcttcttccgttgcttcaatg

SEQ ID NO: 35303 - DNA, 3000 bp, Unknown; identical to SEQ ID NO: 35302
  misc_feature (1)..( 3000): 2750-1469P.txt file - cDNA_ID_3086121; gDNA_ID_2926276; Annot_ID_205332

SEQ ID NO: 35304 - DNA, 3000 bp, Unknown; identical to SEQ ID NO: 28562
  misc_feature (1)..( 3000): 2750-1469P.txt file - cDNA_ID_3086129; gDNA_ID_2926276; Annot_ID_205330

SEQ ID NO: 35305 - DNA, 3003 bp, Unknown; identical to SEQ ID NO: 28561
  misc_feature (1)..( 3003): 2750-1469P.txt file - cDNA_ID_3086133; gDNA_ID_2926276; Annot_ID_205329

SEQ ID NO: 35306 - DNA, 3003 bp, Unknown
  misc_feature (1)..( 3003): 2750-1469P.txt file - cDNA_ID_3086136; gDNA_ID_2926276; Annot_ID_143550
ttgttattgaattcgttcacggaaaatgctgagaactcttttcagttttgttgtgtaataaccttgcaaattaacattgcaggcagtagcagaaggcagcttactaaaactcccattctcaaccatatatgagtatcttcaggttcttcgatcttacaccaagctaatctttgttttttgtcttgaggcatatagtaactgcaaaagaaactgccataaagcgtagtgagaattcttcaacagagctgccatggctgaaattactttctttttgtgaatgtttctggttacagatgttgcggttgattgcagaggcattgaaagatgttggtccatgttcaatgttttatcttgctgctgctgtatctgacttctatgtgccatggaagagcatggtacgagtctcatgtccctaagactatgctacacaattcttgtatctgaaagatgttttttgtatatatttggtgaaaccagacagagcacaaaatagaatcaggatctggtcctttagacataagactagctcaagtccctaaaatgctatcagtcttgagatcaaattgggctccaaaggccttctgcatatcattcaaggtcaatctctctctctattctctattctttcttgtattgattctccgaaatccgatgatgtatatgcaaattcttgattcagcttgagacagactcaaagattctgatggagaaggctacaaaggctctaagaaaatacaaagtgcacgcagttgtagccaatgagctatcaacccgtaaggaagaagttgtggttgtttcaagcagcggtaatgttgtggttagacgcgaatgcgataagcctgaatcttttgttgaagataatctcattcgtctcatcgtagatcgacattcaacatacatcaaagaatctcacaactgattgctcaagtgtgcttctaaaggcaaagaaaagtttaaatctttcctccacataaaatagaatcatagagcatcttgttatgtgtatgagtgatgattaagtttaaccataatttaaacaatatttcagatttgttgttagatcttttagaatttaacacattttgaaatgtttgaatttataaataggtaaatcacccaaaacttcacgaattaaaatatttagcgttcaatcttttagttaatggattggaacgaaataatttgaaagtattatcataatttgcaccctgttcaagtcaaacacgtattctctagattaaaatatagttttagtcatgaaaatgtttagcatttttttttttataggtttaatcatctgtattgactgcgacaaagcaacttcgtcgttgacgaaaaagaatgcgtaaatgacaagaaatccattatgatatgatttttgcaaagaaaaaagaaaatccataagataacacacttgactttcttttttggttttacaattacacaatgaacaaagccactaatcaatacatatatgatcgatccaccgtaaattaaaaaaaaaacagtaaattacatatttgtttaatttcttcatcaaaattatggacaaattatatttacagtttaaccataatttcgatgattttaacaaaccttagttttactagcaagtataataatttaaggtggaccgtacgtatataacaatatttaatttacaattaccacaatcatatctttacgtatgtatatcgatcatcagtcgtccttacgtacgtttggtgatgttcctagtggaaacacgagaaggcgaagatgacggcgtcgtttcgagcattccaaaacggtccgtcccaaatcgtcggagatcggacgttcgaaacctactagacgagtcgccaggaagtcgcatgtaataaccggcgttagaaggagagtgatgatcgctgagcaaaaccgacgaaaagcttccttctcttttatacataacaatggctttgtacaaaaatggaatcaaaccctccattttctttttaaatctctgcaatccttaagaaactttttttttcttccttttgatgagatttttttttttgtggttttgtgatttgatcaatgcgagagagggcttctggtgtataatataagagggaagagggttgcgatagtgacgtggcgtgatgcttatgttgccacgtatgcttaaacgtgacggtaaataatgttcttgagaggatatgcatcgaaagataaattaaataaagatgttttttatgagacgatagataatatgtgaaagggaagtctcaacttacataaagaaatcttcatcttctcaagcaatcttgagtttaacatttttatataaatgaaagtatcctcacaaacaaatttgttttggtatatgaaaagagtctctactcaaaattgaataacaaattctcgtatgaagtataaaataatttattcaaaattcattcgtatcaaattacccaccgcactatcctcaaaatcttgaatgaagtcatagtttacatcatagattgggaaaagtttgatcccatagtcattatattttatatattatccaaaaagattagttaaaatgatataattataaaattttgacttcaatacagatataattggctctctcactcaaaaagcaatgacaatactttcttagttttgaagatcgtgttaggtgagggaaaataagaacaaacacatatatagccgttaaaattgaacataattctattttgggccgttatataaagcccaacatgtagaatgtgagcttatattgggcctcacgtggtttatgtcgacatcttctcaaatctgcttgctttcaaatatcaaggaatccggtttggttcggttaatgcttcaattttcaaatgtgatataagaaacaaaatcatttagtggctttttgacttcaaatcggagaaccgccaacgaagaatcgtcgtcttcttcgtcatctccgtcgctgatcgatctcattctttcttaaggtagagctggtggtttctgtaatcgccggtggtgatg

SEQ ID NO: 35307 - DNA, 3003 bp, Unknown; identical to SEQ ID NO: 35306
  misc_feature (1)..( 3003): 2750-1469P.txt file - cDNA_ID_3086136; gDNA_ID_2926276; Annot_ID_205327

SEQ ID NO: 35308 - DNA, 3000 bp, Unknown
  misc_feature (1)..( 3000): 2750-1469P.txt file - cDNA_ID_3086148; gDNA_ID_2926276; Annot_ID_143547
ggcctttggagcccaatttgatctcaagactgatagcattttagggacttgagctagtcttatgtctaaaggaccagatcctgattctattttgtgctctgtctggtttcaccaaatatatacaaaaaacatctttcagatacaagaattgtgtagcatagtcttagggacatgagactcgtaccatgctcttccatggcacatagaagtcagatacagcagcagcaagataaaacattgaacatggaccaacatctttcaatgcctctgcaatcaaccgcaacatctgtaaccagaaacattcacaaaaagaaagtaatttcagccatggcagctctgttgaagaattctcactacgctttatggcagtttcttttgcagttactatatgcctcaagacaaaaaacaaagattagcttggtgtaagatcgaagaacctgaagatactcatatatggttgagaatgggagttttagtaagctgccttctgctactgcctgcaatgttaatttgcaaggttattacacaacaaaactgaaaagagttctcagcattttccgtgaacgaattcaataacaataaaaaaatggtctaatgcatacagtttgctgatccataacagccattttcacagcttccaaatgtgagtatgaactgaaaaccaacaaagtgatgtataaagacacataatttgcaaccatagagagcagaaacacacacttaatatccataaaccatgaactacatttgaataaacatgaatctatctatatagattgagaaagagatgttctaagaaaaaaccttgaatgttagtcttatcagaaaactcaaaacattcaaggaatggatcatcgggaagagatcgacaatacggttggcaagttcccctaaagattcacataataaaccgatattaaaaaccaccataaccattaccaacaaaaacaaaaatctcacttatctttcaactacacacaattgagaaacacatgacaaggccaacgttacctcctatacagaaatatcacagcatatccagccttgacgaaattccttatgcaccaaatcaaaaccaatttagatcaaagagtgatcataaaaacagagaaaaaccacaactttattagggtttctataagagaaacaaaacttactcagtagaagcagcacctctgtttccggagctgaaattatcgatatacctaacacatcgttgctccaatggaaccgttgttccccctgaagtcacacatacaatcctccttccccctgaaatttaaaaaccctttgaatcattttcaataattcaataatgtcacgtatataatcaacagctatgatcttgccttgtgacgatgaattcagtttgatgaactcattaagattctctagaatctcctccatgttcttctgaggtggggatgattcgaaaaacgaactaatttcatcttccataacttttccaaatccagagaaagtgattcagattgacgaagcttgcttcagaggagtgtgagagcgaggaagaagaacaaaacttgttgggcttttgatgatcaagctattctaattgggccttagaaacggcccatataatcacaaagtttatattcttgcaactatggacatttgtttctgataaactcacacttgtacgcttttagttttatttgtatcaagaaagtacctgagatagtgagttttggattgctgttttgccagattgtgtcgatgtcttttgtgtcacttatgcattatctttttctttttgtcaagtgttatcaaccaacacttgtgcattcatttttaacctacgaagttgattccgagaatctataactgatctttttgcgatcatgatgattacatcttttgttgacttgaaaatgtatgatataactatataagtatagatgaaatagttgagaagtgtgaacaataataatcattcgttattttttcttgagaaaatggcgatactattctatctaaacacaatttcaatatcatatacttcacatttctatgtaatttgacgtatgcaattacctttaattgataagtatatagctataggggtaattaaggggttattgtggctttccagtggtgtgggaagtgggaacggtatcttaaacttggttacataactccgtaatgggaccggacgcttctcgtgttaaagtttgtaacaacgaatacaaacaaaataaaatatgtgatgaacttaaaatctttgcatgtgcaaaactttggatcttgaatacattgttcatgccttattcttcttcttcttcttcttcttttttttgttccttagtgtttgttaaagttcgtaatatatcttggaagatgtatacgattacggaaaaaaaaccttataatagatttactaaaaacatgttctagaaaactctatactgtcacacgactcccatttaaattcttaagtttttgtatctatacggataaatagtgaaagatgtgatacaacaattactaaaattctttttacaaatcagaaaatctaccagaattttttctgaataggcaattactcgtcctcaaccaaaatgaataagagatgtagtgaaaattatacttgtcgaaaacggtccagtctaaattgataacgcaaaatcgagtaaaaaatgaacagtcaataatacttgtcgttgaatagtaaataaaagtagaaaacttaggaaacatgaaaatgtcgggatgatcatgacagacaatgaatctgcacaatcttccttagaaaatacaaacatgattttgagaaaatccaaaccaatcctcacattttctcgtttcaaaacaactcgggaattgcttttgtttactttactaagatatacgtaacaaatgtataaccacagcaataacataaataaataataatgacctttcattagtacataaacctaaacttttactcacatcttttgatcactaattgtccacactcttaattagttatacaacaaaatg

SEQ ID NO: 35309 - DNA, 3000 bp, Unknown; identical to SEQ ID NO: 35308
  misc_feature (1)..( 3000): 2750-1469P.txt file - cDNA_ID_3086148; gDNA_ID_2926276; Annot_ID_205324

SEQ ID NO: 35310 - DNA, 3000 bp, Unknown
  misc_feature (1)..( 3000): 2750-1469P.txt file - cDNA_ID_3086156; gDNA_ID_2926276; Annot_ID_205322
cgattaaaatgtaatggaacccggttttcaggactgaccaagagattttggggtctgcaggcgccaatagattgtagtcctaccagcttatgttacagctacatcaagaacaatgcatcaccttgttctaaggctcccttgtgttgcaccttcagaaccgacgggtctcaaaccgcttacacgatcaggatcaacggtgggggatgcctcgcgtaccaaagcttcgtggggctgaatccaaacaaagaggttcctcctcccgggaaaaaatggcctgacacggggctcgagttgcaatgggcattgcctaaagaaccagtttgcaaaactgatgtagattgtaacctcttgttgggtaaatcaaaatgcttgcctgatccaacgagtctcggcctgaaacgatgctcctgcaaaaaaggtttggaatgggatccggttaacgcaatatgtaagtaaactgcataacaagtgaactattcaaaacaaatttcttgaatcagatcattgtgattgattagttcttggcatacatgtattaggtggtaaatgtcgccatgggaaacactgcaaaaagaagaagaagaccgttgttttcgcaggtacagaggatgaaccgaaaaaccaaaaatatattcaaatgcccatatgattgtactccattttaacttctttgctcttgaaggtgcggctgttgcggttgtgggagttacgctagcgattgcggtagcagtaattggaaccaaacatagccaccaaaaggttaaaaaggatatccacaagaacattgttaaggagcgagaagagatgcttagcgcaaattccactggaaaatcatcaagaatcttcactggcagagaaatcacgaaagcaaccaacaatttctcaaaagacaatctcataggcactggaggttttggagaagtgtttaaagctgttcttgaggatggaaccataaccgcgatcaaacgagcaaagcttaacaacaccaaaggcactgatcagatcctaaacgaagtccggattctctgccaagtcaatcatagaagcttagttaggcttctcggttgctgtgttgatcttgaattgcctctcttgatctacgagtttattcccaacggaacgctgttcgaacatctccatggcagttcagaccgtacttggaaaccgctgacttggcggcgcagactgcagattgcataccaaaccgctgaaggattagcttatctccactccgcagcacagccacccatttaccaccgcgacgtaaagtcaagcaatattttgcttgacgagaagctaaacgccaaggtttcagactttgggctgtcaagacttgtggatttgacagaaaccgctaataacgagagccatatcttcacgggtgcgcaaggtacattgggatacctcgatccagaatactaccggaatttccagctaactgataagagcgatgtgtacagcttcggggttgtgcttctggagatggttacatcgaagaaggcgatagatttcactagagaagaggaagatgtgaacctggtgatgtatattaacaagatgatggatcaagagagattgactgaatgcatcgatccactgctgaagaagacagctaacaagattgacatgcagacgatacagcagctcgggaatttagcatctgcgtgccttaacgaacggagacaaaaccgaccttcgatgaaagaggttgctgatgagattgaatacatcatcaatattctgtcacaagaggttactgagacatagctgtcttagaaaattaccaaaatgacttgtacccttgccctgtttccggttatggattggagaaaaacaattcatagaaatggatttttgtaaaatcattgagatgggttttgtttgatatcatatcaagatccaaaacatggtatgagacgatatagcagctaaaaaccaattaaagaaagataaaccaacagaaatctgaaacctatcgcaagagagagcgggttgctgcctgcaaaactcagtgtctttagtgaataaaacagtaactcctgcagaggaacacgcggctgcaagagcgagaagtgcagtgacctgcagaattccaaaagaaacctatcaaacaaataacctttaaaacaacaagacaccaacagtgaataagcatataatgaaatggaagataagtttaatacccaatcaccaacagtgaaaaggctcaataagatagggcttcgtaaatcactttttctccttatcgcatatacatcaagacacgcaagtccaaagctccatatcaattgaagacccatagatgcgactaagaagctgaaatcattggcaaaagcaatctatcatcattttgtatcttttgagataaccccatacagtaatcgaaatatagaaataattccatttccacatattttttaccaaacaaagaaaaaaatcttgtcaaagtttcaggcaaatgttaatcatacacaattactagttcagttagctctatcttcaaaagtttatccaagaaaaaactacaaagtcaagatttttgatacatcagtgtccaatgtcttcaactaaactaaactaaaccaaaacaccaagaccaatgagattgaagatggacaattaccagaaagcagtgtaattggaaaagtcgtaagaagaaaccataacaccaatggaagcagcagcagttgcacattgccctagtctcagtatcaacccactcattgttccaggactcccaatcatcttcttcattgatcagaacccaaaaacaaacacaataaacagaacaaaaccaagactttctatcctgttcctcaccaaaatccccgggagaaaaaaatcgctactttacaggaaattgatcataaaaaccctaaacccataattttattcaggaaaatttcacaaacccaaatctcaaaagttgacttatgatcataaatcgtacggaattgggtaattaagagcatcgccaccagaaaaccaacattaaaaatg

SEQ ID NO: 35311 - DNA, 3000 bp, Unknown; identical to SEQ ID NO: 28553
  misc_feature (1)..( 3000): 2750-1469P.txt file - cDNA_ID_3086160; gDNA_ID_2926276; Annot_ID_205319

SEQ ID NO: 35312 - DNA, 3003 bp, Unknown
  misc_feature (1)..( 3003): 2750-1469P.txt file - cDNA_ID_3086162; gDNA_ID_2926276; Annot_ID_143541
ctgtggttctgactgctttgttgatttgtatttcaatgaaagattcaccattgttgctgctatccttcgacgcttcattcatccatcccacctcgttctccatactattagttaccgggtcacttcccaaaactccatctactacgactagttatagatatataagatttgatctcttgctcctaattttttaacaataatcaagtagattctaattgatatacagctagcagctcatgtgagctcttagtgcaataatataagagaatgaatacacgattattgtctgatcaaattaaatctctcgatgggatcgggggattggtggtataaatcaaatttttaataatatatagtttggacactagtccctgataatatcataatgtagctaactgagttgtatttatcgccaagctcttgggatatcacatgcatatatcacatgtcacattttatttgctttctcgttttgaattgtattttggtttctcatttttgatggagtcaaattccgaaaagccggaaagaacagctaatggattaagtcttgaaatgtatcttttgtatacgtgtttcggtttttgttgtgagattttattggatcacgcttgaagatattatttcaagggataaaaggataaagaaaaaagattcttgataaaatattatgttagcttagcttggtgtacgtacaataatatgagaagagcgattttgatctcaccgtaaagtactttttccaaacgggtttgcactagatggcccataatgaagttttattaggcccatggatgatagtccaatgaaatgatgtaatcaaacgtaagcaataagtaagaacttatgaagaaccaactggtttgcttcggtccatcaatgaacgttatgcaccgtggtccgtggtaattagacttttctagttcgtatttgaaaattttcaatagttcttattttgtaattatcataatctctaaacttttgtagtgcagttgggaagtaaacaaataaatataaaaataacatggtttatatagctcaaagaaatgggatatgttttttggagaactttttgattaaggatattgggtagtgtaagttgaaagtaatgttcttgttaaaaataatgatatagcattatagcgtaaggagaaattgaaagttgatgaaatatttgtaagaatattatgagtacgtagagtagataatattcttttatatatgattaattaactatcactttagtattgtgtaaaactcaaactctcggtatgattatagacgcaatgacaaaatcatgatacttaagtcgttcaagtattattaaatagatacttttgtcatcgtgttgcgtttgttatacaaaaggtggaacagttttgagttttgaccttatttttagggttgttttgtaagggaaacaacgacgtgcaatacgacaactgatagagaacaaaggacaaaacattatctttgtttgaaatgctcgacaacatctacatattcctatttaatcacgacattacgttacttgaaaaattccataattcaactatggctatatcttatatatttgaaaagaagttatagaattggaaaaaacaagaaaaatgagaaatttttggcaaacatatagtataaattatgcaatcaagaagaaaagtttagggattttgaaaatgttaaaatcttctcctagtttctaagcaaaaagtataggttgaaactattttcacaagtaaatttttttaaaaaaatctatgaaattcgagataaataaagataattatgaagctacagttcatattaaaaaatcgtgttgtgaccactcgatcgtaatacacacgcaaagacaaggaaaacgttggagatttgggttgggttagaaccaaagacaaagcatcactttctacctttatccttaagaatggaccaaattgtggtcattatggaagcctatacggctaataccattcatttatcaaacttgttaaatgtaaatgaaaacatagaagaaaatttttattgatacttattgagttattgaatttcacttcacgtattgaatgtgtgtgttatctttgaagagaggacgcattcattgttagggagtgaatgctttacggagtaacatttttgaaatttgtaaacttttttagaaatttaaactatcttcgatccgatccgctgcactatataaacaaaaattgtatatagtaatattgaaccgtaaaaaaaagtagaggaattttcaaggttgtgtgttaatataaatgaacaaaatttaaaatactgacaccaaatatatcttgtggaagttgtaaaaatagacaataaatgggataagtaatagtaatacaaactgttatagaggtattgtaccgttgcatacttgcatatcatttgatgaatacgactttatttttatttttatacttctttagttccaaattcctaatttaatatggttacgtaatttgtaaaaaatatataatcttattgaatacgtcattttatgattttatagttatcaaatctcatcgtagatggatccgtcaattacacgattcccataatagaaaaagaaacagttaattagtaaactatagtataaatttaaatcttgtcgtcattgatttggattagtttagaattaaacccgttgattaaaataatcacctggttactgagagaagataaagttggtgtttttaaatcttatgttgaagatgcagagagatcgaggaagacagagcaagagaacctcttcactcacagacccactcactgcattttctcttcttttctcagaaaatacttttttcccccgagaaaatgttccacaagaatcagatcgaacaataagggttctcataaatgtaatgcgattcaagcacgagaatatccacagagagagatacagaaggctccttttgagtatttgagcaagtttcagaactcgaagactgtgtttgaaagagagattcaggcgtagtaataatg

SEQ ID NO: 35313 - DNA, 3003 bp, Unknown; identical to SEQ ID NO: 35312
  misc_feature (1)..( 3003): 2750-1469P.txt file - cDNA_ID_3086162; gDNA_ID_2926276; Annot_ID_205318

SEQ ID NO: 35314 - DNA, 3003 bp, Unknown
  misc_feature (1)..( 3003): 2750-1469P.txt file - cDNA_ID_3086173; gDNA_ID_2926257; Annot_ID_204612
tagaaaaattagaggaaggtataggtcctgtgagttcattccagctaagatccctgtagcgaacaagaagcacaaacacattcacaacactggaaagagaatacatgcattgagattgatcagaacttacaagtatttgagatgacgtatcttgctaaaatcaggaagtgcccctttcaaactacaatttctaagactcctgtaagtacaaaaagacgaacaaacataataagttctctctataatcttctaaatgaaacaatcaaacaaggactttaaagataacagtggcctgaaacttacagctttagaatattcgaaaagtttccataggaagctgggatatcggatccactgaagttgttattatcaagttgcctgaaattgaggacaataaccataaatcaaacaaattacttgtagaacgaggtaaaacacacaatcgagaaacatacaggatttgcaggtttggcaatgcagagagttgtggtggaagatttccagataatttattgttgtctagcagcctgtaaaattagtttgacccctttaaccatcatgatgtaacaaatcatgggaacagtggcaacatcgtggcaatgactcacacatgaaagatgttagtaagattggaaagctcaactggaatctggccggtcaacgaattattgttgaagtgactgtacaaggccaaaagaaaaatatatgagatgatattgaaaaagctgcgtctcagtttgatatcactgtctggcttgatgttcagactcacagatgtttcacttttttcaagttggaaaaggactttggtattggtcctgtgatgttattctcatctatctggaacctgttcaagttcgaaagatacccgagttcgcttggtaaagtccctgaaagtttgtttccattcagcagcctgcccacaggttacagaatcagaagataaagaaaaggaacacacatgcttataaaaaattgttccatctagagcaatgattatttatcaggtaggtccaacttacaagagtaccagggatgatatctgtcctatctcgtttggaattgaaccacttatattattccacatgaaatctcttcatagatgccacacgaaagaaatattagacagtcagtagtgtaaccaaaatatagggcgttccaaaataaacactttgcaaagctttacatgttgaaacttacaatatttcgagatgagctaatttttggagctctggtgacaaagtcccggagagattcatattcatcagcaggctgcttggcaataaaaggaaggatcagggaaggaatatctggtcatgtaagcaactgttccgagaaaagagaaaaaaaaaagacaactgaaccagcttctcccaaaagtaaagccttttagttaactccagcatatatacaagcagactaacagcgaaagcaagaaggtacataagaagaaaaaaaagaagcaaattcatacagttctcggacatgcaggtagtcgtcagtaccaatctcattaaagcagataactccagtccaatttgatctgcaagggtcgcctctattccagtttctcaaataatctttagggtcaagtagacttcttttaacagatcgtaaagcagtgacttctgaagggtgggttctttgagcatcggcaagcagaaggacgcaacaacaggcaacaaggagcgcatgtagatagagtctttgagggaacaccatggtgcctttggaaagcgtaacagcgtaagaagcagataaatatagactgagaccaaatatccaagcgcacaaggagctcgtatttaagacagaaatagacacagcaggtctaaaattcaaccccacgcaattcaatagctcaaagacaagatcattacctcactattgagatcagcaatactagtactagttccctaagagaattttccaaaaaggcaagcggataagagaaagcttctgggatggcaaaatccctgaaacgggcgagagaagtcaaaatatgcagacggcaatgcagatcaaatcaaaacatcgggaaaatgatgcaattaatcgagagagaaaaggggggaagaaatgaccttgatgggtgtttgctaggtttgatcttgacttgtctgccattttaaaaagcttaaaccttcttccgtggtcataattcggaactgggttgactctacctacctgctccacaagtaccctcgtgtgtgtgagcctttttgaccaatagtaaagtagaaagtagaaagaaagaaacccctttagccattagcctgcatttattagtatcagcaacccaacattgacggcgtttcgagacgcgctcttgtccctttcttctcatgtcagtcaacttctttctttcttctcagtcagagtctcagagagagagagagatattttattcctccccaatggctgggggctgtagtcacgcatgttattttagtaggcttgcattaaagcccatttaggttataaggcccataatgtatttaataggctgcccatttagagaagactgtcgtcgcttcctttaagtcaaccaaccctttggattaaatccacaatgcaattcgtccaactaaaaaactctcaaccgttgatttgattcacacacagacgagacaagacaattccgtcccctctctctctctctttccgcagctcgccggatctcctttgtcttcttcccctgggttccgtttagctcaatccctttttaggaaagactccgtggctcgatcctagtcttggcgatcgcctctaccctttttgactctattcttcttcttcttcattcatttcccctcttattcattgcctttagggtttcttacacgatatgagctaaatacgattttgatttcaccctaagctttcttctattgcttctcgtcgttgcaggtactctttttttttgttttttggaaaacgcgttttctttccaccactgttagctaatcatcttcatatatgcttttagggttttcttaaatg

SEQ ID NO: 35315 - DNA, 1826 bp, Unknown; identical to SEQ ID NO: 28550
  misc_feature (1)..( 1826): 2750-1469P.txt file - cDNA_ID_3086173; gDNA_ID_2926276; Annot_ID_205313

SEQ ID NO: 35316 - DNA, 3003 bp, Unknown
  misc_feature (1)..( 3003): 2750-1469P.txt file - cDNA_ID_3086199; gDNA_ID_2926277; Annot_ID_205387
ctctcaaagtctcctttcccaaaccctaaattcttagtgtaccaagcgcaaaatcgtttcaaaataccctttttgtaataaaaaaaaaatgtatgcataaatgaaaaataaaataatacaaaatcatgaattaaatcatagtaagagattccaaattaaaagaaaacaaaaactcataagtaactttttacatgatccattctgattgtaaatctcgattatgaattagtgcaatacaaaagttggtagccaaacaaatggtttcaataagtctggtttttggatagtgtcgtgacttggtaaagtaacatttcactagatttgcttgtccgaagccaatgagaatgactcacttttacatttctgttcacaccatcattattatcaaaatctcgttatcattgttactaccattccatacgtacctttaatccatacgaccaaaataatgcataaactccctgcagggacaaagagacgtcggaaagtacgagattagaccactccaactgccaaaagaactacgcgggctaagacgtttcatttggcagtgacaaaaacaacgtcaacggtgaacagtgccaccatggccatcgtcttagctttttgaagacacgtaaatcctccttatcaaaaattataacaaaatataaacataagctaccgatctatagtgggctttttaaaaaggatgggccgactattcaagttatcaacacgtcgtcgtataatcatagtagctctttgtatttttgttccggacatgattatcttagtatccaaacacgtcacattcaagtttattctaaagatttttctctccggagacgttaagagaagaaacagccaacggattagggatcttaccgttctgcgattcgccggtgagtgtttttattttatttttccgatttcatatcggcttcttactctttaattcgatttccttatatgttatcgtgattaccttcccgagaattcatggtaaaattgatcggtatatattttgataatcgacttcaatttggtttatccctccttatgcttaattgcttcacttaccggttttgattctgacttgtattgatttgatatcgattatccggtttagtagcttcaagtgtttcccctgtgtccatgtatcgtcttggtcctgatgattttgaaatgttctgttttgtttgtttatgttaagaacagagtttgaagctttttttagagacttcaatggtgagccaaggaatggtatctcttacaaagtctctatgcactatgactccaagagtccgtctcaagaatccgaatatgttgcagaaactaaagactggatcttgtaatttccgtttcagaaatctccgtgtcttatgcacaccaaagctgtctcagtgggaaccgtcacctttcattcatgcttctgcagaagaagctgctgatatagtattggacaaaaccgcgaatgtgttcgaatctattgtctccgagagtgcagaggaagagaaagtagatatgtcagcgcaacaacgaactaattctcaagttcaggtacttaaatggccaatatggcttttgggtccatctgttctcctcacaagcggtatggcgcctactttatggcttccgttgtcatcggtttttctcggttccaacgtggttagtctactttctttgatcggtctagattgcattttcaatcttggagcaacccttttcctcttaatggctgattcttgcgcacgtcctaaagacccatcacagtcctgcaacagcaaaccaccatttagctataagttctggaacatgttttcactcataatcgggtttctagtcccaatgttacttctcttcggatcccaatctggccttctcgcttctctccagccccagattcctttcctctcgtccgctgttatcctcttcccgtacttcattctccttgctgttcagacattaacagagatcctcacatggcactggcaatcaccggtctggctagtcacaccagttgtctacgaggcttaccgaatcttgcaactgatgagagggttgacacttagtgcagaggtcaacgcaccggtttgggtggttcatatgcttcgtgggcttgtctcttggtgggtattgatcttgggaatgcaactcatgagagttgcttggtttgctggttttgcatctagaacaacaacaggtcagcaaccacaatctgttgcttctaagtaaagacagataaatgtttcttcgtttagtttttaaagtcatgtcaaagatttgtaactctttcttcactgtatagcttttattattcgtgggttggtgataaggattaaaaaaaaacacatattctttatgatcatattcgctcttttagttaggtatgtgatgttattcatttcaatattaaaggctgataggttgacgttaaggttgagaatatgcaaaggttgacacagattcctgtcaaagaaagacatttaagaatttacgaaaaatgatgaaaatgtttctcttaagaaagtagagcataatgtcgaataagactagtttatatggttttgtatttttactaagtcatgtcagaaagaagaagaaaaatatatgtactgtgttatagccttataagtaataggtttttgcatttggtgagtacttggtaacagtaaaaaaaagaaagttatacgttacgttgtgaaatatgatcagattataatgtatattctttactttagttgaattgttgttgttgtaattcatctccacgcgtttgcgattagggcgcgtttgcgtttttatcaattttaaatgaattgacagtattacccttgagaaatgaacaagacaaatagcgatgtcccactctattcattagctctgtctaatctctctcgatcgacgactgctctctctctgaaccggagacggtgtcacgggacgaatctaatcgccgggaaaccgttttttttttctctcggaaaatcgatttgaatctccggcgatctgatcgggatg

SEQ ID NO: 35317 - DNA, 3003 bp, Unknown; identical to SEQ ID NO: 28575
  misc_feature (1)..( 3003): 2750-1469P.txt file - cDNA_ID_3086207; gDNA_ID_2926277; Annot_ID_205384

SEQ ID NO: 35318 - DNA, 3000 bp, Unknown
  misc_feature (1)..( 3000): 2750-1469P.txt file - cDNA_ID_3086211; gDNA_ID_2926277; Annot_ID_205383
tcatatttgtgtttagctaataaaaacgcgtttttaatttttaacttcaacaaatttacgtagttaggtagtttaccacaaattaagagactttatgagtgaacttaataagtctttatttaccaaacttgtgaagaacagtccatcaatgctttgtgcaagtactttcttccctcacatacaaaataaattaaacgcctctcataaaccgatctgatccggtctatgactctattatgttccacatcgaatggtaaaccaaaccgaattccatttattaatcatgggcttttttaagccgagcgacaacaactctaggcccatatgaagaacaagagtagataagaaaaaaaattcaaattagtttactatccgttacaagtttaacccctctttctttaaaacgttacaattcgtttatgaggggaagaaaaattaaatcatttctgcttcctttgaacggggaagttaaccttagaatggtaaatagcaccaggactccacttttccgggataacgcctttcgcaatgatcttcttaccggacacggcggaggtaagcctgatgttgaacggacctttcaaaggaacaccagggcttagtctccaaacagcggatctcatttcctccattttcatatactgtcctccggccggttggacctcaatgcaggcgaagttcccatcaccgtttgcaaacttaaccgcgaatgacatgtagtaaggatttgctccggcgtcgacatggatagcgatcatagtcttcgggtgtttgcaacatgcactaaatatacgtatgatattgattagaatttagtatatggttttacaatccaacatcaatgtaagtttattagaatttattggttgaacaaaataagtcactaaaattttatatttcaaattaactctagtaaattaatataacattagtttaaaatgactatttatatttgtgaatattttctatccaaaaaacccgacctaaccgaaccaaattggtttttgactatacgtaccgtttgtaactaacttttagttctccaaggttgcgtagttgatctcccttgccacgtttggccaatgcaccaaaggccttaccgctaagatcaaaatggacagactccttcgtgcagccgggacactcatccgatatcatcaccttgatcggctttttcgtgcacaacggatggtcgcatttaagctataacatataaacatggttagtatatagttctacattacaaatatcatattcaatgaactgatattgttatatataaatacccaccctgtaacaagccccacaaccctttccgtctttgaacaatgaaggtcctccggctgaaaccatacatctgtacgggtgttttgccactgcatcaccatatccacaagctcctcctgtgtacatattttacgaaccgtgcatatataggtaaatatgggaaaatgttttcgagttttataagtgtattggaacaattaaaggtttgattaatacctgtggtgccaggaccttctcggtcgccataccacgtgatgccggcggtgttccagtgggttttattgtggcaataacatggcttcaatgagattgcaaagaaagttgtaagaacaacgataaaagaaaaacatttgagagatgaggaagccatgtttgatttagaatcttgaatgggtagagattttttagagcttatatatatatttttgtttttagctttcaaggttttaattagtttctggttgttagaatttaacaaactgaaatagctttaggtttctactaaaaagacaattatagacttctagttgtttttttttttttttaagacttatagttatcctagatttgaggaaataaaaaactttaaaaagcttattggaaactatgattgtttttctttttctttttagaaaccaaaaactataactaaaaccgctaccgttcaaacaaaggttaattttgattagtttcttatattcactttctaaattctatattacttattttggattatatatgtaacgtaatattaaggatcaattagagtaaatgatttgatcaatcatgtctcctaattatgtattcttcttactctctcttttatgtaaagtataatattgtaattaacttctctacaatactctagctactctctgtcatcttgctatacaataaagattatcaattacataaacattcatatcatcgggtggtatcaaaggaactcgatctctaaacctaaaattttctttctcaaaccaagcacacagtcgttgtcatgtacaatcctccgactatgcaaaacaccatcactacaaacaaccaaacacttcttttttatgtttttgaatatgattttaaattatactcaaaagaaaaagttacggggtattacatatgaatgtaaaaaacttgtcagaatatatacaagaagttagggattctaagttctaaccaaacacttcttaatctaaatatgactaatgtaaggtgttagaaattataatgaagttgtcatattttcaatgttttaatagtttcttatgacatcaggcttggttgatgtgtggctatatggaagctgaatttggcaaattcttcatatatacaacatcataagatgggaattcaagccttaactcataaaacgtatagtgtaagcaacaaacaagtaaccggcccaacaacaacaaaaggcccatctcagcccagtcaaatagaagaagacaaaatagactccagctcaaaacagagcaacgatcgtacagaggaggggcgttttgcctgatgactcaccatagccagctacacagcatctgccatattctagactgttccatatctacctccttctacaatgtctataaaagagtagtgtaaaaccctaatgtaattattgagaaagaaacgattttttaccaaaagcttgaaactttctctaatcgtttcatggtatcagagcctttgtagccttaacaggtatttcaaatg

SEQ ID NO: 35319 - DNA, 3003 bp, Unknown
  misc_feature (1)..( 3003): 2750-1469P.txt file - cDNA_ID_3086230; gDNA_ID_2926277; Annot_ID_143583
tactatagaaagaacgttcataggactatcataagaagaagtggatttgttgcttttggactagcatcattcttaaggtttatgttagcttgctaatgttcttagatttggatttcgagctttcttgatatcggcttgaactttatgctttgtatttttagtgtatcttgattccattttagtttccggagaattcactgtttcttccggcttatgactttggggacttttagttgtccgctgacttagtttccttcttttgggcgtttggtttcttgtaaggttccatctcaagttctaataaaatttctagtgacaaaaaaaagaaaaaagaaagaacgtttgtggaacagaccaaacacttcaacacgttgcgccacgctattctgcgaaccttcaatcagtttatatacaattttgttattttatgaattatgatgatatatgtgacttaatgtattattttgtattaaattttaacaaattcatgtattgcagttgtaaaagagaaaagaaaaaggagtcactgttctcacatcaaagccctgcagagatatttctgtgtactctttaaaactgatgcctccatccaaagtacaatattggaatatgtttttactgcatatacacgcaatgtatttacctaaattctaattcaattgtaccttgtaattagatggttaagacataagaaatcagatacatctgcccgaattagagccttatgatgattggcggtgccacataaaaattgaacacaagatagtgatgcatatgaatgtttatattttagccgaatatgaacacaatgttcgcaacaattggttccccattctttatatcatatgcatgtgccgtgcgtgtttgtacatatatgagtagtttctgtatagttgaaaaactgaataaattaatgaaggagcaatgcatgaaagagacataagaagataaatgatagggaaaaaatatgtatatataaacctaaaaagagggccataggaatttatagaaccaaagtgcaatgcacttcggatcgtcggtcgactcatctccttcattgtctccatccattttcccattccccactacatttttatagttatctcttcaatgtttaaaataatatgtcaaaacaactctttatcaaaactaaattttcgttacttctggtagtaaggatatttctaaacgttatcacattagttattaatcaaacctgtgaaagacatgctaggttactgaagaatgatattagatacttgtgtacactctattctacaacgatcgaagctagtcccacttctgtgtctctttctttttctgtaagtgtgattgcaaaatgcgaaatattcatgtaagcacaagaaacaagatagttatacattcgcatcactttgtattaataaattgttgagccaattttgttctctatttccttgttttggtcatgttgaaattcaactctatgattgattacacattccggagaatattattttattttctttgaacaagaaaacataaaaaaaaaaaaaaactcaacgggatactaaatgatccaactcacaaatttcaacaaaattaagaaaaaaaatcggaaaacctttttaggagatggcagaagaatttaattaacaaaagggagagaggcttattgaaaaaaataaaattagtaaccttgcatttatttaatttccccttcattacttgtttaaattaataaaactatagactatgatctataatgagtttattgcaaataaggcatttgtcttagatatatattttattttaggcacttttgaaatgatctttagatttaggcacttctttcctggggaaagtcgtttttacccttacagagagatgatgttgttctttctttgttgatgaacttttacgttttacactagaaatcaaaaatacttgcgaccaacaccaacaactttggagtcattgattacagagtgatgtcagcgacgattggaaattcagacgactaacaatcggtcctcatgagatgtgaatgcgatctagatttttaacatcccacattttgagatctggaaaaaaaaaacaagaaacaaaaaagtcccacgatttagtattacgatttgcacgtttttttgttcagtgatttttgtgcaggttaaggaattcaagaagtgattgatactttgttgattgctcaattgatgttcataatcatgtctacaagtacattgatttttgttcatgttaatggtgtttgatgataatgaggatggttgtagtgttgtgttattgtgtgtatgtaagaattgcatactctatatttgacggtttgggtttacaagtctaattctagggtatagcgtttaccattgacgccgttcgttacccctcgttgtcaaagccgtgaaccaccaccaaatctttgtgctatcgtcaaagcttcatgcctaccgtcgaagctgcaagtccactatctaagccatatatctttggatgtcaaaagaaacttaaaattgaatcagagatggggatacaatttttagaagataaacacattcttttcacctcattctcaactccagttcatagtttaagggcaaaaatgtccgtaacaataaaaattgaagtattatatgcttttactgtttagagtgtctgttttgaaagaaatgttttcaaaatgcttgtttagaatataagctcgatctataatatatgcgtttttaaaaaaagactagtatatgcattatgtaattcatggttaattaatcctctggtaagtaaattaaatagcacatgcatgttcaaagaaaaatgtagacaaatatattaaagtggataaataaatagaaaaaaagggagtggtcaggtcagtctcggtgcatgctaactctatgcacgttctcatcttcgtctctttcctcacttacactaattctctctctctatattaaacctctgaaccagtgaccacatacatactcagtaagcgagtccgagtcaacaatg

SEQ ID NO: 35320 - DNA, 3003 bp, Unknown; identical to SEQ ID NO: 35319
  misc_feature (1)..( 3003): 2750-1469P.txt file - cDNA_ID_3086230; gDNA_ID_2926277; Annot_ID_205378

SEQ ID NO: 35321 - DNA, 3000 bp, Unknown
  misc_feature (1)..( 3000): 2750-1469P.txt file - cDNA_ID_3086234; gDNA_ID_2926277; Annot_ID_143581
tgctatttgtaaaattatgagccttctaaccaaacgggagtgtctatcacgctctcaacggagataaagtcaaagatatgcatcccacaagtttctctctttctcaaattcctaaaaaagacagaaaaaagctacgaaagtaacatcccaaacaaaaaaacaagggcaaaatagtcatttacaaatagtcgatttttataatttaaggttctttgtttctccacctcccaagctccaactgaaaacgactgcaaagcaacctgcggtctctacctgccttattacgctattatacttttttattatttatttaacatatttcttggttttttaaatattattattatttatggaccgacttgcgaatataataagttttccataaccaatttatatatctttttttctccttctttatagaatcaattcttcccttttttattttgtttatctctctctctctctcattctcttccaactcttcctctccttcatattctccgtctgtcttctgctaatttaaggaaacaaaaatggtggatcttgaaagaagagtgtgttgcatgtgtggtgatgtgggattcttcgacaagctctttcactgcagcaagtgccttaatcgctttcaacactcgtatgttcttacatatttctttatctctataccacatgtacttatgtgtgtaatttactcatcatcatgcatatttacagcatataatacagatttagatcgcagtagacggtgagatcttgtgccacgtgctttatatctatgtagctgatgatcattcatcatcatattaaatcaaaagcatgcatatatcatatacatatatgtgtgtatatattgtcaaactagacaagaaatgtctcaacaactaccatatatacatatacatgataaatatacatggattatcatcatcaattcatgaccatgatcataatcttgatacaggtactgtagtagctattacaaagagcaagctgatccaatcaagatctgtgattggtgtcagtgtgaagcaaaaagtcgaaccggagcaaaacacggtgttaatggtggatcgtctaagagatcgtaccggtcggaatattcttcacctcatcaccaaatcaaacagcaagagattaaccaaaccactagtagtagtattcctccagcagccgacaagggaaaaactggcgtgccttctcctagaccggccactcgtaggtacaagcttctcaaggatgttatgtgttagtaatgttttcgaaataaccaaaagttaagagagacatagagagtttattaggatctgggatgatgataataagacacatgtctgtaagatatataaaactagctagggctatgatagctgttgttatggtttgagaagcaatgtaatatacctgcggagttatttcatggattagtaagtgtttgagataaattaattaagtatatctataacaaatgaaatctctctctttttttttgggttgggtgattgattttactagataagcgatgaattttgtgtgtgagttttgttgttgctatccttcatgatcagcatatgatgacactattctctcgctattcaaaagccacacatatagttaacaatcatttaaacactttttttttagttttttaaaaacaagttaatcaatggagccactattattagatttgagttttaacatgattgagtcattcctagctagttttaagaagtgtgtttattggattaagaattcgtgcaaatacatgtaaaatgtgtgtcatgactcatacattagtacatgttttgaatgctttaggtattccatgtggccctctagtaaataagggttttgttttgatgcaaacgttactagctaaacttagtttcaaatcatcaaagcgatatgttcgtcgtcatagtcacacaaatattgagatactaacaaagtagttgttgtatacgattagtcgagtagtcatcaatagttttgttgaaaaagacatttgaccactaaaaggcttacacatatacagtatatatagtgtagtagattaaatccaccgcgatgagaaattcgcatggcgattgctttacatataacttgactcagatccaaaaacatatctaatgatgcaccctcattcatatttatagctgttcatggtctcaccgtgtgcaggacccaaatatgaaaatatcacaaattatatgaattgagtcacaggcaaagcagtgtcacgaacatcgatccacatatattgctgagattcttcaggagaaattaatacatttttagtccttcgtcttgtttcctcttttggacccaaaataaaaaataatactataacaaaaactaaaagctgccaccttctttctctgccactcaaattcgttccatgtcttttctctttttaatttccttttgtcactaaactattttcgcttaaacaaagtgataaaacatgtgaccaaaccgcatcatttctaatcctttttagaataatgcatacatcaccataatcacatgaaaacatttggttttatttgctaaaagagatcgtccttgctttaccaaaaaaaaagatgagaggtcgtcactacgtctccactccaaaacgacgacgttgttatgttcaatgtgaaatatcaaaattagggttttattagacaaaagggaatcacaaacagacgattgaaatttgagagcaaacacgtatataggaaagggtactatggtaaattagttattggtaatataggaagcccagtaaactaaatttaggttcgggatcagcccattatccccaaaagaaggaacacgtcatcaggagtgagagacgagtcagaaacctctgtctgggctagaggttcttccgtggcatcggagctgataaactcgccacgacacgaaaacggaaaatcgatccgccatgtttgattttgccaaataagagagtagagttctctagttttgaacgaagaagaagacgaaagaagaatg

SEQ ID NO: 35322 - DNA, 3000 bp, Unknown; identical to SEQ ID NO: 35321
  misc_feature (1)..( 3000): 2750-1469P.txt file - cDNA_ID_3086234; gDNA_ID_2926277; Annot_ID_205375

SEQ ID NO: 35323 - DNA, 3003 bp, Unknown
  misc_feature (1)..( 3003): 2750-1469P.txt file - cDNA_ID_3086238; gDNA_ID_2926277; Annot_ID_143580
tgactcacatgttcatcattgtttctttctttttcttttaaagttacaataagttaataacctttcactttctttattttcatttgtccatttctttaatttgcgtaaaaggtgaaaggatatatgctataacaatgggaatgcttttgcccaacatcttactttgtccactgtgtgaggcataacacgactgttatggattcccaaacacattcattggatccattaagcatattagtaataataataactggatatttcgaataaattagtaaaattctaacaaattgcaaaatcaaactttttgtatattaaagaccacatttttatcttattttatattttattaatccagaccattaatgaaacatttagaagaaggaaaaaaattagtaattatataaatataaattacataaaccaaatgtcattcgaagtttcatgggtatataactttgattgaaaacggaatttgactccggaacaggacaaatcttggtgaaaaatatttcaataaagcaattttaggcaatacatgtacattcttttggttgactttatgaatgttttttttcttgtgtgtgtagttaagtagactcatgaattacgactgaggccactgatttaaaaaaaacatataaagatagtggatgtggtagtgagctcactatcacattagttttacgtacatgtattattaaacatgccgagcaattagtgtgtacttattctatattctcatgatgttaggatttgaattgaatgtgtgtgtgtgtgagcctccatagaaattaacaggaagacataaagagtcttctttttttcattggtttagtggtggcatgagtatctacttgatagcagccaatctttttatactattcttatctaagtaattaatagatatatatccttttttataatgggttcctcagccgtgagtaatatacttagctcccacacttacctaatcttttgtattttttttttcatttttgggggaaatgattatgattattgctgatacattacaatatccatatccgtttccacacgaatacctttagactttggacaatactataaattaaaagcttacaaattacaaggagctgaattcttcttttggcgccttccattatgcacatagactagtccaagtataattgtacacataattaatttatcaaataaaacataattaaaataaaagtgtatatatatatatatatatatatatattaaaacatgcgatctttatctttggaataaagtgggggaaaagaaaaaataagcaaacagaaagaagaaaaatgaaagcaacagcagaagaagaaaacaatggagattcatattgttcactcttactaaacattttttcttacatctcaatcaaaagaaatgaaaaaaagaagaaggaaatttggagagcatgtggggaaagctgaaattgttataccaaaattagcgaaacgtacaattgaaaaccaatcggaaataatgaaagtaaaccttaactaatttcattcaaataagttaagagagttacttataatgtaatttcaaaatttaaaaaaaaattgggcaaacaatatcaaagatttaagctgtctccggctcgttcatgtagactacatgatgtagtttgtgtgtgcgtgaagcaaacataaacatggttctatcagtttctagattcatcccaacatgtttcttgttcataattaagtaatagtaaacaatccaaattaagatgatcataaagatacaaccatatcttcttgacccttaccaaataagcagttttttttttcttttctctttttaaagaattcgatgtggttccaagtttaggaaagaggacggaacttaagaagagacactaattaagtgacttaaaccaagacatggtgacgaaaagatccacaagaggcaaggcatctcgcggaatctgtaaactttttttggctgctcataacagacttttacgcttgatagtttctttagaaatatagttctcgttgaagactttaaatagctgatgattcttgaaatagagatcgaaggattgaaagcttgctcaaaattctctcattgttaataaataatcgtttaaagtcttaattagtccaaatgttgaagaaagtacagaaaacgatatatttgagtggtgctgctggaacaagtaggataaaatacgtacaagcaatacaaatctagtaagtgtacatgcatgatcttcaattcttgaggattttgtgggaaagattctgaaaactgtactggcttgttgaatattctaaatctaaaatacaatttatcagtaagtaagcaaacatgtgcgtcaaagttaatctttccaagctgaaacaacaattgctgagatattaaaaagttcaacatactactcattgactttcttaacatttacaccaaaaagataaaataaaaaactcattgacgtttttccctttgaagttagtagcccaaaaagcatcaagataatgtctgtaagcccatgggcttatatccattataattttttttgtcaaataacaaataatatatgaaacgacgtcggtaacagctgaaacgacgccggtgtttgttgatccagaacgacagcgtttttagttattcaccctctcgaatttttccgaaacctgtgttttcccatcaccaagctttctctgaatcgccgccgtgtttacatttactgttgttaaggccgagagatagatagaaaaaaacatctgtgcgattttgccgcctctccctaaaatctttggagctccttcgtagttagccggaggtgaagtacaataaaagaaagaagaaagtccaagtgtctcttctcatctcttttctccagtaggtacgttttggtttaatttacagagttgattctaagcctaagagaaggttttctatcgattagagtgtttgatttgctgtaagggttgctcaaagttttgatttttagtttactagtgatagcagataatg

SEQ ID NO: 35324 - DNA, 3003 bp, Unknown; identical to SEQ ID NO: 35323
  misc_feature (1)..( 3003): 2750-1469P.txt file - cDNA_ID_3086238; gDNA_ID_2926277; Annot_ID_205374

SEQ ID NO: 35325 - DNA, 3003 bp, Unknown
  misc_feature (1)..( 3003): 2750-1469P.txt file - cDNA_ID_3086256; gDNA_ID_2926277; Annot_ID_143574
tattgtggactatggaaatttttaatgattctctaagcaaaattctgttatgttgttcttataaccatgctgatcattttgattgaagcatttgagatgttttatgcttatatatgtcttgtctcgtctgctttaggtggctattgaatttggattgtccgagataccgcacccaatctttattaagagtgaagttgctcccaaagatgggaaatttgatttcaagatttcagatcttgaagctatgtttcctgaaggaacagtggattctaatgtggatatggtttataaagaggtgctctatatgacttgttttgtcgtgtcttcgttcttaatgttttgttttgtgtgactatatctaaactttatttcgataattctcgattccttgtttgtactgtttaggtgccagaatggggagaatctgcacaagcctttgaggatcgatattataagacagtgaagattcttgcggagaagtatccttctgagaacttgctcttagtcactcattgtaagcaaaacagttatggcttttttagtttttaaccaaaattgatgttttcctaatcttgtagttcgtttttttttttgggatgggaaattgcagggggagcagtaagtgttgcattttacaactacttcaaagacgcaactaagtacgtggtagattattgtggtagtgttgaaatgagaaggcagattttgaatggtgatgggtttggtaaatttgaggtagttactagtcatggagtatcttataagtacaccaaaatcccagtccatgatcatgtagttgtaagccgccaatctcccctttaaccggtttatatgtgaatatctggtttaacgggttgcttcaataaaaaaaaatatataagaataatggttcagttattttccttttcttccacaaattttacaaaaatatgtaaagctaaagggttgtaatttttctaacacaaaattgttgttcaacaagaatttgtcagaacgtatttaaattaccattgctataagcaagagaacagtcttagcaaactgctgaaacgacaaaaaaaattgttctttagtattcaaaaaaaaactttgaactatacgtagtcttcctcatgtctgatgcctattgacgagtttattacaatagtaaaaaacaaatgaaaatacaataaaaagtcaatggtcttcttaattgcatgtaatatactatacttgcatcacgccatgaagcagcaagaaacagagcaaatgaagtctaaatcaaacatggatggccaccaacatgttttcatgatgcgccatggcgatcgcattgataagtttgagccacaatgggtctcgactgctgctcggccttgggatccaccgcttattcaaggcggcatgtttcgagcgtttcgaaccggtcagatgatccgatctcagatccattttcccattcaccgtgtctttgtctcccctttcctccgctgcatccaaaccgcttccgaagttatcgccgccctttctgaccccgacgcaaattcgtctgattccttcgacaaacctaagctcaaggtcaaatgaccatctacgtatatatgtgtttatgttaaactatggaagattttcagattttttcatagatcttaagaacagttaatcgtcgtgcatgttgtctctatgtcattgaaagtcctatgcatttgtttttcgttacaacgtgtttgaatgttctagttacattatgctaagagacttgttgtttgtagtgttatagtgtacgtactgtataagtcaatttaagaagcttgatcgtgtgcttcaggtttctattgaatttggcttgagcgagatgctgaactcaatcgcttttaagcctgaagttgctccaaaagatggcaaatttgatttcaagatttcagaacttgaagctatgtttcctgatggaatggtggatcataatgtagacccggtttacaaagaggttggtctctaagaaatctttgcgtgtattctttagtttgaacacaagtctataagtacaagaatttgacatgttctgtatatatacatacagatgccacaatgggaagagactttggaaagttgcaacaatcgatatgttaatttggtcaagactcttgctgataagtatccttgtgagaatctgttgttagtcactcacagtaagtgactctcacattctgtttttttttttttttcttgttttatagtgtttttgagtatcatagtctttttaaaaaactcgtccatggaaatgtaggagaaggagtaagctttacatatgccacattctataaagaggcaacgcacaggttagatttttgtgcttgtgttgaactacaaagacagatctcctctagtgaagttggagattttgaagtcgttacaagtcatggtcaagatggtatcatgtaccctccctctaactccggttaattttgtcattgtcttcgtatgatccctacgaaccggataaaaccggcgttagccgtcgcttgactgattcagtctatattgaaatctctgattttttttattttggttcagaatttgccttcacttagtaattttaaattcaaataaaagatattatcatcaccattatttatctattctcaattgtttcaaatttttgattgcggtttggttttgttgtcgattaacctctgattttctaaatttatttacatcaacatacttttaaatacataaactggttagctaagtctcaatcaattaagcaatgtggttattagtcatggagtatctttcaaattcaaggaccacaaaaatccccaatccatgatcttgtagtttccggtttagccggttttgtccattacgatgatgttaaaaaaaagttgtttttataaaacatagaaaagagaaggaacagaaattaaaaaaaataaataaaaaagcgccatgtatacaacaatcacttccaacgtagtctcaaaggtcacagcagcagcagcaacaatcagagcaacaatg

SEQ ID NO: 35326 - DNA, 3003 bp, Unknown; identical to SEQ ID NO: 35325
  misc_feature (1)..( 3003): 2750-1469P.txt file - cDNA_ID_3086256; gDNA_ID_2926277; Annot_ID_205368

SEQ ID NO: 35327 - DNA, 3000 bp, Unknown
  misc_feature (1)..( 3000): 2750-1469P.txt file - cDNA_ID_3086274; gDNA_ID_2926277; Annot_ID_143569
aaccaaaaagccctagttgatcctcatcgtttttttcatgtcatataacgtactagcgtgccacggccggtgtcacactgcctcatcgctacgaactataagtagccaaattcaacaaatatgaaagaaagaaaaaaagtaaaaaaaaaactcaacaaatatgaaaactttgaatttctttcaacaaaaaaaaaaagtgttgaagttttgtacttctatcaaaaaaaggtaacctaatatgatagtattttgaaatttctctatcactttctacttgatatataaaatggtaagatgagctaaagaaatgtttgagcaacaaaagaaaaaaaatgaaaaacattaaagaaattatactttttctttgttttcaaaattataattatacaaagcaggacactagtgacaggtccttttctcgtctcttctagtataaaactaagagaggttattagtttattacgtaatggaagtcacatgcttaaataacaacgatttctcgagatctggtccatctgcaccgttcaatttcagatcaatctgcgaatttaaacacatcataaactattagctaggtttatgacctgacttacttttatccgtgcttttgtttatgattacttcactaggttcttttagcatttgtcttttttggtttattggctcattgtaaacacaatttaagcccgatagtccgataccacaatatatctattcggtcgataaaaataatttattttattttgtataacaatacaaattgtcaacaaaaaatctactacaatttttacattccataaaatacaaacaaaacttgaatttccatagacttcagagcttgaaagtctctcgtataacaaagaggtaaaacaaataaactttggctatgttttttttttttttgcgttgaataagtgtgttaataataaaaggaaaacttgatcaaatatattttgtctttctattttcacaaatgcttttttttttggtgttttctaaaaatctaagtaacagtgttattaatggagaaaataaatgagaagaagggttatgtttagattgtttcctgtgtaaatgtaaaatcaaacatataaattaaacacgagcaggaaattaaataaatagagctgacctgtcttgtctgtgtaactgctgaaagttttgaagagactgaaggcagaagtaatgatggcaatatcaataacatatatggagtcatcattaattaaatagtaatttaattactctcttattagtcataaaaatcagccaacaccacttgtcgtgcgtttttatttatgtttgactgacagatgaaattaatgagaaagttaattatcttttggtatcacattgggaaaaaggaacaataaatgaaggagggaggcatggaatgggaatgcatgttggattcgcagacaactcaaaatccatgcagtgtttagggcttttaggttctctgtaacctatctatacgacaccgtatctctgccccctcctgattccatacccattttgagcccaccgccttattctccccccacctcacactcgcccattcgcgcgtatctattctttcacgcttacctattattccaacatcctcataatcacattttaacaataacccattgaagaataataattcatttcattctttaagaaagtttggtttgtaactaggttatataattttacccaataaaggttatagaatggtttaaaactactaagaaaaacataatttagctgatcttttctcaaaaaaaaaaaaatagttgtcataatcgaatgccaatgatgaaacatattcaccataaagctaacttaaagaaccttttctaaccaacaagttaacaagtgatggtgaatttggagagtgggtgagatttgttttaaggatataattccatgttaaaatgggaagtacaattatatggtttgatatacagtactacaaattatgctttaagagtactaatattaaagcgaagctgcattatttttgagatacgtaggaccccaatggtcagagggagaagtaaagttatgatgataacaataaggcatgatatgatgatgatgttcataatgatactgatgatgatgatgatttattaattattatgatatgatatcattatttgatcaccctcacgagcgcgtggattttaccgtctggtcgctgcttttttaatcctctcaatcagtcaacggtcaacgagcgagaaagccgctttcgtaatgaaagccacattacaaaaagccaattatgcttgtttgtgtgtttttgaaaaagagcttcttttacattttctttactttgaaactcgggtacacaaaatctctactcaattatattgtcaactactaatctttagtatcttttaaagtagaaactcagcttttatctatatttagtaaaacctcacatgaatggatttgggtgaatgagtttatcatatgtataagaatctaatataatatttgaaaaacgctcataggttattttgtaattaagaatagtgacaacttacaatataccaaacggaaaatgatagagaaagaacaagagacttggacttttttttttcttataataaatcaattaaccatggttgaaaagggatgtgaggtgaaagtaataactcctggttttaattttaaccatggttaagttaaaataaagagagaaggaagcaggtttttatgcagtatatatcatcattgaggtaacagaggtctctctgacacaagtcatcattgaaaccctaagcctccccacaaccccatatctctttgtctgaaaaaactcttttgcatatataaataaatataagccatatcttttgaaactgtactgctgcacaagtgtagaggcagtggcacaacatctttaagaaagagagagagaaagagtcatttattcatttcctcgcttaaaaatcttgagcacccagacagaattcttctttcttctttctggggttgagaaaaatg

SEQ ID NO: 35328 - DNA, 3000 bp, Unknown; identical to SEQ ID NO: 35327
  misc_feature (1)..( 3000): 2750-1469P.txt file - cDNA_ID_3086274; gDNA_ID_2926277; Annot_ID_205363

SEQ ID NO: 35329 - DNA, 3000 bp, Unknown
  misc_feature (1)..( 3000): 2750-1469P.txt file - cDNA_ID_3086278; gDNA_ID_2926277; Annot_ID_205362
atgtctaagattataggtttctttgttttagatccgatctttttattacactttatcctataatagataaaattttcttgatatgtttgtgatttttaatcatttggcgtgattaacgtaacgtgcagagagaaactcggacatgagatcgtttctccggggaatagacgtgaacagagctccatcgacggtggtggttgacgtggaggatgaaggcgccggagtttcgtctccgaacagcaccgtctcaagcgtgatgagcgggaagaagagcgagcgagagctaatggctgcggcaggtgcagttggaggaggtagagtagaagataatgagattgagagagcttcttgctcgctcggcggtggtagcgacgatgaagacggtagcgggaacggagatgacagttcgaggaagaaactccgattgtctaaagaacaagctttggttcttgaagaaacttttaaagaacatagtacactcaatccggtcagtggcatttccgtagttttcttcaataggttgactttttatatgtttttcattgactttttttgttgttgttggatgcagaagcaaaagatggctttggctaagcaattgaatctgaggacgagacaagttgaagtgtggttccaaaaccgaagggcaaggtagaaatttttattctattttaaggggttactttcgtaaattttatatagtccaacaaataaaacattagtagttattgctatgatggtgatatgtgtaatggtccattttatgacccataagattatcctaaaggattttaatgggtctctcatgtcttaaattaggaggtttggtttaagctattcagttttcccggtttaagaattaaaaccgccaatgttgtttttgagtcaaattttggttaaagtgttttcagttttccggttcaagaacaataaccgccagtttcgaatacaagaaacaaatgtacttcgggttttctctttcccggatagttaaaccggatatcggattttaatgttttggactgtttgtgtgtgtgtttataggacgaagctgaagcaaacggaagtagactgtgaatatcttaagagatgttgcgagaatctaacggatgagaatcggagattgcaaaaggaagtgagtgagcttagggctttaaagctttctccacacttatacatgcacatgaaacctcccactactctcacaatgtgtccttcttgcgagcgagtcgctgttacgtcatcttcgtcatcggtggctcctcctgtgatgaattcatcgtctccgatgggtccgatgagtccgtgggctgccatgcctctacggcaacgacctgctgctggttctcattagagtttaattagtctaaagataataggtttggtgatttgtttttattatattgttgaacggacttggaagttcttttcaagagttggtcccatgctcttctttcctttgttttattcagtttctatttatagctgaattctggataatggaaaatctactaatattattgtccaattattagtttggggaaagataagaggttctatcattctttattgttatatattttgattacatcatatctgtttttcaccaaatccagagttctattttaaggccatcgaatcataataacgaatggtgcataaactaattttcaagagcgtcatttattaaagttgtaattgtttaattggggttttctttcttttgcttggaacttaagaaagggatttgtaaagatgattattaattacagtagaagattagttagaagtataaagtaaaaagaagcaatgaaaggtgttatgattgatggagcaagcgtgtgttgtttgcatatgtaataagtaaatgttagccaatacgaatatcgagacatgtacgtgacataacatagcatttggtatgtatatggagatatttgggtccacatagacgaagtcagaccattagaatctcttgcagaacactgaagatacgatatttttttcttcccttatgtcaaaagatctcaaccgacagagaaagagaaaatgagaggtacgaccaagatatctctcggtgtttcaatttttggcagaggcaaaaatagagaaaattatacagaaactaataaatgggcctttgaaggcatgccacttcccacatgtggctatcgagtataggctttaggtggacagttaaatcaaaatgagcgttaaccaatttgtatataagccctggttggttctatacgctccataccaatcaaacttaatcacaaccaaattagtttctaccaaatcgaactggattttttttaatatattattttattaaatattaatactacaaggtaaaattaatactatataaagtgtggtgaaaccatgaaagcgtcataccaattaccaaccgttacttcaaatttttggaaaaaatgaaatgttgatgcaatgattcttatgttgaagcgattacaaaatagcactgtctcaaacttgtgaagtaggattagtgcatcatgtggctagtggtcccatagctaaaaaatctctgaagcttgcaagttggagattcgatttcaaatagatcgaaaattttagagatgttctaaccaaattttattaacacaattttttattcaaaacccaggaggcaggaacaatggacagcctaaacgtctagaactgatacgacggcgtttaggaaggggtcaaacgatacgacgtcgtataattctggattgaataatgccaaggtcaattccgtaaatctcggcaacggtctttgtgagcggcttcgtctttttgctttatggtggtggtctgctgctgcagatagtttccattctcactctttctctctcaatggttagatctgtcttttacgtcgcttcgaagtcttctttcttcccttcacatacccaacgaatcctctcaaatccctaattatccaatttcacactcgagatctcgaattggagtctctcatcatcaccaatg

SEQ ID NO: 35330 - DNA, 3003 bp, Unknown; identical to SEQ ID NO: 28626
  misc_feature (1)..( 3003): 2750-1469P.txt file - cDNA_ID_3086282; gDNA_ID_2926277; Annot_ID_205358

SEQ ID NO: 35331 - DNA, 312 bp, Unknown
  misc_feature (1)..( 312): 2750-1469P.txt file - cDNA_ID_3086286; gDNA_ID_2926277; Annot_ID_205357
aagctttgaagggctaacgggtgatgctttggtgaaggttttttctggtccaggtttgtgcttattttgcattgcttctctttgattcacgtctgcataaacatcaaataattcatttatgtttgagttgattatgtagaaaaaattattaggggagatgctttatgataagaaaaaaaagtggtcttgtggtatcttaaggcagaaggaaaatatttagtgtcttaatgagtaatagatttatctgtctatccagattttataactgagttttagtaacttccggctcaagcaaaaaggaagttcgatatg

SEQ ID NO: 35332 - DNA, 3000 bp, Unknown; identical to SEQ ID NO: 28576
  misc_feature (1)..( 3000): 2750-1469P.txt file - cDNA_ID_3086294; gDNA_ID_2926278; Annot_ID_205402

SEQ ID NO: 35333 - DNA, 1646 bp, Unknown
  misc_feature (1)..( 1646): 2750-1469P.txt file - cDNA_ID_3086299; gDNA_ID_2926279; Annot_ID_205413
ataaagtttaaatttatcaagcataatataatatgaagtcagcttgccgccaccagttgatgcatggcttctaattattggagcattgtacgtgatataggtgttaatggagatggtttgtagttctttatcaatacggatctttatcttaccaagtcatttctaagtgttgcatctatgtataaactaatattggagacttcaacaaaaagtagtatatatatacatggtttgcacattgtgctatatatatgtttagatatataactcaaaaacacctttattgcttaacagtctttggtcggaggggggtttggtgaggaagacaatgaaaattattattattaagagaaaagggaatctttctggtttcaacacaaactaatctcccaaaaaaaataaaaaataaagctagcaatatttagaagacctaaaagagttaattagtgactttaatgtgaaactttttcataaaaaatgaatgcagcgatttgttggaggccaggattgcaaattgtttttaaacttcgaaagcaacaaagataaaacatcttagaaccctaaagtaaatccttgacgttagagaaacaagcttacttaaaatctaacttggagatgaaaataaagatttactgatttatgtaggaatacgaaaccctaatttcttgatttaaatcaaaatggaagataaatgtgcatcaaaactctgttttgtgtgtaagattcttcttacaggtttcatcttccatgggatataaaagaatttgtgaacgtcaatgtagcaaatgaattcacatcaagtagtatttccattgatgtctcaggacgtcctttcaatatctcatctcttactacatcaagaagattttctggaagctgcacaacaccattcaatatctgcataaccacactcatatccggtcttattgactcagattgatgtgaacacaacacacctagcttcaaaaccagctcaatctctcccctgttttgttcttgacgtatacattcctctgccgcatcgaaaatgttcccatttacccaaagctctaagatccaatccactagaacttcttcattttccgcttcacgtcgctcaatcaaccttctaccacaaacaacttcaagcataaccaacccaaaggcgaaaacatctgtgcttgtagttgctcttgttgaaagttaaacttgattttgaatcaagtttaattattggatcaattatccaataattaattatggccaaatccaagttctagagttttctctagaaatatcatcatttccacctccttaaaggattctagaaattttctagaatcatcttccacctccttaaacataaaaatctagatactctaatagaataatctagataatttgaataatgtaatctagatcttatgtaagaactctctagacttaagattaaaatattttagatattttgtagtttggaggctataaatacctcctccccctctcaaatgttgtaatgttgtgaagttgtattcaagtttaaagcaaagtaataaaagttctatttcctaaaaaactctctcaaaacacttaaacactttctccattacctctaaaagaattttactctaacaaagtggtatcagagcttgaagatcctaaagatg

SEQ ID NO: 35334 - DNA, 100 bp, Unknown
  misc_feature (1)..( 100): 2750-1469P.txt file - cDNA_ID_3086310; gDNA_ID_2926279; Annot_ID_205410
gaattcttttatactcttacttaactctcaatgagatgataaaaatatctcatatgatcaatttcttcccataagcaaaaacaaaaaaaatcctaacatg

SEQ ID NO: 35335 - DNA, 1099 bp, Unknown; identical to SEQ ID NO: 28577
  misc_feature (1)..( 1099): 2750-1469P.txt file - cDNA_ID_3086318; gDNA_ID_2926280; Annot_ID_205418

SEQ ID NO: 35336 - DNA, 3003 bp, Unknown
  misc_feature (1)..( 3003): 2750-1469P.txt file - cDNA_ID_3086322; gDNA_ID_2926139; Annot_ID_197359
agctcttcatactatctaaagcagtaaatcccaattcatgctagtatattctcatactattcctctaagatcgtgtatagatactactagaatcagatatgcatgatcttatatctcttgtaaagaatcttacttgtatcattttcttaattcgtgaaaaagagatttctctttctctctacatggaagatagcttattcaaacatatgaaaacataaaataatcaatttacgcgtctttctgatttttgtcatattaggttaaccgtggcgttggctataataatagcaactgcaaatatctttcaatctttttggaaattgaattccactttttataagacagtactcacacacacaacactagtccacattccatattgtacaacgttgtaataaattccgtcgaagccattcacgtgctacgcgtctccggagcgtcgcttgggatagtaatcatctgaacaaaatactttagtatcaccatcatggatggacccatagtatcactaatcagttgcaaagtaaatttagatttctattttaagagtatctctttaaatggtatcaatttatgacgatacccaaaaaaatagaacaattcaatagagattttctatttaatagtacttaataattatggattaacttccaaagcagtgccaactatacaataataaccaaagaccattttttcaaaataacattgttaaattaatagatcgatttatggaaaattagcaaatttcgataaaataaatatacttaaataatcaatgtaggtggaacaatatatagactagatcataacccgtgctatacagcacgggcattaatattttatataaattaaattatatattttatttgaattacataagaaatagtatagtataaaagtgatgtcataatattttttaatgtttttactatttggatataatgctgcattggattgactttgtttaaaaatgttatttttataataaatacaacatatgtagtttttaagtaaatgtaaaatttgtatacgagttgttttggtaagaaacatgtttcctttgtattagaagatttaatttttggcctaacttagaattattctttgtataatattttggttatatttgtggatctaattggatcctatattagattatctttgatagggctcacgaaaaaacggacccgataaccaatccaatatccgaaccaaaaaaccgggttagagcgggttagaattttaggaaatttccttattgggtagagttttattaaacccgtggatatccgattggtccagaaattacccgttacccaaaaagggtattcaaaaacccaaacattaatttaatatctaaaatattaattatatttaatcttaatagattattatctaagattataattataaatctaaatatgtcaattaattttgtacctaaatatccaaaacaactaaactattcaaaaattatttgttatgtttgtcaaaatttagtaaaatatattcaaatataattaaatatattaaaacttaacaaattttaaagtttttttttttggagacccgctatctacatagaaaatacccgtttctatttttttgagtatttttaggacctgaaactttttatccaaactgacccaaatccaaatggacccgacccgaaccagaaccaaatatttcgaattattctattgggtagtaaatcatatacccattaatcccaaacccgaacaggttctacccgacgttactcatatgtccagctctattctctgatttaattatctaaaaactccccaaaaatcatatgttttgctgactactttttattcgaaaaattttacattctcttctaccaaaattatttcgtaagacatcccaaaacccttggaataatgatttcatgaatgaagaatcctaatttgaatataccaagaggttttgaaaggttttaagtttttgataggtgtgtatgtgagaaggtacagacatcgtgctgataatctgcttatttataattttaacctccagtatatcgcaggtaggcttatattttagtgaaactaaaaacttttattgtaaagatgattataaatatatgatattattttatttgattttaaatgtatagtaaactgcgagttgtatatgttttgttgatattatttatattgtttagtgtttaaaattatacacttgtattttgattgttaattttagagtttcacttgtagtataccatcttgtattaatatcgatctaaacccgtcaattatagaattttccagcttgtattaaaaattaaatcacatcatacacataaaaaaatctaatatattattaattattgtagtatataagattataaattttcaaaataatatatatgaaattgaatataaatattcaaattttgacccagtactcagtagaaagttttcttaaatctatttttgacccgttataatattttttcatgtattgaatagtttatattcgtttttaaaaatttaaattatggcatattcgaaaaaactctaattatttttttataacgatgatattatttttctcaaaaatagaatcatataaagatgagaggtgaactataataattaataaaaattaatatgataatttagatattaaatctaatttgttgattttaattggttacttttttggaaattaataatgtattttgttttttaattaagtctaattaattaaattagtatttgactttttagaattaatttactctttaaaattttatttctaatggcatacctatgtaattacttacaaaaaataaagttatatttaaaatgtacttcccaaataatataataggataaacctcactcactcacatttgtataaataaaagcattcatcttacttacacatgcaaccaagaatataacaaaagggaacaaatcacatattttgtgaaatcccaaagaaagtttttgctttcaccggccagtcatg

SEQ ID NO: 35337 - DNA, 3003 bp, Unknown; identical to SEQ ID NO: 35336
  misc_feature (1)..( 3003): 2750-1469P.txt file - cDNA_ID_3086322; gDNA_ID_2926139; Annot_ID_138961

SEQ ID NO: 35338 - DNA, 3003 bp, Unknown; identical to SEQ ID NO: 35336
  misc_feature (1)..( 3003): 2750-1469P.txt file - cDNA_ID_3086322; gDNA_ID_2926280; Annot_ID_143596

SEQ ID NO: 35339 - DNA, 3003 bp, Unknown; identical to SEQ ID NO: 35336
  misc_feature (1)..( 3003): 2750-1469P.txt file - cDNA_ID_3086322; gDNA_ID_2926280; Annot_ID_205417

SEQ ID NO: 35340 - DNA, 3000 bp, Unknown; identical to SEQ ID NO: 28505
  misc_feature (1)..( 3000): 2750-1469P.txt file - cDNA_ID_3086326; gDNA_ID_2926139; Annot_ID_197358

SEQ ID NO: 35341 - DNA, 3000 bp, Unknown; identical to SEQ ID NO: 28505
  misc_feature (1)..( 3000): 2750-1469P.txt file - cDNA_ID_3086326; gDNA_ID_2926280; Annot_ID_205416

SEQ ID NO: 35342 - DNA, 3000 bp, Unknown
  misc_feature (1)..( 3000): 2750-1469P.txt file - cDNA_ID_3086330; gDNA_ID_2926139; Annot_ID_138959
tcatgtttttcaaacaaacttgacgtaaaaggttcaattctttgtttgcaacgacgaactcatgatcacttctcgaccgaatctacaacgaaacccatatgtttcttctacccaaaaaaaagtaaaaagagatcttcgagtcatgttgacctttacgacttcaactcatatttgtcctttcaaaatttgtcatggccatattgttgtctcatggagaaacacttttgagccaacagtcggaaaacaaccatcacttagcatttttttatttttaatactactatttttttttttgtaattagtcgagtgtaccaatcccaaatttaatgggtatctttcataaccaaaaagaaaaaagcacaaaaacaaaatactactactatactataatggtgaaacacacattacattagcattaaccgctattccttaaaagatatatgagcagactacaaggaagtacatttaaatcagtgtgctaagttttctcaattatcaatctaataattgtacttacataaatttaccaaatcatctcaccatttagggcatacaatttttgctcaataatggagcttgaaaagactaattatagaatgtctttttggttgacacaagctcgcttcttcatgtcgtttactttaaaaattgtagattctttcacaacttataagattctatagcctatttgattatcctttaggatgatgagtataatatctcaaactataaaataaaaatgttcacatcaataattgaaaaaaaatgcatgtatgaattcacgaaaatatggttacggttgtgtgttgctgctagacaaaagtctttcatatattcagttatatttcttaaaactaatcaaaattgttttatgcaattttggcgagtagagagaaaaagcgcgtgggataaataaagaaaggcgttataaaaaaagagaaaaagtcaaccgagtagttctggtaagagagtctcgtgcattcgtaaggtttccaagagtccacatatctatttcatcatcctcttaacgtttttctcacttacttttttccccactcttaattgattccgttgataaaatttgttcgttatatagaaataatcagaatataattagggttaattttggagtaaagaccattcaatcaatggtttggcttgattcttgtttgaaattctatgtttaaaaagggtaatacttacaaacttgactttattagtattttaaaaaatgacaaaacttaaaatggatttgaaatctagcatatttaactttaatacagttttggtttaagtttcactctcttttctatcaaaaatataattttaaaatttgaaagatgttaaaatagacaaatgtcattagtttgttcagatttagttatgtttttaatatacagacaattatattaaaataataataaaaaagtcagatcagttataaaagaaagtcagttcagttttaagacttaagtttgagtcttttggatttgaatttaatagattcacttttattaaaaattgttgaaacactttttaaaaactaaaacatttgtcaaaaaatgcatttaaccaaaaaaatgaaaatgaaaggtagtaagtaataaaagaagaaaacaaaatctaaaaaagtgtctttaaaatctcaaaattaaaatatacaaaaaagtacaagaaaataaaagaaaagggggaaaaagagagtcaatatcaacatgcaagtgtgaatattagactcttcttctctcatcagttaccccaaaactagggtttacccattttcatcatcttcttcttccccacatcactctctgaaagacaataagagagagagacacacacaccaaaaaaaaaaccccattgatttttaagagagagagagagactgagaacgaagagcaaatgagagagaagttgaatcaaatttccgctttcgttctctttctctctcctccatttcagtaataaacactccttcctctttaatttttctgggtttcttcttcttccctcttttgttgtttctgtgtgattcagttctcgatccatcttttcgtgaaaagtatcaatcttttaattctctagttgtttgtcaaatctggttagtttcttctcttgtatttatttgatgaacttcggtagtctcttcgataacacacccggtggtggctctaccggagcaagacttctctccggtttaagttatggcaaccacaccgccgcaactaacgtcttacccggtggtgctatggctcaagcggcagcggctgctagtctcttctctcctcctctaacgaaatctgtttacgcttcttctggcctctctctagccctcgtacgacgtcgtcttcctctactactaatacttatctttttatacttaaacctaatttgtgttttggataggagcaaccggagagaggaaccaaccgtggagaagcatcgatgaggaacaataataacgtcggaggaggaggcgatactttcgatgggagtgtgaacagaagaagccgagaagaagaacatgagagtagatctggtagtgataacgttgaaggtatctccggtgaagatcaagacgctgctgataagcctcctcggaagaaacgttatcaccgacacactcctcaacaaatccaagaactcgaatcgtaattatacctttcgatccaatatccatattgttattaccatcatctcttttattcgatctaatgaatctgagtttttgctttcagtatgttcaaagagtgtccgcatccagacgagaaacaaagattagaactaagtaagagactttgcttagagacaagacaagtcaagttctggttccagaatcgtcgcactcagatgaaggtatgtggagattaaatcacatctttaatcccaaaaaatgaattcttttgtaataaaatcatattgtggcgcagactcaattagagaggcatgagaacgcgttattgagacaagagaacgataagttaagagctgagaacaatg

SEQ ID NO: 35343 - DNA, 53 bp, Unknown; identical to SEQ ID NO: 9526
  misc_feature (1)..( 53): 2750-1469P.txt file - cDNA_ID_3086330; gDNA_ID_1972140; Annot_ID_179276

SEQ ID NO: 35344 - DNA, 3000 bp, Unknown
  misc_feature (1)..( 3000): 2750-1469P.txt file - cDNA_ID_3086330; gDNA_ID_2926280; Annot_ID_205415
tattgttaattcttggtcacacgtggttgtgtcagtgatttatgtgaggggtctaccttttagaagcaacttgtgacctacatgagtaaagtatgcatgtgactctgcgtatagttttgtactagagaccatgtattagtaggtacacgtcctggatacgtatttatgtattgaaaaactcccaacttactgacaattcctatgattcaatgttttagtaaaaaaacaaggttgtggtcttatggattttgggtgagaaacggacactatagaagacttctctttttcagtacttgttttcaggtgggggaagacatattttggtaaaaaacctgagagagaaagaagtctccaattggattggaaaaaacgttgaggacattaatgcaacaaaggtttggtcgttcgtcctcttttgaaccatatttgttgtctcaataaatgttcttatgctttataacgtccaagacaatctgatcgttttattcatctgtttgaacataacatcatcgacacactagaggattcaattagatgtgactcttgatggaattgtctttgtagaaaagtctagtctttgctatgtttctaacggtctttggtttgtttctcaatgttcaataatgttatgtaatggtaaatatttagcagcggtatagttcattctcttgatatcggtttcaaatttttatttgaggttgaaaccacatgaacatggtcgatagtctggtcttttttgatgttaacattcatataacaattagtttagattgagctgtggtagaattttgagccagtgctgctaattggagtttgtggtaatctagtaattaccaaatttaaccaaacaatgaaaatgacgttgtcctttatatcatcaatcaggggaatgggaatgaatattcctctttacttttcaacctttttttattcaccaaactaatttcttcatgactctgtcataccaataagagaagccatacgacattttttttattttgtggcagactcttatgtgtaaattattttgtgaccaactcttgctggtcggttattctgtggaaccgacattcccatgtgctccaaaccgaaccaaaccaatatgttccactacttcctttcttcttcttatgaaattgttttccatgattttgttattattcagttctttttaagtgcgatgatccataaattcggttcaattaattctcactttataaacactctaaatatcatcaacactatataacctcagtttttgtatgtcgttttaattctgtcatcagctttgatatgtttaaccaacatgattttgtatataacaatagtttagcgatttggttgttctccttaaatagagatccaccaagtcatatgtgatgtggacaccgttttgaccggaaaagtcgacgaattatcatgtttttcaaacaaacttgacgtaaaaggttcaattctttgtttgcaacgacgaactcatgatcacttctcgaccgaatctacaacgaaacccatatgtttcttctacccaaaaaaaagtaaaaagagatcttcgagtcatgttgacctttacgacttcaactcatatttgtcctttcaaaatttgtcatggccatattgttgtctcatggagaaacacttttgagccaacagtcggaaaacaaccatcacttagcatttttttatttttaatactactatttttttttttgtaattagtcgagtgtaccaatcccaaatttaatgggtatctttcataaccaaaaagaaaaaagcacaaaaacaaaatactactactatactataatggtgaaacacacattacattagcattaaccgctattccttaaaagatatatgagcagactacaaggaagtacatttaaatcagtgtgctaagttttctcaattatcaatctaataattgtacttacataaatttaccaaatcatctcaccatttagggcatacaatttttgctcaataatggagcttgaaaagactaattatagaatgtctttttggttgacacaagctcgcttcttcatgtcgtttactttaaaaattgtagattctttcacaacttataagattctatagcctatttgattatcctttaggatgatgagtataatatctcaaactataaaataaaaatgttcacatcaataattgaaaaaaaatgcatgtatgaattcacgaaaatatggttacggttgtgtgttgctgctagacaaaagtctttcatatattcagttatatttcttaaaactaatcaaaattgttttatgcaattttggcgagtagagagaaaaagcgcgtgggataaataaagaaaggcgttataaaaaaagagaaaaagtcaaccgagtagttctggtaagagagtctcgtgcattcgtaaggtttccaagagtccacatatctatttcatcatcctcttaacgtttttctcacttacttttttccccactcttaattgattccgttgataaaatttgttcgttatatagaaataatcagaatataattagggttaattttggagtaaagaccattcaatcaatggtttggcttgattcttgtttgaaattctatgtttaaaaagggtaatacttacaaacttgactttattagtattttaaaaaatgacaaaacttaaaatggatttgaaatctagcatatttaactttaatacagttttggtttaagtttcactctcttttctatcaaaaatataattttaaaatttgaaagatgttaaaatagacaaatgtcattagtttgttcagatttagttatgtttttaatatacagacaattatattaaaataataataaaaaagtcagatcagttataaaagaaagtcagttcagttttaagacttaagtttgagtcttttggatttgaatttaatagattcacttttattaaaaattgttgaaacactttttaaaaactaaaacatttgtcaaaaaatgcatttaaccaaaaaaatg

SEQ ID NO: 35345 - DNA, 2472 bp, Unknown; identical to SEQ ID NO: 28578
  misc_feature (1)..( 2472): 2750-1469P.txt file - cDNA_ID_3086352; gDNA_ID_2926285; Annot_ID_205421

SEQ ID NO: 35346 - DNA, 59 bp, Unknown; identical to SEQ ID NO: 28579
  misc_feature (1)..( 59): 2750-1469P.txt file - cDNA_ID_3086371; gDNA_ID_2926286; Annot_ID_205433

SEQ ID NO: 35347 - DNA, 3003 bp, Unknown
  misc_feature (1)..( 3003): 2750-1469P.txt file - cDNA_ID_3086406; gDNA_ID_2926287; Annot_ID_205465
gatcatgtccacaataaatgtatgtgatacttcttttgataagaaagatatattttataagttggcttgagattgcaacaaaaaagagaataagatgcatgctccatgtaatgttttcataaggtaaataacaaacttcactacttttcaaatatattaaatgagattcaaacaaataaagaaacataaatgtccatcgtcatgtgttagttctccctattcaatcaccaaaattaagaccccattatgagtcatatgacacatgcatcgtgaaccatcttctttactttttctctacttattatatttttctgtcggttatttttatttttattttatatataatgaataaaaaattatgatttagttatcctcagaacatattcccatattctcttttgatgtataaacaatgcttctaaaattggacctaacatgcggcacaagtaaaaaatatcttagttggcaagaagaaaatattgtcgtacccttcaagaaataattttctcctaaagtttctattaaacatgatcttctgatgccccctcaaaaactgaatttgattcaaagtattaaattcaattcaagtggttaattattacgcatacaaacagtataagcagaagcagaagaaatacaacttttgtatgcatgcatatagatagtttaagttatagctgtctaaaactatttgaaggtcaatttatgaaacttacatttgatgttttaacctgttttattttttattttttattgaatgtgtaattgattaatatgagtaaaattatgtatgagagtgttttgctttgtctaaaaaaaacatcagtactatgaaaccaaaaaagaaagaaaaaactgatacaagacttagtaataaactggaaaatagtgtacaagcctctttagctccttcccgccctcgaagatgagaccgagaaccagcgttgcataaggtaccgtaaccttggtttaatagtatagttcagagatgttatcatgtatcgaatcatctttcctatgcttctggtaagttcagaggctgatgaaaaaccgatgtggtggatgcgagtgttcctttaccacacaagataaatagttgtttgaaaatagagctccaggaggatatcttctagataattccctgagcaggcgataattaagactggtaagaatcagctcccaatcggatctagaatttgtttgaacctgtttttcttttttcttctaatagttccaatttatgtatatgtttataattttttcatagtaattttctgaaagagagattgagataatatttgaatacatcccttgcacatgtaaaacgatggtctttataatatttataaattccctataagatagatgatagatccgatgatttggtttgttattacaaattttgcttgcaaggatgaattttcacattggacagacaatgattctgttgcggagagattagtaaataaatagacgatatatatccaaatgaaagatgaatacttcagccagtgcgtaaactttggtatgtgatatatatttaaatattaataagtttatatttatgatgataaactattagtagcttatgataagcttagtactgtagtaattaagtgctagtgcatgaccgtctcaaactattcaaagaccttagcttgtgcaaaagtttgtaataaacgtataaaatttacatagaaactttaaaatttaaatatcgaaccatgtgcgaatgcatgctaaaatgatcatgcttaccttaacataatggcctagtgggaaaagaaacaacataagtagcaaagaattaataaatcttaccagctccttttatgctcaacacttaatcacctaagaattcatgcaccctagctaacaactcaacaaaacctaaccaattagcattaaaccctaattatcaaatgtaagaaatcagtgtccgtacttggtttgttgtggccatcaataatattgtcaacaatgtgaagaggaagcatgggattgttctcttaaatcagccatgcagtagccagtagacaatgacgacgaagtatattgggtatataaaatgttgttattatatcacataatgtgctacatatgtattctacatacttaatctatacatgtatatcagctttctttctttcactagatagatgatcttttcaaagttgaattcgcgtactcctaacattgatgaagtcatgaagatgtccagaatgtaaatgttggaattgtacctttgattgaaactgcaaaagagagaagaagaatccatgagaagaagaagatgaagaacagagaaagaagcattagcaaaaggaagaagaagacgttgtcgcataagagacgtcgtgaagagaagagtcaaaggaagagaagaaagtcaacaaaccaaatgggtttgtgttttgtgagttgggcccataggtgatgagataagacccatacgaaataaaataagtgttttgtggttgtttagttaaggtccaacaagaagaggttgtaataactaaaagtaaactaaggcctagttagagtctaaaagtgtgaatcaaggaactagtgttccattgtgtagggtggctacttgtcttgtcttgtgtaagagtcatgattaggcctaagtgaaaatgtgtaagtgtgttgcaagtagaaaagtagtagtatatttatgagagtgttgtgttgtgtaagatgatccagtgtagtcattaaaattcttaaaacgtgttcttgtttctcaaagcaaaagagcgagaaagaaagtgaacagagatacaagagagtgagagaatgatggaagaggtcagaattacaacagtaaaacatcgtcctgttgagtaatagtaagccttaaatgccattatgaataattaaacgttaattattcatcacaaaacgacgtcgtgttgagtgtaggtgacgaaacagttgttttcttctcccttccattgttggtctttgaagagaagcagaaagttttgagaagaaaagatg

SEQ ID NO: 35348 - DNA, 3000 bp, Unknown
  misc_feature (1)..( 3000): 2750-1469P.txt file - cDNA_ID_3086412; gDNA_ID_2926287; Annot_ID_205463
cacatggttcgatatttaaattttaaagtttctatgtaaattttatacgtttattacaaacttttgcacaagctaaggtctttgaatagtttgagacggtcatgcactagcacttaattactacagtactaagcttatcataagctactaatagtttatcatcataaatataaacttattaatatttaaatatatatcacataccaaagtttacgcactggctgaagtattcatctttcatttggatatatatcgtctatttatttactaatctctccgcaacagaatcattgtctgtccaatgtgaaaattcatccttgcaagcaaaatttgtaataacaaaccaaatcatcggatctatcatctatcttatagggaatttataaatattataaagaccatcgttttacatgtgcaagggatgtattcaaatattatctcaatctctctttcagaaaattactatgaaaaaattataaacatatacataaattggaactattagaagaaaaaagaaaaacaggttcaaacaaattctagatccgattgggagctgattcttaccagtcttaattatcgcctgctcagggaattatctagaagatatcctcctggagctctattttcaaacaactatttatcttgtgtggtaaaggaacactcgcatccaccacatcggtttttcatcagcctctgaacttaccagaagcataggaaagatgattcgatacatgataacatctctgaactatactattaaaccaaggttacggtaccttatgcaacgctggttctcggtctcatcttcgagggcgggaaggagctaaagaggcttgtacactattttccagtttattactaagtcttgtatcagttttttctttcttttttggtttcatagtactgatgttttttttagacaaagcaaaacactctcatacataattttactcatattaatcaattacacattcaataaaaaataaaaaataaaacaggttaaaacatcaaatgtaagtttcataaattgaccttcaaatagttttagacagctataacttaaactatctatatgcatgcatacaaaagttgtatttcttctgcttctgcttatactgtttgtatgcgtaataattaaccacttgaattgaatttaatactttgaatcaaattcagtttttgagggggcatcagaagatcatgtttaatagaaactttaggagaaaattatttcttgaagggtacgacaatattttcttcttgccaactaagatattttttacttgtgccgcatgttaggtccaattttagaagcattgtttatacatcaaaagagaatatgggaatatgttctgaggataactaaatcataattttttattcattatatataaaataaaaataaaaataaccgacagaaaaatataataagtagagaaaaagtaaagaagatggttcacgatgcatgtgtcatatgactcataatggggtcttaattttggtgattgaatagggagaactaacacatgacgatggacatttatgtttctttatttgtttgaatctcatttaatatatttgaaaagtagtgaagtttgttatttaccttatgaaaacattacatggagcatgcatcttattctcttttttgttgcaatctcaagccaacttataaaatatatctttcttatcaaaagaagtatcacatacatttattgtggacatgatctaattttattttttggtagtgcgtatgtattggattatcaacaatcacattcgaaagaattagattccattatggcatattatttaggagcatgtgcttcaatttaggctctaattaaaattagtctacgaaataattacctttagtgattaagcatgcaaaagtcatttttgttttggaaataatatatactattatacaaaaatgcgaagaaattagtaaagtttgagaggaaaatagtgctaaaaatagattcttgcttgacttttcttcaatggtggagatttcctaataaatccaattaaattacgaaaatggtaaaaagaagcatgttcgaaatacgataatgtgtaaaatcggaaatctatatctctggttcaattttattacaaggaaagaaacatcatgatatgatatttttctcaagtcttttggtgttggagaagaagagagaagaagaacttggtttctctctctaaaagtttattgcttggctccataaaaagtgcacctttttctctcttttctttctctctctctctctctctctctctctctctcacttctcctcggatgcactattgtccgtgagatcagagattcaccctctttagattttgcgcagaaacttttgcccacaattttgtattcgtcaaatctgagctgagatctctagagtgagaaaatgagcatcactaatgaagaagcagtgaagcaattgcgtgctttaatggaagatggtgtgtctttatttgggttttcaatgttttaacttttaagcttgctttgtttgaagatcgctgacgaaatctcaaattttgagctaattttacttacttttggtattgacagttgatgattcactcagagagtcgtatcgggttagtaaattcacttgttttttagatgctttgaaagattcaactcccaagtctttgcttattgaaccaaagatcgatactttcgattttctataaataggtttctgggaaaaccgggaaaaaaatatccccttttttcgtgtcctgtgtaatttgatcggcatgtatattggtttcagtgatctggatctaaatttgaatcaaagtctctctctttgcattagttatttaagattcagtattgttggatctgtggagttgttgtttaaaacatatactgatctagagttggttgagtgtcatatgtaacatggatcttattgttgttcttggctatagaaaagcccattttgtgatgtagatggtggatttacaaatgcttgtgttatg

SEQ ID NO: 35349 - DNA, 3000 bp, Unknown
  misc_feature (1)..( 3000): 2750-1469P.txt file - cDNA_ID_3086416; gDNA_ID_2926287; Annot_ID_205462
tctctctctctcacttctcctcggatgcactattgtccgtgagatcagagattcaccctctttagattttgcgcagaaacttttgcccacaattttgtattcgtcaaatctgagctgagatctctagagtgagaaaatgagcatcactaatgaagaagcagtgaagcaattgcgtgctttaatggaagatggtgtgtctttatttgggttttcaatgttttaacttttaagcttgctttgtttgaagatcgctgacgaaatctcaaattttgagctaattttacttacttttggtattgacagttgatgattcactcagagagtcgtatcgggttagtaaattcacttgttttttagatgctttgaaagattcaactcccaagtctttgcttattgaaccaaagatcgatactttcgattttctataaataggtttctgggaaaaccgggaaaaaaatatccccttttttcgtgtcctgtgtaatttgatcggcatgtatattggtttcagtgatctggatctaaatttgaatcaaagtctctctctttgcattagttatttaagattcagtattgttggatctgtggagttgttgtttaaaacatatactgatctagagttggttgagtgtcatatgtaacatggatcttattgttgttcttggctatagaaaagcccattttgtgatgtagatggtggatttacaaatgcttgtgttatgctgcagaacattcatcaagggtatccgacagagaatttgttacgctttcttaaagccagggatgggaatgtccagaaagctcataaaatggtttaaatctgtttgctttcacctaatttagattgtctttgatgctttgtttcttgttttagctttgttttggggtttaaaactaatgactgcaagtgttacagttgctcgagtgtttggaatggaggactcaaaacgagattgacaagatactaactgtgagttttctttcagcttttggtgtccagttctgcgattttctgtggccctttgatctcatttggttattgatttttgcagaaacccattgttcctgttgacctgtacagaggaatcagagacacacaacttgtcggtgtgtctggttactctaaagaggtactactattttgagtccctttctttctttaactttttttttaattttaaaagcagatgtttgatccaactaaaaactttgttgaatcatttgacttttagggtctccctgtcattgccattggtgtggggcttagcacatatgataaagcctccgtaagcatctctattcatcttccactcagagacttgttgtgaagttgaaactctctgaccgtagctttcttatccttcattcaggttcactactatgtacagtctcacattcaaatgaatgagtaccgggatcgtgttgtattggtaagaccaaaactctatttgggtttagccttttcctccctacttttattttcctatcttgattttgtgattttctcttctgtagccatctgcttcaaagaaacagggacgaccaatttgcacttgtttgaaaattttggatatgtctggtttaaagctttcagctttaagtcaaattaaggtattaataattgcattaccttgtgtgattttatgactttgattcttgtcttcaccacatgttttgtttttttccttttttcatttctgtgtgcagttaatgactgctataacaacaatagatgatttgaactatccagagaagacagagacatactatgttgtcaatgtcccgtacatattctctgcttgttggaaaaccataaagcctctgttgcaagagagaacaaagaagaagattcaagttctgaaaggttgcgggaaagatgagttgctaaaggtaagcaattcagtttccccatgaagaagaagtagtcttactcttgtgcaagaagactgaaagttcttataacctttttgatattgcagataatggactatgagtctctcccacatttctgtagaagagaagggtctggatctggtaggcatatctcaaatggaacagtagacaattgtttctctctggatcactctttccaccaagacctttatgattatgtcaagcagcaggctctggttaaaggatcaggtgcaccgatcagacatggttcagtccacgttaagttccctgagccagacaccgaaggcaacaagatcttcgataccttagaaaatgagttccagaagcttggaaatgaccagaagatctgagtgatctacaacccttataacacgaattgcccataagaaaccggaatttgtctctggttgatgagcagtatttaagataagaatcaatcacctttacttgtattactagtttcgcttgcatcagctcgatgcaggttttgtttaaaaagaagatggaacacaatttcctcggaatggatcttttgatctagtaccattatatatatagaactcatttctatttatgtccttttgcaattctctgcattcttctttagtcactagagtgttctttaatatcaccattgttgcagacccttttatctcaattgtgaaaccaagatctctgcaacatcattggtcatacactgagtggatttgattcaatgataatacaataaagaaatagagattaacatagctactctctgacttttcatcaccaaccattagtctttttggttgttgataagataaataaataattgtactctcaaacaagatgatcgtcgacgctatctatctgtccttatttgactgaaatagaaagtagaaacatagtagctgacagttccaatgacgtaagagagtgtctcgagatccacacttgttcttgacaatgtccagagttatagccgccactaaattcggttcttcttgtataaaaggcttaacctttccacttgtctgagagaccacttctcttatccctctcaccttctcacttggcaccgttgcagagagagaaccaaacatg

SEQ ID NO: 35350 - DNA, 3003 bp, Unknown
  misc_feature (1)..( 3003): 2750-1469P.txt file - cDNA_ID_3086420; gDNA_ID_2926287; Annot_ID_205461
aactctaaggagtctcgccacggagcgcttgtcacgccagtcatctcaaggtcaatcgccacgaaatctgcagcctttacgagtgagcgtagatcattcagcgtcgtctcgaagttcgaccttgtcacatgcttcaacggaaaagccgccgtcgctgaagctgccgttgaagtagtaactgtctccgccgcagaggagctgaagctgcagacaagagacctcaaaggccatcgcttgtgccggcgcatttttgaacggagagagagagagagaatcaaacgaccatttttaggttttgctctcggtggaaggaaagagggaaagatgatgattccgaggaaacggtaccgttttgtgaatttcagtctttcgaaatatacacttgcacagcctgccgtttctaggttaataaatactgcaaacatttgtcttaacatgacttgaaacagcgtgatgtattttattttcccgatgaacaacaacaggaaccaaattctcgccactgctctctcacacaatggctattgcagaagaagttactgtctttgctgagactagcttgggaactcgaatcgtcatggcggttcctctggatatcacagcagcagatttcaagagtaagctcgataccaccctctaaagaaattcccttttggtcttctctttcgaatgttgtttcccgtagcctactgttcttattaagtttttggtcttcctcggtttctcaatttcgaaacttagcttataggtgaactgataggattctctaattgaatctttctggatgtataatgtgttggtctgtgaggaaactgatttgcatgcgcattttgggatgaaaattttcaaggttgtgaattcctatggtgagcactaaaagaaatgttcttttcacattgccttctgcatcattggtgtttgttttcttttgaagttctgtctattacacacttaaggactggcagggcacagtgcattgctcatttcctttgaatgtgaatcattgcttatatgttacttcatgacatcttgagatgagattggacatgtattgtttttctttttcttccttttgccttaaatttgaaggttaatgatctttcgtttgtgttacactttttatttaagaattcagagcatgtatcaatgcaaaatgctttctttttttttgcaggaaaactcgagaagacgcatgcaagttgcttatcgagcgtaggggagatagaagttcatggtctgatggtaatgaaaatgagctagcaattttattttctttctactcctgtgcttttgattttgttaacctcaaaccattgcagcaaactcattctaacttctccttctctcttagtataggttaaacgaaagtctcgcttttaccaccttgtggagtctgtgcctataaggtacatcttcctggataaccaaaagccttggtttatccatgcagaagctagagttgtaagcagatcacaagagtcaagcgtatctaacagtattgataaaacccacattagacattgtcacggttctgataactccatcgaaagagtcactgcattgatccaaggtaaagacaagaagataaagaaatctcgggccaaatctgattccagaaatgttgcatctggacaagaaacttgccttgacaagagggaatatcttggtccttccacatctgaacctgaaaccataaagtctttgccgtcaatagcaagagttgctgagatgaaaaactctgaatgtttcaaaagcttcacaccaaaaccgccggagaggaaacctgtagactctgaaagcgaatcgataggcaagagaataactgtggctgcaaacaacatcagaatgcaaggaaagactcataattcatcgtcactatcatcatctattttcagaagtaattcttgcagaaacagatctttagatggtaagataatcacctctcttgcaaaatttatggtctttgaggtacctgaaaatgaggattgagtctttaagcaagctctcctataatgcctcaatgcacaagaagtagcattgtgtagatgtgcaaatgatcatgattctttttgacaaatacgtagtgaatgtaagatatatcatatatattagtaagttttgtatcactctgtttcataaaaactataatcatgagaaagaaagaaaaaagcactaagaagtgaagaaaagaatcacagaatttgtctttagcttttgcttctactctttttctcaaggattctcttttatactttctaatctaactcgtttaagaattaataaagatgctttatataataaaacaagacataactttggctatatctaagatcaaacaaaaatatttgtcatattgattttataataattttagttagtcatgttaatcatctattgtgtatgaactactctaaaattgataaaaaaaatattacaagatatatgttaagatttaatatgtattttaaaaaatattcaatatattttgcctcgaatattaccttagtcaattaattaataaaattgcaaaattgcaaaagaaataaaataaatgttttagttaaaccggcactggaaaaaaaaaccgggcattggaacaaaatatatcgtcatgtataaaacacaaagcgccttagcttgttagaaatcttctccacttctctttctctctcacaccgtctttctctctccctatcaaatcccttctcttctaatacgcgatcctcttttaaaccctagtttcggatcgctcttacacttggcgattatctccaggatcgtcaattcttctctccttctctttttcttcttctcgttcgtcttcctcaacgatcgccatcaatccaaagtattggaccagatcacccctcgttgatatttgtgattcgatatccacaagtgattactgatcaattctctatcgtctcgaggatttgatcactgcttaatcctttagtgtttgctttaggatatgccctgtctgactgtctctaaatcatcatg

SEQ ID NO: 35351 - DNA, 3000 bp, Unknown
  misc_feature (1)..( 3000): 2750-1469P.txt file - cDNA_ID_3086428; gDNA_ID_2926287; Annot_ID_205459
ataccaatcaatgatcacaacaataaccatgcaccaagacatcagaaacagacaaacgaaacaaaaagataaatcttttgagtgagattaaaaaactgaattccaaatgataaatgaataacaagtagcagatattaaaaagagtaatgcaaagagacagatagttatacaattgattaaaaggtttaattacgtggtttagtaacactaaccacttccgaagctcttctccttctaagcttcatgatgatttagagacagtcagacagggcatatcctaaagcaaacactaaaggattaagcagtgatcaaatcctcgagacgatagagaattgatcagtaatcacttgtggatatcgaatcacaaatatcaacgaggggtgatctggtccaatactttggattgatggcgatcgttgaggaagacgaacgagaagaagaaaaagagaaggagagaagaattgacgatcctggagataatcgccaagtgtaagagcgatccgaaactagggtttaaaagaggatcgcgtattagaagagaagggatttgatagggagagagaaagacggtgtgagagagaaagagaagtggagaagatttctaacaagctaaggcgctttgtgttttatacatgacgatatattttgttccaatgcccggtttttttttccagtgccggtttaactaaaacatttattttatttcttttgcaattttgcaattttattaattaattgactaaggtaatattcgaggcaaaatatattgaatattttttaaaatacatattaaatcttaacatatatcttgtaatattttttttatcaattttagagtagttcatacacaatagatgattaacatgactaactaaaattattataaaatcaatatgacaaatatttttgtttgatcttagatatagccaaagttatgtcttgttttattatataaagcatctttattaattcttaaacgagttagattagaaagtataaaagagaatccttgagaaaaagagtagaagcaaaagctaaagacaaattctgtgattcttttcttcacttcttagtgcttttttctttctttctcatgattatagtttttatgaaacagagtgatacaaaacttactaatatatatgatatatcttacattcactacgtatttgtcaaaaagaatcatgatcatttgcacatctacacaatgctacttcttgtgcattgaggcattataggagagcttgcttaaagactcaatcctcattttcaggtacctcaaagaccataaattttgcaagagaggtgattatcttaccatctaaagatctgtttctgcaagaattacttctgaaaatagatgatgatagtgacgatgaattatgagtctttccttgcattctgatgttgtttgcagccacagttattctcttgcctatcgattcgctttcagagtctacaggtttcctctccggcggttttggtgtgaagcttttgaaacattcagagtttttcatctcagcaactcttgctattgacggcaaagactttatggtttcaggttcagatgtggaaggaccaagatattccctcttgtcaaggcaagtttcttgtccagatgcaacatttctggaatcagatttggcccgagatttctttatcttcttgtctttaccttggatcaatgcagtgactctttcgatggagttatcagaaccgtgacaatgtctaatgtgggttttatcaatactgttagatacgcttgactcttgtgatctgcttacaactctagcttctgcatggataaaccaaggcttttggttatccaggaagatgtaccttataggcacagactccacaaggtggtaaaagcgagactttcgtttaacctatactaagagagaaggagaagttagaatgagtttgctgcaatggtttgaggttaacaaaatcaaaagcacaggagtagaaagaaaataaaattgctagctcattttcattaccatcagaccatgaacttctatctcccctacgctcgataagcaacttgcatgcgtcttctcgagttttcctgcaaaaaaaaagaaagcattttgcattgatacatgctctgaattcttaaataaaaagtgtaacacaaacgaaagatcattaaccttcaaatttaaggcaaaaggaagaaaaagaaaaacaatacatgtccaatctcatctcaagatgtcatgaagtaacatataagcaatgattcacattcaaaggaaatgagcaatgcactgtgccctgccagtccttaagtgtgtaatagacagaacttcaaaagaaaacaaacaccaatgatgcagaaggcaatgtgaaaagaacatttcttttagtgctcaccataggaattcacaaccttgaaaattttcatcccaaaatgcgcatgcaaatcagtttcctcacagaccaacacattatacatccagaaagattcaattagagaatcctatcagttcacctataagctaagtttcgaaattgagaaaccgaggaagaccaaaaacttaataagaacagtaggctacgggaaacaacattcgaaagagaagaccaaaagggaatttctttagagggtggtatcgagcttactcttgaaatctgctgctgtgatatccagaggaaccgccatgacgattcgagttcccaagctagtctcagcaaagacagtaacttcttctgcaatagccattgtgtgagagagcagtggcgagaatttggttcctgttgttgttcatcgggaaaataaaatacatcacgctgtttcaagtcatgttaagacaaatgtttgcagtatttattaacctagaaacggcaggctgtgcaagtgtatatttcgaaagactgaaattcacaaaacggtaccgtttcctcggaatcatcatctttccctctttccttccaccgagagcaaaacctaaaaatggtcgtttgattctctctctctctctccgttcaaaaatg

SEQ ID NO: 35352 - DNA, 3003 bp, Unknown
  misc_feature (1)..( 3003): 2750-1469P.txt file - cDNA_ID_3086435; gDNA_ID_2926287; Annot_ID_205457
ctaaatacttatcaatggctctagcagaacctgatcaaaattcaagcaaaccaactcatgctatgcttaattaaagacatactattagttatgatgacagaggcgcaagaactatacctgtcattgcagcagagtacaacttagtctgatatttctgcagaaagatgagtataaagggtattaattcagagaagcttataaacaataccttgaagcagagaaacatggcagcacgcatttgaaagccagagactaaagaaagtcaactaatacagaagcaagttatgatcaacattaatttgacagcgactcaaggctaccaagcttactcacatcaatcacatcaatgccagaagatttaataactggtgtcttcgtagctgattctcggaacgccttagtcttttcattcacttcatctatcgtgtaagctgcataacgaaacaaacaagtataatcagaactaaaaagagtcaacataacgaagaaagacacagttctaccaagtgaagaacactgaattcaaaagactgatatgtgaaaatgtaatgcaatgccacgattaagcaaaccataacacatttttactcgcatttcacagcaaaaacaactttgtactagaaatctacgagagggaaaaaagataattcatgaatgcaagtacataccaaaacttgcgtaaccagtagcagcggtagcaccagtgagtgcccagaggagtgcgtaaccaagatacttaagacctttcctctcctttcccgtcgcagccgcggcagcagcttccacttgaggaggaggaggaggtggcggctgatttggcggtggaaaatcagaaaacatcgactgggtagaggtgactcccgaatacctagatgtagaattcgtcgaagatgcttccgcagagaaacatctcagattacgagatctgagctttgctaatcttggcaacaggcgagatcgaagaacaatagacgccatttccgatttcggcgttttcttcaaactctgtgaatgatgaatgaatcgcagggttgaagtagggttttggaattgatcggagaaaaggaaaattaacagatggactgtttggaaacaggttttatgggctcgttttaactctcttatccactgtttggtagtcggtttatttctactccgatatttttctattttttttgctgttttttttacttgtttaccaagaagagaatctattttattttatttttgcatttcgggcttttaataactaattaatgaagttattttacactatttatttaccaaataaaatgaaaatatttttccaacaaaaataataaattcattcgtgtcaaaaagagaaaacaaataaccaaaatttattaaatttgtagggtttcttctgcctaaacctcgactacatgctgttttttgcaccagtgaaataagcgaaactacatagaaagaaacaagtcttacttccacagaggaaagtttagagaagtagaaaagccacaaagcaacaccagcaaatacatatagcttaagctgctcagacacaattcaacgagacacttagtgagagagtagcaaatgacttactcttcctgggacggcaaatttagcttcaactttaagaaatcattggtctttgcaatcttcacaatctcctcagcttcttctctcttagaccctttcaccaattcatcaactaactgctgcaacgttgtttgaccgacaagataccgcttactgaatgtctccttgaagagctcaatcgcagactcaaagtcacctgctttacacatagcaggaagcaataaagcaaaggtagctttatcaggacgataaccatgcttcacaatttctttgtaccacgcttcagcttcgtccatttttccttcgttgatagatcctctaatcatagcattgaaactgaaaacatcaggtttgagcccactagccttaagttctccaaagagatttactagctctttcgatttcgcctcattggctaatccaagcagcctagcattgtaagtcctgatgtctattgctacattcttctccaccattttagcccatatctcttcccctagctcaaactgtccctttagatacgaagacagtaaaagtgtgttgaatgtaactatatcaggttttagtcccttgttctcaatctcatcaagcaatgcaacagcttcaggtaaagaatccttctcacacaatgccttaatcaaagtattgtaagatacaatatctggtttgattgataactttccaggtaactcattgaaaagttcttcaaccacatcgaatttcttggaaagtctatatgcactaagcaaggcattgaaggacaacactgacctcttgcagtctctgtttggcatttcttcgaacaccttctgtgcattttcaaacatgccggcttttccatacagagaaatgatcctcgccgcgaatccctcttttgacatgtcgcggtacttcttctgctcctccaaaatctcttcgacatagtgtaatctctttgcggctacgagacggcgcacggttctatcgtacacggctatgttggtccggaaccgctccgactcacatgccttcttgaatttctccacgatccgtttggggtttcgttcgccattcacgagactggttagtgacttttgaggaggcgagattgcggcagtgactgcggtgggttcggagactacggtggcggcggaggaaaaacggcggatcgggcaagtgttgaaggtgccacggagaacgcgagatagagacgacatcgttttgggagtgagagcaaagggtttcagccttcaggagacgagtttaagaacaaatcaaatgaaggacgcatctgataatttaaaaaatgttagtgccttatttttaactaaaggaaatattgggggctagaataacaaataatagaaatagtgttgttttgccgacgacctaattttacttcaccggtttgattacgggagaaggcgagcttgagcttcaatg

SEQ ID NO: 35353 - DNA, 3000 bp, Unknown
  misc_feature (1)..( 3000): 2750-1469P.txt file - cDNA_ID_3086455; gDNA_ID_2926287; Annot_ID_205451
ctcgtatggagcaccattgtcaactggtgctcctaatgtcggcacttgagggagttaccagtcttccacaaggactaaatgtcaaactcttagccatttttggtagccaacggacatgattctccaagttctataaacagtgtccaaacttggacttgtggctacgttgtgttatgtagagtagtaggctttttaactttattaggtggaaatagtattttcattttgcaaacactcaaacaaagttagatgagtaaactcaatgatgtgaaaaattggaaaaggttttcttttttcctttgaataacgatttttgaggaagctgaatgaaaataagattctttgttggtattctgatggtggttttctaattttgacgtcgtcggcgtcttgttctacacagagagtctctttgttctcgttgcttccatcttctatctatggctgtttcagcttctggtcctgtaaacactccctttcgtctaccaagtcttgaaaccttagacccattgcctgaagtcaaatgagaaactcgtctctgaggcttccgaggtatgctcttcttcttaaccattctcagagcctctattgtttgatttctagaatgctatacttttttctaatcctgctttgcagaatctttagctaacctgatagaattgtgcttttctatccttggtattagatcaagcggtctaaacttcccagttagactttgaggtttttgtctgctcttgtgaacaatcatttacatacattgtgtgtgtgtgtgtctgcgcgtgtgaattcaggtacctagctctttcttaaatcaattcagacatgattcgtggctgttaaaacaagctacaataacacaaatgaagaattgttcaaatatcatgtgcgttaatgtccacgctcctgaaatagattacgtatgtttcactaggacttgttagaattgtgaaacttataaaactgttctttttgttaggcaatggtgaggctattttactttcaggtttaaaaaacctgttgaagcattagagtgttgatgaatatgagtttccctaaagtagatagtatcttcagtctgaagtatatatgcatgtgttgtttctgatcatagtgtgcatcaaatgggatggttctgaagatcttttgacaaactctttgtctatcaattgatgtttaaggttcaacagcgattcagtttcataaaaggtgatgtttttgcttttgcttttgttagcagatggtaccaaatcaaaaagcttaggatcatatcgagtgccccttatctgatagaggactcaaggaagcagatacttaacctcattaagcatcatgctcaatcttagctccttattgtgctactaaagttccagtctattggtatcctcttccaatcttattatttgtgttgtttttttgtgtgtcctgacgtttcacagtgtccattcttcatcatgtcattctccattcttcaacacatcacaattatattttagctaaatagataaaatttattcatatgatttattctaagagatattcgacatttttcaatataaattttagaaaccaaaaaattgtgtaactcgaaagggaaagttcatatattctttgtgaaccaaatcgaattctctaactgaatagtattttgtgttttcatgattttgaagagccaaatctacttgactactggttgaaaattgaaagaaaccctaataagggacaatgataacgaaagattgggtcctcaaacaatggacaccactattctactgccatttaaaaaaaaaagtttaatatttttgaattttattgttgttgttttctcatttcaaaacatccaaaattccaactaagataagataacttatttgcagtaagaaaaacggataattttatttatttgaatccatccatcaacataaaggtgtgcacaaaggacaatattaggcaaatgacaatgtcacgtaatctacgttgcccaattgaataatttgattatcataaaagttacacaagtttcattattgagtattgagtactgaatagagatatcttcaaccataatgtagctttcacaatttccatacgcgaaaaaaagatatacacaaatggagtgtgtagagtaaactaaactcactctattatgactaacagtcaataacacgtacgtagttatcaaattattaatgagtaaaaaagttccaagttaaattatgtataaattaatcatgtattagcattagattattaaagtgtgaaaaaatgattagattcagacaaccttgaaaataaggagttaaagtcaaagggcgactgcttcacgtaactttagacttacgtcattactaacgtcacctttctttgaaaacctcctccttttgaaaacctcctccttttggcaactttaataatagatccaattttcttggtttttccccccattatttggaaattataaccattttactacaagtgccttctaaattctacaacccaacaaaaaaaaaaaaattatattacatatcatacaaaatagctagataataagtagttgatgttattgttatgaaaaagttggtggcactaaaaacatgtgatggctaatgacccttagatatgtgtagataagcagactaatcatgcaaaaataaatacaaaattgtaaacatcgtaattgtctggacaataaatcataaaattaaaaacataaaaccatttccaaaataaaattgtgtatggaaaaaaatatatattaatctcacttactatataattcattacctccttaatctgcagaaaaatgtgtataattaaagaataaaatatttagagagcgctaattaaactgtaattactttttgagatttttttgggtcagagtcaaaggtcgccgccatctctctctgtgtatataagctatgttcatcttcttcactcaacaaccattctctcttctcttctttatctcaaactctttcttcttccaaatcataaaccatg

SEQ ID NO: 35354 - DNA, 3000 bp, Unknown
  misc_feature (1)..( 3000): 2750-1469P.txt file - cDNA_ID_3086458; gDNA_ID_2926287; Annot_ID_205450
catgttcgggcatattttgagagtgaacaagtacggcttttacaaaaacgatgtgtccaacgacaagatcaagaaactcttcctccatctacttcatttggataatatttcgactatcttggcggatccacaagcaatttaccggactattaaatcactagttaatttgatgttttagtttttttatgttgtttattttaaattaggtacttgtttcttgttaagtttataaaattattttaaatttaatacttaattgtttgttaagtttataaaattatgtgttgtagttgttgtttgtaaaataattatatgtattaaataaaaagtttaaatttgagggactaaagtataaataaaaaaattgaactcaaaaatagagtagagaatagagttgctctatatatagagtcaatctgcataaatctctatttttgagtcaattatagagtggggttggagaaggcttttgtatttttactctaaaatagagtagggttggagatgccctaagagattgtaacttgtatctttattctcatgagagtctaatataattcatcatctaaacacttttgtgttctttactttcatcaaatttatcgagagtcacctttgaaagtagatacactatcatctttgtccatgagaacgtccggatgagtatgatagtgtatctatttcaaaagtgactctttataatctcagttctatatttttgagtttttcatttcttttctaacaaaaccaatgttttttttggttgtttatttacagcgaaaatttgcaaagagtatgaatagtgtttcccaagttttcgaaacatcactatctctgctttgaaggtaacaatgttttcttcatacacaccgacattttttttgtttaagaaacaacaactcaaggaagatttgttttttgttttataggttaactgtggtggtcaatttttttacttagttggttcgctggctttgaacacggctttccggagcaacgaatcgtttctatttgtggatgtgctgagagttgaggagaatggtaagatgctgactggagaaactgctttgtcaaatcctaatttacttgagagaccaatgatctgactattaagaaagctccggtaacccaagctggtgataataaaactaaaaagttcggatagtgccaaaagaagtcgtaagaaacgatctcttggggatctttcaagtgggaaaggagaggttgaaccttttgcaatgtcaccaacaggaacaataggaaaaagtaacctctatctttttctttctctattgttgtctatggagtatatagttgatgttattggagagtattagtcaagttacattcgattgtatgatctgattttattaagacattaaaaggggtgatgttattcttgaagtaacggtcgaaactgaattagttgtgaggcgtgagagtgcccttaatctgtataatctttctatgttccatagatcttgaaaagggagaaaaaagtgctgctacgactgaccaagagaatgatcttgcacttgtggatgatgagaacgagagtcacaaagatgatgttcgtttaggagcaatagtacaaggtaaacttttttgtgtttactgattttcatatctagacattcttacaatattataccttgattaggtccaagtgctgcaaataaacttttaactgctgaatttttagacatcaatcaatctgctgatgtagagaacgaagggctaaacaaagatggtgttgatgcaactcccgaatcttttcccaaactcgacaggagaaaagccagttaccaatattcttgtattaatggcgcctgttccaaacaataatttcagtatttttcgaatattcattttcttacgagggacgttctattaactcgtaaattgtttaatctgtgtagagaaaaagattggtacaaagaacaatggtggaaaagatgctgatcatgaggctactacatctttaaaggttgctaagaaaggaaggacaaagaaggagaaggccccggctaaaaaagatactaaagtggcttctagttcttggaacgttgaccacgatgttgttatcggagacccgcaggagaatgtggacaaagttgtaaggaaatcaagcaagaagtcgaagaagaaacaatcttcggacgttgtggagtaggcttaagtatctctcatctgagataaacaatgctctactatgagcatcattgacctcgtttctgtctttcttttttctctacgttgctgatctttaatgctttttctagtttaagaaacttgtttcctcgtgtggtttttgtttttctaatgcatgatgacatttaggctttaacatttcaccatctatgttgagatgaatgtttagtatgtggattaatatcgcttgtacttggtattacctataggattttcttaacgtcaatgcatctagctaatacttatttgtcatgtgaagttgtaaagttgatcccatgaagcacagcctcacccactttgtctacactcaccaaattattcttaaaagcccaattaagttttctaggtccagttaatatttggtaagaatattattgggctttgatctacttaatgggctccgttttgggaaattgcttcaggttccatttttttggttctatatcaaaacacacgaatgagagagaggttcgaatttctcttctctcattcaaaggttactaatttcgctcgtagaattttgccctatttgcattagctgtcgacaacgtctaaggcaagaaaacttgatttggaaccctaatcgattctagctccattgtatcaagatcaagcccccctacgccggatattatagcgtttttgggtcatattttctcttaattaggatttgctcatcgttgtagctttagcggatcgatttcgaggtgccctaattttctgatttcgtagaaattggttgttctgggaaagatgacgactttatccaaaaaagaaacattgaatatg

SEQ ID NO: 35355 - DNA, 3003 bp, Unknown
  misc_feature (1)..( 3003): 2750-1469P.txt file - cDNA_ID_3086476; gDNA_ID_2926287; Annot_ID_205445
ctctacacagtgccaatatcaaggttgtcgtaagagtaagatgctcttcagacattgtatagactgtacgactggagattgccccatttgtaagggattgtggagtctcctcaaactccatgcccgcaactgtagagattccaagtgcactgtccccaaatgcaggtacatagagtttttttcacatgcttttacactgattaaacaacttgtcatatatagatagatagctaactctttggtgttgcatctccgttgaacagcggtttgagagcgattagtagaaggaagcagcagcaggcagacaaaaggcgtagagctgctgtaatggagatgatgcgggaaagggccgctgaagccacccgcactggctgactcatctgatcaattacatgccagctgcattctcaacaaaaacaagagactattttgtagactattattgcatagaattaaaggaagactagaagcaaaaggaggagctttttcgtctcttcagcaggtagctaattataagttaagattagaggaggcacataggatggtacatatttgccaaatataagatgtcggttgtggtggattttttatttgaagtctctttcatattctttgttgattgattcttttgtaaataactaaaggaatttgacaatctatttcttttataggatcatatagtaaacacaagtacacaatggaccttatttacaacagatagacctcaaaagtgactacttactactaccttgaaggatgttcagttttcaattcttggacgtttcggggaagtttcacatttgtcggcgttaacttcagatgcattggttttacaagattagtgttgtacttacaagatcttttccaagtacttagtatatatgttcttctatccgtagttgtagtgacatctgtacctactcacccagcagtaacatgtacatgaattggttgagagcaaatcttgaatgaaaccttatcaccaatgttagagttttacctcgagctgttcatgcaattgcttctgtacttccatctgcagacggagcttctgctaactgtacggctctgcacaaaaagtaaacagaaaaacttttaagaaaatgtttgaaaacatatcccacaatccaaaagttattcgaagctgctttcttctcttctcaataaaaaaaaacaatgaatcaataaataaactttctcagatgatcatatatgaactagaagcagatgagggaacaagttaccttgttttctctctggcatatacttggctagtctatacttctgcaaggaaaaaatacagcttcaaagataattcagcttatgtagttgaaatttctgtcagggtcagatggcttttcacttgatagatggtcaaactctcaacattcattagcttcatagcagccttaggagttgtctctacatactatgaattttgacttcgccgttttccgtccccgtttctagttcccgtacccgttttggtgctacttagtcttttaggcccttgaagcttgttcactgcctctagaaaatgctcatggagctcaggactctatcttattcttggcttgtggttaatcgctgatcctagagaaggctctgcggtgacagacaacgctgcaggaacagagttttggtcaggattcacttggtagctagcaagttaaaggagagaaaccaacaaactctttatagatgaaaaagaactaaactcacatcacgcctgtgggtttcagcacggtctgtgatggccaactcaagctcatcagacagaaactgcaattccatttgctctcgagaatgaaccttttgagaaatctcgagtttctaatggcatatttgtggtttctgtaggaccgcgcaaaaatgagttccaacagtttcaggtggcacaatgtggagaaagttatgcaatggagatagagacagataggatgaacgataaacattgtttcatccatccatggataataagcagctatggctgttcatcaagcgacagggaaaatactatgatctaagaaagagtgtattaatgtttgtttgttcataatttcatacactagactagagtgttcaattgcttgaattaccatgggcctgaccattgtgtatatataccataggcccaataaagtaagctcaaactaacgtccaggggattcaataaacggagaagacaattaagcccaccggttagaggcagaatatccactctgaaccgactcaaaccaaaatcacctgtggaattcaaaccaaatcaacattttttttaagaaccaagatttgcagtagccgatatatttgatgcaagaaactattgaataatgaagttggatagatttcaactacaaaatacattttctgttaaattttgaaggtataactttaaagaggaaattgatagtccggtttattactggccatatatcaaattggatcagctattggtactggtgtatccggtcctccttagtcatgaaccattagtctctctatagtatcagaatatttgtttctttgtggttttctccacatatttgctattagaacaagtattgtgtgattgtgattgtcacagaatcaatagagtcaatcgttgccttatggcccttatccattttctctgacacttcatttcttccatatcttttacatgaattaaaacgacaggttctttcgatttcattatgtggcttgcctcaatttatggttctagatcacaaatcgagtctgacctgtcaatagtttggtcatgttcttgttgtatataaacacccattgatttaacacaaagagggcaaagttgtaagaaaataaaaaaaggggtcaaaaagaacaaaaaatcaaattttgggggggcgacaccataaaataaagagaaaaagcagagtccagaatccgttgccttgcccgcatctgcaactggaaaacacaaaaacagacgccacgatggatgaatgatttcgcaaatcgtcgagattttggaattcgatg

SEQ ID NO: 35356 - DNA, 3000 bp, Unknown; identical to SEQ ID NO: 28587
  misc_feature (1)..( 3000): 2750-1469P.txt file - cDNA_ID_3086522; gDNA_ID_2926288; Annot_ID_205509

SEQ ID NO: 35357 - DNA, 3000 bp, Unknown; identical to SEQ ID NO: 28586
  misc_feature (1)..( 3000): 2750-1469P.txt file - cDNA_ID_3086530; gDNA_ID_2926288; Annot_ID_205506

SEQ ID NO: 35358 - DNA, 3003 bp, Unknown
  misc_feature (1)..( 3003): 2750-1469P.txt file - cDNA_ID_3086552; gDNA_ID_2926288; Annot_ID_205499
gcgggtttatgtttttttgtggaaaaattacgagtttactttttctcaattcatcgcttgtatatttaagaaatttggaaaaatattgattttattagattggtttagatgtgttggttaaacttaaattggcattgatttagagattttagttggtttaattcaattttacaaaacttgatgggttaattgggtaaaccattgaaaccattaaccattacaacccaactcattttacattaaagataacatttattttaaacataaataatcgtaaataagttttaaacaatgtaattaaaaaacatacaaaatagaatgaatcattttgtcgagtgttagagaaataaataaaaacgataattagaaaaagcaccaaaattatttatcaaattaatttgaccaatataaattgttataactaacaaattatggataaataaaaccaaacattgtgcaagtgttggcctagtatgactccgattggttacattgcatgataggataatggtataagttgcagaataaaaatttgtagaatgaaaatttgtaaaatggaaaaccgtataatgaaattatgtttaaaatatgttgattgaatacattttgcataatggcaaaataaaatattatatacttaataaacaaaataatgtttaatatattttaagtaatatttgataaaaaaaaaaataagaaaattaaaatttattttaaagttgtgaatttttttatatattattaattatataattttgtgtaaacaattatattttttttcttttacaattaataatatttagtatgcttataagaataacaatttattatgcacataagcaactatatacccactttctttcataatgaatttttacttgtaattttagggtgcaaattctgcgtttttgcgtttgttaatgtaattatgcagattttttcttgattgacaaacttcttgcataatcgcattagaaaacaccgttatgtcattatgcgtgttaccaatcaaaaaacaccttaagtaatagtatcataagtgttcgtaatactgtaagaatatgtgagattttctagtttaagattggaaatatctaagtgttgggtgaaaatcacaagaggaattattgtattagattgtgataataagtggaattattaatttgcatttgacatgatatatggatataaattgtaagacgacagattttttaaaaagttattctaatcaaacaagtcaccttcaataacaattgattagaacataccgcgtcatatagtaaaaaacctttaaatcatatgttaacattctcttcttctataaagtaacatcaaatagttactacaatgagatatacaacaatcaagtatggtatttagggtttaacgtaagatttgagagatatgatttatgcaatgacatccaaatttgatagatattgagaagatatagaaaaagccaataaaatattgatagtggctaaaatatttgatcattttcatataatgatatttgcattgtttagctttaaacttatacgtggataaggtaatctaaagtgtgagaaataataatttgctgataaatattttgtagagataatttgagtatagtgtttgatagaccagtttaagtctacaatcttctttctgtaaatgagttggaaacatatcaaaaagacgagtcagatatactcaaccatgttttaaggtagtaaaaataaatagatcaaaatattcaaccatgtttccaatggcaggagaagttcttgcaataccaatatctttggctatatatgagtctgtttttttaaccattagtgattgtaatttaaatcaatataaaagctatttggtttgtggtgttgttaaaccgggtgaagcactctctcaactctttatacatattttttctttttgttgactaataaatttaacattttaacacacaaaaaaatgcttttgacttaaaattggttacatgcattattaggttcagaaaaaatgaggtatttaagatttatattcagcaatggttcatatatatgctctcatgtctgattttttcttttaaatatatttatgttagaaaatgatctgcaacacatcagactaaaaaactgaattattttttttatatattttctaatattaatagaaaacggtttattaaacaaatgaatatgcaaatactctaaaccgtgagaattccttgtggagtttcatttgtatataatatttattttctttgctttataactttaaaataccatcatgattattatagttcagcttctatgtaatgaaaccatgtagacaataaaataaagaaaataagaagcagtttttattatctaaaaagcgtagacaaaaataattaagaaaacttgaacaaaagaaaaaagatagaaagttgagacgaaaaagaatatataaggggaatgggaaaaaaaaatcatctaagcaagggatgaagatcaaactcgagttgtttaatctcatacataaatccgctttcaaattaattttatgttgtcgttccataattatattttttcttaaaaatagtcttgttttccattctctctctcaaaccaaatttacacatttaaataaactttaaacagaaaaaccactattaatgtagtaatatattaaatattgatatatttctatatcaaatttaaaactaaaaccaaaaaaagaaagaaaaatttctatatcaaatttagaactaaaaacaaataaaaatagtgtcatttccattatgttcttttaaaccaaactttacattctaagaaaaaacactattgatgtgtatattaaacttttgatatctttctaaatcaaacttttcttaaggtatttaaaagtgatagtattctgaatggaaaaataacaatttaacactaaaaccaataaaataaagagaaaaatgtttgtggctaacaaaaaaaaaaaatccagattgtgattacaaaaaaaaaacatttctagggcatg

SEQ ID NO: 35359 - DNA, 3003 bp, Unknown; identical to SEQ ID NO: 28580
  misc_feature (1)..( 3003): 2750-1469P.txt file - cDNA_ID_3086602; gDNA_ID_2926288; Annot_ID_205484

SEQ ID NO: 35360 - DNA, 3003 bp, Unknown; identical to SEQ ID NO: 28580
  misc_feature (1)..( 3003): 2750-1469P.txt file - cDNA_ID_3086602; gDNA_ID_2926305; Annot_ID_205852

SEQ ID NO: 35361 - DNA, 2460 bp, Unknown; identical to SEQ ID NO: 28588
  misc_feature (1)..( 2460): 2750-1469P.txt file - cDNA_ID_3086642; gDNA_ID_2926290; Annot_ID_205526

SEQ ID NO: 35362 - DNA, 3003 bp, Unknown
  misc_feature (1)..( 3003): 2750-1469P.txt file - cDNA_ID_3086682; gDNA_ID_2926292; Annot_ID_143674
ctctttgcggaaacggatccatttgttggctcctgctggacgatctcccatcactctcagcttcctcgtggtggttacttgcaccttaagctgctctttcctaaaacctgtttatttcaagaaccgttacacaattcaagaaccgattaataaaccaaaatcaaaacgagaacaatgctagagtttgttgagaaatcaaacctggaaggtaaatagtgagagcttcgaatccttgttcagttttccaatttgagagtggctcaaattcatcgtagatgcgattagcattagcatgatcagaaattctttccatcttttataattttcttggtttgatgtagaataagaggattttgtgtgtatgttgatacaagagagtatctaagcgatttcattatataccaaagaaaagatgaattttctaagttgttttctttgatattgggttattccttaactttgcctatctattatgattcctttctataaagttctttcctttttatatgcatttttacaactttattttccaattctcaaaaaagtgaagtaaatgaaattttaaaaataggagaaatgctttgctttgtggagatggcttcatgtagagaacaaataacaagtttatgttgttgttaatgtatctcctaagtttattagacaacgtgcaaaaaacatctacaacaacaaacccaatttcacgtctctcccaagcattttactattaagaagatattgttaagtttttttttttaaatgaatgttaaatttaatcaaccaaaaaaaaaccattgtacaatatatgcatccttaatttgaatgtttataaaaatttaactagactttagagcaaaaagaagaagacacttagagattagcttcttaagtcgaaccaaacccgcagaccatcttcaagcttgcgtgagccataccgtaatagttttttattccaaaaatatagtattcaaattagtccttatttcactagaaggcagaagcaatatatattcttcatattcaaagttggaatcattacaaatttccaagttacgtatttctatcataaagatatatcttcttctttttttgataagataaagatatatttttttttgttaaaccactacttaaacacgcatattacaatgtttaaaatcaatgctatagcttcacaacttctcaaacgtatattcttattgttaattaaataaaaatcaagttttatcataaatagaaacaaattaagagcaaaaatgatagcagcggcaggtcttaggaggcaggcaaagactagccacgggcttcttcaacttctcacatgcagatttacattccgtaaaaatacattttccagatttgttaggaataacagtatggcattgttctcgtttcacttgttgcacatttcccattactcctgtttgtgtcatatttagaacatgtcttagtaaatgttaccatcacataattatgtatcgaaaagcaattgttacatagattttacataacatatatagactatagctgaattgatatttttaacaaaattgtatagttgacagaatgaccttttgaagaagtatcacaatactgtcaatatatatatatcacaatattcgttattatttacagttgaaatatatatttttaatatattaaggcgaatttcaaatgtaaatacaaacctaactcaagaaggatgaaaaacgttagaatgatgagtgaaagttgaaattggttcttcatcataggtgttatgaatgaattgatggtgttttgaaagtgataaacaacttacatagtgtactcctcctatatatacttttttttaagaagttctatgtaccttaaaccaaaaaaaaaaggttctatgtacctcacattcaagcttatctaacttgagctatctatctccttaaatttcggttttacacaatttctatatttttctcattctttatgtgaaagctgtagactcgttcgttgttgtaacacaatttcctatttaaataaaaacattgaaatttcacaaagaaggaaaaaaacaaatatagccacacattcatacaatatcaaatctcatatgttatttttaaaataatgtacatgaatagccgtgagtgaaaattatcattgaagaatcggtgttagtcaacttgtagtttatgcacggagtcagatgtcacatgtccagactctagagtgttaacgagactaaaataaaaagtgttaacgagacgactttacacaagtaaaacaacgttattttgattatacaaaatcaagactattgttttagatatttttttgtttactagttaagaaaaatcaagtctctatctcactagtagtagttttttttttgtcggcatcactagtagttttttttttttttttttttttgtcgacgcatcactagtagttaaatacaagttatataggccatggtaagcttgatcaataaaagactacattagtttttgctatagatttgagcaaaaaaaaaaaaaggtttttaaaatagatttctaatttttttttaacttaatagatttctaattttttttctacaaatttgcgttttatcttctttccccacttgaacagaaaaatttatttgtttagcaataaattcaaattaaaaaaaaaaaaaacatttcatttcaatttagtaagattttgattggatcaggttgagatttcttccaaagtcaaatattcttttcccataagactgactcgtggcgcacagtcaatgacttatgacttatgacttatgagttatgtctgaaactcaaacttatagatgtgcgtgaaagaggcgcaactataagagaagctgatatgaaactcttcatcacatctccctcaaacttatttctctctttaattggttaaatctccacacccacttcgtgttttcttgattcgtttcctgggtttctcaaaaatctaaccttataattggaaaaattctggtgtcactgctctgggaaaaaaatg

SEQ ID NO: 35363 - DNA, 3003 bp, Unknown; identical to SEQ ID NO: 35362
  misc_feature (1)..( 3003): 2750-1469P.txt file - cDNA_ID_3086682; gDNA_ID_2926292; Annot_ID_205544

SEQ ID NO: 35364 - DNA, 3000 bp, Unknown; identical to SEQ ID NO: 28591
  misc_feature (1)..( 3000): 2750-1469P.txt file - cDNA_ID_3086712; gDNA_ID_2926295; Annot_ID_205562

SEQ ID NO: 35365 - DNA, 3003 bp, Unknown
  misc_feature (1)..( 3003): 2750-1469P.txt file - cDNA_ID_3086791; gDNA_ID_2926298; Annot_ID_205609
tgtgtcttcctctgaatggacttttgaggaactgattagagtcgggtctggtcggacgtagcagaaggagtgacctaaaccttcgtctaaaggatccggaagaagaacggagatgtcttttggccggagacgttctcctccaccgcctgtgaaacatatactcagttttgttactccgttacccatcaaaaacgttattaatttcagttttttcttagattcgcaaagtcaatagaggatttgggagaactcaaagctgagattgattgttcatcaatggaagaaaatccaaagagagggcaaagagaagaagaagtaaaagagagagagagagagagttgacttatgtgcaaagagaaaatgatttttctaaccaattgttattaattaccagagaaaggaataaaagaaaagaaactgtaagagatattattcgggttttgtctgatttaaatctgcgagaagaaaaattggtgtcaaacagaaaataaatactagtagatgaaaagtgtgacgtcaaaaacaagtaaatgacttttggttcgcatagatttgttgtaagaacgcgagagaggcgttgactaaaagagtctttaactcaggggtttctatttaaatggggaaagatgctataaggaccactctcaactaagtgcgtgaattgcacgcgactctgctggttagtaccgtatgagaggagtcgaagacatgcgtgtgtgagaaggatcaatatacgttctttaatttatagagatgtaatctatacgttagtaaaaactatctaatcctgttagagaatggatattccaaaatattgaattgtggaatctaattgatcatcaacgttgtgaaaaccttatgatgagttatcgtatgtatgacatatgatgattactataatcatatactaaacggagcttctaatgtgagaacaggggcaaagaagttactagtgcaaataattcaaaaggaaaacatggtgtcaaacgacatgaccggtcattgaaaatacccggtacacgcctcagatcgagcgtgggcttacgcgtgaactccaatagcaaataaagacttgcttataaacttagctgcggaaaactaggaaaggctaattaaagaagttgttgatatgttgatatagatcttattatgggctaagacaaaaaaaactctattaaaagtcaaaagagtgtgccacaaattctcatttgttttcgtttcggccgtcgccgttggatctcgtgtaaggatcaaatgggctatgagcctaccacgtgtcatattatcactgaaggcctcgttttcttcaatctctcgacaactttcataattccctttctcccccaccactctctccctctcttacctcattcatattataaaatttggacttttattcttttgttaacaatgtgttaatgggggggttttctagttcatttttatgagtttggtggcaatattcatttactttggttggggcagttgtgatcattactattcttaatcacgccaatccaactaaagtctttgacttcctttttcttattacgttttgtttaagattaatatgataggaacatactgcttattagaatatcagaaaagtaacaatctaatatacatataaatcgtttggtagcggccacttgctaacgaaatgatataaatcttctctctttctcatttgccttttgaatatatttggttgtctaagttttccttctagtcggttaaatatgaagcgtgattagggttttaatcttccaagtcaaccttagcttccaagtcaattctggcttgcatagtactatttatatataactagatatacaacattctgttatcatttgacagaattaatatttacagaaaacctaagcagccaaaaagatggcctacctcccatacaaagagtgtcaacaatttgccacaaacacaagtagcctaacaactaacgtaactactcatccctcttgggttgttcacatactttaccagcgcaattttagaaaccgttaatatatttaaatttggttacgcacaagatatttgatatgacgacaatttactggatcacaacttttgcttcttctttaaaaagaaaagaaagaatcagcaacaatttactggatcatatttgcatagaaaatatcaaatataatgaaaaaatcattaatcatataaagaaacaaagcggatggagtacttaaattattcaatatttacaacagaacattattttaaataataaatctatgaaatctaccttataaacgtgcactaacaaaagaaatgatacgtacgtatattcgtagcaataaatataagggaaactattttattaaattctgaattacaagttgaaaagtactagatattgaatttagtttagaaaaatacaagtgtttcaatgaggaaaaaacaaattattcatgtatatttctcgtggcgtgtgagcgttatatatatagatgaaacagacattttgacagttttctacaagtagaccgggccatagttggcgggtaaagactaaagtagaaccacataggagaacgaaaagtctcagtttcatcgtccttgttcatggtcttcctcgtttttcttccagacaccttccgttgcatcaacccctattgaggtttttgttgttcttgttccttatgttcttcggtttgtataataccaaacaatttggttgtctcagtcacttccttcttcttgttcttgaatattgatcaggtcagtttctaccgtataactttttaacggcttttatatattcttcttttgcttaggtttatcaaaattatggaacaagaaagattatttgtttctttgacttgattatatttgattggattttgaagatttcagactgctactaagtctctcgtctgactaaatttgtgttttttttaatacgtcgctgttatcatcctctgtctttcaaattgatcaaaaacgtaatttaatttgtagatcataagattcgaaatg

SEQ ID NO: 35366 - DNA, 3000 bp, Unknown
  misc_feature (1)..( 3000): 2750-1469P.txt file - cDNA_ID_3086797; gDNA_ID_2926298; Annot_ID_205607
caatcttttaaaattgaaaattactttacaatattttatgagatggagcttacagattggtcggttcttagttctccaatggtggaagtcaagcacatgaagcattccagctaaccatcctagtttgtgattgtatttgccatggtttggacttgaactctcgtttttcaaatgcttgcccatttcgaatcttatgatctacaaattaaattacgtttttgatcaatttgaaagacagaggatgataacagcgacgtattaaaaaaaacacaaatttagtcagacgagagacttagtagcagtctgaaatcttcaaaatccaatcaaatataatcaagtcaaagaaacaaataatctttcttgttccataattttgataaacctaagcaaaagaagaatatataaaagccgttaaaaagttatacggtagaaactgacctgatcaatattcaagaacaagaagaaggaagtgactgagacaaccaaattgtttggtattatacaaaccgaagaacataaggaacaagaacaacaaaaacctcaataggggttgatgcaacggaaggtgtctggaagaaaaacgaggaagaccatgaacaaggacgatgaaactgagacttttcgttctcctatgtggttctactttagtctttacccgccaactatggcccggtctacttgtagaaaactgtcaaaatgtctgtttcatctatatatataacgctcacacgccacgagaaatatacatgaataatttgttttttcctcattgaaacacttgtatttttctaaactaaattcaatatctagtacttttcaacttgtaattcagaatttaataaaatagtttcccttatatttattgctacgaatatacgtacgtatcatttcttttgttagtgcacgtttataaggtagatttcatagatttattatttaaaataatgttctgttgtaaatattgaataatttaagtactccatccgctttgtttctttatatgattaatgattttttcattatatttgatattttctatgcaaatatgatccagtaaattgttgctgattctttcttttctttttaaagaagaagcaaaagttgtgatccagtaaattgtcgtcatatcaaatatcttgtgcgtaaccaaatttaaatatattaacggtttctaaaattgcgctggtaaagtatgtgaacaacccaagagggatgagtagttacgttagttgttaggctacttgtgtttgtggcaaattgttgacactctttgtatgggaggtaggccatctttttggctgcttaggttttctgtaaatattaattctgtcaaatgataacagaatgttgtatatctagttatatataaatagtactatgcaagccagaattgacttggaagctaaggttgacttggaagattaaaaccctaatcacgcttcatatttaaccgactagaaggaaaacttagacaaccaaatatattcaaaaggcaaatgagaaagagagaagatttatatcatttcgttagcaagtggccgctaccaaacgatttatatgtatattagattgttacttttctgatattctaataagcagtatgttcctatcatattaatcttaaacaaaacgtaataagaaaaaggaagtcaaagactttagttggattggcgtgattaagaatagtaatgatcacaactgccccaaccaaagtaaatgaatattgccaccaaactcataaaaatgaactagaaaacccccccattaacacattgttaacaaaagaataaaagtccaaattttataatatgaatgaggtaagagagggagagagtggtgggggagaaagggaattatgaaagttgtcgagagattgaagaaaacgaggccttcagtgataatatgacacgtggtaggctcatagcccatttgatccttacacgagatccaacggcgacggccgaaacgaaaacaaatgagaatttgtggcacactcttttgacttttaatagagttttttttgtcttagcccataataagatctatatcaacatatcaacaacttctttaattagcctttcctagttttccgcagctaagtttataagcaagtctttatttgctattggagttcacgcgtaagcccacgctcgatctgaggcgtgtaccgggtattttcaatgaccggtcatgtcgtttgacaccatgttttccttttgaattatttgcactagtaacttctttgcccctgttctcacattagaagctccgtttagtatatgattatagtaatcatcatatgtcatacatacgataactcatcataaggttttcacaacgttgatgatcaattagattccacaattcaatattttggaatatccattctctaacaggattagatagtttttactaacgtatagattacatctctataaattaaagaacgtatattgatccttctcacacacgcatgtcttcgactcctctcatacggtactaaccagcagagtcgcgtgcaattcacgcacttagttgagagtggtccttatagcatctttccccatttaaatagaaacccctgagttaaagactcttttagtcaacgcctctctcgcgttcttacaacaaatctatgcgaaccaaaagtcatttacttgtttttgacgtcacacttttcatctactagtatttattttctgtttgacaccaatttttcttctcgcagatttaaatcagacaaaacccgaataatatctcttacagtttcttttcttttattcctttctctggtaattaataacaattggttagaaaaatcattttctctttgcacataagtcaactctctctctctctctcttttacttcttcttctctttgccctctctttggattttcttccattgatgaacaatcaatctcagctttgagttctcccaaatcctctattgactttgcgaatctaagaaaaaactgaaattaataacgtttttgatg

SEQ ID NO: 35367 - DNA, 3003 bp, Unknown
  misc_feature (1)..( 3003): 2750-1469P.txt file - cDNA_ID_3086805; gDNA_ID_2926298; Annot_ID_205605
acggcgtcacggataacattctcgaggaagatcttgaggacacctctggtctcttcgtagatgagaccactgatacgcttgacaccacctctacgagcaagacgacgaatagcaggcttggtgattccttgaatgttatccctcagaaccttcctgtgcctcttcgctcctccctttcccaatccttttcctccctttcctcttcctgacatctctttacttgatacacaaagatctgtgaaaaataacagaaggaaactattcagaaaccctagatttccagatcaatcaattgaattgagaatcgaaacatttaaactcttcgaaaatgtgacaaatcgagaaaaactttgaagaaattaagctaacattaaattgaaatctacgcctaagcaaggcagaaatatatgaattacctgtagatttatggaatgaaagttcttcaaaaatgtgattgtaaaaagtatgttacttcgagtacaaagtggtgggattaacttgtatctttctttctgttgtattatcgtagcttgtatcaactttcctctcttgaggctttgaggccttaatgaatgaaagttgtgttttgacaaaaaaaaaaaaaaaaaaaaaaaaagtggtgggattaacattttataaaggaagtgactacccaggacatatattttcggccgtaacgattcatcttctttcaacggtccaagattgcgatccgcgtgaaatctgtaagaagaatatggatcgttggttcttaaagatcaacggtagtagatggctttcgacttttcgtcattctctgtgtaaactccattaaacaactaaaaaaagcctccaacataacagataacccaagacttttttctaatctaaaggcccatatgtgagtagtaggcccaaattgacccaaaaaagggagcaaaaagctcacgtggcagcaagtaccctacacacgaaggtgcatgttgtcgaccacgtgttgagctcaccgtaaagagagatcctatgtgaggtttgatgatgagcatttccaaggatttcatcggatcgaaatcagaatcataagactgggaaaaaatggcagctaatatgatgagaccggcgtttgcttacactgttgtgtacgtgaaggacgtagctaaatctgtagaattctactctagagcttttggtcacaacgtccgtcgtcttgacgaatcccacaggtttgtattatgaattgttactattctctacgttggattgtcttaggtgttgttggatacgatcataggaatgtaaacgacagaatcgtattaggtcatgaaacaaaactctcgggtttgagattctattggtgcgatgtcctataatcaggtccgatccgctggctaacatgctaagcaaacacaccaaatatatatgtttgatgaatgaaagaaactgatacatacaggtggggggagctagagagcgggcaaaccacgatagcgttcacaccgcttcaccagcatgagaccgacgacctaaccgggaaggttcaggctacgcagtcagcacgtgaaagagcacccatcgaagtctgcttctgttaccctgatgttgatgccgctttcaaggtagaaatcaattattatatacttatgtctatatttgcctgttactcttcaattcgtacgtgttgataaaccagtgagatgctgcgttgtgcagagagcggtggagaacggtgcggaggcagtgagcaagccggaagataaagaatgggggcagaaggttggatacgtgcgagacattgacggcattgttgtacgcatcggaagccacgttaagtgaattcaaaataaagactcgtaaaatatgatcattaactagtctatatacatatgaataaatattacaagatactttggtacctttgttaattatggttgatgtcttgatgaatatatttacttaaagcaacatgtaaagtaaaaagatatacaaagtgtccagcctagtccccacactcccctctctcaattcgttttttctttgttagtatcgttacacaaagtaggaaacgatgttatgatcaaaatcataatagttggatttttctcctatcctagttatcttaaacatttatcaaatgattccgcgacccaacaaaataacaaacgaaagagagtgtaaagttccttttaccttttttctttttatcttttgtcgtagtcgtagtttcgtatgtttgtgagtactttggctttccaaattaatacgactggctgtctatcaaagtagctaaaccaataatgtaaagatctgtcgtatgtggtctttgaaacccaaatcaattgtttgttttataacaataattgattcttgatttttgtcaaatagaacttatcaacaataattgatgagactcgattatccgctgaaaatatttttataattattttaggaggaaggtatcatatatatactacttttcattgtttgccggctaaataattttaggaattgctgacacttagtataaaacattgaacataagataagaaacttgtttaatatttaaaattctttacttcctatttcttaatataatacagaaatatttgtatctttttaacaaccaaataaatctttaaccaaaacatagactagtactcttaaagcaaaacatagactaatctcatacaaggactaatcccaaaatcgcttggggatataatttctgaagggtctctgtcaaaccttaagaaaagatatttaaaagtagcactgggtcctgatataatatacataatgtttacattacagtattacacacacacatattagaatgggctgaagaccaaaatagttaagagaacatgacaaagtacagcaaaccttattaaatcctgacgactaaagtggtcaataagctctagcttctcatccatcaccacttcctaaatgtttctctctctatatctcttgcaagctttctcgcagaagtgataccatattttattattttgtatagaaaaaatg

SEQ ID NO: 35368 - DNA, 3000 bp, Unknown
  misc_feature (1)..( 3000): 2750-1469P.txt file - cDNA_ID_3086813; gDNA_ID_2926298; Annot_ID_205603
catcatcatcaaagataaaaaaagtgctttgatttgcaaatcatagagatgcacacacatatacagacgagagacaggactagaggaagaatctttatagtagtaccttcggcctcgtgaagtttattgttgtcggaaaaaccaagacgcccatggaaaattagtgtgaagaggacgatgatgaaatatatgcgatgtaaatatatcattttttctatacaaaataataaaatatggtatcacttctgcgagaaagcttgcaagagatatagagagagaaacatttaggaagtggtgatggatgagaagctagagcttattgaccactttagtcgtcaggatttaataaggtttgctgtactttgtcatgttctcttaactattttggtcttcagcccattctaatatgtgtgtgtgtaatactgtaatgtaaacattatgtatattatatcaggacccagtgctacttttaaatatcttttcttaaggtttgacagagacccttcagaaattatatccccaagcgattttgggattagtccttgtatgagattagtctatgttttgctttaagagtactagtctatgttttggttaaagatttatttggttgttaaaaagatacaaatatttctgtattatattaagaaataggaagtaaagaattttaaatattaaacaagtttcttatcttatgttcaatgttttatactaagtgtcagcaattcctaaaattatttagccggcaaacaatgaaaagtagtatatatatgataccttcctcctaaaataattataaaaatattttcagcggataatcgagtctcatcaattattgttgataagttctatttgacaaaaatcaagaatcaattattgttataaaacaaacaattgatttgggtttcaaagaccacatacgacagatctttacattattggtttagctactttgatagacagccagtcgtattaatttggaaagccaaagtactcacaaacatacgaaactacgactacgacaaaagataaaaagaaaaaaggtaaaaggaactttacactctctttcgtttgttattttgttgggtcgcggaatcatttgataaatgtttaagataactaggataggagaaaaatccaactattatgattttgatcataacatcgtttcctactttgtgtaacgatactaacaaagaaaaaacgaattgagagaggggagtgtggggactaggctggacactttgtatatctttttactttacatgttgctttaagtaaatatattcatcaagacatcaaccataattaacaaaggtaccaaagtatcttgtaatatttattcatatgtatatagactagttaatgatcatattttacgagtctttattttgaattcacttaacgtggcttccgatgcgtacaacaatgccgtcaatgtctcgcacgtatccaaccttctgcccccattctttatcttccggcttgctcactgcctccgcaccgttctccaccgctctctgcacaacgcagcatctcactggtttatcaacacgtacgaattgaagagtaacaggcaaatatagacataagtatataataattgatttctaccttgaaagcggcatcaacatcagggtaacagaagcagacttcgatgggtgctctttcacgtgctgactgcgtagcctgaaccttcccggttaggtcgtcggtctcatgctggtgaagcggtgtgaacgctatcgtggtttgcccgctctctagctccccccacctgtatgtatcagtttctttcattcatcaaacatatatatttggtgtgtttgcttagcatgttagccagcggatcggacctgattataggacatcgcaccaatagaatctcaaacccgagagttttgtttcatgacctaatacgattctgtcgtttacattcctatgatcgtatccaacaacacctaagacaatccaacgtagagaatagtaacaattcataatacaaacctgtgggattcgtcaagacgacggacgttgtgaccaaaagctctagagtagaattctacagatttagctacgtccttcacgtacacaacagtgtaagcaaacgccggtctcatcatattagctgccattttttcccagtcttatgattctgatttcgatccgatgaaatccttggaaatgctcatcatcaaacctcacataggatctctctttacggtgagctcaacacgtggtcgacaacatgcaccttcgtgtgtagggtacttgctgccacgtgagctttttgctcccttttttgggtcaatttgggcctactactcacatatgggcctttagattagaaaaaagtcttgggttatctgttatgttggaggctttttttagttgtttaatggagtttacacagagaatgacgaaaagtcgaaagccatctactaccgttgatctttaagaaccaacgatccatattcttcttacagatttcacgcggatcgcaatcttggaccgttgaaagaagatgaatcgttacggccgaaaatatatgtcctgggtagtcacttcctttataaaatgttaatcccaccactttttttttttttttttttttttttgtcaaaacacaactttcattcattaaggcctcaaagcctcaagagaggaaagttgatacaagctacgataatacaacagaaagaaagatacaagttaatcccaccactttgtactcgaagtaacatactttttacaatcacatttttgaagaactttcattccataaatctacaggtaattcatatatttctgccttgcttaggcgtagatttcaatttaatgttagcttaatttcttcaaagtttttctcgatttgtcacattttcgaagagtttaaatgtttcgattctcaattcaattgattgatctggaaatctagggtttctgaatagtttccttctgttatttttcacagatctttgtgtatcaagtaaagagatg

SEQ ID NO: 35369 - DNA, 3003 bp, Unknown
  misc_feature (1)..( 3003): 2750-1469P.txt file - cDNA_ID_3086815; gDNA_ID_2926298; Annot_ID_205602
gaagtcgtcttcttgtgttttgtcaatgtaggaaatgtacgtataaacatgagaaaagactttgctatatataggaatttctctatttgcatatctctctaaatgctcacctttttttattaccaactgataattgtataactcagatagttgttggatgtgctttatggaccgattggtaggctgtctttttttttttttctgattatatcgtttgactagaaaaactcctctaattttaaaaatgtaatggaaatattttattttttaatatatcaagtagctagtaacagatttccaggaaaaaaggcaggaagtttcaattttctacaacaataattcaaaaaaaaatcttataatttacacaaactatttttttagagtttgacaataccaatacgtttggggcattaagatcctatatctatatctatctatctatatatatatatatatatatatatgtatatccaattcctgattaaattgattgctgcatttaagggtattggattaagatttttgaagagtttgatcttttaaaaaaaacttttgttattcaattgatgattcatagttatcttctcttttttttttttttttacatcatagttatcttctcaaatctgatgttattgaataaatcaacttcaattttagtaaatatgtttataaaagtttttgaaatgtgaaactttatgtacatctttagttaacaaaaactgacacctatcaatcttctttctaaaatccacccttcttggatatagaattcttaaaaacaaatatcaaaatcttgttttactggatatataattatttctaaccaacacgtaataatttaaaatcccccattatttcaattgttgaataagttctatcttttttaaaatgtaaaattttaaagatatcaaagtatttagttacaagcttttgaaattgtgtgtaatgtaacgacgacaacaacagagattaaagatcatcatatcacttatagcaaaaacaaaatcttgacaaggaaaaaaaaaatcaagagaatttaattattgtttcaaacatttttgtttgatcaattattgtttcaaacattggtgtcaccatttgaaagctttcctgctggagcactcatggtcatggcaactgttttcgtcttcccgtccattccatagcccatctctttagctcccaattgtcctattaaattacatacactcttcatatattaataagattctttagttatcctaattaatctcgataatcactacgatatttaattatttacatacgtccgttgcatgttctaactggggttagtgtttaaatttcctggacagatcctacctataattaggcccaattatatataattcggcccaactatatggttcgattaaaccaggaaaaacaaatcttaacgaaatcaatgttccgacaaaactctgcaattaatccagctggtttgcgagtgaaatggtgattgaatttatttgtttggtttggttggaattataatgttgcatcatattacctggataggattggacaatagctgcgttcataaccttttgtcttctgacgcagcaaaaccagattccaatggcgacaagaataagaaagaagagaccaacggctaagtctataatcgtcacgaaaccgttgtttccaccgttgcctccaccaacagtagtttcacaattaagagtgatcctaccaaacttatctgcattgtctagactttgtcgtgcttgttcgtcgtgcaagtcttcccaggtgggagatgatgatgaatcacaccccggttctcctaattcgtgaacgtaggttaatttataatcaaatgaattcatttcagtaatatacacggatataccacatataataaggtacaagtgcatatatttttgttgtagatgtatatctaagtgtgataagaataataccattgatggatccaacaatagctatcaaagtgaagagaagtagaacaacaagggtacggagcgagaacattgttgggtctagaaaagatgattgatcagtctttttacgttaaccggagtgtgtgtccatatgtatacagtatatatatatataaaaagtttaaagtaatgtgtgctataatgggctgcaagtcatcaacttaccctattttatccattttaaagtttgatccaactatgattttatacatatttaaacttttgtgttataaataacgctctgtagaactagtccaatatacagtactcttttcggttagaagttttgaaaaggcaagatgagattttgatttatgaagtagtccaatatatatgcacctactttgtgaagttttcatgtttagtctttaggttgcatgtaaatatgtattgtttgttgagtgcctaataaatgatatatactcattgaacaagttgtagaagctcacgactgcgaaattacaatttatacctgaacaacactatagatggagaagttgtgtgttgttctttaacaaatgcatatatatggtggtgtgtagaataatgggatgcaagttatcaaccttgcctattttatttctaactacacaattagaattttttatgataatcttatagctttcattactgactccgtccaaaactaatattttttattactatggttcattttatttttgaaaaaaaactagtgaatgaatgaattaaatgtaagtgaaagagataaaaaaacaaatgagtgaaatataagtgaaagagatataaaaaaatataagaataattttgtattgctcattcttcagcataaaaagagagagatatttttctttaaaatttgcctatttttagtagtatattaaacataaatagatattagcaaaatatagataattgctttattttacatcttatctttctaaatgggcaactatatacttttcatatatatatttttaaaaatcaacataaattttttatttttcactagtattatatttgtcgatcaacttgggaaatg

SEQ ID NO: 35370 - DNA, 3000 bp, Unknown
  misc_feature (1)..( 3000): 2750-1469P.txt file - cDNA_ID_3086821; gDNA_ID_2926298; Annot_ID_205600
caagttgatcgacaaatataatactagtgaaaaataaaaaatttatgttgatttttaaaaatatatatatgaaaagtatatagttgcccatttagaaagataagatgtaaaataaagcaattatctatattttgctaatatctatttatgtttaatatactactaaaaataggcaaattttaaagaaaaatatctctctctttttatgctgaagaatgagcaatacaaaattattcttatatttttttatatctctttcacttatatttcactcatttgtttttttatctctttcacttacatttaattcattcattcactagttttttttcaaaaataaaatgaaccatagtaataaaaaatattagttttggacggagtcagtaatgaaagctataagattatcataaaaaattctaattgtgtagttagaaataaaataggcaaggttgataacttgcatcccattattctacacaccaccatatatatgcatttgttaaagaacaacacacaacttctccatctatagtgttgttcaggtataaattgtaatttcgcagtcgtgagcttctacaacttgttcaatgagtatatatcatttattaggcactcaacaaacaatacatatttacatgcaacctaaagactaaacatgaaaacttcacaaagtaggtgcatatatattggactacttcataaatcaaaatctcatcttgccttttcaaaacttctaaccgaaaagagtactgtatattggactagttctacagagcgttatttataacacaaaagtttaaatatgtataaaatcatagttggatcaaactttaaaatggataaaatagggtaagttgatgacttgcagcccattatagcacacattactttaaactttttatatatatatatactgtatacatatggacacacactccggttaacgtaaaaagactgatcaatcatcttttctagacccaacaatgttctcgctccgtacccttgttgttctacttctcttcactttgatagctattgttggatccatcaatggtattattcttatcacacttagatatacatctacaacaaaaatatatgcacttgtaccttattatatgtggtatatccgtgtatattactgaaatgaattcatttgattataaattaacctacgttcacgaattaggagaaccggggtgtgattcatcatcatctcccacctgggaagacttgcacgacgaacaagcacgacaaagtctagacaatgcagataagtttggtaggatcactcttaattgtgaaactactgttggtggaggcaacggtggaaacaacggtttcgtgacgattatagacttagccgttggtctcttctttcttattcttgtcgccattggaatctggttttgctgcgtcagaagacaaaaggttatgaacgcagctattgtccaatcctatccaggtaatatgatgcaacattataattccaaccaaaccaaacaaataaattcaatcaccatttcactcgcaaaccagctggattaattgcagagttttgtcggaacattgatttcgttaagatttgtttttcctggtttaatcgaaccatatagttgggccgaattatatataattgggcctaattataggtaggatctgtccaggaaatttaaacactaaccccagttagaacatgcaacggacgtatgtaaataattaaatatcgtagtgattatcgagattaattaggataactaaagaatcttattaatatatgaagagtgtatgtaatttaataggacaattgggagctaaagagatgggctatggaatggacgggaagacgaaaacagttgccatgaccatgagtgctccagcaggaaagctttcaaatggtgacaccaatgtttgaaacaataattgatcaaacaaaaatgtttgaaacaataattaaattctcttgattttttttttccttgtcaagattttgtttttgctataagtgatatgatgatctttaatctctgttgttgtcgtcgttacattacacacaatttcaaaagcttgtaactaaatactttgatatctttaaaattttacattttaaaaaagatagaacttattcaacaattgaaataatgggggattttaaattattacgtgttggttagaaataattatatatccagtaaaacaagattttgatatttgtttttaagaattctatatccaagaagggtggattttagaaagaagattgataggtgtcagtttttgttaactaaagatgtacataaagtttcacatttcaaaaacttttataaacatatttactaaaattgaagttgatttattcaataacatcagatttgagaagataactatgatgtaaaaaaaaaaaaaaaagagaagataactatgaatcatcaattgaataacaaaagttttttttaaaagatcaaactcttcaaaaatcttaatccaatacccttaaatgcagcaatcaatttaatcaggaattggatatacatatatatatatatatatatatatagatagatagatatagatataggatcttaatgccccaaacgtattggtattgtcaaactctaaaaaaatagtttgtgtaaattataagatttttttttgaattattgttgtagaaaattgaaacttcctgccttttttcctggaaatctgttactagctacttgatatattaaaaaataaaatatttccattacatttttaaaattagaggagtttttctagtcaaacgatataatcagaaaaaaaaaaaaagacagcctaccaatcggtccataaagcacatccaacaactatctgagttatacaattatcagttggtaataaaaaaaggtgagcatttagagagatatgcaaatagagaaattcctatatatagcaaagtcttttctcatgtttatacgtacatttcctacattgacaaaacacaagaagacgacttcaatg

SEQ ID NO: 35371 - DNA, 3000 bp, Unknown
  misc_feature (1)..( 3000): 2750-1469P.txt file - cDNA_ID_3086825; gDNA_ID_2926298; Annot_ID_205599
ttgattctgtgttatgtcttttgaatttgcgatgtgtacatattgattatttctcttacggatcttgattgtaaggacagtatcaaactcaataatgaaattggttaaaacaaacttggtttgatgatgagtttaattacagtgaaactgactttttataatttttatcttttgatgagatcaaaattatgaaacatgaatactgagaaagtgagaaggatgtaaaatatcttaattttaaaatatttacattaatctctgaaatattatttagatttatcttaaatttaattgaggagataagatttagttatctttatatccaaactcaatatttattttctgaaaatagaagtcttattagattcattatcaaataaaatctaaatatatatattctccacaaattatttactgcctctacataaatgtaattattcaaaataataagggtcgtagtagcgccatttgttgcatgggcccatctaatctaactaagatacgaaattttgatttgtggttgaaaataggtcaacaggttctttcaatgtcatggctgacaaagtcgataccaagttcgtctgggttccgatttccgtcccaagtaggacggttcaagcgcatctacagaaaaacggtttgtactttcaaaagaacgcaacttttatttcgaaagttcgatcctttgggtccatagtattgacgggtgagtagattacaattctgattgctttagggtttttgccgatttggggatggttgatctttcagttgaatccttaatctgatttgctgacattagaaggttcattccatgttttgtcttaatccccatctagttgccgaaagggtttagattttggggtcattgcttgaaatttatgcttcagatgcgttgatcttgtaccgtttagaactctgtgttgtactcggattcaaagttgttccctttacatgtcatatctctgttttggttattttcatgcctcaccattgaattcttcgtttcaggccactcaaccaactacgagtgctatctttcacccctgagttcactgaaagtgttcctgcttggtttgctgatgagctattgcttgtggagttagtttaaatatctgcaaatgtcaagtcttcttaatgtactgccacatatcctttatatcactattacctatgtaacttctaggattatttcaatgcaaagatgacccccctgctttggttctgcttcaaaattttgatttttgattctaatttgcagatatctcactgtagctatcatggatactcaggactcactagtaggggaggcataaacactgttgaaaaccatagatgggtctggcacaacaacggagtcaggttgtcgtttccaagagccgagtcttctataaacatcactatgggttgtacgcttcagcgtgggatagcaaaaagcttaagtcaggaaaacctagtggagttatctgatgaaaatgatgatctatgtcctgtggagtgtgtcactgagttcaagacagatgatgaattgcttagcgttcttgaaaagtcgaaagaaactaattctttggttgtggttgatttttatcgcactgcatgtgggagttgtaaatacatagagcagggcttctcaaaactgtgcaagcaatctggtgaccaagaagctcctgttatcttccttaagcataatgtgagtttctgatctctcatctttgatgtataaacaataaagaagtagagaaaaaatccattaatagctctaatgctgctatttgcaggtggtagatgaatatgatgaacaatctgaagtcgcagaaaggctccgtatcaaggtaatccctctttagaattttggtactaacaacactcaaaaattaactgaacagcgtagtaaagagtttgatatactacaatcttacaggcggttcctctcttccacttctacaaaaacggagttctcttagaatcatttgcaactagagacaaggagaggatcgacgcagctattctcaaatatacatcctcggaatcttgaagaacattcgacaaaaccgcactctttgggttacctttcccaaatcattgaatatgatgtaacttatattgaacaacacagcatcatccttcttcttgtaagatgtcatactgaataagacagatgcaacattttgatctctttcttttgtttgtttgcctttatgtcttcataacccacatacttatagtatatatgtgcaaaatctgcagtgacagcttactagttttggttacttgataagtatttttggtccccgcaagatctttaaaccagattgcaacttgtctcatatggtatgatgatcaattaagaaactatctcattcggatatagtcaacctaattttattagtcactataattattgataatttaccttaataacatggttaattactagtaaaccctgaaagtaaataaaattactatgtagagaaaaaaaaggtccctttaatttgttcgcctccgaggacggggtcctaaacacataagactaaaaacggtcagtagtacaaaaagatcagatttttttattccgatttcttctccatcttcgagaatttcgttccttggagcttcgagattgagtttctttgttcatcctttgggtccatattcttatcaggttctaatttcgtttgactgctgattataaatctgagtgctttagggtttttgtttattttccgatttcgcaatggttaaactttctcttgaacccttgatcggttgttgaaagggttttgattgtttgtaatgtatgattcagatacgttgaagttttactgtttatagttctgtgatgaatccaaagtttgttcctttccatgtatttactgtctcaccatataatccttcttttcaggtcacgactgcaatctcacattcctgagctcactgaagggttcctgcttggtttgcttatgaacttttgcttctggagttgattaatctctgcaaatg

SEQ ID NO: 35372 - DNA, 3003 bp, Unknown
  misc_feature (1)..( 3003): 2750-1469P.txt file - cDNA_ID_3086845; gDNA_ID_2926298; Annot_ID_205593
aagttgcccaagaaggtttacggaggagatggtggatcttactctgcctggtgcccagaggagttgccgatgctcaaacagggtaacattggagccgctaagcttgctcttgagaagaatggcttcgctgtccctcgttactctgattcctctaaggtcgcttatgttcttcaaggttcgtttttttctataaaagttttctactttattgcgatccatgcgtttttgtataatgggtttgttcgatttcatcactctgcttcttcttttgagggtttttgatcttttctatgttctgatcttctttattgctttaaaagttgtcaactttatggtaattcatgcactttgaccactgtgattaggtttattgtgatgctgattctatgatctgatttttgttgtagaaagtgaaaaatatgatagtcaaatagatcacgactactgtgtgcaagaaaaaaaagtagtctttagctgtttttgttttgcttaatcacgtcttaatcgttgatctgatcaacctcgcgtgtaaggaattgaaagcttgtttatttgactctttttcaaatttctgtttcaggatctggaactgctggaattgttctcccagagaaggaggagaaggtgatcgcaatcaagcaaggtgattcgattgctcttccctttggtgtggtcacatggtggttcaacaacgaggatcctgagcttgttatcctcttccttggtgaaacccacaagggtcacaaagcagggcagttcactgagttctatcttactggcacaaacggtatcttcactggtttctccactgagtttgttggcagagcctgggaccttgatgagaacaccgtgaagaaacttgttggttctcaaaccggtaatggcattgtgaagcttgatgcgggctttaagatgccacagcccaaggaggagaaccgtgctgggtttgtcttgaactgtttggaggctcctcttgatgtagacatcaaggatggaggcagggtcgttgtcttgaacaccaagaaccttcctttggttggagaggttggctttggagctgatcttgttcggatcgatgcacactccatgtgttcgcctggtttctcttgtgactctgctcttcaggtgacttacattgtgggtggaagtggaagagtccaggtggttggtggtgatgggaaaagagttcttgagacccatatcaaagctggttctctcttcattgttccaaggttctttgtggtttctaagattgctgatgctgatggcatgtcttggttctccattgtcaccactcctgagtaagaacttttctctgcactttcctttttgaggtttgaaattgaaagaaactaatatgtttgaaacttttttcttgtgtgtttgtagtccgatcttcacacatttggccgggaatacatcggtgtggaagtctttgtcccctgaggttttgcaggcagcgtttaaggtggctccggaggtggagaagtccttccgatccacgaggacttcatcagccattttcttccctccttccaactgaagaaggagaagaatgagaacaagaaccagcttttatcttttatcgtttgttgctttccctcagagatttttgagggtttttacttttcttgtgattcaaggaagtttcttagtctagttgtttaattctcttcctgccttttccccctggaccggttcttgttctcgttgttttaaaatattaaaaaatcaacctttcctatattttacagtcttccttcttttcaacttttggaaaaattgaatcaaaagaaatttgtcttccttcaaattctcactttcatattaaacttcagaattttgatggttcaaaaagaaattccaattactgtaaacaaaaattccaatcaaacgaacactatattgaaaagtaagttcatgtaacgatgactgataaaacattacaacatgtgattttgatgacatgaaaagtaagaatggtttgataactactattaaaacctttgacaaacaggaacaggtacaccacacgcttctaaaacttgtttagcagatgtcatatatggagcaatcaatgggtttttcaagtactcacaaaaacacgactttttatctttcaattttgtgcaacattttgtcgatggtggggtttcgcctattatatctggtaggcatgctttgagatctgtcacgacgcatgccgctttctcctctgctttggtcggagccattgacgagagaacaaacgcaacgaaaactaatgtagtgaacttcatcttcatgtcttgtaagttgtaaccttaagtttctccttctatctaatttctagtcttgcttagaaaatgcttgaaataatcgattacgagatttgtttaagaatggagtaatgttttgcagtataggctgatgtgtgtgttttaggtatatatatagtgtcgactgtctttaattgttgattactggaattaagctaacaaatttgaaagcactgccttttatagaaactggaaagatttaattataggaaatgaatcaatcagttcacatgtgtatatacagtttggaaatgttcgaaaatacatatagaagtttgatattaacaaatgatttcaatcaatgaaaatcttcaaagatttaatataaataaaatttctttggaaagtaattaaataggaaaaaaaaaataagagatctggaaatttataaatttatttggtttaggttaactgagtatcggtttaaaattgaggtgaccaaggatgttaaaatgggctaaaagtttagggccggtccggatccgttgaaaaatataagctctgggcctgataaaattgaatgagagattttcgggctaaaacaaggctggccctatttgcggttttcagattggggtaaaccgggattaagagtctgggtcgtgaaaacgaaccggaggctaattggatttgttcttccttctccacattccaatttgagggcagtggaggtgtaacaacaatg

SEQ ID NO: 35373 - DNA, 3003 bp, Unknown
  misc_feature (1)..( 3003): 2750-1469P.txt file - cDNA_ID_3086848; gDNA_ID_2926298; Annot_ID_205592
tgtggttaccaatcaaatgcaggttacattggtgagtttgagtatgtcgatgaccacagatctggcaagatcgtcgttgaattgaacggaaggttgaacaagtgtggtgttatcagcccacgttttgatgttggtgtcaaggaaattgaaggttggactgcccgtttgctcccttctagacaggttcgctcttcttataaactttctagttacagtggccttatgaattataagatcaagatttggaaatgtttttgaatcactttgcatactgtcccgaaacatcaatagtagtagctttgtttaatgctcgctaatggtattaatggattgaagctattaaattgtgcagtttggttacatcgtgctgactacatctgctggcattatggaccatgaagaagctagaaggaagaatgttggaggcaaggttctcggcttcttctattgaagttttattttatggggaaacagattttcattgagttatttttaacttttgtcctccattttctctgaaactacctttctctttctttcgaattttgtgataactttgatggatagtgttctgaaatcactctttttggtttggagcccttttttagacttcggatgcactcgtaaaattattctaaaaatctctgatttggctagtctcttaccttctctttaccggctataatctctaagttgcggataatgctctaattagtcatacgagttcatgtatcaaacgacgtcgtaataactcggaacaaaatcattgttgatctacatcatatcatctacattgaggcttaaaacatcatatcaataccttaggatcatttagaattcttagaactgattaactgtagatgaaatcacagcaacggattaatacaatatgcggttataagtaaaaagaaataagaagcaaaaaatactgacaaatcatagttgttatatcatcaagaaacgtggaaaacaaaagaagaagaaaaaaactcttcaagaaccaaatgccaaaggaacatagttgcccaatttctaactctagttttcacccataaaatggatcacaccttattagaaaatggtcttacggatcacacttccttctccagccaaatatggcccccgtctcatctcatctccggcgatgggagctcgaaagtaccttcatgtatttagatatgtaagagataagagaggagagaggaaggtttgatgaggagcatccattgttgatggtcttttcgaccttatcaaaggagaagccaagtgagagagacgtttcattttgggtttatagaccaaaaaagtggtcatttgtgagagtatcttcgaaagcatatgctttgaaccattaactaagctgacctgagtcccattattactacttttgattttcttcttcttttttctcttttgttagtatattaaaatctatttaaattattgaggcgagtaacatgggttgcttcgccacaaatcaaaagtagaaaaaaagtgaggtcctcttttcttcgcctagttgtttctcattggactgcttccaactcttgttggttctgtcaattttacgaggttaccaaatttggttcagttttgtgaatcacttgggaattaggttacgttggtattcttctgcgtttataaaacgtgcctatgatctaagtaactacccaagtcattgtctccagctagtggaaagcgacacgttactgatgttagagttgatatgatttgcatattttcttgttttaaagcacattttgtgtttgtgtttacaattttacatgaaacgaaattaacattccaccaaccatcaattatacaagtgctattaaatacaagatttaggtcagctgtctaatgcaatggaacttagcagcaattttgaaaaaaaaaatatggtactaatagcatattgttgtgataaatattactatctgatcatcacagtcattcaagtggctgtagtttagtggtaagaattccacgttgtggccgtggagacctgggctcgaatcccagcagccacacttgttttggttattttttcatttttattttacatgggcatgtgattagctttctgctaaagccccttaagataaatgacactgatgggcctaagtattttctctcggggggatataactaagcgttatgatatatatttttttgtttttgtcatctaagcgttatgaatatgcaagttagatataataataattaggccaaaattaattacatatttatccatgttaaactaatccttaataacagcaattctttcaacttatccatcacgttgctcgttggattaaattaaaattataacagtctgttgctacttatatttctggataaatcctttacaaaattagagaatatacaatcctgtcagcagatcccatccttaaaaaattagcaaaagaaatataaaatcagcgattaccttagataaaaaaaacatacgatttttgaattcatcctttaattttatctttaaggtaacaaaaaaaggaaaacataatcttaaaatcaccaaattggaaagaaatatggtgacataattgagaaaatatttacaacaaatattctgatgattcgatttgaccaaataatacagcacttttagtagatttatttaaatgtctcaattagtatttgtttatgaaaaaaaaacgaagaacgtgatggattaacaaaaattatctcctcacaaaggaatctttatttggtaggcaaaatataaattatatcgtgggcataaagaaatggataaaatttggattaaaaacgttaaacaagaattatccacaagtaaatcgtaacgcaatcaaaacgccgaatcagtctctctattagtaacggattcaccctaagcctctcctatataaatacgtgtcgcatctctttcacatttcacatcaaaacttactacttcttcttcttcttcctttaccaaatcttttcttctttactctttttcatcgtcgagaaaaaatg

SEQ ID NO: 35374 - DNA, 3003 bp, Unknown
  misc_feature (1)..( 3003): 2750-1469P.txt file - cDNA_ID_3086852; gDNA_ID_2926298; Annot_ID_205591
agcaaacggttaattcggttttacaaagaccaaacagaaaattcaataattcggtttggttcggtttaattacaccgaacaaaaaagttggtacattcgtttttatttttccgccattcttgtcgatcttcttcagtcgtaaaaccgccgcgtctctgctgaccctcctcttctcatttcatcgacgggagaaaatcccataccatctgagatttccaacagtgaaattaagatgtcaacaggtattattcttctggtttagctcattgggagaaatgcagataacttgttcgatgtatttactcaatgagcttgattttgttttctagtagtgattttgctgctatcaatctgctttagtgatgatccattttcatattatattgtttgcttgacatgttcatgcactaataggaatctcgattgtataattgtcttgtaaattcagagtttgtgttgttttgttaatagtgagctttattctaagatcagttgatgaagcaagctttcttatttttcctcaggaatatccactgatctccatgtccattttggagctctaaatttctcaaaaacctacaaatctggtaacttttcttgacttttagtttttcttcagatttcactagaccttctgtgtgtgtgattctctttgtttccggctaattactgaagcttgccattgatctcttttttcctactggatttgtccaggtttaagcaatcgaacggtgtctttttcgagagtcgggtatgctcagaacaggaaattgagctgcagtgtttccaacacagagaatgtagctcctaaggatgatgaaagaggaaaggatagacctttggttaagatgtgtggcatcacatcagccagagatgcagctatggcagttgaggctggtgccgattttattgggatgattatttggccacattcaaaacgatctatttctctttctgtcgcaaaggatatctccaaagtggccagggaaggtggggccaaacctgttggtgtttttgttgaagatgatgagaacacgatactgagagcagctgattcctctgaccttgagcttgtgcaggttctctacattcttatcgatttttattttgctctcaccaaagtgattttctcaactttattaacggttgatagttatggtttcttacagcttcatggtaatggttcgcgtgctgctttctcgaggttagtacgcaagaggagagtcatatatgtccttaatgcaaatcaggatggaaagctcttgaatgaagttcctgaagaggattgtcatcttgctgattggattcttgtggatagtgcaacgggtgggaggtaccaagaacaacttttcaatttctttcgcattgtaatgtactccttagaagaaaaatttaagcaatcactctagtacataaaaccatttgtctttcacgaggtgattgaaatatcaagagtgtgataggttcaatcataacaatttgctgcagtggacacggatttaactgggctcaattcaagttgccttccgtcagaagcagaaatgggtggctcttagctgggggaatcaatccaacaaatgtttcagaagctctttctatccttcaacctgatggaattgatgttagtagcggtatttgcggtacagacggtatccagaaggataagtctaagataagctcctttataactgcagttcgctctgtacactactaatggcaagcaatataaaccacggtaatttatcttgtaactatagttttgagcatcaacctgttgtttccaatccatgtcattaagttttgaattgtaactggctgataataataataatgcccttttttttcatcagtagtagatttaaattaaaagcgttgggttgtcaccgtaataatgtcgttgggctctcaagaacaagatccttgtatgaaatgtattctactgatcatatattatttcatttgatcgagagttttaccacaggtttctacaaattaatgcttttttaatctcgaaaaggctttacaccaaaacaaaaagaacataatgaatgggccaagatgaatttatgtaacttgtctgcctggttcactgcagtatgtcctcatgttctttgtccattgagttttggatctgcctcatagtacacgacatctcctgtatcgcttacgaaatggtcttgtttcgcattgcttaaatggtgataataggtttactcgaggcttttagattttatagagaaggaacaaacgtattctattggatagaaatcttcacgaggatcattgacgtgtatatttctcattcgttaaatttatcaatgctcaaattagatctgacggctgagagaaacatcattcatttttacaggttcaagttatagctttgataggcttcaatggtcgtgacaaagaagcccattgggcctgaaatgaagcttgagacgcagcgcataacacatgtcaattggtttctttgattttccctagtataaaaagcgataagaaaaccctagctcaccttctcttcttcctctaattgcttttctccgtcactgagtaccttgcctctcgagctcccaatcttaaggtacaattgatcttcactatagtcgttcagaatctgatctgcttatagaaatattcagaagtgtgagatagctgctaattggtctttactttgtttttttctcttgcttcacatcagaaaatttaggatcttagagcttttcatagtgaacttaagaacgcttttcgaattagtcagtcttagctctattttgtctgtgtgtgtattttctggacacaagacctttgtttcaatttctataagtgatttcggtttacattttaaaagcttgatttattcccattgaaataaatattcatgatgagtaaatctgtgcatttgtatcaaatttttagtgctttgcagattttattttaacgcaagctcttgtttgttgtttgacttgtttagtagaggattgagcttaaggcaagatg

SEQ ID NO: 35375 - DNA, 3003 bp, Unknown
  misc_feature (1)..( 3003): 2750-1469P.txt file - cDNA_ID_3086856; gDNA_ID_2926298; Annot_ID_205590
aactgaatacaagattattaattaatttacaagtgtttattaaaaatcatccacattctccgtgccaatacatgatcggatcaaacaagccgaagcagtgaccataaccgccgcgaaaatcgaaggcacaaacaaatcaaaacgcgatctcttcaccatattagacggcacgcatatactctcccctgcaaaatccatcggaatcttcacgaaaccatctcctcctccgcacgaagacgacaccgtagacacaaaagccatctccggagcaaacgaagcgacggccaccgtgaacattagaagcaccgtccacgtggcagcctgagcgatgaccggccaacggtcagagacactccgtagaaacggctccattagcgatggaagacggtgatacatcttgatcagaagaaatggggattgttttagcgtggatcaaaagaaattaggtgttggtttgcgaggaaacgaaaagattgtgagatcgatgagcaaaaaccagagcttgtttgattggtgcggtttatgtgtttggaaacggaaatgaaaatggaaaggctgcttctttgcacgtttaactaactactcttctttcccatacacacacagagagttgttaattacgaatttgcccttccctttgaactcttctcttcttcttttgcccttccgggtcgtctccgtcccctttgacactcccacgttttcagcaatatcaatttttgtttaatcgacggctgtattagttggttgttaagaaatttcagactcgttcctccataattcagatataggaggagaacataaactatattatatgattatggagtaatgacagtgatttatgctttatgttgttcaccaaaaactattcattaaaattaagcgggttcacctaaatctgatgcttatagcctgcttgtggcacaacgataacgataggtaattcaactactaatcttcaattttatctatttcaatgactccaatcatatcataattagactctgttcgttataagaaggtaagaaagcaacatcattcaaggaaaagtaggccaatttcgcgtatcaaataatataaacacacacatataacatatacttcaatagagacacatttcaatatagtgattaggtaaatgaaattgaaatggaaaaaaaaatcgttaaaaatatataatccaacattgaaattcataaaaggaaggaacaatcttctctacttcctagagttacaaagccacaaaatacgaagttaagcgaataatgcatctaatttcctacaagtactaaaaaccaaaccgaaattgaaatccctaaaaaccctaaccgggtctcttcaagagctagtaaacttggtaaccgccttggtaccttcagagacggcgtgtttagcgagttcaccggggaggacgagtctcacagccgtctggatctcgcgagatgtaatggtcggcttcttgttgtacctagcgagtttcgaagattcctgagctagcttctcgaatatgtcgttgatgaaactgttcataatccccatggctttgcttgaaattccgatatctggatgaacctgcttcagcaccttgaagatgtagatcttgtaggtttcgacgtttttcttagatcgcttcttcttcttgtcaccggcttcctttggtggcaatttcttccccgccttgggtttcttctccgccggagccttttcagcagccttgttctcttccaccggtctctcagcggcggtttttttctcggcgggcttcttctcggctcttggtgccatcgtgaattttctttctgattttctcgggaaaaggaagttgattgaagtagtttagtggtgaatggtgataatagtttagattttatagagaaggaacaaacgtattctattggatagaaatcttcacgaggatcattgacgtgtatatttctcattcgttaaatttatcaatgctcaaattagatctgacggctgagagaaacatcattcatttttacaggttcaagttatagctttgataggcttcaatggtcgtgacaaagaagcccattgggcctgaaatgaagcttgagacgcagcgcataacacatgtcaattggtttctttgattttccctagtataaaaagcgataagaaaactctagctcaccttctcttcttcctctaattgcttttctccgtcactgagtaccttgcctctcgagctcccaatcttaaggtacaattgatcttcactatagtcgttcagaatctgatctgcttatagaaatattcagaagtgtgagatagctgctaattggtctttactttgtttttttctcttgcttcacatcagaaaatttaggatcttagagcttttcatagtgaacttaagaacgcttttcgaattagtcagtcttagctctattttgtctgtgtgtgtattttctggacacgagacctttgtttcaatttctataagtgatttcggtttacattttaaaagcttgatttattcccattgaaataaatattcatgatgagtaaatctgtgcatttgtatcaaatttttagtgctttgcagattttattttaacgcaagctcttgtttgttgtttgacttgtttagtagaggattgagcttaaggcaagatggtaagaaacttaaatatttattttgaatatttgatcaattatctatctttatgaattattgatcaagaaacaaaatttaaagaacatccgggacttgaaaaagtagtggaaatttcacaaaaccgaaaagcaaacggttaattcggttttacaaagaccaaacagaaaattcaataattcggtttggttcggtttaattacaccgaacaaaaaagttggtacattcgtttttatttttccgccattcttgtcgatcttcttcagtcgtaaaaccgccgcgtctctgctgaccctcctcttctcatttcatcgacgggagaaaatcccataccatctgagatttccaacagtgaaattaagatg

SEQ ID NO: 35376 - DNA, 3000 bp, Unknown
  misc_feature (1)..( 3000): 2750-1469P.txt file - cDNA_ID_3086867; gDNA_ID_2926298; Annot_ID_205586
tttcaatttcatttacctaatcactatattgaaatgtgtctctattgaagtatatgttatatgtgtgtgtttatattatttgatacgcgaaattggcctacttttccttgaatgatgttgctttcttaccttcttataacgaacagagtctaattatgatatgattggagtcattgaaatagataaaattgaagattagtagttgaattacctatcgttatcgttgtgccacaagcaggctataagcatcagatttaggtgaacccgcttaattttaatgaatagtttttggtgaacaacataaagcataaatcactgtcattactccataatcatataatatagtttatgttctcctcctatatctgaattatggaggaacgagtctgaaatttcttaacaaccaactaatacagccgtcgattaaacaaaaattgatattgctgaaaacgtgggagtgtcaaaggggacggagacgacccggaagggcaaaagaagaagagaagagttcaaagggaagggcaaattcgtaattaacaactctctgtgtgtgtatgggaaagaagagtagttagttaaacgtgcaaagaagcagcctttccattttcatttccgtttccaaacacataaaccgcaccaatcaaacaagctctggtttttgctcatcgatctcacaatcttttcgtttcctcgcaaaccaacacctaatttcttttgatccacgctaaaacaatccccatttcttctgatcaagatgtatcaccgtcttccatcgctaatggagccgtttctacggagtgtctctgaccgttggccggtcatcgctcaggctgccacgtggacggtgcttctaatgttcacggtggccgtcgcttcgtttgctccggagatggcttttgtgtctacggtgtcgtcttcgtgcggaggaggagatggtttcgtgaagattccgatggattttgcaggggagagtatatgcgtgccgtctaatatggtgaagagatcgcgttttgatttgtttgtgccttcgattttcgcggcggttatggtcactgcttcggcttgtttgatccgatcatgtattggcacggagaatgtggatgatttttaataaacacttgtaaattaattaataatcttgtattcagttactacataacatccaccattttgttattccaaatcacgacattatattaagctgcgtcgtagaatagttgacatttgtcagtgttaacccaacaatttgatctgttatgttatccacgacccaaaatcacaactaaacaatttgacattccgttttgccatcgtccggttttaaatcaccatcaaattagtaattagtcaagtgatcatgacaaatgccgagagatacaggagacatttgtgtgattctgaggtttgtcaggtttgcaaagggggagtggagactatcttgcatgttcttagagactgcccttcgatgtcgggaatatggagcaggattgttcctaggaggaaacaacaagcgttctttacgaagtcattatttgagtggctctttgagaatctctgtgagcaggttaacgtggaagaggggccttggtccacgatgtttgcactagcagtttggtgggggtggaagtggaggtgcggtaatatttttggtgagaatagaaggtgtcgggacagggtacgctttgtgagggatttggcgaaggaggtttcagcagctaatcaacagttggtcactcagggaggtcgacgctcgcgcgtagagattctggtagggtgggagaaaccgttgcttggctggttgacagttaatacggatggggattcgcgtgggaatccgggtttagctgctgcaggaggagtattacgagatcatgagggaaggtggtgcggaggtttttctttgaatatagggagatgttcggcaccaatggcggaattatggggagtttattacggactccatttcgcatgggagaggaaagcaccgcaggtagtgttggaggtggattctgcgatagttgtggagttcttgaggacagggataagtgatcatcacccgttgtctttcctggtacgattgtgccatggctttttatcgaaggactggatagtccgaattgttcacgtgtatagggaggctaatcgtcttgcggatagattagcaaactatgctttttctttagcttttggtttgcactttttttactctattccgaatgttgttgagttactttggcgagaggatgaccttgggatagtttgcccaagacagatcccagaacggtaatttttagttttaagtttgaataaaaacggggggctctttgccgcccggtcacttaccaaaaaaaaaaataacctactttataaacattttaaccaaaacgttttgtgacctatcatgataatttggtctgcaacatatgtcaacgtaaagtttataggcccaaagacgatcaatattagaatgagtagtagcacttatacttgaaacagtgacccattgggcttaaacagcatctttttgaatcactggtttttttaattaataagaggagttatcagagagacgtcagagaacgtccctgcgattgcttgcagcgggaagtttctttctctctagctccggatttgctttggtatgttactacttcacaatcttcaactccattgattgtatccttgattgcgatttgctcctactatgtaatcgttctcttgtctcagatctaaatttaagctcatctttgaattttagtctgggactgagattctctctatagattcgtcgatccagtcttattcctttgtaatttgtttgagatgatgatgattatgttgctacagttttataattgagtatcttagagtgaagtttttctaatttctcagctattcagaggatctaattttttaataatttgcagtcgaaaaccgtaagctttggcgagtttccgggagaatttgacgaatctgttttgcaacgagtgagaattcatg

SEQ ID NO: 35377 - DNA, 3003 bp, Unknown
  misc_feature (1)..( 3003): 2750-1469P.txt file - cDNA_ID_3086871; gDNA_ID_2926298; Annot_ID_205585
gacaattaaagtgattcaacgattcattattcaagctgtattctttttttctttatggctaaaacagagaacaatttcatgatgggtaagaataactcacttcttaactattccaacaaggaccggtttggtgatctcctccatgattcttgttcagtacttgacagaagataagtctgtgaaaaaaggaaaacaaacatgaaagttcagagactaacccttgaatttgaataccacattaagatactcagataaactaaaccatagtaactgagaacgaaaagaatttaattcatgttgagattttggaacagagattatggtttggtccaacaacgtttgaatatctaagtaagcagccaaagagtagctaaataaaagtttcatcttcaatccttacgttttcctacaaatactgtctaccaatttactaattcatagaaacaaacattcacgataacccaatgctaaccaaaattgatgaattcccaacagagcaactatctctccgttttgactcgattaattgagctcagtggttgtcggtacaccaaatctagaagcggaaaagacacgaagaagaaagcactcaccggagatagtgaacttgaaggtgacagagagcgacgctaagaaaaaggtcacggcggccacaaagtaaaattaatcgaaagcctctctctactgattttccgacaattaaaacaaaaaaaaaaaggttttaaggagacgcatgattctaacatatttcaggccccatttagctttagggcccaataagggtggctaagtttaattatcgcaagacgcaagcaaataatttagcgcaatctatggttttggtggtttaatcattttggttattcagtttcgacaatatgattcttttcttttataatcaaataatcagattttattttaatttttgctgtgtcgttagtcacaataatcagttgagtttgagaacgaacactgagttctgattccttcagtctcctccatatagcccatataggactcgactaaaccaccaaatctttcatctgccaaaatctacttcatcagtgtcgttgccttgccattaccgtttatgttggttttaagagaaagacaaagctctgaatcaacactgaccaacatgtgtctcaaaaagaaacatcaaccataagttacagaaatgtgcgtacagataccaaccaaacgtttttctactgccgacactactacagtcacaatcattggaccagttccaaagtcttgaaagctatgcgttatttcttactccgaaaaactcaacacctctgcggattgactcgtgcttactgctaggttgccaaaacaagagccaatgggatcacataccatttaccattctcttcatctcggctgatcttctagaatctggttcttcaatcgctctctcggtcagcacatgcttaatgcggcacattgatctcctcacctatatttgtgagaggcaaacaaagttgacattcattaaaaaataatcataatctccctcggtaacaaagaacataaccattccttgaagaaaggattcatgtttcttctcgtagtatctattattttgtcaacaacttaattggatagagagtcaaagccaaattagtatcgattacctttggaatgcgttcagggttaggaaactgcatgttctgagcctgaagcatctgacgctgagtcatcaacatgtttttctctttgagaagaacgtaccacagcttctgaagatcatcccatgacttgagacgcagctctgaagctttccaacctcgacctaacaccagaagtttacaaattttcccccattaacaaaactaaacaatcctaattccaaaaactccatgggaggataacaaagttaagaagaaaaacgaacgattagcaagcttgactacagtcctaagctacagtgaattactttacttcttcactgtacattctatgaacaatcccactagtaaactagtattaagcagatgagtggcagaaaacagagagaagctaccatagacaacaggtttatcttcgtcttggcttctgtcgaactcaaagaactcttcgagtggatttgttggcgtccgaatcgtcgaggcagctgctgctgctgtagtggactccgatcgcgccgatgcagccgccaagaatctcctcccgacaaatcgcgtaagaaacattttaacaacaaacaattcctttgagcttgcagttatataatctgatcatcaacaacaatcagaaagagaaatcgagattggataacaaaatggtaaatggttaatgaaagtcgtacaaaatatttcaggcttccgaagaagtgagagatcgtgtacacagaaaagcacatctcgcagaggaataaataagaactcaccggagatagagagaggagagctatttcacggcgacggtgacggccacagagaatggaaaaccctctctcaacgtttctccgagaataacaggtttacggagacggaaacttttagggcccaatactagctctgttagtattgatactattattgggccaggtttcattttctcttttaaggcctaataagacccaacacttgcaaattattggaagacgaatgctgtttttgttttgtttttcaataaaacaacatctttcaattaaattgggagcaatccacgtcatcgatccgtcaagtattgttaacgatgtataaccattggatcagtaatcaacggttgatatgaaaaatcacacggatcaacgcagttttatatattaagacattagttagccacttcatatccgtcaaattcaattgatcctctctccaaatcatcttaaaagtatcttcttcttctccatctggtttattgttcgatcgtcaattcaattgattgatttggaaatctagcgtttctgttcgttaccattcactgaataatttttcttctgttcttcacagtcacagatctttgggtatcaagtaaaactgtgaagtgatg

SEQ ID NO: 35378 - DNA, 2923 bp, Unknown
  misc_feature (1)..( 2923): 2750-1469P.txt file - cDNA_ID_3086906; gDNA_ID_2926299; Annot_ID_205640
gagggttgttgatgggtcatcggaggaagcaatgaaggcggcgccggaaccaccgcataaggcggtaccaacaacgaggagcttcgtacgggttctccatagggatcgtgccgccattgaggaagcacgtaatgaacgcacgcctcagcagatcggaggagaaatagaaagcgagcgagcgaaaacaagtggtttattccgacaaggctaaatttgcgttcaatttgttcggaagatgcggattcggatcttgtttgatgtgggccttacttattgggcttgtaatgggtctggcgttggactattctttgaaaactacgagtgtgtgtatttacgaattatgaattcatagagttaggctaaattactaattatgattttggtgtggttttaacaattgtttcaggataaacagttttaaacatgaaaataaagataaaatttgaattttttgtttctttttctaattatttttgatatttatacattgctagttatacattacatttgtctaatatcacatatattaacaaaagatgtaatatataattagaaatgattgtgagaaaaatggagattattgtattttgataaaatattctctcttttctagttattttgatataaaactcgtaatatagcctcaatatttttctaatataaacaattctagcaataatgtaatatcaaatttattttattttttgacaaatgtaaaatatttttgtgaggttttaggtttataattgtgccactattttggtggagtataatcaaaggagaaagctttataagcgacgagtgcatgtttttggtgagctgatatgtcttgactcttgacttgagaagtttcttcaacttccggtcagtttcgtaggcctataaactcttgactttcagctcctccctctttattttggatggtcctactctaattattgatatgcaaatctgaccgttgctatcacaagaaacaaaacaagcaaagagacacatatttgttgttcggttaattaattctcatcatcggagtttggtgacaatttgtaattatatattccaggtaagaataatctgtcactaaatctaatttagaatgttcagctggaaaacaacaaaaacgaaataagtttggaaaaattctattagaacatatcctgatttccgaaatttcctaaggttttgcttaacagtcaatatatacatatatcattccatttacgagacaaattgtaaatgatcaacaattgactagtacatacactcacgcaaagatatacgcgtacaaagtaaagagttacgacttttttattagtttgtttgtgtaataacttggcaatgctttctttataacaaacaagtaaattaaattcctatcgaatgttttgaaaagtttgataagaaaaggcaatcatttcctatctttatatttggtagcattagacgagaaaacaatgaaagatcacaatcaaacacaaaatagttattaaaaaaattggatacgatagttcactgtttcttttagtacaatgaaacaaaaaaaaaataaaaaaaaataacaccgtaagatataagttagggtaacaaacggcatgcatgtggtcacatggctgaaatcggtcggttcctccattcccgtatatgtttgtgttaacgaataaacgagtctcggttcatttcttcggcgggagaggatgggtctaacattattttactagtaacaatttaataaaacgataaacatatattgtgatgattttaaaatattccaatccattatatattatatacaaatgaaatcaagaaagaaagaaaaaatgttccaattatcgagttttgtttatgcttcacgttatttaggttttaccgttattacacggaggctgaaatctgaagactccgaacactattttgttttaatttaatacaccagtcaaaggattcaaagagctggaagtttctctcaacatttttttttctagaatgtttcagtttccaattactatttaagatttttcagttggctaatttttattttattttagtgtgaatgagagaaataaataattttacaaaaaaaattattaagaaagtaatacaaataaaaattcaaatatgaatagcctcatttttgtgtgattatgattaacattacatgtatccttaattttaagagggttgagagcgttttatctattaacgagacatttaggagattcagatgatggaagatcagagcatctaccaaaaaactttgcttactaaaaagtatttaggaagcaatgttttggaagttttacctcaacaatatttacgaaaaagctttcttttgatgtttttaagtattattactcagcatataaagaaacaactgaaatttataaatagaaagtggaaaataattaactaacccacaaatcctatattcatcaaaattatgtatgaggatgtaatttcataacatataaattgtggatctgtatcaatcgtcaatatcaataaaaaaattaggatagatcgacgaatgaattgactttcattcatcttacgattcttttaaaaattaatcaaacatgatttacatacaagaaaattaaatcaacaacgaaaacatttatagaaaagaaatattcaaaagatttttatagaaagaataaaatttaataattatattatatagaagaaatccataggtaaaaagatatagacagataaaaattaccaaactaatccaaaattctatattcatataaatattccaagtccaacaaggaaaaatcataatagtataaattaatcccttagtatttatcttagcatcatcatcgccgtcatcgtcactttgtctcgtccaccttttaaaaaccctctctaaagtctccgaaacatcttctctcttaaacaaatcctctctgattcgatg

SEQ ID NO: 35379 - DNA, 3000 bp, Unknown
  misc_feature (1)..( 3000): 2750-1469P.txt file - cDNA_ID_3086937; gDNA_ID_2926300; Annot_ID_205686
caaaactgattttataatataagtgaaatatatggaaattaatttatcttattttaaattaactgaaattatttggaaattagttttatctttgtgtatacatagaaggaagttttagttccagttcaaatattggctttcaaattgaatataatcaaaattctaattcagtctaattcggcaaagcttttgtaaaaccaaaatttttgatgttctaaaccaaatcaagatatccgaatattgaagctttagattgttcggcatggatcttaacgcttgagtggttaattttgttttttctaattaattgaattatttcttctgcattgtcaatcaatattggtagtggaaaatgtagtaaggggcatgttcaatcccgtattttaaattatttgagttttatttttttatatgattttggatgaattaggaaagttgatatgatttataatttattataaaatcctacaaaattccacttaaaattatgggatttagttttgtgtgttttttacttgggaacattttttaaaaatctcttgaagttatcaagaatactgttcttggacaaatttaaaaataattttaaatttaaacatgttttgcctccgcaaagaaaagacacaaagaactactatgaggcacacaaaccaatccaatgaccaccataatggacgagcaaatggtaaagctaaaacaaccaaaataactcaaaggatgcatgataatagggagctaacaagctcaaccaagaagcatccaaacaaagacaatcaagagaaaaaatatcgaaaaatttattatttaataatatagaactagttaaaacaaacaaaaatgtttgattgaatacacccctataaaacgtattaaattgaaaatgctaaaaagaagatttttttttcggatccaacataaaaatccaaaagtcggctggataaaacgatataacttggtaatgccttaatatccctatacaaaaaggcaatgtatattgggaaataaaacattaattgtcatagtaaaaataatacatattacaaaaagtgattcgatatgaatagttataaagtgatgaaacatcaaaaacgtttgaaatgaatataatttattcagaatatatattttttatttatttattcagaatattcaatatgatacgttaaaaacttgattttaatagattactaaaatgtaaaaaaaaaactgatttgaatagaggctactaacatttaaattttactacccatgttatttgaatagaggctagcatgtaatggatttagcggaataaaaatgtgaaagtttgacgaatgctatgaatacaaaaagaaacactatgccattcataccatcatgaacaaatgctctgattcaaaaggaggcaatatgggtatgtcgatttgacaaaatggtcgaagttcttagggaacaaagagatttgaggtcacaatgcaaaatccaaatatctttatttttatttatttatttttttgttaaaagggttttaaaatccaaacatcttgtctaaagaaattgtaaaagacacttcaacagaagatgccttccagaagcaagcaaacagagttgagtttctcaatctcgttccatcatgaccactaagccaatacatgtatgtatgcatctacgtaacgtatgcgtgtatatgtatgtgcatgtatgtgtgtgggatttggaggaatgggagagaaagaataaaaggacaaaggaaagagtcatgtaagaacattttggacattgacgtctctagagacgcttggatagccattaaagtgcggctatggagttgtccacgtcttacttcaaactatgatggctcagcttaagaagatgcatacaaaaacctcttttgtttccattcgttttttcttatatgagaatgtggtaaattctatagacgatgtaacacaagctatagagaatgtatataattacaactggaattagcacactatttgtttattaatgccaatggtatcccaactctacataaaaaaagctttatagcaaaaaaaaaactctacatccaaaacgcagatgcatggactgatggacattggttaattacccaaaggaacaacatttacgtaccactgggcatccaaacatataagcgaatatcaccaaaatccaaaatctaagaaatttcaaaaagcaagaagttatatatatgtgtccattgctttgccaaaatctaagaagttatagattagggtttctagaatagataagcatcgaagggatcacaaaactgtaaaccaaactgaaataaatgtttataccaaaaacaaaatttgcttcttaaccaattggttttataaaaagaataagaatttgaaaccgagtttaatgtaaccagtcgatcggactaaactaattgagataaatataatcataatgtacattttaatttattaatacaatagatgttagtataactatattaaaatattattagttcaaacattatatttatataatataaagttaatttcctaactaaaaccaaaccgaatcaaaaccataatcaaactgaaccaaactaatctgttttcacattctatataaccgaaaccaaacaaacagatcggattttaacccatacctataataaaacgctgtcggtttgaattcggatatatgggcccaaataagttcagtcaagtaatgggctcaaagcccataaatatattctctggcgccgccagaaatggaagaaaccgaaacaaagtttctctctctctctctctctctcgcataaccttttcgccgaaactctcatcttctcttagccgagaaaattcagccaccaccaccgatcagtaagttcttcgtattcctccgtctctatcatcgaatcattatttattcaataaattaattccatttcttcaaacccatgttttttggttggtaaagttttcatttttatcgtctctctgtttttcaatctctctttcagtttcagattttggcatg

SEQ ID NO: 35380 - DNA, 3000 bp, Unknown
  misc_feature (1)..( 3000): 2750-1469P.txt file - cDNA_ID_3086949; gDNA_ID_2926300; Annot_ID_205682
aatcgttttcggaccaaaatatccttaattgggagcaatcaaaccgtacaacagttggtttcggtttagcttctatagttcagttttgaaaaaaaaaaaaaaactgaagcaaagaaaccgaagaagaagaaaaagaaaaagagacggaaagatttgagagagaagtagaaagaagtttaaaaatcattatcgactccttcatatttcgacatctctccattgaactccaaaattgaggaacaaatttcttgttttcagagatcaacaaaatgcaaaaaaaaaactcatagattcaaacactttagttttttaaactaaagatactctaggtttacaagatttatttataaatagtaatcaaaacgtaaaaaaaaatgagattttgagaaaactggtaaagacgaccgcaaaattaggtttgtagaaaaggatacataggttaaagatgactggaaaattacaattatacccttcatctaattttttctgtgtacgtacacaaaatcatttattggaacgtatatgatacgatttctaataacttaaaatattttattatgtattattatatctcaataatctccatacatacataataattaaataaaaatagatggtgaaataatgtttgttcctcatattgaaaagttatgtacgtatatgtgtaatattgttggtaaattaatgtatatacatgtgaaataatatacgtacatatttgtttgtgaattaaattataaagaaaaatttattaatacaatattaaactaatattggcagtagctgagatatattttaaaacgttcatacgatgtgattttgaaacattttaaattcatggacaaatgtcagtggcttgagctgtcaaatgtcatggacaagtatcatcaacgcaaaccatctccaatcttgtaggacatgacctaggttgcttgtagcaaaaagattgtttgattgcaagataagacattgtttgttgtatgacttttctgtttttaaaaacacttcccaatctatagtgtacgtacaatggtacaaaccatgttgacacatacttcttggagtcacaactggtgtatggtcacccgagtgagaaatgttatcttcgccaggtacacgctgacttgtgtacgtacactctgccaacaaacgactgaatttccctggatgttgaatagtcagttgtgtgagaatgacgttctcctcaacattccatattccatattcttttacaattatatcgttccacttgttgtaatcataatcttcgccagtactttcattaccatcaatagtaggatcgagggtactttcccccatagatccatcgtcaccctgataatcatcatacccatcaccatctttgttgtccccctcctcttcatcctcatctgttttatcgtcttcaacgtcgtcttgctcatctacggtctcattattttcatcaacatttgaaacactatcacacacacggtcactttcagcatcgtcaccatgagtcctaaagacattattcccgagtgtcttgacggacaaacaagttgagagaaggataccgaccacgaatcaaaaagaacgtatccaaccccacttgactgtcaatgtagacaggaagacgtttagtatctatcatcactaacatctctcctggcatccagtaactaattatgggattgatctctgtggacttcaaactgaaagcctcgcttagtgtacgtacaaattccgtgtacgtcatgttttccttaacacgtacacagtgacgaaacatgtcttcctttgattcaaattttcatttttcttctttgcatctccactcaccgaccatagtaaatacggaaatatccattacccaagtgcatcataaattcaggaaaaactcattaaatgcaactgaaaacatgattatatctacaaaaacaaatagaattttgatatacacacttataaacataaatatttatacatttagaattttcaaccaacaaaattggaaataaaaatttctgggtttctatataaaaaacaaagttgatttcgaacatactgaagatcatagtgtgttatagcaaaaaaattctttaaaacttcattacttatacgataatgcttatattggttccaaacttcgtgaataaacaagatcaacacttcttgagcatcaatgtacgttagcaattaatgtttgttcctgggttcatctttaactcaataatttaatcaaaaaagaaagaagatgagttcttctttacttttatcacttaggagccgtgcgagatgaaagtcgatctagtattgcggcttacgctagattgacacctttccttgaatacgaataaaattattatcaataattttattatattataacatgtaatgatgattttgcattaattatgacaagagtcacgtctaaactttttgggccattaaatgttgatgtcacttcatttttaataaaaaaaaatctcccttctaactgtacagccgcactcctcaccgtgaaacaaaaatatcttcaactaaaccggaacagtgtatctaactaaacctgactaactaaaccgtacatttaacagtttttcagctgtagcagcaagggcaaaaggatcaaattttagctaaatagacaaaacgtgaaaaccatctttcactttgccaatccctgaaaataaaacatggtcaaaaggtatgcctcgcaaattaccgagacttaactaaatggttcacacttttttgctaactttcacactttcacagtttctttccaaaacaattgagtaataataatgtattaaggccggtcctaagttaaaatgagtctatcatagaagcccatttagcccaaactaaacaacattacaaatacaataaaatagagacggaaaacaaaaaaaaaagagaagagagacaagaaaaaaaacacactctatttgagaaagtacttgtgggaatcgcggcgaaaagcaaagagagagagaaggaaggaatccattaatg

SEQ ID NO: 35381 - DNA, 3000 bp, Unknown
  misc_feature (1)..( 3000): 2750-1469P.txt file - cDNA_ID_3086953; gDNA_ID_2926300; Annot_ID_205681
gagacttaactaaatggttcacacttttttgctaactttcacactttcacagtttctttccaaaacaattgagtaataataatgtattaaggccggtcctaagttaaaatgagtctatcatagaagcccatttagcccaaactaaacaacattacaaatacaataaaatagagacggaaaacaaaaaaaaaagagaagagagacaagaaaaaaaacacactctatttgagaaagtacttgtgggaatcgcggcgaaaagcaaagagagagagaaggaaggaatccattaatggcggctgccacagttctcggtcgcttatcactgataccaaatctatcatctaaaccaaaattgaaatctaacagaagaacaacttccacaagtgtttctgttcgtgcacaagcttcgttctctgacccttttgtacttcaattagctgaatctctcgaagattctctctcagcttctccttcttcttctttacctcttcaaagaatccgtgattcttccgctgagactcttttatctacgccatggccgtcacgaaaagacgaacctttccgattcaccgatacatctttaatccgatcttctcaaatcgaaccaatttcgacccagcaacgaaattcggaaattttggataatctgacggaaacccagttcacaaacgctgtgattattgatgggttcgtgtcgaatttgacgattggtccatcggatttgcccgatggggtttacttcgggaaatattctggtttaccggatgagttaacgaaccggatttctgagtttatcgggaattttgattctggtgatttgttttggtcgattaatggtatgggagcaccggatttgatggtgatttatgttcctgaaggatgtaaggtcgagaatccgatttatttgaggtacttttctggtgaaactggtgaccgggaatcgaaacggttaccggtatcgaatcctagggtttttgtgttagtggaggaaggaggagagattggtatcgttgaggaatttgttggtaaagatgaagaagggttttattggacgaatcctgttttggaagttgttgttcaaaagaatgcgaaattgaagcattcttatttgcagaaagaatccatggcttctgctcatatcaagtggacttttgtccgacaggttcaatctttgctcattctcttattgtctttccagtaactaattggcttggtattagtagaattcttgaattgttgaatcagtagtttagcctattactgtttggtagtactctctcgtggcttagattagtgttggatgttttgatatcaatttgagtacgaaagtaggaatcttattgctgtctgaggagagtgtcttagtttagttttgttgctgctgattgctgaacttggaaaagttgtaatctttatgattgaattgttgatgaggatgaatagtttagtttcagcctcatgtgagttttgattttgtcttctcctctttgtagtataaaggtttatagaataggatgttttggtatggcttcggaatgttttatgctgaattgttcatgtggtgaactctgtaggaggcagagagtgaatatgagcttgtggaagtgagtactggtgggaaacttgggaggcacaatgttcatgtgcagcagcttgggcctgatacgctcacagagctaaccacgtttcatatgtgtgtcaacgagcagactcttgatctccatagcaaaattatcttagaccatccacgaggcgcttcacgacagcttcacaagtgtattgttgctcattcctctggtcaagctgttttcgatggcaatgtccgagttaacaggtaaacttttcagtttggtttggtgtgcttagcatcggtttaacttctgtgtggtaatatgcagattcgctcaacagaccaacgcgggacaactaacacggagcctccttctgaaaccccgagccaccgtgaacataaaaccgaatcttcagatcattgcagatgatgtcaaatgctctcatggagctgctatcagtgatcttgaagaagaccagctcttctatttccaagctcgtgggatcgacttggagactgcaagaagagctctcatatcgtcttttggatcagaggttatcgagaagtttccaaatcgggaaatcagagaccaagccaggaatcacgtcaaaggcttgctctgatgtgtttcacagaaaccgatcgtgatactcacgcgccggttttgcgcttacgattcgtcaattatcctttgttcattactgctcaaaggcttgggaggcccatatagtccagtttggcccatttaattaaaaactaagaagaacaacaaacagttggcttctatatgagttaaatagcgtgcagtttctctttaaatttgggaaaaggtttctattcgcatctgtataagtaaaacgacgcgatgtttatggatttaagtaaaacttgaaaacaacacgctttttatttgaaatctgataaaacaacaaacacttgtttttcaccgcctcccttttctccatcgttggcctccttcaacgtcggagactctcaccgccttttctatccacccactcgggtgaaatacttcgatagactccgatatatatattcgcgcccaccggtagcttcgaaaacagagatcctcactctcgaaatcttctcactctcgagaaacctgaacccttagtttaccgaaatctagggtttgtaacttgttccattagttcgatgattaggataatttgtgtcagtttataaattaggttttgttactttcgatttttcggagatattgctgcctacggttgatttgatagctatgagaattcaagctgcgaagtgaattttaaaattgagaatcttgtatagtttcactaattattgttttgattcgtatatcaatgaaataatgtgaaatggttagagaatggattttgatttgaaattcttggtgttgctttgtttattcaaatacagtaagaatg

SEQ ID NO: 35382 - DNA, 3000 bp, Unknown
  misc_feature (1)..( 3000): 2750-1469P.txt file - cDNA_ID_3086961; gDNA_ID_2926300; Annot_ID_205679
tcagatcacatgtggatccaattgacctttgttttgggttaaacatgtgttcaggtccggagcatgaaaagagccagagatatccgtgatcaattggagggacttctcgaaagggtggaaatagatatcagctcaaacctgaatgaattggattcagttagaaaatccatcgtagccggtaattgccaatctcattctcctttttgttgatttgaaatgtataattctttacaattatgcctctgctaatgaacttcttacttatatactcagggttttttccgcacactgcaaagctacagaagaatggatcgtaccgaacagtgaaacatccccagacagtgcacatacatcccaattcgggcttatctcaggttaatgaattctcactctacataaaccacaaatatctgatttgacagaatctcaaaactttgaatactgataagtttttctcaatgcgtgttgtaggtattgccgagatgggttgtatatcacgaactagtacttacgtccaaggaatacatgcgacaggtaattaatatgtttgatactgcaaggtttagccataattgtatttctgttcttaattacttttggtttaacttattggtttcattcatcggtttgtctgtatgctactaaaactcccatacccgaaaatgcaggtaacagagttgaaaccagagtggttgattgagttagctcctcactactaccagctcaaggacgttgaagacggtatgaaccttttttctcaaatccagttatactttttagttattactgtcctttgtagaatcgactctttcagtctctaaagacaaaaccgatctttcagctgcatcaaagaaaatgcccaaaggagctggaaaagctgcaatgtaagaactcagatgggattggcaaaagaataatggaaacagatgcgagtacatacgactttgacagattgttagaaaagctctcttcactacattaactcatttttggtcagcctcctgagtttttgttagaaaatacttaaaatgttatgaacagttcaatgtagtgccatttattcccattgttatatattgtaaggtcgagctacattatgtctgaatcagtaacttcttttccgctgcatggagcagttgtgaaaacttttacaaagagaacccaaataaagtatcaagcaaacttatttggaaaacatttcgaagttactttggaaaaaatgtggttagaaaactcagaaaccctgtgttaagtcaatccaagtttgcaattacagaatcaacaacctcttgtgtagttgtattactgttcccacactttccttcagagataacacgtgtcacggcggttttaagccggtcggcaaataaaggaagcagaagatgtctcagcatcataaccgaagagaacagtaacgccacaggatttttatggtttcctactgatccaacttgctcaaagattgcatagtcatcaccaaaacttcctccagcaacaccagaagcaatgtttgcaattatagcccatagagatttggagttactatgacgtcgaatcgctctggtttctctactagctgcaaacagcagttattaataccgatttcgttgtaggtgatgtttggatacattttagcaacttcttgacaagactccaagaaaaacgcatcagctagtttttcgtattttccattgttgtgaactgctgtaactttcttccttttgctgaagtgagcatattcaaaagcatacttagcaatacgatctgaccagaactttgtcattgtcacctgaaaactctctatgacaccgggaacaacttcgtgctcccgacctgcatattcgccttccgtgttctctctgatcaccacgatgtcaacattctcatggcgactcggttgaccattaagattaaagcagtcgacaagagatgcaaagagatcaagctctttccttgcaccaccacacaaggagttattgactctgccattcaagcacactttgttcttccgtatcgagtccaccacttcccacgtcaaatgattcatatttttcccctttatgatgtatgtctcgaagtagaccggcgcttgcattgcatccatcacctggtgcaccgcgtttgtcacattgctgtcgataaccgtaacaggcctaggcatatatgttgcggatcgggtctgaatttcagacctggcagagattctactgagattatttcaggagagatattgatttgtgagacatcccccgcctgcaattttgcgtggaagatgatcacttgaatcagtaatggttgtaagaaatcacaaaacattacgccgatccatgacattgctctttgaaaagttaaaacaactagttttaatatatatcatgtaatatatagttttgagacagattgcaaggagttgacacagcttttggacacttctgatgagtgacccgctttttcttctgagttagaaaattttattctttaaagtctagctttcctcgtttttctttatcttttattccacgtttaaacaatgtccgtgctgattgtcttgctaaaagccaattgttaattaatgcactaactcatgcttcttatatactagattagatccttaaagttctccgatgtgggattaattactcattaccttctaaatttcaatttctggccgacactataaggtaccgtaaacctcaagttattgtgtttatcagctttgtgggccgaaataaccccgtttaagttttttttttttttggtttctttattcattttcattttactttttgttcaaattcaaaaccttctgactggtcgagaaagtttgggtcacacttttttcgacgacaacattaagatgaggcctttgttttctgccatacatctaaagatagaacacaaacgtcaataaaagcaattaagatctctctttactgttttcccacttttcctttgagaaaactcaaaacaaagtaaacaaacaaaccagaaaaaggaatg

SEQ ID NO: 35383 - DNA, 3000 bp, Unknown
  misc_feature (1)..( 3000): 2750-1469P.txt file - cDNA_ID_3086966; gDNA_ID_2926300; Annot_ID_205676
ttttgtaactaaaaattcgaattttaagttatagttgttttgtaaatattgtttcttttgtttagtgtttaagattgtataattgtgttaaaattgttaattctaagattacactcgtagattatcatcccgtatgagtatcaacccaaactcgttccaccagataacttcatttcgtaaaattaaataatatttttattattttaaatattcttattgtaatatattaaaaatcaagggattgacctgtggtagatcttggattaatatatttaaaaataatttgtgatttataaatttatgatattgaagtatataaaaccgatatttaatgtatacctttcaataattatataaagtatattttaaaagtcaaaatttgtataaattgatattgcaacctcatgaaatcgtagtgatttacacgtagggtaccacaagctaatttttattttatttttaataaactgataaatttgttgattttagttaaaattaaaacataaattaagttatatttgttttgtttattgtttcagattgtataactatattttgattgttaattccataattttatctgttgtataatattgaccaacacccggctagttttttgtaatctaatgttgaccctgaaagaaaaatctataagcatacgcataaatggatagtaaaattaggagataaatatcattagaacatgaagtaatttacatatgaatctctatctatttttttaaggaatcaatattctagattgattgtgaggcaatatgaatgtatgcataacatttataagagatagattgtacataaaattagattttaatttggattcaattttagctttactggaaaaaaactaatctgaattacatattttaaatttaggataacgaaaatatttttttttaaagctaaaattagatctcaacgattttggtatgtttttaaattaaacttatccttatacattatcgcaaatatggtagtcattattgttcgaatacaattaatgatctgccaaaaaaatcatattagtgatggttctcattttgaatatttgcattaaaatttttaaatattggtatttaaactttgttttactatttaaaaataaataaataatttaatctagtataatgaatatttcaaaagcttgtaactattataatacgtttaaaaatatattttcttttatataattcaaatttagcttagtgatatatttttaaaataatgaaaattacttgttttaaaaaaaaagtactttaaacgtttatatcatttaaattctaattaaaatattaaatatatactgaaaccattttctagataattacaaatctaaaatccaaaaattttcttaatttattgatttaaatcattttttaaaaaagaaaaattgaagatatttatttagttggagtagttgttaatttactaaattacccatgcaaaaatattcatttagttagttttaaactacccttacaatgttgtagttcacacaatgcttcccaattaatagtatacatgtgtgatcacgagtgttcaacataaaatataatgtaacttcaggaatagaaagatattcttttttcttttagaatttgaaatctaaattggatataagaaattattcgaaccttcaattttttcagtctatacgtacttatttaatttaatgtggtacctcttttttctaacaacaaatattttgggattttccgttgtagtgaaatttatagaatcattaattaaatctatttctaccaaacgtttaagttttgctacgaaaataaataaataaatatcctccgaccatcagcctcagccacatccccaagtttcgaaagcacaagaagcctttcagcgccagagaaaacaaaattattgggtggaaaatgcaaatattgatttcctaaataattaaaattgtgcttttgagctttttttttcatcgtgctaaagtattttttcagaaacaaaacaattaaaaatagatattgggcatgtgagtgtcccatgtaaaatcagaaccgttcaaatcatcttccaaacttctatttattctcaacattctcttctctacaacacccaagcttgaacttgctttctgcttcttccttcttcgtcctttgttttaattctctcatatcacttacgaaaagaagaaagaaaaaaaacaccaaaactaaagagaaatttcgttatcactctcttgccaaaactcacatacatataatcatatatcatcgcaaaatgtcttgcctagagatttataacaaagacgtaagtaatatttaagcttgtcccttcaattgtttctttattttctttgatatattaatcagagtttgaagtaatggacctttgcttttcttccttataagattttgattatctgattaaggctcttgtttcttgaatttcatatgtgactacaaaaggaaatattttctttttaagttactcattgttatagtaaaaactttctaagcttttggtggctcaagaagagcatgatcaaaaggacatgcttagtgcaatggaaagtcacgatctttatgtgcaaaaacttagctcaacatcttttctttttcttcaaatttctttttaatacaccatactttttaattaattagctctattatatctaatcttcttaatttaaatatatagatgtaagtatttttccgtttagtgctgtcattgaaagttgagaatgattccaaatgatcttgaaaattgtgtatacgaaacgagaattacgtgccaatacaaaaagtaagagttaaaaaaaaaaaacgtttttagtttttggttaagttccggaaaatacaaaactatcgaactcatgaatcttctccatatcaagagcacaaaaggttgtagagactagtagataattaggcatataaagcatctttctatatatttatagataaattgatgtgtgtgtatcagttaattaaatttaactaaatgaaaatg

SEQ ID NO: 35384 - DNA, 3003 bp, Unknown
  misc_feature (1)..( 3003): 2750-1469P.txt file - cDNA_ID_3086970; gDNA_ID_2926300; Annot_ID_205675
aacagcatgtgatgcttttgctgacgctcgaccttgttgatgaaccgggacacgtctgtgcgacatgtatgcgagtttagagcatctcctatggtattcaatatcttgttccaaactttatatttggtgaaaaatcactccaatgatgctctatattttgttctaaaaacatatatgaacaataatttggagcaacactaatcatatcatacgaacggttcatatcactatttttatagcacaatttttgtttcacaaagtacacctcaattttatatattactttttatacattaaaaattatatatttaaatcagtatctacttatttttataaaatgtcaattttcacactaattatatctacaaagtaaacaccactctttcacattgtttgatgtatgcatgttaaatttcgtatagccttttcaatagtttatattgttttgaacgttctctccaaaatggactttcttatagccttctcaatagtttgctctaagatgatgatacttaaataaaaatgtattaatcatttgatctctgatttatgtattgtaatgaaattttattagatatttgttttaaaataaactatctatgtagaatttgtaaacttcaaaaataaaggactatgtgaaaaatttaaatataatatacttagaatatttgttttagagcaaaaaaaataaagcgaactaacaaactatatatagagatctctagatttagagttaaaaataaagtcagccataggaaatggtattaaggaggtatatataagatggagacggagatgaggaacgagatggggttaggagtgaagaagagaccaggattttagttggatcgtggttatgatggaagctcatgtgtttctatctggtaataagtcagcttgtgaaattgctcggttgattttgccaatcttttgtggtagtgaaattaggaagatgtgaaaccgttgactatctgtcatcattgctgaactgaagtgaagcacatattttttttctctttatttttttttgtggagaactgaagcacaacgttacatttgtctagttgtatttgtttactaatttttttttatagcattcaaatacaaattatttttattattcttgtttttgtttggaaaattgccgacaagaaaaagtttaaattatcaccacaattgcattttttcttttaatctgggtagagaattggagttgtatgtaaaaactaatttcagttaccctatttcttactaataagattaaaaatatactaatcgatagattaataattgttaattatcgatttcgttaggaaatcacaaattcaatcaaataacaaaggaactaataaaatctgttatagaagggacatattttcttggtttaacaccaaatgggcttataaacaaagtagacattttttcaaaaataatttgagaaataggtagtttttttagaaatttgtgaaataaacattctttttactttttgtgagatagagtttatgtgtaataagctaaaagacaaaaattttgtcaaataccactttaccctttactttatatgagaaagttttattgtgtttccaattttatagtatttaaatatttagactaattattatattatagttaaaaaaaaatttcatctttatttttttgtattaatatttgttaacttccaaaacaagatgatttctatatattcaattatcaatctcgtacactagcattaaacatagttttgtacactaacacttgtataccaaattattttatccaacaatatttatataatatatcctaaatcgttaaatgcaccgactttgactcatatttattaattaaagtaatgattgttcataaatttatattaatatgatgttgtacaccatcatgtacatcattaaataaccatgatagtgtactaatatttgtatacttttatgtacactaatctcgtatactattatttaaactttgttttgtacattatcacttgacaaaaatggttctattttttgtatatggggtgtacaaagtaggtgaaggtatacggtattgtagatggtgtacgaggtgatatatggtatgactcattatctcatcatttcatatatactattaatattatgtacaccatattttatatcatctccgtataccattgtattatatagttgtacaccgctatatattgtcgtttgtacaccactttatacattgtcatatatcgtattacgtgtattacttcttagatcaatattattcattttctacatacactattatttgtacaccacttttttataatatcgcgtacaccacgaggttgagattaaataaaagaaaatgttacatatttatgatagataacaaaattagattttttagattcatataaatcttttaaagattatatgtttttatggtaattattttaaaaaaaaattatagcaaaacaaactaaatatgtataagtaaaaataagaaaaagaaaaagtaagttttgtctttatttgattacatgacaaaacaagagaaggttataaaggtcatttacaaattagagaagaaaaagaaatgtgtctattctccatatttataaaaaaaactacctactttacaaattatttttgtaaaaagtatctacttcacaaaatatctcaatcatttaatctgattttagaccgacattataatcttacctttcacacaacaaattcgttcatttgttgaaattttgtacatttccatttcattaaaactttatagtatatactataaacagacaaaagaagatataatataaacttttgtatatgcgaatttaggtgagaaaatattcactggttctctctgactcagagggttcagtgtaactgtctaccaaacaaacaaaccaatagaagaaaccaaaaccctctctctctctctttctccgcccctccttctctgtctctcctctgcatctcctctgttcctcaggtttctctgctcatg

SEQ ID NO: 35385 - DNA, 3003 bp, Unknown
  misc_feature (1)..( 3003): 2750-1469P.txt file - cDNA_ID_3086987; gDNA_ID_2926300; Annot_ID_205670
cgcgatggttttgagtttttttgtgttgttgttgttcttgtcgccgagaggaaggggatgaaaaatccaaggatgggaaaatatttgtttggaattttgctgtgtcatacaaatgccagctggcaatttaaatttgaagatgaagtgacaagtccaatgggtagataggccattttagtttttcaggagcccaactacgaatacgtgtgtcgttgaataatttcagtttacagattctttatcctttctgatttctgtcggcaattaaaattagttttgtgtggaatggaatgtactacacatgtctatatgtcctaaagactccaagacattacaaaatacaaagctttagttttatttttttgaagttaaatttacaagcacttttaatatttacgtataaaatcttttctgaaaataattgaagatttgtgtagtccgttcgatttgtttacaaaaggaagctatgatagagcgaaattaacacgaaaatgaaaatgctttgttcatcgcctaaaaggcagcttaaaggatttgtctatcctacgaaattgtcacgagctttcacgaaccaagactgttctgtgggttaaacaatatttttatcgagaaaacgtattttgtatgtttatgatctgcgttaaatatcttatcaattttttattaccttgtccgtcaaaatatccaaaaaataatttagaaattcggtttataaaaatgttgttttcaaagtttaattgttagaattgataatctcataatgatcatttcgaaaaaccaaaaaaattatcacattgtatgaaggattttgacaaaattttattcggaaaatcactctcaacaacataaataaacaaaaaaagtttgttttatataaaaaaaatcagtataaataggtaaatgggattactttacacactaaaaagtaccaatttgagttaatactaagattttgggttggacattaatacatcaaagtcaccgattctcatttgaacaacttcacttctccgatcaacgatcaataaacgtaacaatcactccgatgttcctaaaacaccaaaatgataaagcgttagctctcgagatgagagaacttagttatgaattgtttttgggtttttagatttttacaaaaaattagtagtcagattagtagtcggaaaatcactctcaacaacataaataaacaaaaaaagtttgttttatataaaaaaaatcagtagtcagattactttacacgcagtcagattagtagtcggaaaatcactctcaacaacataaataaacaaaaaaagtttgttttatataaaaaaaatcagtagtcagattactttacacgcagtcagattagtagtcggaaaatcactctcaacaacataaataaacaaaaaaagtttgttttatataaaaaaaatcagtataaataggtaaatgggattactttacacactaaaaagtaccaatttgagttaatactaagattttgggttggacattaatacatcaaagtcaccgattctcatttgaacaacttcacttctccgatcaacgatcaataaacgtaacaatcactccgatgttcctaaaacaccaaaatgataaagcgttagctctcgagatgagagaacttagttatgaattgtttttgggtttttagatttttacaaaaaattagtagtcagattagtagtcggaaaatcactctcaacaacataaataaacaaaaaaagtttgttttatataaaaaaaatcagtagtcagattactttacacgcagtcagattagtagtcggaaaatcactctcaacaacataaataaacaaaaaaagtttgttttatataaaaaaaatcagtataaataggtaaatgggattactttacacactaaaaagtaccaatttgagttaatactaagattttgggttggacattaatacatcaaagtcaccgattctcatttgaacaacttcacttctccgatcaacgatcaataaacgtaacaatcactccgatgttcctaaaacaccaaaatgataaagcgttagctctcgagatgagagaacttagttatgaattgtttttgggtttttagatttttacaaatgattcttgatgatgatggaaataatctgctcatgactcttagtctcttatagcttctaacggccttctcacatctgcccgttattagcctccatgcgtcatttctaaatcttttttattggtcacttgattccacacttgccaactcacacctgctgtggttctgcaacagacatgactggaccggactaaataaggtcaaaccgtatcgggtttggtacacacgtggccgatcatcatcaaagggcttaccaatattacgatggactcgaccacagctgatagaagttccgatattacaaaaacagaaagacagaagggtttacctatgattaatgtctgaaaaatttgatatttgaagcgaatcaacaacaacagtcgggttcgtgaaaaaaaaagatttgatcggctaaacttggtcggtatgattctcatctatctggttgaaattcttcaaattgttgctattgttgtgtgattttcccctttttctttgaactttggatccgtgtgaaatcaattctggcgattgggattggtatcactgtatcagtaatatcagattttcttcgaatttcttggaagtagttgagctttgtcgaattcaaaccttcttcaaaaaagaaaagaatagaagaatgagaagttttctcaaatttttggaaaataattatttttgtcacagttagttagcgaatggagaagtagaaaaatcagatatttagtgatactttcttggggattcttttgatgtttaattgaagattggctcactgattttatctttgaaggtcttagtaaacgttaatagcttgacgttatcattagaaactcaaaaaacttaagtctctctctaattattagctttcaggtttatcgtggaaggacttgtcaatg

SEQ ID NO: 35386 - DNA, 3000 bp, Unknown
  misc_feature (1)..( 3000): 2750-1469P.txt file - cDNA_ID_3086991; gDNA_ID_2926300; Annot_ID_205669
gattcgcttcaaatatcaaatttttcagacattaatcataggtaaacccttctgtctttctgtttttgtaatatcggaacttctatcagctgtggtcgagtccatcgtaatattggtaagccctttgatgatgatcggccacgtgtgtaccaaacccgatacggtttgaccttatttagtccggtccagtcatgtctgttgcagaaccacagcaggtgtgagttggcaagtgtggaatcaagtgaccaataaaaaagatttagaaatgacgcatggaggctaataacgggcagatgtgagaaggccgttagaagctataagagactaagagtcatgagcagattatttccatcatcatcaagaatcatttgtaaaaatctaaaaacccaaaaacaattcataactaagttctctcatctcgagagctaacgctttatcattttggtgttttaggaacatcggagtgattgttacgtttattgatcgttgatcggagaagtgaagttgttcaaatgagaatcggtgactttgatgtattaatgtccaacccaaaatcttagtattaactcaaattggtactttttagtgtgtaaagtaatcccatttacctatttatactgattttttttatataaaacaaactttttttgtttatttatgttgttgagagtgattttccgactactaatctgactgcgtgtaaagtaatctgactactgattttttttatataaaacaaactttttttgtttatttatgttgttgagagtgattttccgactactaatctgactactaattttttgtaaaaatctaaaaacccaaaaacaattcataactaagttctctcatctcgagagctaacgctttatcattttggtgttttaggaacatcggagtgattgttacgtttattgatcgttgatcggagaagtgaagttgttcaaatgagaatcggtgactttgatgtattaatgtccaacccaaaatcttagtattaactcaaattggtactttttagtgtgtaaagtaatcccatttacctatttatactgattttttttatataaaacaaactttttttgtttatttatgttgttgagagtgattttccgactactaatctgactgcgtgtaaagtaatctgactactgattttttttatataaaacaaactttttttgtttatttatgttgttgagagtgattttccgactactaatctgactgcgtgtaaagtaatctgactactgattttttttatataaaacaaactttttttgtttatttatgttgttgagagtgattttccgactactaatctgactactaattttttgtaaaaatctaaaaacccaaaaacaattcataactaagttctctcatctcgagagctaacgctttatcattttggtgttttaggaacatcggagtgattgttacgtttattgatcgttgatcggagaagtgaagttgttcaaatgagaatcggtgactttgatgtattaatgtccaacccaaaatcttagtattaactcaaattggtactttttagtgtgtaaagtaatcccatttacctatttatactgattttttttatataaaacaaactttttttgtttatttatgttgttgagagtgattttccgaataaaattttgtcaaaatccttcatacaatgtgataatttttttggtttttcgaaatgatcattatgagattatcaattctaacaattaaactttgaaaacaacatttttataaaccgaatttctaaattattttttggatattttgacggacaaggtaataaaaaattgataagatatttaacgcagatcataaacatacaaaatacgttttctcgataaaaatattgtttaacccacagaacagtcttggttcgtgaaagctcgtgacaatttcgtaggatagacaaatcctttaagctgccttttaggcgatgaacaaagcattttcattttcgtgttaatttcgctctatcatagcttccttttgtaaacaaatcgaacggactacacaaatcttcaattattttcagaaaagattttatacgtaaatattaaaagtgcttgtaaatttaacttcaaaaaaataaaactaaagctttgtattttgtaatgtcttggagtctttaggacatatagacatgtgtagtacattccattccacacaaaactaattttaattgccgacagaaatcagaaaggataaagaatctgtaaactgaaattattcaacgacacacgtattcgtagttgggctcctgaaaaactaaaatggcctatctacccattggacttgtcacttcatcttcaaatttaaattgccagctggcatttgtatgacacagcaaaattccaaacaaatattttcccatccttggatttttcatccccttcctctcggcgacaagaacaacaacaacacaaaaaaactcaaaaccatcgcgaacatcgaagaatcatctctcaacaattctccgtaagtttccatcatcttcttcttccactctctcaatctcgtgcttcgattgcgtaatttcgattttgttctcccgatctgaacttattcgttcgtaattttgttcacggaaaaaaaaattggtggaatcatttctcttagattacgagatatctctgtgatttggtcgttttttatgtcgattagagaaaattaattggtgtatctctcattctcagctctatgagaggcttgattcgtgtgtatagcaattgaatttgggcaggacatcacaatttcattgaagtttgatttttagtcaaaattcatttcttagttttgatgatattttagatagaatctttatcattgatctatctttgggattgttattatgaactcattgaaatttagttttttgttcttttaggataattctttggactgatgaattaaagggaaacgctgagtgtaaatcatacaacagttctaagtcgtgaaaacaaaaaaaagatg

SEQ ID NO: 35387 - DNA, 3003 bp, Unknown
  misc_feature (1)..( 3003): 2750-1469P.txt file - cDNA_ID_3087012; gDNA_ID_2926300; Annot_ID_205663
atacaaatatttggcgatgtccatatactagcacctaagaagtaaagtccttgtattcgtattacgttaatatttcaatttttaatgttaatttgaaatcatcccgaagaatccagagatcttgaacgttgagtatgtggtttttaatttttaatcagtggtaaatatttgtgaaccacaaaaagtaaaaagtccatgtctagtttttgaattgttaactgttcatattacgaagttgtttatataaaataccaaaaaaaggagatattttagaatatctcatatggtttttgttcacatacattttctttgtttttgcttgttctatctctctgtctttaatgccgttctcgactctcgaaccgatcaagcgttgcactaacatgtgccttcgctgaccgatagagctacaagagttaggcaccacaatctcatcttttaacactaaactaacaatacaagataaagtaacatatatctgaataaagacaatttatatgtataataaactagtgtactggaaagaaacgtttaacataagtacataacatatgattatatttaatgatgctgagaacaaaagatacttaggaataaatctaatgttcatcgttataagttataacacaaagcattaaaaaaaaacgttatacttaagtcccaaattttggatctaaccattaaggttgctcttagaacacataatattctctgttgttaccttgttctctatctgctttgatcaagcttcgtcatcacgttgcgcactaatgtgcaatcgtagaccaacgggctacaaaagccaggtgcctcaattgctaaattagatgaatctgaacatttttgtcaaggaatttaggaaaagtgacaagaaaagcaatattaaatcctatccatatccattgaattgaatgcatttaaaaatttagaagttttaagatttcaattctccaatgacgaatctataaactatctcctttctttatatgtaatgtttataaactatcttctttattttattactttgtttttgttaaagatatattaccaattttagttattattgtctgcttctcagctacaaaattgttttcctaataaagaattaaagatcttatccaatgtccacacgtttagtatttttctccatctacacaaaaaaaagaaaagaaaagaaaaagatattttagaatatctcacatgtgaaatgatcatgatcaacttctctctctgtctcttccatgccttgctcgagcatcgaacctaccaagcgttgcacattaatgtgccttcgctggccaggagagctacaagagcttggcgctgtctctgcagcacatagctaatttaaagttgattcgtcaaatccagcaaacttagttatagaataaaacattttttggcgttttgccaaggaaaaaaaaggggattagttggcttcaaataaaccaaaattagctaaatgttcatagagtaaataagtgaatgatcaacagataatatcattatgcatggagtatgatcaagaatacagactgaaaatttatatttactcaaaatgaaacaataaataatactgtcgaaatgaaatttgatgctaaactaagaagtatataatgaagaaaacaagtattatcgctagttaatttttatatgattatggtgttaaaaaataaaaataaaagtatataaacacaaatattgtatattttcgtgaaaattttaaaagaaaaatgttctaaattctagatttcttaggttgtctgctaaaataatgttagcaggtttcttaaaaccaaaaaaaaattcataaaatttacttgaaagcatgatgatagctactaaaaaaaattcataaaaagatatttaaaaataccttaaatgtttatctttatataacaacaagacctctgctgctgctatgctttcactggctctctcttttctcttttcgcccagctcgagcttcgaactaatcacacgttgcacattaatgtaccatcgcagaccagtgcgctacaagagccgggcgccaaagttacaactttttactaacttaaaaacctttggtcacctatataataacttcaataattcttttctatttttgagtcaaaaacataattcactccaacagtagtagtaattactagagtttctttgagttttttttaataatacaacaattaactttaccattttatctttttgaaaaaaggtttaccattttttacttcttgtagagttgtagtagtattatcatagtatggtgcatgtgtgttactgtgttaggtgtgtattgttttgtatatacgaaataaatgtttggaggcttggaaaatttttcaaggaaaaaaaaatcacatccatatgaccatatctattaatgagcaacactcatttcatcatatagatgccgagtgatcatttaatacactgtaagaaaatttaaagctttctgattccaaaattctcaaatctttttattacagtgtctttcatattcactttcttacaaagattattattaccaaatttagttacatgtctgctgctgagtttcaaataaattattgtcttaataaagatcttatcctatctccacacacgtttcctcctttttatttctcactttcaagcttagaaagaatattcttgttcgattttttttctcccgaacatgatctttcaatctcaacgacgatttctcagtgactaatactacatttgtatacattcttcatcatcatcatcatcatcatctgtgtttttgttcatattcatttttcagttatcgttttcaatttttaaaactttttttcttgggtttcacaaaatttgtcgttaatcgatgaatttgattgttttcaagatcacccatctctcgaattcacgaaatctctcagcttttccgtgattcttggtaaaaattcacaaaatcgaaattggagaaagaaagaaaaaattagggtttgaggaaaagcttcgatttttcacacgatg

SEQ ID NO: 35388 - DNA, 3000 bp, Unknown
  misc_feature (1)..( 3000): 2750-1469P.txt file - cDNA_ID_3087016; gDNA_ID_2926300; Annot_ID_205662
tggaagagacagagagagaagttgatcatgatcatttcacatgtgagatattctaaaatatctttttcttttcttttcttttttttgtgtagatggagaaaaatactaaacgtgtggacattggataagatctttaattctttattaggaaaacaattttgtagctgagaagcagacaataataactaaaattggtaatatatctttaacaaaaacaaagtaataaaataaagaagatagtttataaacattacatataaagaaaggagatagtttatagattcgtcattggagaattgaaatcttaaaacttctaaatttttaaatgcattcaattcaatggatatggataggatttaatattgcttttcttgtcacttttcctaaattccttgacaaaaatgttcagattcatctaatttagcaattgaggcacctggcttttgtagcccgttggtctacgattgcacattagtgcgcaacgtgatgacgaagcttgatcaaagcagatagagaacaaggtaacaacagagaatattatgtgttctaagagcaaccttaatggttagatccaaaatttgggacttaagtataacgtttttttttaatgctttgtgttataacttataacgatgaacattagatttattcctaagtatcttttgttctcagcatcattaaatataatcatatgttatgtacttatgttaaacgtttctttccagtacactagtttattatacatataaattgtctttattcagatatatgttactttatcttgtattgttagtttagtgttaaaagatgagattgtggtgcctaactcttgtagctctatcggtcagcgaaggcacatgttagtgcaacgcttgatcggttcgagagtcgagaacggcattaaagacagagagatagaacaagcaaaaacaaagaaaatgtatgtgaacaaaaaccatatgagatattctaaaatatctcctttttttggtattttatataaacaacttcgtaatatgaacagttaacaattcaaaaactagacatggactttttactttttgtggttcacaaatatttaccactgattaaaaattaaaaaccacatactcaacgttcaagatctctggattcttcgggatgatttcaaattaacattaaaaattgaaatattaacgtaatacgaatacaaggactttacttcttaggtgctagtatatggacatcgccaaatatttgtatttgctcaattaacgtaatctactagtgcgatttatgagtcacttatctttacaaaaatattaaagaaatagatgaacaaatctatatatacatttttacagctattttagcaaataaatcatgaacttggacttatttacaatctaatgtcattagcattaaatctttttttaaaaataattaattttattttaaatttttgatttaaattgtcaatcacattatcaatcaaatttaatcccaccaaacttcaaatcaatcctttaaaattagcataaacatatttgctaacaatattttaaaacaaatttttttgttaaataaatattatttttactgaacgttttttgtttaaataaataaattttgtatttgaacttatttaatatgtcatgtcactgacattaattatttattaatgaaaatatttaattaaagatttaaatcttctaaatccttgcttttagagttattatgtcattaccttataagcaaaaatattaatttttttaaatattattatttatatatttaaaatttataaaacattattaatatttaaacttataaaaagttcgatatattacaattttttaacatcattatataatatatagaattttaaaaaaatcttaattttttccgtcatattttataattcaaaattttaaaaataaacatatattaacaaattagcaaaaaatgtgtgggttcaacgtcccgcatcgacaaaaatatttagacaatgatttataaacatatcataaataagatcaacattaatataaataaatagtttttttacgggacgggtttggcgggacgggtttggcaggacgttacttaataacaattgtaaactataaaataaaaatatattatatatagattcaatttgcaaaaaaaaaattatactaactttaaaaagttaaattgtcaccgcggtataccgcgggataaaatctagtacaacataatttcagaaaaatatacaatagtccttttctatctcaacatcttttttggatcaaaaccaaaacaaacttaaaacaacttatcattttttaacacagtagcaattcattctttctttctatctttcttttttttttttttttgtgtgtgtgtgtgtgtgtttgagtggtaaaagtagcaattcattctgattcgagagaaccacatttttttctatattataaactcttcttaatttttctatttatcaaatatagtatagattctaaattaacatttgtttaagaaaatataacaaggtatatacgaaatataggaaaaatttaagcgtctttgtatattatgatagtaacatgatctgagtttgtaatttcatgatgtgtaataatatagttggtgtgtctatctcgtgataaactgtagtacttttttgaatatatgaattattgaacaataagataataatataatatgatggtgacaaacacaatccttaagtaatttcacatgttcttttacttttccacaaacataaaatgtaacaaaacgtgtcaaacatttcctccattcttattcatcctccaagaaactttgaacttgaccgagattagtaataatcactcgtgtatataaattcatctcttcataatttatctgccacatatgaacataacccaatctgaagatcaatcataaccttaaaccatctctcataattttagtatttctattctcaccaccaaaactcgttgatacatcacaccccaactgttgttactcatg

SEQ ID NO: 35389 - DNA, 3000 bp, Unknown
  misc_feature (1)..( 3000): 2750-1469P.txt file - cDNA_ID_3087020; gDNA_ID_2926300; Annot_ID_205661
ggaaaaatttaagcgtctttgtatattatgatagtaacatgatctgagtttgtaatttcatgatgtgtaataatatagttggtgtgtctatctcgtgataaactgtagtacttttttgaatatatgaattattgaacaataagataataatataatatgatggtgacaaacacaatccttaagtaatttcacatgttcttttacttttccacaaacataaaatgtaacaaaacgtgtcaaacatttcctccattcttattcatcctccaagaaactttgaacttgaccgagattagtaataatcactcgtgtatataaattcatctcttcataatttatctgccacatatgaacataacccaatctgaagatcaatcataaccttaaaccatctctcataattttagtatttctattctcaccaccaaaactcgttgatacatcacaccccaactgttgttactcatgtcctacagatcgatttaccgcactcttcgaccggtactatcatcttcggtacaatcctccggtttaggaattggaggattcaggggacatctcattagccacttgcccaatgttcggctattgagctctgacacgtcatctccggtaagtgggaataaccagccagaaaatcctatccgaacggccgatggtaaagttatatccacttattggggtatacctcctactaagatcactaaaccggacggttcagcttggaagtggaattgttttcagccatgggattcatacaaaccggatgtgtccattgatgtaactaaacatcataaaccctccaatttcactgacaaattcgcatattggaccgttcaaactctgaaaataccggttcaactattttttcaggtaatttaatcagaaattttaaatcttcttcatttgttcttttatttttaacatgattttgttttttcaaaaattgaataatttgatttttgagtatagaggaagcacatgtgccatgcgatgttgctagagacggtggctgcggtgccgggaatggtcggggggatgcttttgcacttgaaatctctccggaggttcgaacatagcgggggatggatcaaagctttgctcgaagaggctgagaacgagcgtatgcatctcatgactttcatcgaactttcacaacccaaatggtatgtatatatgcatgcatgtacctttttagtttattaccttttctaaataacacgtaacttgtattacatttctaatcaagtttggtttgacctagatcggttatctaatagaaacagttctaacctaaaacttttggaattgtgtaattcatttatcatttgaaccggtgtttgaaggtacgaacgagcgattgtgttcacggtccaaggcgttttcttcaacgcatatttcctggcttatgtaatttcacccaaacttgctcatcgtatcactggatacttagaagaagaggctgtaaattcttacactgaatttctcaaagacattgatgccggaaaattcgaaaactcgccagctccagccatcgcaatcgattactggcggttgcctaaagatgcaacgcttagggatgtggtttatgttatacgagctgacgaagctcaccaccgtgatattaaccactatgcttcggtaaggagttgtatagtttatttgtcaaaatgataaaacaatgtgatattggtataaaatgtaaatttcgttacaatatggaattttatgtgtgcaggatatacaattcaaaggacatgaactcaaggaagctccggctcctattggatatcattaaagattatgtgacaaagtcacaaagctgtgtatacatctatgaacatatgttgttgtggatctccatgatatttttattttatgttttcgatttatttaaaactgttattcgtttttattagctcaatatggatatttaaaccatattattttgttacgatttatgaacatagtactactcatgtgtgtgtaaaagatcatactgcctggacacgaagcggatatccggaaaaattataatatttgttttttgattcgttttaaccgaatacttgattttgtgatttgcttcgattcgaaaatttccggatatccggaaattcgaatatccgattttttttgtgatatttgcggatatctgctttgatacatataaataataaaaaaaatctgtaaactatacaagcatatcaaatattcaatgtttttatttaacatcctttcaaaataagttctaaataccaaacataactgttgttgttatcaccagtcaacaaaatgttatcaaattaattaaaacaaaaacaaaaaccgatagtttaagatgccattaatcaaaacataacataaaagaaaaatgatcaaacaaacatcttaacataaaaacagaagataacaacaatacacaaactatttatgatatttatatatagacataattatatattctaatatatatatatatatatatatatatatatatatatatatatataaatacggatcgaagcggatattcgattttttaaaaaacaatatttgttatttgcttcgatttttatgaataccatattttcttatttgctttgctccaaaatcttacggatgttcggatttttcaaatcgaatcaaatcgaataccgagtcaaagtggatcgaacgaatattttgtccagcaatcgatcaatgatactaaaaatatggaaccataattatgcaaatgtgaacatgaaacgtaattattcttttctctttgaccaagtcttctccggttcaatcatggtatttaagattcggtttcctctatcgaaccggtaaataaaccaaacttggaatttttcggacacaatccataaaaacccaaaaaacataagtagaaaaaagtacatttttttttgttttcgtcaagtagagaaagtgcattaacatttaacagagtttgtttgtctctctggacccaaacttggctgcaagaccgccatg

SEQ ID NO: 35390 - DNA, 3000 bp, Unknown
  misc_feature (1)..( 3000): 2750-1469P.txt file - cDNA_ID_3087079; gDNA_ID_2926301; Annot_ID_205721
atacgtctcttttctttagttgcttttgatatgtcattgccaaatatctgctttgatgtcatgtgaaaattctctatgttatggaatttgtgctattagttgttgttgatctctttctgttataggaattgctcgttgctttacatttggtggaagcaggaacagagtgcttcatgatcctgagatcaagccccggacagagctaaccaaagagcagtacattaagagagaggagcaaactactattaatcactttcatgagaaactcctcaagctaaagaagctgatgaaaactgaggtaagtttaaccgcaactctattttgacgcgaaaaatttgtttcgatttgagatttaatgtggattgaaaacatatcaggcgggtaaaaggagggcagagaaaaggcacaagttcatggaagagtatcttaaggagttctatgaagagtgggatgggtcaacttgaaaagttaaaaatgataaatgaagcagaaaagcagaggatttgttcaaccggattttattgagtaagcagtacctaccaaaccaatatgtggtttaggttttaaacagagtggcaactctctctctctttttattttttgtttaaggcaactctatttaaatagctcgtaataactatacatttataaatgttaaaattgctttgtttttaaaaaaagaaaactctattattttgtcaatgccaatgattgtggaagaaatcaagcaaggattacacgatagagccaatcgttttcttttcataatttttttttttacgccaaagtcagttgttgtctttttcgtaaagggttttataaagtccagtggctttttgtttgtcaactggtttaaatattgacttgctattttcgtttttaagtcttctttaaattttattagtggaagatgataagatgtcttctggatgttttagtggatcaagtcattgcgaggctatcttcggtcggccataatataacatttacctggtttgaatatcagaatatgtatattcttataccaaactgacgtgatttaaaaacgtataatgacgaaaatttagtattagtgacatttgtttgtcttttgatacctagataatagttttcgttcgttgggtaatcttcatcttatgtgttggcagttaagattcttcttttacaatttaagtctggttttgcaacaacatacacaaaatacaaaatcaggttcttggtgggtatataaaaaaaaaaacagtttcatgtgaagaacttacgttgggagttttaccaaaaaaaaaacttacgttgggagtattcgaatacaattttactaattaaaagacatagttgtttacttgtttagattataaatagaaaataaatcctttacgataattataatacgacactcctttttttacatacaattattcccttcttctatttttgtacttttgtttgaaaaccaattaatatttggaaagagtttgcttcgtacacaaggaaattttgttgaatttaataaaaatatataataatcgagtggactgttcatgtttagccaagtcgtttggtttgtagtattaaaaaagactaattaatcgcgtatagaatacataatctattaccattcaacataacacatgtccaacatccattgagttagacactttcgtcattcaattcatcgattaggtcggccattacgtgttcgatttgtgttttaattaagaaaattagagttatcaaaattaaaacgtttaaatttaaatatacaattacctacgtaaacaagggagtttcagaactaccatacggttaatttttgtcggagggaagaagacatcatgataacttttgatgtaaggtcggagtcggagtgcctttaagcgtgagatcatctcattctcactgagatgcgtgtgcatgcgttatgtggtcatttctgcatggcctaacataccttagaacggaaagtgagatatgttggcacagtagaaattgcccatgaggtttaatagtaattttgacatttccatacgtaagattaatcagcaatctacatacttacgagttacgaataaataataaatgtcgacattcctattgattttagaattagtcgttttttatggaagccggagccggaccaagaataactaatatatattcgattcgatcatatcgtgaattatttatactgctcctaagaaaaaatcatcatcgtgaattatattatatgggtttaatgtggacccaatatctccctccatgtgtttaacgtgcatctctacgagactacgacattccatcgtaaggaaaaaaaagaggcactagtcgatttactagtaattttactatagatacagtttttatccggttaaaaactaatactatagtcttcatttaaagaaacatatgtagaatttagaaaattaattctcaaagtttccgacagaaaggaaaaagaggaaattgccttttacagaatttaaaatcatttgacaattagaaaaggtgaaaagtaaaactttacatagtttgatgttatatattaatcttaaagaaaaaatcaaaagacgcaaaaggtaagagcctttcttaacgagtaacgaacgaggtactccagaaacgaccgcgtatcagaaaggctataaataaaaggcaaattagcgcccaaaaggttaacaaaataaaagcgagaagctaaaacaaaataaatttaccatatattaacataacaataacaaacgggtctccgacttggtcacatccttcgacggctccactcttcttctctatcttcttctccgaaatcgtctttgtcgtcgttacctccacctccagaattccgaaatttctgggaatatcgattttgatttctatttcttcacgctctaatttactcgtctgctcggctgtttctctgtattggctgattcgaaatccggggtcaaaccgggtctgagctatctccaggttcggaatttacagattttatctggtctgatg

SEQ ID NO: 35391 - DNA, 3003 bp, Unknown
  misc_feature (1)..( 3003): 2750-1469P.txt file - cDNA_ID_3087096; gDNA_ID_2926301; Annot_ID_205713
cctattaacaacataataaattttattttatatatatttccagccacctaaaagaaatacatatgcttctaaaatggagtaaaattaaagaatttagatgcttaacacgtgtactgtttgaaaatcacaaagacaacttaagaactccctagattttgtgttaaatgacaattcacaagagtttaggcaacgtcttaagtctatgaaccacatattaatcactgtttaaagtggtccctaatcctaattcttgtcccaatgtccccacttattcttaattaactacacttttaatcaattctgtgtgcgtgtcagtgttttgtcgctagaaacattcggatttatgtgtaactttacatttagttagtctcgatcttgttaaagatacttgtaagtaattatcaaatggtttaagatagtgatcagaaagaaaaaagaggagaaggtgggagagcaagttggagtaaatgacaaagtttcatggagaccaagaaaatgtttgctatccaatgatgtcacttcattcggtaacatgaaattctattggtaagtgatgatcattttatattttattttacttacacatcttgtacttgtaagcaagttgaccgatccatagaggtgggatgaattttttactatggatattgcgaagatgtattatctattaattgattacaaaaatgaaacactaaaattaatatctggaatcagaatccactagatccgaatatatatatatatatgttcgcagaaaactgaaagtatttcgatgctaaactaaatgagagttttcaaatacataaaattttatgttaacgaaaaatgatctactgtatatcgttcatgagtataatgagacaactacgtttatatataagattatttcacgagacaactccgtttaaacatatcgtcatgtattcaatcaatatatcaatttaaacacacatttttgcttactacaaataataatatcttttcttaaaaatacattttgaatgcgatttcgctactaaacaaccccttttgaaaccataagaaaatgtgcttcttaaccattgactatcaaaatgtaaaatccggaactccttaaaactaagagaatctgaatctcttggatttgttacgttatttgatagtgatacttgtctaataaattttaacaaaaaaaaagatacttgtctactaaatagatactagatatatatcatatacactaattttttttaaaaaatgttttttaaacttttatactcgcatctaaaatatggtaatggcctttaaaagtcaacccgacctatttggaccgacagaagattgccaaaatagcctctgttctcagacacgtgtacatattattcctctgccatttacgtgtgtatgacatggcgatctttggttggatattgtacgtgatttggagtggtgtaggttggcccacaacgttttcttcataaacgaaaaagcgttcagtggtttagtttttttactcttatttataaaatttcactttccatctgtctactgtctacttctcaactcttttttcagtacgtaaaaatgtatactttaatacgtttaaatatacacttagatctcatagtctagataatcgagagtagaaaaagaactcaagaattcgagagttttaaaaaaactcaatagcttttgtttttacgttgggttttcaaacttcatgcaagtttgagtggcgattagctaagcaatggatattagtcaatagtttgtattttttttttgatgtaagttacaagattgaaaaactatttgccctaatatataagggttaaagacttaaggggacatcgacacgagatcttttcgtggattttccttatttttttcgttctttctttctgactcttttcctttggattttctattcattctttgaaaagaacatagcttctatattaattttccaattttaataatttttcccatattctataagactatagtggatacataattggcgagcaataatacattgcatagtcgatcttcctaaacttggatttaaccggcttgtctatactctactatctttgacgtttagtttgtatcattgtatgttatgagttatgacactgaattgacataaatgttatccgtctaggttaaatgcattctccaaaaccaatattacacaatgttacagaataattattctccaactttctcgattacagattaagaagagactaaagccttataaatataagaattttggattagaatcagataacacaatttcatttattcaatcgacaataaattgagttactaattaatatctgaccgaacaaaataaaagtgaaaaaaagaaagagaagagcaaacgaaaaaaggaatgtgaatactagtcccaacaagttcatattatatatgtaattaacaaaattcatgagaaccctctccgtgtccgtgtgtcaccatagtaaccattgaatgtaatgaatttctagggattcaactagtaaaaacagatcaaactttagtctatatatcgttgagttggctccactgtgtatgagccgagatcaaagccgtgacgttctctccgatacatgggttaacaattaattaactaagttttttggggcttaaacttttaatggtaatacaattaatttatgggccatagaagaatgttggtggactcgtttgcttacgtggggatgtgtgcattaatgtgggtttgtgagttgtataaagaagcaactgtgagataacatctgaacacaaacttacaagaacagtttaaaagtttttttcttacttaaaattctctcttttaagtagtcaaagtttggaacttgaacaccataaaattcatcaattttactccaacttgtctaaaaatctaatcttttttgatcactataataaccaatcttgattcatcaataactcgagttgagaaatatatacattgatctctctgttacagtcaattgtcagaaaaaaagaaacatg

SEQ ID NO: 35392 - DNA, 3000 bp, Unknown
  misc_feature (1)..( 3000): 2750-1469P.txt file - cDNA_ID_3087100; gDNA_ID_2936558; Annot_ID_194314
gcctctttgcttcattatcccttcctctttctcaatcatcatttgcttcatatgccatgataataattcttttggattaagcttaagtagatctcttaaagcttcacttgtcaataggcaaaaatcttctgtatttagtcaatggaagacccatgagagttttaaccacacgtatagaaaatagagaatatgataacttctcactataggtatgcatgtaaaaccatgacgtcaatgatataactatgacatacttcacatcccacaatgagaaaactaatctgccacaaatatattatggtttttggttaacaacagcaattatacgagcttgaatgttttctatttgtattgttgtattctttgttacagttggtaattgtatcaatcgatatacatgaagtcactttttgtttttatttaagtgtttttttcttcacattttgcttatgttttgcttatattttgcttattttattttataattaaagagtttatgtatatgaacgccaaatatattactccgcctaattccagcagtgggattgagaatgctaatatcaaaccccctaaaaatatgttaaagatggtctcaattatcgtggacgcatcgtccatgtcactcagcgacaagagaagggacctctctcgtttgtacacaacatataaaaatccatcagagtatctaaatagcttgtggagaactctaacgatgattccaactacaactgcactaacaagtctgtcacctattaccattagtagaaacacctcggacttcaacaaagacattcccaaaactagcttactgcgcaaggaacaaattgaaatggttatgattatcacagcagtgactgcaaccataagaaaccattcaataaacttccaataaacaaagaattttttttcttctccatcgttgaatatgttttcatccaacggttctcttgaaatccaagaaaacaatctcattctttctattcggtacaaatggaagttttcccgataaacgggaacgattcctcaatgttaaaaagctaaattgtccttcagtttgatttccagttgtagcattctcaatatccatcactgttgtccaatactattccaattcaactattcgaagaagaagttttctaacctaagtggagggaggggtttgatgttccaagaagtaaagtgtgtaccttaatttttctcttatcttgcactgagcctgagattgctttgcaccaagcaatctgttttccaattttctttcttctttgctttgttttcttttcttttctttgttgtaaacgtttcgtactgtgcattccaagttctttttttttttgtaggcttccaagttcttttttgtaggcaaccaagttttatttgattgcttagctactatttctttttctggtaactgtgagtaactacttctcttaaatgcaaattttcaaatgttcgcttatgagataccattttcatagcgcttactatttaaagaaattttcaccttagtgatgaattttctcttcaccagttggcaaagtcaagttagactctcaccaattagccattaatatattttaggacaaaatacccttatcagtgaactaagtgtacaacagacgtgtaccgactagtttaataatcaagtttgggaagatgtatgcaagagggattcaagtgtgtttgcttcaaggcaagatcaaaatcaaggatagataaaatatatttatgattcggtttaagaaaagtttacattcatatgtataagtttttttttctttcttaaccaggcatcgtggtctggtggtaaaggaacctcgactgaggcgcccgccacccgggttcgattcctggccaccagggaattaacatgcggacttgctcaggcgccttagaccaccagtttcagggggcccttaagtagaggctcaaaaatccctgatcgcgggtttcggcccaatggactagtcagatcactgtgtggtctggacactgagttataaaaaaaaaaaaaaaaaaatttctttcaatataatttgttagattcaaaaaacgagttttgcagcatttaaacttgagtaatgtcttaatctcaaatagaaaataatatttattatagcgtaactaactaataaatgaaatgtcttgttatgtttatgtcttagataggcactttgaatatgaagttgaatttgttcaaaactagatccattttgatagaatgtgaaaaataaatcaaatcaaaactcgatccatttctttaaatgggtaatttacggccagaccttaagatcatgttttatctttaccatttggcaaaatcatccacatttccatgttttagccataaaagcattttctaactaaaaatatctttgccagcgtaatcgatgtacaatatctgtgtacgaaatcagtgagacgttttagttaagtacaatatctagttggttaattaaaaattaataataataaccaaactgtatctttatatgattttttttttctttttatttgctgaaattatttactacagtatttctttatttatgaatttaaatttttttgaaaactttcttattaacaaatttattttgcccctatattaccaaacatatttattttttagcataatttatatttttaaaaaaaaatatataataaaaataagagtgtttgtctctacagcctaacagttattatcaatcgggccctaatattttttttaaaaatgttgataggcccaaacttaaatatatatatatatatttttttttttgtcaaaaatggctttgattatataagattataagattcgggttttagcccttttaagtcgacgttaaacgcgcgtttcagagttttccggcaggaggagcaaactcgacgacattagcttctccgaacacaattttcctccggctttcataaatttcggggttacatcgtcctaattcgtctgataggttgccgaatttgtgttctccggtcaagtcaatg

SEQ ID NO: 35393 - DNA, 3003 bp, Unknown
  misc_feature (1)..( 3003): 2750-1469P.txt file - cDNA_ID_3087100; gDNA_ID_2926301; Annot_ID_205712
tcggcctctttgcttcattatcccttcctctttctcaatcatcatttgcttcatatgccatgataataattcttttggattaagcttaagtagatctcttaaagcttcacttgtcaataggcaaaaatcttctgtatttagtcaatggaagacccatgagagttttaaccacacgtatagaaaatagagaatatgataacttctcactataggtatgcatgtaaaaccatgacgtcaatgatataactatgacatacttcacatcccacaatgagaaaactaatctgccacaaatatattatggtttttggttaacaacagcaattatacgagcttgaatgttttctatttgtattgttgtattctttgttacagttggtaattgtatcaatcgatatacatgaagtcactttttgtttttatttaagtgtttttttcttcacattttgcttatgttttgcttatattttgcttattttattttataattaaagagtttatgtatatgaacgccaaatatattactccgcctaattccagcagtgggattgagaatgctaatatcaaaccccctaaaaatatgttaaagatggtctcaattatcgtggacgcatcgtccatgtcactcagcgacaagagaagggacctctctcgtttgtacacaacatataaaaatccatcagagtatctaaatagcttgtggagaactctaacgatgattccaactacaactgcactaacaagtctgtcacctattaccattagtagaaacacctcggacttcaacaaagacattcccaaaactagcttactgcgcaaggaacaaattgaaatggttatgattatcacagcagtgactgcaaccataagaaaccattcaataaacttccaataaacaaagaattttttttcttctccatcgttgaatatgttttcatccaacggttctcttgaaatccaagaaaacaatctcattctttctattcggtacaaatggaagttttcccgataaacgggaacgattcctcaatgttaaaaagctaaattgtccttcagtttgatttccagttgtagcattctcaatatccatcactgttgtccaatactattccaattcaactattcgaagaagaagttttctaacctaagtggagggaggggtttgatgttccaagaagtaaagtgtgtaccttaatttttctcttatcttgcactgagcctgagattgctttgcaccaagcaatctgttttccaattttctttcttctttgctttgttttcttttcttttctttgttgtaaacgtttcgtactgtgcattccaagttctttttttttttgtaggcttccaagttcttttttgtaggcaaccaagttttatttgattgcttagctactatttctttttctggtaactgtgagtaactacttctcttaaatgcaaattttcaaatgttcgcttatgagataccattttcatagcgcttactatttaaagaaattttcaccttagtgatgaattttctcttcaccagttggcaaagtcaagttagactctcaccaattagccattaatatattttaggacaaaatacccttatcagtgaactaagtgtacaacagacgtgtaccgactagtttaataatcaagtttgggaagatgtatgcaagagggattcaagtgtgtttgcttcaaggcaagatcaaaatcaaggatagataaaatatatttatgattcggtttaagaaaagtttacattcatatgtataagtttttttttctttcttaaccaggcatcgtggtctggtggtaaaggaacctcgactgaggcgcccgccacccgggttcgattcctggccaccagggaattaacatgcggacttgctcaggcgccttagaccaccagtttcagggggcccttaagtagaggctcaaaaatccctgatcgcgggtttcggcccaatggactagtcagatcactgtgtggtctggacactgagttataaaaaaaaaaaaaaaaaaatttctttcaatataatttgttagattcaaaaaacgagttttgcagcatttaaacttgagtaatgtcttaatctcaaatagaaaataatatttattatagcgtaactaactaataaatgaaatgtcttgttatgtttatgtcttagataggcactttgaatatgaagttgaatttgttcaaaactagatccattttgatagaatgtgaaaaataaatcaaatcaaaactcgatccatttctttaaatgggtaatttacggccagaccttaagatcatgttttatctttaccatttggcaaaatcatccacatttccatgttttagccataaaagcattttctaactaaaaatatctttgccagcgtaatcgatgtacaatatctgtgtacgaaatcagtgagacgttttagttaagtacaatatctagttggttaattaaaaattaataataataaccaaactgtatctttatatgattttttttttctttttatttgctgaaattatttactacagtatttctttatttatgaatttaaatttttttgaaaactttcttattaacaaatttattttgcccctatattaccaaacatatttattttttagcataatttatatttttaaaaaaaaatatataataaaaataagagtgtttgtctctacagcctaacagttattatcaatcgggccctaatattttttttaaaaatgttgataggcccaaacttaaatatatatatatatatttttttttttgtcaaaaatggctttgattatataagattataagattcgggttttagcccttttaagtcgacgttaaacgcgcgtttcagagttttccggcaggaggagcaaactcgacgacattagcttctccgaacacaattttcctccggctttcataaatttcggggttacatcgtcctaattcgtctgataggttgccgaatttgtgttctccggtcaagtcaatg

SEQ ID NO: 35394 - DNA, 3003 bp, Unknown
  misc_feature (1)..( 3003): 2750-1469P.txt file - cDNA_ID_3087109; gDNA_ID_2936558; Annot_ID_194316
gtcataaattttaaatttagatgattaatgacacatgatgtgtgtagatatcaatgccccgcggttgttttgacaaaaccttgatacgcgataatcttacaagcccacgttgaaagtggaccaagtgatcaattatttgtgaaaacacgaatcaaaagtcttagtactagttaattatacatttaaattatgttgaatatctgtttgactttgttcattctacttttagtttaatttcatggaccagtttaacgtgctgttaattggaaaagaagctgggaaccagttaaagcactaaatttcgagttaccaacttaaaccaattattcatttaatcgtttgcagatgagagtgtcttgggctttcaaactatactactctaaaaccatcgagctagagctgtcaaagcgggttgtccatgtccattagcccagtccaataatgtccatttcgatatttgacaaatagtgttcatgtccattaaagcccatgtccattaatgtccatgcccattaatgcccatgtccaaatgggttgtccaatgggcataacagaaccaaattttaacacaatagtatttgctttatattccaatcaaattatcaaatcgagaagcaaatttaaataacaaagtattagttgatttaaatatcaaatccaaaagcaaatttaaacacaattcaagtattcaacaaagtatcaaatccaaaaacaaattaacagcaaatttaaacttcttcctcttctccctcgccatctttgtcttcattaaggaactcgatattatcacctaagtacaacagtgacagaaacccattattgagtaatcaaaaacagaaacccaaatcgaattgagtaaaaaggatgagaatttgcttacttgaatagattaggattctcaggaggatccatgatgtgatggagatgagttgttgaaggaactcgccggagaaatcgccggagagaagaaatcgccgaataagcgccggagaaatgtttcccgacaaaaccaagaaatgttttttgcccaaatctatttttgcccaaatcgacttaaacctaatatttttgaccattgggccgcccatgtccattacgtccagtccgctaatgtccatgtccgttaacgcccatatccattaatgtccacttcataatgggcttgtccatgcccggtccattaagcgttggacacgggcagcccacgggccgcccgtccattttgacagctatacatcgagcttttggattggagaccttaatcattatatttgaattcatatatatttttcgctaacctgttaaactaatcacatttggtgtccacacttatattttgaccctatgttactatatatatatatatatatatatatatgcatgtgcaattccattgtaaataaccaaatcgatataataaggaatgaacctcggtatgagcttgagtcttgatgttaggaagtgacgatagtctatagtgacctgttttgttatgcggttagaagagattgtggttcaaaatggtcagaatcttttggtaagattaattaagaagttgtagcattttcataaataataaagggtttatttgtataccataatactattttaagcatcaagtacatttatgtcacatctatttccggttagtttaattttattaatttcgtctgtaaaactattcataactaccaaaccccattttcttatttttttctcaaaagaactaccaacagatcttcaacggtcttgttgtcgaattatttatttactttctcggggcctttgttactttataattagaaaaaggcgatggtcaacattctccggttaacccccataatgcaaaatcttattttgggcaaatgagagggtaaaatagtcatttaaagaattccgaccggagtttctcctttgattcctcgcccctatactacgcgtcgtgtcagactcgtaactccgtttgactcaattaccccacatttttcattccatcatttcctttttcattgttttcattgtttttggctagttaacatagccaaactatgttcattatgcaactcacgaaacttaatacaaagatgaatctaataactctggttaacgaagtatattctccgttgacaaaaaaaaaaaaaaacacaaacagagaaaagtgaaatctgttgtattaagaactttgtagctcctacaagccttttcatatattgaaaattcacatatttagcaaaagaaaaaaaagaaaattgaaaaatcattcccgttttcatgtactaaaaagttttaacagtaaatatgcatatatttaggaaatgtatagttgccttgataaattggtaagtttgatttaatatgcatttaaatataaaactctttttacatatacttaatcttcaactatcattctaaagtcatacccttttaacactttatttatcctctcttttttttttttggacaactaactttattttatccaatcagcttttaaaatcttaattaacatggtttggattggacaagctaagtaataatactataatacgccacgtatatatacgacgtatccttcttctcttcacgtataaaataaaaatagtgtgttattgccataacatacgtgttttctaaaatttaaaagaaagtcatttatcatgaaaaggtatcataatcagaataagagtaatcagtttgaaaactagctagttgactaaaacagaaagaaaaatatctttacttgaaacatgtgttgagaattcacattatataaaaggaaaaaaaataaaacatgacttttgcgtagacaatccatagtccaatcaacaaaacgtgtggacggcaagggttccttctagctctctctatttatatctctcactcgccgatttttactagtaattaaccagaacgttcatctaccaacaaatcctcaactccttcttcttcactaatagtataccacaaaacctcaaaattgtaatttattagattatcgtgatg

SEQ ID NO: 35395 - DNA, 3000 bp, Unknown
  misc_feature (1)..( 3000): 2750-1469P.txt file - cDNA_ID_3087109; gDNA_ID_2926301; Annot_ID_205709
ataaattttaaatttagatgattaatgacacatgatgtgtgtagatatcaatgccccgcggttgttttgacaaaaccttgatacgcgataatcttacaagcccacgttgaaagtggaccaagtgatcaattatttgtgaaaacacgaatcaaaagtcttagtactagttaattatacatttaaattatgttgaatatctgtttgactttgttcattctacttttagtttaatttcatggaccagtttaacgtgctgttaattggaaaagaagctgggaaccagttaaagcactaaatttcgagttaccaacttaaaccaattattcatttaatcgtttgcagatgagagtgtcttgggctttcaaactatactactctaaaaccatcgagctagagctgtcaaagcgggttgtccatgtccattagcccagtccaataatgtccatttcgatatttgacaaatagtgttcatgtccattaaagcccatgtccattaatgtccatgcccattaatgcccatgtccaaatgggttgtccaatgggcataacagaaccaaattttaacacaatagtatttgctttatattccaatcaaattatcaaatcgagaagcaaatttaaataacaaagtattagttgatttaaatatcaaatccaaaagcaaatttaaacacaattcaagtattcaacaaagtatcaaatccaaaaacaaattaacagcaaatttaaacttcttcctcttctccctcgccatctttgtcttcattaaggaactcgatattatcacctaagtacaacagtgacagaaacccattattgagtaatcaaaaacagaaacccaaatcgaattgagtaaaaaggatgagaatttgcttacttgaatagattaggattctcaggaggatccatgatgtgatggagatgagttgttgaaggaactcgccggagaaatcgccggagagaagaaatcgccgaataagcgccggagaaatgtttcccgacaaaaccaagaaatgttttttgcccaaatctatttttgcccaaatcgacttaaacctaatatttttgaccattgggccgcccatgtccattacgtccagtccgctaatgtccatgtccgttaacgcccatatccattaatgtccacttcataatgggcttgtccatgcccggtccattaagcgttggacacgggcagcccacgggccgcccgtccattttgacagctatacatcgagcttttggattggagaccttaatcattatatttgaattcatatatatttttcgctaacctgttaaactaatcacatttggtgtccacacttatattttgaccctatgttactatatatatatatatatatatatatatgcatgtgcaattccattgtaaataaccaaatcgatataataaggaatgaacctcggtatgagcttgagtcttgatgttaggaagtgacgatagtctatagtgacctgttttgttatgcggttagaagagattgtggttcaaaatggtcagaatcttttggtaagattaattaagaagttgtagcattttcataaataataaagggtttatttgtataccataatactattttaagcatcaagtacatttatgtcacatctatttccggttagtttaattttattaatttcgtctgtaaaactattcataactaccaaaccccattttcttatttttttctcaaaagaactaccaacagatcttcaacggtcttgttgtcgaattatttatttactttctcggggcctttgttactttataattagaaaaaggcgatggtcaacattctccggttaacccccataatgcaaaatcttattttgggcaaatgagagggtaaaatagtcatttaaagaattccgaccggagtttctcctttgattcctcgcccctatactacgcgtcgtgtcagactcgtaactccgtttgactcaattaccccacatttttcattccatcatttcctttttcattgttttcattgtttttggctagttaacatagccaaactatgttcattatgcaactcacgaaacttaatacaaagatgaatctaataactctggttaacgaagtatattctccgttgacaaaaaaaaaaaaaaacacaaacagagaaaagtgaaatctgttgtattaagaactttgtagctcctacaagccttttcatatattgaaaattcacatatttagcaaaagaaaaaaaagaaaattgaaaaatcattcccgttttcatgtactaaaaagttttaacagtaaatatgcatatatttaggaaatgtatagttgccttgataaattggtaagtttgatttaatatgcatttaaatataaaactctttttacatatacttaatcttcaactatcattctaaagtcatacccttttaacactttatttatcctctcttttttttttttggacaactaactttattttatccaatcagcttttaaaatcttaattaacatggtttggattggacaagctaagtaataatactataatacgccacgtatatatacgacgtatccttcttctcttcacgtataaaataaaaatagtgtgttattgccataacatacgtgttttctaaaatttaaaagaaagtcatttatcatgaaaaggtatcataatcagaataagagtaatcagtttgaaaactagctagttgactaaaacagaaagaaaaatatctttacttgaaacatgtgttgagaattcacattatataaaaggaaaaaaaataaaacatgacttttgcgtagacaatccatagtccaatcaacaaaacgtgtggacggcaagggttccttctagctctctctatttatatctctcactcgccgatttttactagtaattaaccagaacgttcatctaccaacaaatcctcaactccttcttcttcactaatagtataccacaaaacctcaaaattgtaatttattagattatcgtgatg

SEQ ID NO: 35396 - DNA, 3000 bp, Unknown
  misc_feature (1)..( 3000): 2750-1469P.txt file - cDNA_ID_3087115; gDNA_ID_2936558; Annot_ID_194319
tcaatcaagtttatttgcttgtatagataaacttaatgattgtatttgtcaaagaaaactgaaaagtcattgaattatgggaacgttccaggttggtggaagtggtggacagccatttgtgctttctcaaaacttcttgcacagtatttcaaagtctccattcccagttaatactgggacaagagcagccaagttctccagttggcttttcgaacatgaaagagaccttatggctgggggtgtcactcttacttcggatttgcaatgtggtgatattttaaatttcttttcattggtttcttctggtgaactctctatatctgtatccttgcctgaagaaggtgttggagagcctggagatcgaagaggtttgaaacgtagagctgatgacatagaagaatctgaagctgagagttctaagaaattgaagctactaggcgaaggtgaaatcaacttccgaaaggaaaagggtttccctggtatagcagtatctgttcgtcgtgcaactataccaacagctaatgcaatagagttgtttaaggatgatgactctcgcactggtgaatttcatttgaagtggggagaagcgaatagtggctgtgattctgatgacatgaaagaacttttcaactctacagattctactgtcataccaagcagtctaggtgattctccctggcaagcgatggccagttttactagtagcattatgtccgaatcaacagatgaggaagttagtttattcagtcccagggtttttgaaaccgtttccaatgcccttcagaaggctggtgaccaaggtctgagcattgaagaagtccacagtcttattgatatcccaagtaagcatcaggcaaacctttttaacaggcttttatttttgcatgtgctggcgacttccttcagtgtttttatttaacctttgtgtattcatcaggccaagaaacttgtgactgcattgtagatgtacttcaaacatttggggtagctttgaaggtttgtctgattatctcttattttacaaaccctgttgcctttattaagatgaaagttgcagtgcttggtttactagttttacttacctggattgtgaactcagttcatgttacatcgttttacaagcaacttgttaaccatacaatatcttattcaggtaaatggctataataatttccgtgttgtccattccttctaccgatcaaagtacttcttgacattggaggaagatggaacttcccaaaaaagtcaacagtctctaccagtgaactacctagagagagctgttggggaacataggtccaaagatatcattgctagcagctacagtacttcacaggacatgcgagagcatgtcgctgggaatagcgttcacaaggttacaattcttaaccttcctgaaacggctcaaacgagcggtttgcatgaagcatctatcaaagctccatctgttacttttggaacgggtattgaaggtgaaacaaaggaatcaacttctgaaaagtcacctgtgcctatatatccatgggtaaacgcagatgggtcaataaataaaattgtctttgatggactagttcgccgtgttcttggtaccgtgatgcaaaatcccggtataccagaggtaaatacttctccattttccacccaataagtttttgccatcatggtttcgaactctatgaaaatactaatcgaaacattcatttgtggcaggacgagataataaacctaatggacatactaaatcctcaggtaataacaatcataaaccctaaaaacctcttctcctatggtttcatttactgaaactgatcaaaacttcttaaagctctttgtctgttgtctctatatacggtggttgctctctgataacattctgtaaaaaaatttcaatatcagagctgtagaaagcttctggagttgatgacactcgacggctatatgaaagtgagggaaatggtgcaaaccaaattcaccggtcctccgtctctgttagccggtctcgtctcaacaggtcctagaaaaccggaacttattcgccgcaaacacttgtttgcaaactccaagggactctttgccttgtaatgtctgtaaaatctctctcagtctctctagttcagtccaaaactcgatgcaataaattattaatgtttatgtgggaaattattatagttttgtgatttaaagtccacaagatcttgtatttgtatagctgtaggtgtgatgattaattctctttatagattcatagtgttggattcatatccctattataggtgagttttggaaggttttattcagttaaaaagagagcttattttttattcaactaaaaggtctcctacaagttacaagttataactaaataaagatttctatttaatttgtagacggaaaaatctccaaataagaatgaattaaatgatcaacaggatgttgtttccatctagttagtgtagtttacttagttaatcaataaaggtttgaatcatacagaatcaagaggcagaaaaaacattgtgctgaataaatttaaaaacataattctgaaacaccaaaaacgtgaaaatagtgcacactagtttcatcacctgagtaacgaaacagtttgactttttgttgacgtatttgatgtaataaatggtgaagagaaaaaaatgtaaaatattgattgcattggtctatgagataatcctacaaaaagtgttagagcagttgtgcgagagtctggaataatgaaacacagttcagtacaagtatcttttcgatcatcttccgctaaatctactgacgtgtacggctcagattcttttttccccagaactgattcaacaaacaaaacaaaaaaaatagaagaccatattttatcggtcaataaacttctgggaaaaaaataaaacacgatttcatgagagaaaatcgacaaaacccctctcaaccaaataatacaccttcttcttcttcttcttcttcttcttcttcacagctgggtttcttctaatg

SEQ ID NO: 35397 - DNA, 3003 bp, Unknown
  misc_feature (1)..( 3003): 2750-1469P.txt file - cDNA_ID_3087115; gDNA_ID_2926301; Annot_ID_205706
ttttcaatcaagtttatttgcttgtatagataaacttaatgattgtatttgtcaaagaaaactgaaaagtcattgaattatgggaacgttccaggttggtggaagtggtggacagccatttgtgctttctcaaaacttcttgcacagtatttcaaagtctccattcccagttaatactgggacaagagcagccaagttctccagttggcttttcgaacatgaaagagaccttatggctgggggtgtcactcttacttcggatttgcaatgtggtgatattttaaatttcttttcattggtttcttctggtgaactctctatatctgtatccttgcctgaagaaggtgttggagagcctggagatcgaagaggtttgaaacgtagagctgatgacatagaagaatctgaagctgagagttctaagaaattgaagctactaggcgaaggtgaaatcaacttccgaaaggaaaagggtttccctggtatagcagtatctgttcgtcgtgcaactataccaacagctaatgcaatagagttgtttaaggatgatgactctcgcactggtgaatttcatttgaagtggggagaagcgaatagtggctgtgattctgatgacatgaaagaacttttcaactctacagattctactgtcataccaagcagtctaggtgattctccctggcaagcgatggccagttttactagtagcattatgtccgaatcaacagatgaggaagttagtttattcagtcccagggtttttgaaaccgtttccaatgcccttcagaaggctggtgaccaaggtctgagcattgaagaagtccacagtcttattgatatcccaagtaagcatcaggcaaacctttttaacaggcttttatttttgcatgtgctggcgacttccttcagtgtttttatttaacctttgtgtattcatcaggccaagaaacttgtgactgcattgtagatgtacttcaaacatttggggtagctttgaaggtttgtctgattatctcttattttacaaaccctgttgcctttattaagatgaaagttgcagtgcttggtttactagttttacttacctggattgtgaactcagttcatgttacatcgttttacaagcaacttgttaaccatacaatatcttattcaggtaaatggctataataatttccgtgttgtccattccttctaccgatcaaagtacttcttgacattggaggaagatggaacttcccaaaaaagtcaacagtctctaccagtgaactacctagagagagctgttggggaacataggtccaaagatatcattgctagcagctacagtacttcacaggacatgcgagagcatgtcgctgggaatagcgttcacaaggttacaattcttaaccttcctgaaacggctcaaacgagcggtttgcatgaagcatctatcaaagctccatctgttacttttggaacgggtattgaaggtgaaacaaaggaatcaacttctgaaaagtcacctgtgcctatatatccatgggtaaacgcagatgggtcaataaataaaattgtctttgatggactagttcgccgtgttcttggtaccgtgatgcaaaatcccggtataccagaggtaaatacttctccattttccacccaataagtttttgccatcatggtttcgaactctatgaaaatactaatcgaaacattcatttgtggcaggacgagataataaacctaatggacatactaaatcctcaggtaataacaatcataaaccctaaaaacctcttctcctatggtttcatttactgaaactgatcaaaacttcttaaagctctttgtctgttgtctctatatacggtggttgctctctgataacattctgtaaaaaaatttcaatatcagagctgtagaaagcttctggagttgatgacactcgacggctatatgaaagtgagggaaatggtgcaaaccaaattcaccggtcctccgtctctgttagccggtctcgtctcaacaggtcctagaaaaccggaacttattcgccgcaaacacttgtttgcaaactccaagggactctttgccttgtaatgtctgtaaaatctctctcagtctctctagttcagtccaaaactcgatgcaataaattattaatgtttatgtgggaaattattatagttttgtgatttaaagtccacaagatcttgtatttgtatagctgtaggtgtgatgattaattctctttatagattcatagtgttggattcatatccctattataggtgagttttggaaggttttattcagttaaaaagagagcttattttttattcaactaaaaggtctcctacaagttacaagttataactaaataaagatttctatttaatttgtagacggaaaaatctccaaataagaatgaattaaatgatcaacaggatgttgtttccatctagttagtgtagtttacttagttaatcaataaaggtttgaatcatacagaatcaagaggcagaaaaaacattgtgctgaataaatttaaaaacataattctgaaacaccaaaaacgtgaaaatagtgcacactagtttcatcacctgagtaacgaaacagtttgactttttgttgacgtatttgatgtaataaatggtgaagagaaaaaaatgtaaaatattgattgcattggtctatgagataatcctacaaaaagtgttagagcagttgtgcgagagtctggaataatgaaacacagttcagtacaagtatcttttcgatcatcttccgctaaatctactgacgtgtacggctcagattcttttttccccagaactgattcaacaaacaaaacaaaaaaaatagaagaccatattttatcggtcaataaacttctgggaaaaaaataaaacacgatttcatgagagaaaatcgacaaaacccctctcaaccaaataatacaccttcttcttcttcttcttcttcttcttcttcacagctgggtttcttctaatg

SEQ ID NO: 35398 - DNA, 3003 bp, Unknown
  misc_feature (1)..( 3003): 2750-1469P.txt file - cDNA_ID_3087119; gDNA_ID_2926301; Annot_ID_205705
ggaacagcaaaaacattatgttctataaatcagagatacacatttatgaacatacccgcacaagcttgtacgtaacagggtttccaatttgatttgttgaggaaagtgatccgtttcttgtctgaaaaatactgtcttgaaacgtctctccatagtctttcacatttccaaacattgttaccctattttaacctaccaaatgcaacttcaagcatacaaaaaggcataagcaaatatacctatatgcttaataaatttttcagtcatgcaaaaaactcttacacaatacaatcactgatactcaaaaatcctagctttaccctttcatagagagaaaaatattggggatagagtataatcttattaggattattactatatatcttgtgatagagtttaggtcctatatatctctaatccctcaaatataggacctaaactctatcacaagatatatagtaataatcctaataagattatactctatccccaataaaaaacaccactgcatcttcagaataataaaaaagctttcaactttaagctaccatttatcaaatttcaatggaatttgcgtgttgcagttctcacatcaagtttttggtagattccactcagtttaactcgcatcaaacaaacccactacttaattttcaggatagaaatatgaaaagtcacgaggaaagcagttaaccgagcaacaagtacacaagagagttaccagagaaagtagaacgggaacggagaagaaaaaaatcagactttccagtgagctcgtagtttcatcggcgagaaatctcggaggagaggcttcttgactaagctaaaaaccttggatatttgcaaacttttttgttctgctttatttttttttgttttggctcgctttcggctttttttttccctaatacagtgccatacaggtccggattccaaagctttttattcactcgatttcagaatgccaattgggatccgtatagttatgcgggaagctcctagaggttgccacgtcagcgaatagcgaaatatctgccgaaaaagagccaactacgttccgtcccgactctcgtgcaccacaactgcgtgccgtcttacacttcaggattcgaatacgtgtcgtcttagtctagagttcaaaatactgcactcatgtaaaactcgcacaggctatacaacaacaaacaaacatgcaatgataacactggagaccaaaggtaagaaaaacagaagaatccttaaaccgaaatgtgtaaactttacaacaagtttcttgtaaagactcttaatcatttcaatagagatattacatttgtaaaactctcctttctcctttctcctcaatcaattagctctgaatctgaatatgaatctatgataatcaactttgatggtcttggacctcttggttacaatactaaccggatctaaatctcttctggttagctttcccatcagatttcaaagttccactagattcaccttctgatgaagcatccactgatcttgcaaaagaatgagagagatcaccataaaggctagctactcttctgatattgttgttgagctctttgatcaaccccacgtttcgacccaagttatctggttgtttcgattcatggttctgattgatctcgttgatcaataatcggttttggtccaaaatgtcttgaacatccacaaagctcttctggaaactctgcaacaatttcccatccatattgtgtctgtctccaaatcctgacaacacatctccttccattatcggctattctaacaagatcaaactcttgattgatcctttactcctgtttcaatacaatcatgtcaaaaacatggaaacaaagccaagaaagggattcaatttaacagaaaacgttgactagaaaagtagttacaataacacaatttattctctatgcgttgacctgaccctatcttgattttagagctctaatccttaaagctcacataagattccattagtacagacatttccagtaataatccaatcttaaaacactcaaattcagacaagaacccaacacgattcagctgaatagtcatgaatcgtacaaagtagggaagaggattttgttcttatgaacccaagagggaaagagatctataaagggacaagtaaaagctgttccacaaatagctttaaaacatcacaatagtagtagacacagattcagataagattcgcaatccttaacaatgcaataagacccagaaaccctaagcaaatacacagtacagaattcaaaagagttccgatccagtttccttaccttcggaagtagaaagctccgatgacagataggagatggaaatcgaggatattttctcgggaaacaaacaaagaatccttctttttcaccgattatttatatgattacaaattattggatactgtaaaaaaaaggaatctacttgtcttttgagacagagatatttgagcgaagctaatatgttctaaaaaatgccatttataaaaacgatatatttttctgtatttactctgaatcacgctttttgcagagagagatacggaggttagagaagccagacatctggatcgaacaaacccgacccgcaaaagattcgtgttgtttgtgcctaattcgcataaacagcatgtcgtttcgattggaagtaaaaacggcccgtagtttagaagcgtgaggaatcaatgttttaacttgctgacgtatggccattctcgtcacttactttgtctcaccccctaattaaattacctcgtaattatttcgcagttccttgagatcgatcccgtcaccaagaactcgaatatctctttctcttcgatcgtttcctcttctgatcccgccatcttcgcctaactcccaaatctatataaattattccgacacctctccggcgagaatttccggttaatcggctgactaactaatttatcggcggaagattttccgttgacctaaacctaaccgagtaccttttggatgatgagaaatg

SEQ ID NO: 35399 - DNA, 3000 bp, Unknown
  misc_feature (1)..( 3000): 2750-1469P.txt file - cDNA_ID_3087123; gDNA_ID_2926301; Annot_ID_205704
acgattttcagctttctcaggaaaccgatcagaacattcggacccagcattaccagaagtccaaactcgaaatactctagtcttcttgtgactttctgcctgtaaatgcatcccgacttttaaacaaatactataaagccgagagtagctcttcttcttgtcaattccaagtctttcacatacctggtggaaataatatttaatgccttttcaaaaaaattcagccaaatacataaggtaataccaaaaactgtaaggcaaacccatcaaatgaatacctccatcacagccaagcctttagatccttcagcatcaaccatatcataaatttgattatctattggaagctccaaagtttgttctgttttttgaatactccttccgaattttaggagttgctttttcccagagtagttaaaatcttttgctgaaaatctttttaacaaacggaggcatcgttcaacctgcagaaaagacaatccaaatattttatagccaaataaaacagatcagaaatgctaaataaaggcaattggccaccatatgtggtgaaatgtattcgcatgatggaatgtgatgcagattatagttcaccttattgttcaccacagcatcaaactcctctactacatgagaatctgtcaaccggcgacaaacctgatgtaatccaaaatgcacacgtattaatttttcaaagatatatctaccaaaaagaaattggcaaagtgttgaaagtctctttcctcttgctctataagagaaaaaagaaatatatacttacacttctccaagctctatgccttgaatgtgatcccagataaccgaggtcttgcttaatgtccgagacgactagaacctgcactacaacaaatgagtatagagaaagaatgctccagcttgataaaaaaagaaagaaatgatttgcacttactaaccttctcattagtttcttcaagcttatcacaaattgcctgcattgctggtagaaaatctttaatgagcgtatcctcttttgtactttctgattgtaaactatctccggcgggagtagcctcttgctccaataaagagtcctctttgcaaatctcaaatctctgctgggaacccaaaggcttggcgtaacgacttaaatatatcatattggtgctaatgcatgaggtggttttggaatccccttcaccatcaacttcctttgttctcactatcgctggttgtttaacaactaaacctcgagactcaaggtgcttcacaatatagaagaagtttctaccttcgataccaaactctttagcaagcagattttgtgcaactccattggctctgcatcaaacacatacaacataatattatacgagctcgaactcttaagagtagctagaagagaatacagaatttgcacttaccgagcaacagcaagccgctcgagaacgcgacgctgaatagcggaaatagtcgtgttattggactgagcatcgtacaagccaacgaagttacctcggagcttctcattcgcgaagatcctcaaatcgagtcttagtgcctcttccagctgttgaatcgaagcatcagatggttcgtacacagtgtttttcgccttgaactggagctgagggacggcgagaagatttctccagacatgagccttgacggaaggagaaagaggaggaggagagagccttgaccagagagaaacgagtgggatccctgtatttccttgacaacagatttcctccagtgctgtgcatacaatcgaatccatttctcatcatccaaaaggtactcggttaggtttaggtcaacggaaaatcttccgccgataaattagttagtcagccgattaaccggaaattctcgccggagaggtgtcggaataatttatatagatttgggagttaggcgaagatggcgggatcagaagaggaaacgatcgaagagaaagagatattcgagttcttggtgacgggatcgatctcaaggaactgcgaaataattacgaggtaatttaattagggggtgagacaaagtaagtgacgagaatggccatacgtcagcaagttaaaacattgattcctcacgcttctaaactacgggccgtttttacttccaatcgaaacgacatgctgtttatgcgaattaggcacaaacaacacgaatcttttgcgggtcgggtttgttcgatccagatgtctggcttctctaacctccgtatctctctctgcaaaaagcgtgattcagagtaaatacagaaaaatatatcgtttttataaatggcattttttagaacatattagcttcgctcaaatatctctgtctcaaaagacaagtagattccttttttttacagtatccaataatttgtaatcatataaataatcggtgaaaaagaaggattctttgtttgtttcccgagaaaatatcctcgatttccatctcctatctgtcatcggagctttctacttccgaaggtaaggaaactggatcggaactcttttgaattctgtactgtgtatttgcttagggtttctgggtcttattgcattgttaaggattgcgaatcttatctgaatctgtgtctactactattgtgatgttttaaagctatttgtggaacagcttttacttgtccctttatagatctctttccctcttgggttcataagaacaaaatcctcttccctactttgtacgattcatgactattcagctgaatcgtgttgggttcttgtctgaatttgagtgttttaagattggattattactggaaatgtctgtactaatggaatcttatgtgagctttaaggattagagctctaaaatcaagatagggtcaggtcaacgcatagagaataaattgtgttattgtaactacttttctagtcaacgttttctgttaaattgaatccctttcttggctttgtttccatgtttttgacatgattgtattgaaacaggagtaaaggatcaatcaagagtttgatcttgttagaatagccgataatg

SEQ ID NO: 35400 - DNA, 3003 bp, Unknown
  misc_feature (1)..( 3003): 2750-1469P.txt file - cDNA_ID_3087127; gDNA_ID_2936558; Annot_ID_194322
tttactccacctttgaaacttttgcagtctaaagaggaattgatgaatggatctcagatgctttttgttcttccggataccaaatttcagatttctactgagctgtctgggaatgtggagctagtcccatccaaagttttgctgcaggaaccaattcttttttcatcaaatggatgcagtattaatcaatctacggatgtcttaaatgctacagctagtcctaaagaacctgcattgtcaactgctgcctcaaaacctgatttttctagagtaccaggcgagataagcttggctaatctttcaattaaagaattacaagaaactttcagagccacgtttggtcgtgaaactacttctaaggacaaacgatggctcaaaagaagaatcaaaatgggactgattaattcatgtgtagttccaacaactaccctgacaattaatgatagcaaactgattggtggagatcaagatgcaattgatgcttttagcaagggtacagtagatgaagaaacagctactgaaagcatagatacaccagctagtcctgacggcataaaggggcattcaaatgattttgggcatagtcctgttgaaacttttgtggaccattattctggaaacgaagattttgaaggtgaagatgggtctgcaaaaagagtgaggaagcctacaaggagatatattgaagaaaccaatgaaaaacaacaaattgacgggtcaatgatcccttcaaaagatccaagctctattcaagccgtttcttcagaagggagagttgttgtcaccaggatggtatcccttgctggttccagaattcaggttccctatgtttctcatgtaaggagaagtcgtccaagagaaaacataatggctcttggggtatgtctctattgttcatgctcttcaatatctttattaaccccattccttatcatatgagctatcaaaatatttttacttatctggcacatgctaaatttatgtctattgttacacactggaaaaaggaatatagaagtattcatcttttaaattgtgtttgctgcaatcaaggtaatagaggataatgttgtttacctgtacattttgtaggaatttcgttctaagtcatgggaggtgaaagctgctccagaggagggtaacctgaatctaagcccacctcagttgagcaatgatgtgaaccgagttccaggtgtcaaatctgcatctagatgtgtccagaaagaagtaagatcactctggcatttctgtataacttggtcatttctataatagtggagagcattttgtaaatgtaaaatccattttactttgattctatctatccaacgaagtctcaattgctctgaactttatggtttttagttgagatggtatgtaaaaagactgtttctaatcatctagcagtatattttttatttctggtatgagacagttgctcattgctttatctattttggttatcagagtgacaaagaccatttaaaaccaattttcactgatgtggatcaagagatgatggagccagagctcttagactcatctggagatagctcagatgataatttcgttgatgcaccaatcacgcaaagtgcaagtggaaggaagcttcatcgagcttggactatctctgaagttgaaaaactagtcgaaggtgtgtccaaatatggagtagggaaatggactgagatcaaaaagctttcattttcaccatacacgcatcgtaccactgtggatctcaaggttggttcaacataactaattaactgtctcatctcaatattcttaatccttttgtttaatcacaagtgtctcttgtgataggacaaatggcgaaatctacaaaaagcaagttcttcaaacagaatggttagcacttgccacatgttttaaccaattaaccaataacttgggtttaagattaaagtggtgaatggtttgtgtatttgcaggaaggaggtctgaagaaacacgggtcgatggccattcctactcacattatgttgcaggtaagagagcttgctcaaaaacaatcaccgatttcacgtgtagtgagcaaggctagagtggtgaagagatcgagatcaagaaacggtttcttgtagcgtttctactctcgtataaatttgtagttttctgtgaggttaacttctctgtttttacttttcgagtttgtagttttaaggtaggttcatgatttaaacagaatcactaaagtctaaaggtaaactgactggtgtttggaaatttctagatgatatgaacacttctctccatattactgaaccaaaccaaaccagattatcaaattcgcacaacaagacacatactactaagaattcactttcacataaatgaaacgcagcgtttcatacccttttgttaaacgcagcgtttcacgaaaacaagataataataagcatcgagatggaaaaaggcctttgggctttaagatacagtaaatgggactgtaatcctttttgggcgccctattacaggcgtgctctctctcctctctccatctatctccctctcttcgccggagatcgcccttcaccaattccactgtgagtcgcacatcaaatattcctactttttcatgctaagattttgatttattgttaaatcagttatatttaaatgattcctgcatttcgagctcgtctaatggaattcatgtttggaatcgatgtctcgacatacgtttttttgttcgattagacgtaaagagctcagctttcgccttttggcattcaaatttgtttactgagtggatatatatggtttgataaatttaagctaaatatgaatcttaaagctttatattcttcgggtttgattttagctcttttattagcaatctgaagttttttgtttgagttattgataaaatttttatgttattatctatgaactctctgattctgagtctattgataagtaacaatctttgtcctttactctctctccacagatagtagcaaaaacaagtgaagcacaatg

SEQ ID NO: 35401 - DNA, 3000 bp, Unknown
  misc_feature (1)..( 3000): 2750-1469P.txt file - cDNA_ID_3087127; gDNA_ID_2926301; Annot_ID_205703
actccacctttgaaacttttgcagtctaaagaggaattgatgaatggatctcagatgctttttgttcttccggataccaaatttcagatttctactgagctgtctgggaatgtggagctagtcccatccaaagttttgctgcaggaaccaattcttttttcatcaaatggatgcagtattaatcaatctacggatgtcttaaatgctacagctagtcctaaagaacctgcattgtcaactgctgcctcaaaacctgatttttctagagtaccaggcgagataagcttggctaatctttcaattaaagaattacaagaaactttcagagccacgtttggtcgtgaaactacttctaaggacaaacgatggctcaaaagaagaatcaaaatgggactgattaattcatgtgtagttccaacaactaccctgacaattaatgatagcaaactgattggtggagatcaagatgcaattgatgcttttagcaagggtacagtagatgaagaaacagctactgaaagcatagatacaccagctagtcctgacggcataaaggggcattcaaatgattttgggcatagtcctgttgaaacttttgtggaccattattctggaaacgaagattttgaaggtgaagatgggtctgcaaaaagagtgaggaagcctacaaggagatatattgaagaaaccaatgaaaaacaacaaattgacgggtcaatgatcccttcaaaagatccaagctctattcaagccgtttcttcagaagggagagttgttgtcaccaggatggtatcccttgctggttccagaattcaggttccctatgtttctcatgtaaggagaagtcgtccaagagaaaacataatggctcttggggtatgtctctattgttcatgctcttcaatatctttattaaccccattccttatcatatgagctatcaaaatatttttacttatctggcacatgctaaatttatgtctattgttacacactggaaaaaggaatatagaagtattcatcttttaaattgtgtttgctgcaatcaaggtaatagaggataatgttgtttacctgtacattttgtaggaatttcgttctaagtcatgggaggtgaaagctgctccagaggagggtaacctgaatctaagcccacctcagttgagcaatgatgtgaaccgagttccaggtgtcaaatctgcatctagatgtgtccagaaagaagtaagatcactctggcatttctgtataacttggtcatttctataatagtggagagcattttgtaaatgtaaaatccattttactttgattctatctatccaacgaagtctcaattgctctgaactttatggtttttagttgagatggtatgtaaaaagactgtttctaatcatctagcagtatattttttatttctggtatgagacagttgctcattgctttatctattttggttatcagagtgacaaagaccatttaaaaccaattttcactgatgtggatcaagagatgatggagccagagctcttagactcatctggagatagctcagatgataatttcgttgatgcaccaatcacgcaaagtgcaagtggaaggaagcttcatcgagcttggactatctctgaagttgaaaaactagtcgaaggtgtgtccaaatatggagtagggaaatggactgagatcaaaaagctttcattttcaccatacacgcatcgtaccactgtggatctcaaggttggttcaacataactaattaactgtctcatctcaatattcttaatccttttgtttaatcacaagtgtctcttgtgataggacaaatggcgaaatctacaaaaagcaagttcttcaaacagaatggttagcacttgccacatgttttaaccaattaaccaataacttgggtttaagattaaagtggtgaatggtttgtgtatttgcaggaaggaggtctgaagaaacacgggtcgatggccattcctactcacattatgttgcaggtaagagagcttgctcaaaaacaatcaccgatttcacgtgtagtgagcaaggctagagtggtgaagagatcgagatcaagaaacggtttcttgtagcgtttctactctcgtataaatttgtagttttctgtgaggttaacttctctgtttttacttttcgagtttgtagttttaaggtaggttcatgatttaaacagaatcactaaagtctaaaggtaaactgactggtgtttggaaatttctagatgatatgaacacttctctccatattactgaaccaaaccaaaccagattatcaaattcgcacaacaagacacatactactaagaattcactttcacataaatgaaacgcagcgtttcatacccttttgttaaacgcagcgtttcacgaaaacaagataataataagcatcgagatggaaaaaggcctttgggctttaagatacagtaaatgggactgtaatcctttttgggcgccctattacaggcgtgctctctctcctctctccatctatctccctctcttcgccggagatcgcccttcaccaattccactgtgagtcgcacatcaaatattcctactttttcatgctaagattttgatttattgttaaatcagttatatttaaatgattcctgcatttcgagctcgtctaatggaattcatgtttggaatcgatgtctcgacatacgtttttttgttcgattagacgtaaagagctcagctttcgccttttggcattcaaatttgtttactgagtggatatatatggtttgataaatttaagctaaatatgaatcttaaagctttatattcttcgggtttgattttagctcttttattagcaatctgaagttttttgtttgagttattgataaaatttttatgttattatctatgaactctctgattctgagtctattgataagtaacaatctttgtcctttactctctctccacagatagtagcaaaaacaagtgaagcacaatg

SEQ ID NO: 35402 - DNA, 3000 bp, Unknown
  misc_feature (1)..( 3000): 2750-1469P.txt file - cDNA_ID_3087131; gDNA_ID_2936558; Annot_ID_194323
aggggacataagaagtgggtgcaggcatgtgaagaagaaataaactccatcgaaaagctaaaacgtgggaactagttgagctaccaattggcgccaaaccaataggccttaaatgggtttttaaactcaaaaggaattcagatggaagtattaacaaacataaagctcgacttgttgccaaagggtatgtacaacaatatggagttgactttgaagaagtctttgccccagtagcacgaattgaaactatcagacttcttattgaccttgctgcatcacacggatgggagattcatcacttagatgtcaaaacagcctttttgcatggtgaactcaaagaaacagtttatgtctgtcagctagagggattcgagaaacagggaagagaagagaaagtgtatagactcaacaaagccttgtatggactgagacaagcaccaagggcatggaataacaaactgaataatattctcatggaacttggatataacaagtgttcaaaggagccatctgtgtatcgaaaacaggttagcaaccatgttatgatagtagctgtatacgttgatgatttattcgtcacaggaacaagcttggaactcattctcaaattcaagaaagaaatgtcatccaaatttgagatgagtgaccttggtctactatcatactatctcggtatagaagtgattcaacacagtaagggcataactttgaatcaaagtcgttatgcaatcaagattctggaagaaactggaatgaaagactgtaacttagtccatacaccaatggatccaagctacaagccatcaaaagttgaaactgaaaaggaagtagatgcaacagtttacagaaggaatataggctgccttagatatctgcttcatacaagaccagatttgtcatatagtgtaggagtcctgagcagatatatgcagagtccaagagaatcacacgctgcagcaatgaaacactgtctccgatatctgaaaggaacaatttcacttggtttactctacaacagatgtgataaagcaaagttaaatggatatagtgacagtagtcataacgttgatccagatgatggaagaagtacaacaggaaatgtattctatctaggtgagagtccaatatcatggtggtcaaagaaacatgatactgtggcaatgtcatcctgtgaagctgagtttatggctggaacagaagcggcaaaacaagccatttggcttcaggacttgttaagtgaaatcacaggaaactcaagtgagaaagtcaccatattcattgacaacaaatcagcaatagccctcacaaagaatccagtgtttcatggcagaagtaaacatatcaatagacgttaccactttataagggaatgcgtctagaatgatcaaatagaggttacacatgttcccggtgaagaacagaaggctgatattctaaccaaagctcttgaaaggattaagttcaaagagatgcgagatctcatcggtgtaagagatatggagaaagaagactttgagcttaaaggagagattgttggagtaagctcaaagacttgaagaagaagaaagtctaaaccaagactaaaccgaattatggctaaaccgagatatggtttaatgtgaagataagattagtgagatttaggagatatctaaatcatgtaatcctattaggtttaggattagaatcttatataaaggacatgttggttgtaacatagcctttgagagagctgtagaatacattgagagtttaggttttgaggaattttcctagactaataaaaagagattcattcttttgattttgtgttcttaatctcttcattgaaatctatagatatggtgttgtcaagaatctaaaagctcgtgtctttattaagcaaagggggtggttacagttcttacaacagaagtatatagtttgtgaccggatcttaggaactagaaacgatactaatcattttacttgtcagaacttttgttaggagtaacagcgtcaacaatggcttccatttcttccatcatacgcccgagaacaccaggtcctttaacatcatcaacccttgtcttctcatcaatgtcttcacttcttccatgagtctctttcccatgaaacatcgattccttctcttcttttctgcttccaatcacatttgtcttcacctctaaaaaaacaacaaaaaccaaaacccagaaacgatcaatgagattaaaacaaaagagttgtcttttcgcccaaattaaccatctcctagataaacctaaataacccaaaaggtccctgattcgattacatatagaaaccctaaattcgataaatcagggggaatctctaggaggaattagacaaattaataagtgatgaaactttattaaaaaaaagggcgcaaaattcgtgaaattgatcaaatcggagaatttgtcttaccagaaagagagctttgttttggttccgccattaatgatcttccttctttgatcttgtttttgagttcttcaaatgtagacgagtttgtttagtttggtctgagcttgaaatagtgtgtacaaatgtgaaccatccaatgtaataataacagattaacgagtagatcgaaccgactcgggtattgtgcaaacccgacactaaaatggattgagttgcccagtctaataacttatgggttaaaaattgagaatacaaaagtagaggggttctcagggaatttctggaacaaataatataaaagagaaaacctaaagtttaaccgttattttaagaaaattgctttcgtaccccaacaatttcaaaattcaaaagttctctctctgcttcttctttttaacacttgcgaacttttgtcaacatcaatctcaatcaacacaaccaaattcccagaaacaatctttttgcttttcccacatttcaagctccaaagcttcgaatttttgaatcaatagcttccgaagttgtgatttttgtagaattcgaaaaccaaggtctcgatttgagaagatg

SEQ ID NO: 35403 - DNA, 3003 bp, Unknown
  misc_feature (1)..( 3003): 2750-1469P.txt file - cDNA_ID_3087131; gDNA_ID_2926301; Annot_ID_205702
gcaaggggacataagaagtgggtgcaggcatgtgaagaagaaataaactccatcgaaaagctaaaacgtgggaactagttgagctaccaattggcgccaaaccaataggccttaaatgggtttttaaactcaaaaggaattcagatggaagtattaacaaacataaagctcgacttgttgccaaagggtatgtacaacaatatggagttgactttgaagaagtctttgccccagtagcacgaattgaaactatcagacttcttattgaccttgctgcatcacacggatgggagattcatcacttagatgtcaaaacagcctttttgcatggtgaactcaaagaaacagtttatgtctgtcagctagagggattcgagaaacagggaagagaagagaaagtgtatagactcaacaaagccttgtatggactgagacaagcaccaagggcatggaataacaaactgaataatattctcatggaacttggatataacaagtgttcaaaggagccatctgtgtatcgaaaacaggttagcaaccatgttatgatagtagctgtatacgttgatgatttattcgtcacaggaacaagcttggaactcattctcaaattcaagaaagaaatgtcatccaaatttgagatgagtgaccttggtctactatcatactatctcggtatagaagtgattcaacacagtaagggcataactttgaatcaaagtcgttatgcaatcaagattctggaagaaactggaatgaaagactgtaacttagtccatacaccaatggatccaagctacaagccatcaaaagttgaaactgaaaaggaagtagatgcaacagtttacagaaggaatataggctgccttagatatctgcttcatacaagaccagatttgtcatatagtgtaggagtcctgagcagatatatgcagagtccaagagaatcacacgctgcagcaatgaaacactgtctccgatatctgaaaggaacaatttcacttggtttactctacaacagatgtgataaagcaaagttaaatggatatagtgacagtagtcataacgttgatccagatgatggaagaagtacaacaggaaatgtattctatctaggtgagagtccaatatcatggtggtcaaagaaacatgatactgtggcaatgtcatcctgtgaagctgagtttatggctggaacagaagcggcaaaacaagccatttggcttcaggacttgttaagtgaaatcacaggaaactcaagtgagaaagtcaccatattcattgacaacaaatcagcaatagccctcacaaagaatccagtgtttcatggcagaagtaaacatatcaatagacgttaccactttataagggaatgcgtctagaatgatcaaatagaggttacacatgttcccggtgaagaacagaaggctgatattctaaccaaagctcttgaaaggattaagttcaaagagatgcgagatctcatcggtgtaagagatatggagaaagaagactttgagcttaaaggagagattgttggagtaagctcaaagacttgaagaagaagaaagtctaaaccaagactaaaccgaattatggctaaaccgagatatggtttaatgtgaagataagattagtgagatttaggagatatctaaatcatgtaatcctattaggtttaggattagaatcttatataaaggacatgttggttgtaacatagcctttgagagagctgtagaatacattgagagtttaggttttgaggaattttcctagactaataaaaagagattcattcttttgattttgtgttcttaatctcttcattgaaatctatagatatggtgttgtcaagaatctaaaagctcgtgtctttattaagcaaagggggtggttacagttcttacaacagaagtatatagtttgtgaccggatcttaggaactagaaacgatactaatcattttacttgtcagaacttttgttaggagtaacagcgtcaacaatggcttccatttcttccatcatacgcccgagaacaccaggtcctttaacatcatcaacccttgtcttctcatcaatgtcttcacttcttccatgagtctctttcccatgaaacatcgattccttctcttcttttctgcttccaatcacatttgtcttcacctctaaaaaaacaacaaaaaccaaaacccagaaacgatcaatgagattaaaacaaaagagttgtcttttcgcccaaattaaccatctcctagataaacctaaataacccaaaaggtccctgattcgattacatatagaaaccctaaattcgataaatcagggggaatctctaggaggaattagacaaattaataagtgatgaaactttattaaaaaaaagggcgcaaaattcgtgaaattgatcaaatcggagaatttgtcttaccagaaagagagctttgttttggttccgccattaatgatcttccttctttgatcttgtttttgagttcttcaaatgtagacgagtttgtttagtttggtctgagcttgaaatagtgtgtacaaatgtgaaccatccaatgtaataataacagattaacgagtagatcgaaccgactcgggtattgtgcaaacccgacactaaaatggattgagttgcccagtctaataacttatgggttaaaaattgagaatacaaaagtagaggggttctcagggaatttctggaacaaataatataaaagagaaaacctaaagtttaaccgttattttaagaaaattgctttcgtaccccaacaatttcaaaattcaaaagttctctctctgcttcttctttttaacacttgcgaacttttgtcaacatcaatctcaatcaacacaaccaaattcccagaaacaatctttttgcttttcccacatttcaagctccaaagcttcgaatttttgaatcaatagcttccgaagttgtgatttttgtagaattcgaaaaccaaggtctcgatttgagaagatg

SEQ ID NO: 35404 - DNA, 3000 bp, Unknown
  misc_feature (1)..( 3000): 2750-1469P.txt file - cDNA_ID_3087176; gDNA_ID_2926302; Annot_ID_205756
ccctttcataataacacttggaattttgtttgcatatatctgattgaacaatagtagctatgtctttttggcaaaagattctctgaattatattgagctgagttataaacaaaatctagtttccaatgggtgtacaattcatcacagattgacctttttaattttgctgtacagaaaatatttgacaacatcctcaatggtaaaatgccctggccagatgttcctggtgaaatgtcttatgaagctcaggatttgattaacaggtctgttttgaggattctgctcccgttttcatatcatccgtctttcccacagtcccattcatgtttctctaagcagaattactatatttccagctaatgaattaacatttatcctagtttctgcatattggttacctacaacatcagctgatttttagactttatgctggtcaccgttaaggagatgttaagtttgacagaaatattataaacactttataggtttgacgtttactactttttctcatattcatatagattcattttctctccgtaataggcttcttgtccatgagccggaaaagcgactgggggcgaacggtgctgcagaggttacttcaattttccctttactttttattaaagccgcacaattgagaaacaaatgcctattagatgctgttgttgtggtcattactaaaattttcagtaacatcgctggtctcattttcaggtaaagtcgcatcccttttttcaaggagttgactgggagaatcttgctttgcaaaaggtaagtactccactcggaacctctttttacattcaagacaaattatgcaaataaatacatgttacttactggatgaagaaagaaaatagaaaataaagcagaagctgtttgatcaaatcgagcttagtcttcacaaatgcatattatgaatgtgaagagtgaaaggttctttaaagccttagctgcctttccttttatttctttttggtaggctgcttttgttccgcaacctgagagtataaatgacacaagctatttcgtatcacgctttagtgaaagcagttgcagcgatactgaaactggtaacaacagtgggtcaaatccagattcaggagacgaggtaggcatttggaaactccatccttttctctctaggtactctatttgcaatcatcgtatctatcgcaaattatttttcctgcttttgtgtgttttttagttggatgaatgcaccaacctggagaagtttgattctccgccttattatctctcgctcattaacttttctttcaaggtaaatttggctgctaaaagctgaaatatgaatcccagtttacgttgattggagttgttgggtagttctgtcttgggataattattattgaagtacaggatattaacagcatgttatgatgatgcagaatttgtcacaattggcttcaatcaatcatgatgtgctattgcaaaaggatccagctaaaggaggaggagactcaccctttaaaagccatggaacgtagagctctcctacaaccgtcaaaggtggccttagtccgctgttttctctggtttgcgccctgctttgaccgttgtagctgctgctgctactatgctgaaattgttacctcaaggtctttgggtaattattttcagttttgtcataaattgatttggaaccatttcaaatgcaaatccaagtatttattgcgtggcaacaacacacatatacatgtgtataagcttgtgtgtattgaggctgatggaaataagagagcgctttggttactgaattatgggcatcccacttccataacttttattctcgaaagaagtcttcatcactctatcagaagacaagaccaaaacttgcatcaatcccaccaaggtcaccgtcaatgaaaaaaaaaaagcggtttctgattattggcaaaaaaagatttgagaaagttatttcataatgagatcacactaatctttcgaatcagtccaaagactacaaaggacttaagagactaacacaccttaggcaaataacagcttatgatgatgacgcaacatactgtacatgctttcagtattcttcatgttatgaaaaactacccctactagattatggggtgattaattaaggcttttcttttattttaagttttaattgtaaaaactttggtggaagggttcattaatggttctacactaagaggtatgaggttgagtcccaatactaccatttattagaagatttgcagattaatgaactacaagagatctccaacgatgtataattatagccgttcgccaggattctacgcagagaagatcattgaaggtgtgcatgaagagcatggagaaggagtaaaatgcatcgtcttatcataatttgtaataaataataaatttaagacgacaatttttttttttgtaaaaactgactataaataattagtgttacttagaaaaccaaattagcttcaaaaattaaaaaggtataaaaaaaataagaagattaaaatctgtaaatttaattagataaaacatggcttaaaagatttttgtattttaatagtgaacaaattaataatcaaataacatatgattttggttataaaatcaactaatcaataagaaatcttctaaaaatatgtaaaaaaatttctatagttgacaaatttaaagtgtttttttttttttaaacaaaatttagggtggataaaaaaaaatttaactctcttttatttcataaaccattttgttgcaaattcccaaaagaatattgcagcaaaaaagcttcaatgagttaaagcctgcaagctactttttcagtttagccacgacggctaagaaaaacaaaacaaaacaaaaagcttgaaattgaactcccttacgtgttctttggcttcctttcacaaatctctcgcaaaacgcgatcgtctctcctccttcttcaagccctgaaagaatctccagattctctgcgactttctcggaaaaccaaaaaaaaaaatg

SEQ ID NO: 35405 - DNA, 3003 bp, Unknown
  misc_feature (1)..( 3003): 2750-1469P.txt file - cDNA_ID_3087184; gDNA_ID_2926302; Annot_ID_205752
gtataatgcaaaggataaaataaaagaattgtaaatctggatcacgatcacatgcaatggagcccagcaaacccatcaccgtgttgcttcttcttctgcttctccttgttgtcgttttcgcacatgtttctatggtccggttcctattaagctattataaatcatgatttcaacatcaaacctaattcattatctcatcgactttaaatttcattagtcggtgtgggtgttgccagttttatttggtctatattgtttattggattataatgtccggttttctttagtcaaacatgaacttttttgttgcaaagtttttatttggtatgcttttgttaacatgaacttgtagtccggttttcaatatagttttaaaaggtaattagccaaatagctttatttgattaacgaaaataaaaaatgtcgtgagaactattcttttgcgtttttctcaaatgaaattatatctgatatttaaaagactatataatcaagaatcatttgtttcttttagaaactttcacaatttttcaaaataatgctaattaacaaactgttcataatgtccgtgtcttcccgtattatatattatgtatgtaaacaagatttctcctaattggctttctaaaccttcaattaatacaatactggacaaaacgaaaaagaataccgatcatggctcgtaatctttctaaaatactctgcatgctataattattcttcccataattaatagtaactttataaatgacataatatacaactccttctgtttcattatatttgtagtttaaggaattttgtttttctgcaaaatgttatttttattcatctatgcaaaaattaatatatttaataatttttgaccaattatattttacagtatattttcttattggttgaattaaatgtagttaatgatatttttatagaaaaaaagataaattaaataagatttttgtgttttcttaatctttgtgaaaaaaccttaaactacaaatatagtgaatcagaaggagtactaattaaatagtaagtatagccaattcatttatgataacatttaatttaattatgtactaaaccaatatagttgatatagttgttacttgttagagatattttttccaaataaacataaacgttattagcatagggccccctacttaactatatgcgtttgtcatgcgagatatgaccaaaaaatatggctcacattcgtttggtaagattagcgttagtcagaaaaagcgaaacacaaattaatccaattcactacccgtacatgtataatctgagaaacttgttactattttagatttattgtaattgtatctcatctcatgtatattttgcctaaatactcataaggaataaatagtagatgtgatgtgacgttgttgcttttttgcctcggcccttcttccatgtggagccatttcctaactttaaacttttgtctcttgtttctctcattaaaaatgattcaatattaacaaaatttcttttgcaagttacattttatgatatgaaaataacactaatatcaataagcaaaaatacgttaaagcaaggatattatcaagatatttttttctatagtaattctctaagactataagtctaaacctataaatataacgaaaatgtgtagaataaattatttatttttgtatttaaatggtttcgaaatcttgagaattcactttgtcaagatgaaacatacaaatttaaactaatatttagaaataagttctactttcactttcgagtttctacatttttaacttgcaaactacaaaatttatgaaaattcagtctataataaaattaaatattgaaactctaaaacttgcaacaaaaaaaactctgaactacctcaagattaaaatctaaaataatttatttttaaaaaatatgaaaaattgaaatataagtaacacataattccaaccacaataaaacctctataaattaataatgttgggatgagaaaattaataatttagagaggtattaatttatcgataaattaataattattaatttataaagagattttacaaattttgtattttttttacaaaaatttgatataaaagtagttttttctttaaaattaattatttttctaaaactaattacaaagaaaaaataattattaaatttcaaaaaataatacaaagtttttttcgacgtaataaaaatattagaattaaactctacaaataattaatggaaatcgaagaaaaaataatactaagtcatattttaataaatattgatatatatatatatatatatatatgtgtatatattagtaaatttacataattattaatttataatattgatgagaccatatatttatataagattttcgaaaaagttattatcttattaatttatcgatttgtatcaatttttacactggtcccaactcgggaccggaagaatttattaatttatagatgttactaatttatcgaatattaatttatggaggttatactgtagtattaacaaatcatcaaatacgatttcacacaaaattttgaaaaaaaaacaaaattagtaatctaacaacacaagattataattgcatttccaatacacaaatcaacaactcttcattctcaacaaccattcaatatctaaatcaaaattttctacaaaacccatagaaaagcaatcacttttccaccacaataaaatcgaaaacaaacattttgtatgtatatgtaaaagttaatgcaaacattaatttaaaactatatggaaagctccattaatttatttttaatctcccaactaattcactacaccaattttgtatgagagtaggcgacgaaaccacaagtacctatatcagagaatcagagaccaacgtcacttatttacacactctgttttcttttttttggttgcttcttctctgatctttctttctttttttttttttgaaagaatcaatttccctctcaaatcagaaatctaaaaatg

SEQ ID NO: 35406 - DNA, 3003 bp, Unknown
  misc_feature (1)..( 3003): 2750-1469P.txt file - cDNA_ID_3087192; gDNA_ID_2926302; Annot_ID_205750
tacttttaaatcttcaaactttttatccaaaagttgtgtttgcctcttgaagaaactcctcaattcgcccgcatacttatcgaacgcttcgtctccaacttcaccatcagcaccattgggtccaccttcaccatcagcaccattgggtccaccttcaccatcaccaccacttggtccaccttcaccatcaccaccacttggtccaccttcaccatcaccaccacttggtccaccttcaccatcaccaccactgggtccaccttcaccatcatcagagtgactaattttcctttttttgttttcaacaggatctgacacccgtctttgcctcttcaaaataactatattaaacggttaaatcatgcattactactcttagaggaacctaattctgatataagttatacgatgaaaagatatggttacctctctctccagttgctgagggccggacttgcttcttaggcgcatcatcgcctccaacccacattttttcattccactcctgctcagatttcaacatccttaaaatgttatcaactcttgggtcctctttttctttcctccatacaaaagattttgggcaattactgtctgctgggtccacaatatatgtgatatccacctacatagacgatcattgttaatttcagagtgtatgtacttcatttttttataccaatgtacgtacaacaacaactgcacaaacctgttcagcagactcgcacgccaatatggtggatgtcttgattggacgcaatttggaaaggtttttaatagtcctctctgtaaacacggcggtatctccttcagaaggtaggagactagcaatagacggtatagttgcgaatgcaaggagttggagtccaagtgggaagccatggagtgcataagaatgttgcttgcaaccactccggagttttttaacgtcggtgtctcctttgaaacttgcgatacgctccaaagtaagcagaaatgatgtccttccccagggatatttacagaagaaatcaaggttcttcgtcagctcaactgtcatctcatttggtctcaaaggaggagacttgtcacatattagcacaccatccacaatgataattagggcgagagctaatttcttccatgcaggcatgtcagtttcagaaatcaatctatcccttaattcttcaactgttggcttagctttatcatctccaaacagagtagcccacactgtattttcaccttcctcacgctgcataacactttctacatccttatctttaggataggttccacattccaaaccagttataagtgcccattctcttaatccgagcctaataggatgaccagcgaataccatccacatctcataacgtttatttgtaactaactgacggcatattaatccaagaacaagtttaccagaaaaggatgccttgttagtagggatcctaaagaggtcaccaaatggagaatctagaaggaacgtcatttctggtgtgtccttaagcgcagctgctatttgaccaatgtactccgctctggagtacgcatttatcttcgccttgctagggtagtgatcgagtgcaaacaacctctgtggtaattcacccggatcattagaagtacttcctgaaagttgagcaagacgaagaagttcttaacacgtacactatatccaaataccaactaaacataaactcgattttcatatacacgtacaccgaaaccttttatactcaatcaactgtttttggcggaaaaaaacaaaatccctttgtcaattgaaaatttatgagttgaaatctctaaaattaacctagattttgaatcaatcattctccaaacgaagttagggaaaactaacccagatttgtcgtcgccgccgatgcctcatcaatatccgaaactcctcgccgccgactactcttcctcgtcgccgccattagagctcttctatgaacagttaatcgataaacccaaaaagcgtattattgttccacactttaacacgaaccctatcgaaattttctccactttagcaacgactagaactcgaacagagcctcaatcggaattgtgattcagttttgtcggaatttctctggttcttcgaaaccactcttcgtttcgacggaactgttctgctttctcgaagaagacagtttttgatttattttcagttttaaaattaataattttaaatatttaaattattttgaaaccagaaaacggttaaggaaactgaaccggttccacgaaacgaaaccgcctccgtcagtttctcgttggagggcaaattcggccattttgggcctaatggctaaaacgtggttgacccagcccactttgcctatttgtgaaagaaaaagtcacaagggtgttataacgtgaaattttcttttgtttatataatgctttgtgaaccctaatccctttatgattttgttttgtttatttccttttttccagatttaccgaagattcggattaagattatttttggttagatttatcttttcttattcttattaattaatttaatataaacaattatcctatttttcaccactgatttaaacaaaaataaaaaaaaatactttcaactgaaaaattgtattattttctaaaatattgaaatttacactacaataaagagcaagtacgtttaaatacatacaaactagaatatcaacaaagaatttaatatttgatcaatatatttgcaagttaattttgaaaaatatcacattgaaatatatatatatatatatatatatatatatatatatataaataaataaatggcgagtttatatagtaaacatgagtgtaagggaaatatatgaaaattggtttcatggatttctttgaaagaaaaaaaaaaattgagaattacataaatcttgctaaccaaatattattttttttaacaaaaagagtatttaaactttaactttgaacaaaccctagctccccggaaaataagccgtcgccgttttcatcttcttctccatg

SEQ ID NO: 35407 - DNA, 3003 bp, Unknown
  misc_feature (1)..( 3003): 2750-1469P.txt file - cDNA_ID_3087203; gDNA_ID_2926302; Annot_ID_205747
gcaacgccctgcggataacgatcgttatgtgaagaactgtaagaatgggaggtctcctaaggagacgaggtggtggttccatgacgacaaggtttgatgcacgaccaagattaaagagaagccttaatatgttaatgatgacatttaaaaatgtcaaaacctaactttttgtctcactcttactatggaatatgtcaagtgaagagctctgaattacataagagaacactgagagcgggaatctatatttcgtactgaacatgtccacaaaaagatcaattaatgctaaacaataagttgtcattaatgccaatagttattacacaaatgtttttttcatccaaatgtctctaaaaatgtatatatacatttattaggatttttgattttctgatttgggtctgtctattcaataaatttcctctctggtggagaggtgactgtcaccaacttcttccctaagcctaagggaaagatttgttagagttgagccgaatatttctctctcgccaaatatggtaaactgaggcttggtacgctaatttgagaatgaaagccacctttttatcccggcaaggatgtctaagccatcttgcactatctttaaacatccttggaggggtaacacgtgcgttagagcagaaaaacgaccatacctcgtgcgagaaaggacaatcaaagaacacatgctgccttgtctcatcaagcgcattgcagagcaggcaaagtgaagggacctgaatcccccaactaataaacctatcacaaatatgcaaacgatttctattggccacccaaacaatgaaagcatgaggggaaatatttcaagagaaccacacctaatcataccagtccactttaggaccagtagggtggagatggtgccaagtatcacaggaccaaaagttgtttaaaattgatcacctctaaaactcaattgatggagtttcaagatattttcaaaattgatcacctctaaatattctcaccaatctacttcaataaaaaaatatttattaaaataacaatgggaagaaactccatatacagttacatcgatgaaaaatcagaactaacaaataaacaaaactatgaaaaaaaataagaaagaagagacttttaactagtaattagttagcaaatcttaaaccaatcgaaaacgaaagtagcatatggttgagtagatgacacagacgcttagtggtgtcttaaaatgtctaaccaccttgtgagacgctctaaaggtgacaactttggaacattgagtgttgttccgaccacgacttggagcttaagaccagccccacagtgacccggttctgagctaatgaaataatggattcctggtttggtgagcttgatgatatcgtggcctgtcttatgcacggctattggagaagtcgggtcgcagtttaagaattcaaggtcaccgctgatctcgtagacaccgttgacttcattgttgtattcgaaaaggagaccgtctccgacattgaactgtttctctttactccagttgtaatagaaatcactgtcgtaaacgccccaacttttggagtcaccaaccttgtagacatgtctagaaggaataatcttgctcggtagtggtagaggactcggactcgacgggtcatggacgacaaaaacgccaagcctctgtcccgatgtacattgagtatggtttgaggtgatgaagtagtaagaccctggttccgtgaaggttacgacatcatgtcctgtgttgtagacggctttaggaaaagaagagtcgcagaattcgtattccaaaccaccggagacttgtgtgacgtcattgaggttgtgatcgtattcgaagatcaaagaatctcccacgtggatctctttatcctcggtccaatggtaatagaggtggtccttggcagtccatccatcggagtctcccactttgtagacggtggccgaacaacaaccgaagagaagtgtaaatatcacaatcacgaagctgaagatcttcttcattcttgctgtggccatgattcgttggtatacacaaaacaaaaaggaaggaagaaagatgaacaaaagctgagaggcgaagaagaaaaaggttatgagatattgaagaggctgaatcaaagagagagagagttgtgttgttgttgaacgatataatgagttgtgaagagatgacctaacctatcattgtttatagggtaaattgcacacagtagccattgatccacttttaatttcagattttgacaaagtgggcagggcctttcagctattagccattaagccaaaaactgaccaaaatgcccctgacgacctgacgaaactgaacccggtttgtacgtacggaccgcgtcgttggaatccaaaagaaccgggttcgtacgtacgctgttcatcgacgagaaatgcattaaatgatttctgggtttcggcgaagttgacacttgagattggaataaaaaaaatttaaaattcgttgggctcagaagtttttaatgctaaatagttttgacaagactaaaactcatgattacctattataatagagattatattgtaagatattttgataatttagattagaattctgggtaaaaaacgtaaatcgaaattctgttaaggtgaagaaacgaaaatcgaaattgtgttacggtgaagaatctgaagttttcagttgctgttttacaaagtttgaaggattgaaggggagacaatctgtgttctgggtaagaaattcgtgttaatcctaattacacttgagaacgtgatttgaatgatacgtttttaaaaatttctgggttcatacattgttttgttggagattctatttgtatttgtagatataaatgaaagctctatgttttgtttagttaaatttataagtacataaattgttttgttaagattctttttgtcttcgttgacataaatgaaatccttcaaaaaagatctgatttttttttatttaatgttggtctgacctgagaaatttatgttgcaggtatg

SEQ ID NO: 35408 - DNA, 3003 bp, Unknown
  misc_feature (1)..( 3003): 2750-1469P.txt file - cDNA_ID_3087210; gDNA_ID_2926302; Annot_ID_205745
catcagttatcctgagtattgcaagagctgctggcagatcctcatcttggtagctgttgttgaaccgatgccaacacttcaaagcatgatgaccaggtttgccacagatctgacaaatgactctttctccatttgagttttgtgaaatttgttgatgaaaacctctaccacgtgtggagaatgaatctttgctttttccactcccaaatctttagttgccttttcctcggttgttgttgttgttgtagtaaccagaggagtctgatcttgaagcattgaaagccatgtgaggtgaagtttcagtatcaggaccatagctgttcagcctatcagcaaatcctgtcagccttgaaatcacactctcaaaggtaggtggtggctgagtatccattgaaccttctacagatgttttgataggctcatactctctacctaacccatgaagtgcagcaaatatcttcatctgttcactaacaggactgcctatggaagctagctgttcacaaaccctctttatctccttaaggtaagtttccatggatttatcctgtttatctatggtttgaagctttctctgtagctcaaagagtcgtgatgaagataccttattgcagtgttgagccaaagcattccagacttgataggaggtggcacagttgacaacttcctgcatgatgtcttcattcagagatcccaacagccaggctcggactacttggtcagatctgttccaggtatgatactctggatttggtacctcaatagtaagaccatcgatgttgttgaatggagttgttgcaggaggaggcttgagtgacccattgacaaagcctagaaggttttggccagaaagaaaggactcaaactgtgtcttcttaagagagtagttttgctcattgagcttaacagtgacacagttggagatgtgaagaacaggaggtgagtagagttggatagattgatccatcatagaccgctgtgctctgataccatgaaagtaagagcaagacggctactttaggtaatgtttgagtgactttccttttgatattatttcacttgagttctaggttacatcacaagttcccttttatagctaaacaatgctagggtttcaatcattgtgaactgacagatgtctcaatcttgttatgctacgcaggtcatcaagcaatcaaatctgttttctgtgatgattggagccgtacaacaagcgctcctcttctctgtcattattctggctttgttctcttgcacaggtggacttagccgttgagaagatgaagaagacttgttgggcttctcagacttgctaggcttctcattttagttgacattaggcttgttaggtgagtggcccaatatccctttctctttgcttactgcaacgacatcgtcttgactccttaactcttcagctacatctgagttcttcttcgatcttgtttcagattcaggagctgaaggcggagcagtagagctcttgctaatactttgctcacaaacacgtatgatcatgtaacagtctccatcctacctttgtcacaagcgatgtgttcaaatcctttccagaccaccctctgtccgtggacgacaaaccctatcccaagcaaccaaatgttgttttctcttttctggtgtacttccccataaaaagcctcttgaaactttatccaaaccatcgccaatcgattttggtaaagatattgtgctcatggtatgaatcaatatagatgccaacactgatttggtcaatgttagtcttcttgcaaactcaaagagcagcctttccatcccggtagctttgatgacactttttcgaacaaaatagtattagcgcggagaagatgagaattctttaaggatacttttgggatggttgtatggaaacttgggctgtatggaaaaaatggcggaaagcacttggtcgaccaatgtttgccatgggagtttggtggagcttgaaatagaggtgtggttatgtgtttggcgaattggaaaaatgtcgggaaagagtaaagtttaccagagaattgggacaagaagtaagccgtgcacataactcacttcgggagagtataggtacgggtgtgagagttgagcgaatggtaacgtggagaccaccgcgggacgagtagttaaagctagatacgactggtcctttcacaagaatccagttttgactacagcggggggactcatacgggatgcaacaggtagttggtgtggaggatttgctctcaatatcggtgtttgttcagctcctttagcggaactgtggggagtttactatggactttacctaacttgggagagacatatcacaagattagaggtcgaggttgattcggagttggtggttggattcttaagcaaggggattagtgattctcatcccttgtctttcgtggtacatatgtgtcatgactttttatctaggaactagatagtctggacttcacatgtatatagggaggctaaccgcctagcggatgagttagaaaactatgcttttactttaccattaacctttcatatgttaaaggttgttccacatgttgagacgatttttcaggatgatgaccgcgaaattgcgtttctgaggcatgtccgtctttagttttttttgttttttggggggggggggcggaagttgttctcccgggttgcacagaaattagcgagtaacaccttaaacacataaaacgacaccaaacccgagcacattatctatgaaatataccaagccaagttagaagaagagaaacactttgaggattatagtgatgcttccttgatagcaggtcaagtcggcatctaatagagttattaatatcctgaattagagctgagcttggcctcgaaaagttattgtgaggtctagagattctttccctccaaatgagataaatagacgcttgaaaagccaacttaagaatcaaagcaatgttcttcttcctgctaggatttttaagcatctgactcctgcatcaaacaaagatg

SEQ ID NO: 35409 - DNA, 3003 bp, Unknown
  misc_feature (1)..( 3003): 2750-1469P.txt file - cDNA_ID_3087225; gDNA_ID_2926302; Annot_ID_205740
actaaatcaatttaccttttaaataattgtattcaataaacgacaatagttaggaaaaaaacttaattttgagatcaatctaaacagttcagtgcaatgtgaattgaagctataattcagtgaagtttggtttaattatctacaaagagcaattcttaattgcgttgtattagtttcaagagcattccatttgaaagattattatggtcatcttttcacatgcataaagtcataaactaatgaaaatttcttagcagtcaaagaaacaattatgcatgtgcaagtgaaataaatgtcttaactaaaacaaattggtagatgattgtaactttgttttatcttttcttgtttatagatagtttttgtttgtatctttctgaaaatagtataaagactaaagttgtatttaatgtatggtcttagagccatgagggtggagagagagaagtagattttgacaaattaaataaatatatatatatatatatatatatatatatataaatttggatttgtccaatataatacagatcaaaataattaaaaaaaaaaaaatctttgatccttgcaaatgaaagttttgcaatatgtttagtttaaaaactatttaacctgttaaaaactaattctctttttctttctttttcaattagaaataaactcattaaatccaagaaaaaaattatttttgtaatttttgaattgttcaataagaatccaaattttaggcgctaaaatcaacattgaatcttaaaggtgtgattggtgggaagtgagaactaaaaaaaaaatagaaaatgaaaaactgaaaaagttaagaaaaaaatagaaaagtggtccaaaaatttcaactaataaaagatagaaagaaaaattgtcttactttatcctttttaagagaaatttagcttgaatacttgttttccatgtactttaaatggctaaaaatgaatttggtagaaattggtttcatccattttagtttaggctaacaacaatgcaatatattctcaaccttaatctcttgcgtgtgaggacaatatattttagtttacgctaacaacaagacaatatattctcaaccttaatctctcgtgtgtgaagacaagacatagccattattattctagtactaaataagacaatatatgcctaataaatagaaaacccgtaggtgttttttggagtaaaaaaacattaagtgaaatttgtaaaactaaccaacaaataaattataattaagaaacaaaagaggtatgatattctgtgtataaactacaatataaactaaaatacccttattttttcttgttttttagtcattactctagtacactataattaccatcaccaccatgcgctgcaaccatcaccatcatcgcaattcgcaaccaccatcgccatgtcgtcaccagcactaccactgcaactgtcgccaccataccaacaaccatagcgctgtcactactacaaccatcaccatcatcaccaccgaaactgctacaccaccgcaaccaccttaatcacgatcattattaccatattgctactaccccgaccaccgtaaccatcaccaccgcaatcaccatcaccactatcaaaacaaccagcacgtcgttaccactaccaccaccatcgtcagtccgtcaccaccactatcaccaatttttgaatagttaataactttttcttttttttttatctagaacactttgtcctatactatttattctattctatataccgtttttcatttgaaaatatacatcattttcaatttttgagtttatacaagttttacacatataattatggtttgggtataagtttttttggtttagcatttagtatattaaattaaaattgatttatgaatgagttatgaaaaatagtacaatatattcttgttctattcctatacatcctaaatagtacaacatatttttacttacacatactattcaccatttcacaaatttacatctaattttaaaattttaaactatgcaatatgtagaaaaatatggtttttgtgcaaaaaatcctacaatacaatttttttttaacccttcaattaaaaaaaaatgcaggtcaatactaccaacttgaaaagtgagccgcaatataaactacgtcgttttggatattttaaaataaaaaggaatgtttcaagagtgttttgaactcaggacctctagaagatataaaaccttacctaaccaattgtgccacataaaatttataaactcttaacaataaataaatatatatatatatatatatatatagacagcctttatgttcaacctgaccaatgcaaccaacgatctcatcagaatcacgcccctacatatcgcatgattcaattttgtaggctctacaaccttccattgagatggcaaaccgccattggttgtttaaaatcttatgtagacgctctagaagaaaatagtctcgacttttttttttttttaaaagagcagttatgtatttgagaatgtgccggagaaaaaaaacaatactattatatatcagaattgaataatacatatgataaatcatatatataatggataaggctaatgtgagtgtataagtctccaatgcttcaagctgattgtaccaccaaatctttttcaaaaaactaaaaattaaaaattaaaaataattaaaattttcaaaaaatcagaatttaggcagaacaaattgcaataaagtttttatttcttgtttctacaaattaaaatatttctggacgtattttttaatcttaagaagataggtttctttaattaattttttattctttattttaatttttggaattgaacagaagctgatgaagtgaatgataacggatccacccagccggacccaaatagccccaaaagcccttaattcatagctaacttaacccattcctcaagaaaacaaaattactttaaaacagaaaaaaagttgataaattgcttcagtgtcaaattctgagatctgtaaaagatg

SEQ ID NO: 35410 - DNA, 3003 bp, Unknown
  misc_feature (1)..( 3003): 2750-1469P.txt file - cDNA_ID_3087245; gDNA_ID_2936551; Annot_ID_194061
tgcaactaatgatagttacttttctgaaggaaatggtgctgacgatataagtttttgtaaccagggtgagtatccatgaagccatggaacaacagagtattagtatatcgaaggcaggaatagttacttctcttcaagctcgttgctctgttattgctgcagctaatccagttggtggaaggtaagctagaaactaatgcccttcattgacctaaaatttgtaattttgatcttgctaatttgtttgtgacattgcaacttcaggtatgattcatcgaaatcatttgcacaaaatgtcgagttgacagatccgatcctttctcgttttgatatcttgtgtgttgtcaaggtattttttcaaacctctgctcttgttcttgcatatcattgattgtattaattttttggctattgaccaattatatggctgcaggatgtggttgacccagttacagatgaaatgctagctgaatttgttgtcaatagccacttcaagtcacaacccaaaggtggtaagatggaagatagcgatcccgaagatggcattcagggatctagcgggtcaactgatccggaggtttgtgattttcatgtgtagctgcttctttgaagtttccatgtttacaggtcttgatctatatgttattttctatacaggtccttcctcagaacctgctgaagaaatacttaacatactcgaagttgtatgtattcccaaaactgggtgaactagatgccaagaagttagagactgtttatgctaatctaagacgagaatcaatggtaggtttgaattcatgattttgagtgtactgatgggttaccatctttcctaaacatcatgtggcttaatctcctgacctgcttaaacttttgtttcagaacggacaaggagtttctatagcgacaaggcaccttgagtccatgatccgaatgtctgaagcacatgctaggatgcaccttaggcaatatgtcacagaagaggatgttaatatggccattcgagtcctacttgactctttcatatcaacccagaaatttggtgtccagagaactctaagagaggtattaaagaacatttgagtcagttgttttgtgagcttgtatctatggaattctgatgtctgaattgatgaaaactcggttattcctgtgcagagtttcaaacggtacattacatacaaaaaggacttcaactcattgctgctcgttcttctcaaagagctcgtaaagaacgccttgaagtttgaagaaatcatttcaggatcgaactcaggactacctacaatcgaggttaagatagaggaactgcagacaaaggtaagttatcatatggttaggctaaatttagaagtatgattcttaatacctttttaacaactcttatgtcttacatttgcaggccaaggaatacgacattgcagatctacgacccttcttttcaagcacagatttttccaaagctcacttcgagttggatcatggccgaggaatgatcaagtgtccaaaaaggctgatcacttggtaaaacaagaagacgagcttcaagttactatcaacttaggtttatttatcattgcatgaaaaaaatgttggatatttaggaagatagtttcgttttgtgttaagattattaaagagctgctcaaagatttgctgttaggattatgcaatactcatcttaagatattaacgaagcattcctcttcctcaatactttgaccgttgaatctgagtaaaactcaggtggcgatttttcaatcggtatgtgagaaagaatttcggatgctagcttttgataccgcaagttgttaccaatcaaagtggcagtgtgaaaaacaatggaaaaatgtcattaaaatccttctcttatgttgacttttcaaaaaataaccaacttttgttgacatgaccatattgagcattctgttatgtagattaatagattccgataaatgagagtaattttttgttaacagtgacacctgttaattcaaaacgttatcattttcaacaacagaacgacgtcgttttgttgtaatgactgaactaaaatcccaaatttaatatacgattcctaaatcgagcaaaatccctaatcctaaatccccatacgatttgaaatccttatcccaaagttaatatacgattcctaaatcgaacaaaattcctaatcctaaatctccatacgatttgaaactaaggatttcattgagccgttatgacaaacgatgacgttttattgttagagggaacgttgtcattttcaaataacgagtctattaacacacaataaatttatgataacatggtctaacctacttaatgttatgcctgatatgaccaggtcaacgaaaatttggtatttatttaaaaaatcaacaaaaattgaatatttatttggaaaataatcctaagtttgatatttatttcgtttcgagaattgaagatttaaatcaacgttttcaataggtcgaagattttagtgacatttttctcgaaaaacaatgtaatacttgttgatctggctttatcatcaccattgtactaagtattctaacatttgaaagttaatgaaaaatatttggatacataagaactacatgccgtttttactttgacaatgtgaactccttgctgtttaaaataccaaggcacatttgtcgactgattcgtgtgttcgtcgagatttttttttgtttattgcaattcggagaagtttgggtcgttaaagttcgagtagggttcataaatatagtgaaaaccaccgtttggtgatacttcgtcgtcctcgacactctcagattcatcatcgaacctggtatgagctctctttcgtctttggtgctctactagttagggtttcgccattactatctccatcctctgttcccagagttagaatttttcttctgaaaacgcgaattaagctcgacgttgaaatgttttgctcttcagattaagacgcgaatttgagaggaagctttattttgtgtgtagatg

SEQ ID NO: 35411 - DNA, 1891 bp, Unknown
  misc_feature (1)..( 1891): 2750-1469P.txt file - cDNA_ID_3087245; gDNA_ID_2926302; Annot_ID_205731
gaattctgatgtctgaattgatgaaaactcggttattcctgtgcagagtttcaaacggtacattacatacaaaaaggacttcaactcattgctgctcgttcttctcaaagagctcgtaaagaacgccttgaagtttgaagaaatcatttcaggatcgaactcaggactacctacaatcgaggttaagatagaggaactgcagacaaaggtaagttatcatatggttaggctaaatttagaagtatgattcttaatacctttttaacaactcttatgtcttacatttgcaggccaaggaatacgacattgcagatctacgacccttcttttcaagcacagatttttccaaagctcacttcgagttggatcatggccgaggaatgatcaagtgtccaaaaaggctgatcacttggtaaaacaagaagacgagcttcaagttactatcaacttaggtttatttatcattgcatgaaaaaaatgttggatatttaggaagatagtttcgttttgtgttaagattattaaagagctgctcaaagatttgctgttaggattatgcaatactcatcttaagatattaacgaagcattcctcttcctcaatactttgaccgttgaatctgagtaaaactcaggtggcgatttttcaatcggtatgtgagaaagaatttcggatgctagcttttgataccgcaagttgttaccaatcaaagtggcagtgtgaaaaacaatggaaaaatgtcattaaaatccttctcttatgttgacttttcaaaaaataaccaacttttgttgacatgaccatattgagcattctgttatgtagattaatagattccgataaatgagagtaattttttgttaacagtgacacctgttaattcaaaacgttatcattttcaacaacagaacgacgtcgttttgttgtaatgactgaactaaaatcccaaatttaatatacgattcctaaatcgagcaaaatccctaatcctaaatccccatacgatttgaaatccttatcccaaagttaatatacgattcctaaatcgaacaaaattcctaatcctaaatctccatacgatttgaaactaaggatttcattgagccgttatgacaaacgatgacgttttattgttagagggaacgttgtcattttcaaataacgagtctattaacacacaataaatttatgataacatggtctaacctacttaatgttatgcctgatatgaccaggtcaacgaaaatttggtatttatttaaaaaatcaacaaaaattgaatatttatttggaaaataatcctaagtttgatatttatttcgtttcgagaattgaagatttaaatcaacgttttcaataggtcgaagattttagtgacatttttctcgaaaaacaatgtaatacttgttgatctggctttatcatcaccattgtactaagtattctaacatttgaaagttaatgaaaaatatttggatacataagaactacatgccgtttttactttgacaatgtgaactccttgctgtttaaaataccaaggcacatttgtcgactgattcgtgtgttcgtcgagatttttttttgtttattgcaattcggagaagtttgggtcgttaaagttcgagtagggttcataaatatagtgaaaaccaccgtttggtgatacttcgtcgtcctcgacactctcagattcatcatcgaacctggtatgagctctctttcgtctttggtgctctactagttagggtttcgccattactatctccatcctctgttcccagagttagaatttttcttctgaaaacgcgaattaagctcgacgttgaaatgttttgctcttcagattaagacgcgaatttgagaggaagctttattttgtgtgtagatg

SEQ ID NO: 35412 - DNA, 3003 bp, Unknown
  misc_feature (1)..( 3003): 2750-1469P.txt file - cDNA_ID_3087254; gDNA_ID_2926303; Annot_ID_205798
aaaggcgcttccaacttctacatttagaaagcatgttcaaagtattggaatgcttcatctacgagacctgtgaagtctcttcgagggggagctcacgtcactgtactctttttcccttgtcatggtttctatcccaatgggttttccatgataaggtttttaacgaggcagtacgtaactcatcaaaagtgatggatactcaagggggagtattataaaccggataagtatggatgtgattatccatcactcatctctatccataagatatggatgatgtttatccattacttcctccctaagatatgaatgatgtttatccattactttatccctaagatatggatgatgtttatcaattacttcttctctaaataatttacttcctagctaagtaagctctactatatatagctcatttcattcatttgtaagttatagagaaaacagaaaaaaaaaaggagaaagagaaagcaataaaaaaactcttgtttcgagttttattctctctagtatttattcttctttcttattttaatcttttataacaatccgatttttatagacaaattacttattttgttcttataaccatgatatcaggtatgcgccgcaataaacaaaaaatacctaatctactatttttcttcaattgaaacgtaggctaatttttgaaatgagaaattattattcaaaataacctcttttctaagttgaatttgtcaacattcactgtgtctcaagctacacatcacgaatatataaactgtaatagcatggtaaaaagataatcaaatatataacgtacgagatgttgttgtagcgagcgattacaataaatatatggattagttagacttagataaataataaaattttggttcaaatttgaccaaaaaagaagagagtagtaaatttgtaattaagcgagataattttattgcgagtgatatatatatattgtgttatatttggagataaaatgtactattgaaatatatagagttgtaaaatataatgtcatcgaataaaaacaactttgttttgacgggctataaacgacactgttttgataaaaaagaataagcacaaattatatttctttttttttgttaaagggttaagcaaaaaatatatttctctaaaataaaaattcgtaaatttgaagatagagtgtttaaagcttacatattgtgttatttcatgtgaatatattagtttgatatatcaatacatttaggttacaactacaaataaaaggaaatcgtaagaggattgcaacgaaagacaaaagatttcagatacaagaaaagagaaaattagaatgagaatatatatcgacacaaaagataagcaaaccctttaaacgtagcagagtcttttaattattttccagatatgatttcaccaaaccaagtcctcttgcttcttttgacttcaaccgacgttaatcactgaacgaatattaaaccaactaaaccaagtcgacatcacggtaaaccagtaaaattggatcactccattaacaatacctataaatattactatgtgtttagacagatttgattctggttagttgcccttcacggagtagaaattaagtcaccgttattttaataacaatgcagatatgtatttaacctatgtagaaagcacatgctcaaattcacgagactcaaaccatttaaatccaccgactagtaactaatgctctcaactttaaaaaataattttcacagaataataaacgaaattttttggtcttgactttaatttatagaatatttttaaataaatagatcaagtaacacgaggacgtcaaacaaaacaagcctacatatgaagaaataaaagcagccaacgaaaccacatgggaaacagatccacccggaagctcaccaatttccaccgacactaattttttcttaaaataaaacagattgtttaagattagatttggcaaatataaattgctaagaaagttttagccgtaagaaatatcgacagaaaattcgtacatatacttttttgttagaaaatacgtacataatcaaaaaggtaaaattacaaaaataataaatttactacgatgtttaatatgaaacagatgaaataagtgatagtaattatatactttttatttttttattctcttaactcttttgtttctgattagtaacaaaatttatttcatatcaattatgtaaataatatttttcaaaattggcttttttaagctgtaaataaaacctgattacaataaaaaaagattagtaagaaaattaacactgtttaattttatttttttgggtgattaatgttggaaaagtttttatacttttgataataatgttgtagccatttgtcctttctttttactcttagacacccttgtagcattaataacagtccgtgtttataatgaaaaacatcaataattttaatttgtaatttaaagttcaaaccacttacctactcaaattgctcactaactataagatgaaaaggaaatttattcaaatcaagaaaacacgtagaacagggtaacaaagtttgatttcctaattataagatgaaagaaagtttggtaatacaaaaaaactgctaaattacaaaaattaaataccaaaaatctgaacgatggttgtgaaaacagtcaatgcggttttacgacgaaattaactaatattacttcgattaattagattattttcttgaaaaaataagaattcaaattattcttcacaatttaagtcaacgcagtaatttttttttaacttgtatcaatgtatttaaatactcaaatatttatactactattttttttttgttggggccaagtctatgaactccactcgtctctccctcgacgcacttaaatttacataactaagtgtgtgtctattcatatcactcactctctctcttcctcacacttacattctccctctatttttttttctctctctccacaagaaacgccgtcgttcattaaaaatgatg

SEQ ID NO: 35413 - DNA, 3003 bp, Unknown
  misc_feature (1)..( 3003): 2750-1469P.txt file - cDNA_ID_3087301; gDNA_ID_2926303; Annot_ID_205784
cactattattcagcagccgtttttcattcctgcaactttgtatttcgatttttcttctaagttattcagattttgctttcatttgcttgttcatctttgtttcattccctttaatatttttagtatgcaatcttcaatcgtttctatgttattgtctttaagcatgttgtctgagtagtgattaagatttctgaggatgggatagagtagttgtggaacccctcgtcgaatctgttggttaagtgtatatttattgaatcccttctggattaattgtgtttactgcttattcctttctgatcaacaggaatccgatcccagacgttccagcactcagaaggcgtttaatggaacgttggatctactaattccagtgataatcgtctctatcccaagggattggccgtttagagcggttattggctttaacagtcgattcttattgtctgcttagttagagatcgctaatggaaattaggtcagtgtctagctatgcttgaggatttatatcacgggagtgaattaatctgttgttgaacctgttgtctagggatagcttaattgagatttgttaaccaactgaattgattacggagaccacactattcgataaccccatccttaggagtttctcatccatatgatttctctgtttacttacctgcttcattcacttgccattgaattttagtatttttctgttttcaaccattctactcgatcacaccagtctactaacagtgagactgcgtgatagagtaaagtggtctatttctgcattttcactctttgtcatcctgttgtactcgatcacagggtcccttctggcagtcgatcctgcgatcgagtatatcagtcatttctgtgactttttactgttttctgcatcaacactaggactgttagaaaaccaaccaaattctgcttggcttgacttagcaacttctgatcatatctcatatgtctgcatcacacccatttggattgacacctaaaatattacaacgacaggattagtgttttaggattaattgatctcaaaaacctattatcaactcttatcgccaagcttcatgagtttggtggcaaaagacacattcgttatagagatctcgcaggcttcatctatggtaaattctccatcactctctcgcaatatcaaaaaacacacttaactagaattgtatttgcttgattgattcaggtaaaaagatgtatcgtgttacatggggattgcaatatgtctatcttttcatgattaattgtgccttcatcttacttgctggttcgaccttaaaggtacaacaaccgaaacaaaccgttttgttgcgaaaatccgaaaattagctcatatggctctgcttttgcattgtgtgcaggctgtttatgtactttttagagataattgtctcatgaaactgcctcactttatcgccatcgcgggtgttgtatgtgcgattttggccatcggtattcctcatttatcagctcttggaatctggctaggagtttcaacaatccttagcataatctacattattgttgcaatagttctagcagctaaagatggtaaactttcatgttaaatcaaacctcgaaaatgatttcaaataaccacaaaaaaactactcgccattttgtttttggttcaataggagtaaacaagcctgaaagagattacaacatacaaggatcatcaataaacaaactcttaaccataacaggagcagtttgcattcaacacgggaatgctaccggaaatacaggcaagtctcatcgatctatttatggtcaatcaaatatttctctgttttgtgacttacactaatcttttgtgcaaatgattaggcgacagtgaagcaaccggtcgttaaaaacatgatgaaagctctgtattttcagttcactgttggtgttttaccgatgtatgcggttacattcatcggatattgggcttacgggtcctcgacatcgacttatctgtttaatagcgtcagtggacctctttgggtcaaagcactcgctaatatttcagcttttctccaatctgttatctctttacatgtaagtctctatctagacctcaatgatgagtctttgtgtcttaatcctaaccttaaccgtttaaattcttgtgtttttcttacgtaaatttttgcaagtccgacttatgagtatatggacacaaagtatggagtcaaatgaagaccattaggaataaaaaatctgttgtttagaacagtagcaagaggaagctacatcgcggtgagcactcttctctcggctcttttaccgtttctcggagatttcatgagcctcactggagcaataagcacgttccctctcacattcatattagcgaatcacatgtatcttgttgctatgaacgataagcttagtcttgtgcaaaagctttggcattggcttaatgtttgcttctttggattaatgtctcttgctgctgctattgctgctgttagactcatctctgtggactcccaagaacttccatgtttttgctgatgtttgattaaaatgtcttcgacattgttaacgatgtaaaaattataccaagaagaaaaaaattgtaatccttttgttgttacttttattatttcaaatgacataaattttttataacattatatataaaaatttttctgttcaacacaaatttttacttttaacaaaacaattcaagagacaaatagaagaaacaaagtaaagtgaagtcatattcttaagcaaagccatattgattaagaaaataaataatcattttcttatgcaaagccatatttgggccaagccgtattaaagtttgggccaacttgtttgagatagccacatataagcccaatagagttttgttgctgagcttatttatgaatccatataaagtcttgacctaatagcgaaaactagggtttttctctgtgaattcgctcggcggcataaaagagagtaagaagaggaagacgagagttacaaggattgaaaatg

SEQ ID NO: 35414 - DNA, 3003 bp, Unknown
  misc_feature (1)..( 3003): 2750-1469P.txt file - cDNA_ID_3087303; gDNA_ID_2926303; Annot_ID_205783
tgaaatatatgcatttgtcacattcattaatggtaaaaccattagacatcataacactgtcaaacttctcatgccactacttaggagcctgtttgagtccgtatagtgacttcacaagtttatacattttgtgttcttgtcttaggataacaaacccttcatgttgtttcatgtagatttcctcttccaaactccatttaagaaagctgtttttacatccatttgatgtatttcaagatctcgtaaggttgcaatgcttatgagcatcctgattaaagttaatctcgttactggagaatatgtattcaaagaaatctaaaccttttttttgtcgaaatccttgtatcacaagcctagccttgtacctatcaatatcaccattcgtttccttttaatagtaaaaatccatttactccccaatggtttagaaccttggggtagatctgctatctcgtaagtatgatgttgcaagatagagtctatctcaatattgactacttccttccaataagatgcatcagggatagacatggcttctgaataagttcttggtatgttttcagctaaaaacaccatcaagaaatcatcaccgaaagatttctctttgcgagctcttttgctccgcctaggttgttcttcaggttcctttactgtttcttcaacagtaatagtacccaaactattttcctcagcctccgaggttgttgaatctcgttgttcacgagtttgttttttgagttctcctacaaggaaaaatatcttcaaagaacgatgcatttcttgattccataaatgtattttcatggatatctggaatattcgattttttaacaagaaatcgataagcactgctgttgtgcgcatatccgatgaagatacaatctacggtcttaggcccaattgtgacctctttgggaggtggtacatccacttttgctagacacccccacacttttaggtatttgtacgagggtactgtacctttccaaagttcatgtggtgcctttgcagtcaccttatgtggtatcctgttgaggatgtagttagtggtaagcaaaacttcccccacatgttttgggctaacccaagttcatgcaacagtgcattcatcatttctttcagagtttgattctttcgttccgcaactccgttagattctggtgaatacggagcagttgttttgtgtataatgtctttttctctacaaaatacattgaatggctcattatattctcctcctctatcacttcaaactatttcagtagttctctgaagttggttttctacttcgagtgtaaattctttgaattttaccaaagcttcatctttgttatgcaatagatatacataacaatatcttgtgcaatcatctaggaaggtaacaaagtatttcttaccgcctctagtttgcacatattttaaatcacataagtctgtgtgaattaaacctagaggttcagttgttctttcaactcgtggtgacggagtttttgtgagttttgcccgtacgcatacttcacatttttcttggttagttttgaatatcggaattaaattcatgttttgcatttttctcattgttttataattgacatgtcctaaacgttcatgccaagtagtaaactcaacaaagtaagcaataggattttcatttatttcaacaacataagctacagttttaggaaagactgtcattacagacattttgaccagtccacccttaacaaaaccctttctcagatacaccccatgtttctaaagaactagcttatcagactcaaagttaactgcacatttttaatcctctaaaaattaattaagtaagaaaaaattttagtactatttgtgtcaatcccctagataaaaatgagagcaaacactaatttaatattaaattgaatcaatttttgaaaatatagtggaaatatataccctaaattggaaataaagaactcaaatataatactacaaactaattttaaaataaaaaaatttcttttaaatagtgaaaatatataccctaaattggaaatagaaaacccaaatataataccataaactaatattaaaaaaaatcgaaatttcttttaaatgattgaaatatataccctaaattggaaatagagaacacaaatttaatattttaaatttattttaaaattattttggttgaaaatattttatataaaattatgatattattgaaaaaataaattagtgataatacttttaggaaaaaaacttcataataaatcaaataatgctatttttggaagtttatggagggtgtgctattattgtccataaaacttgatttagtgctatttttaggaatttatattttttgtttgttgctgctcgtttttggtgaatctacttgtcgtttattgcataatctcgagctgtttctagaagaaaactcttctattattggggaatttatgccccttttcgtcattaaagttttcttaagaaataatacacagaccgggaattgaaagggtcgtttagctttttgtcttctttgttagtttcaatgatactctgttacttgcttttacccgacaagctgttgatgcatgtttcagctgctaaaatatgaagcatcaagggactaaaatgatgttactttccaaaacatgttgtctttgatgattttggcggtgccctatagtggaaactggaaactgttgtctttgatgattcaagaatgtgaactttcaataagtttcttgatcagtttttgtcttccgcaaatttttagctatgaaaactctatttttcttttgttttatattactctgaatttacattgggatgaaaaatgagtggctgaggaatatagaaatagttgacaaaggatatatatactctattcagtgttgcatgtgtgtgaaagcttaagtgttgaagaacttgtacaattcatggtttcaggtagcatttgttataacaaccggtataaacagtgcctatgtgttgggatattccaagacagtcatg

SEQ ID NO: 35415 - DNA, 3003 bp, Unknown
  misc_feature (1)..( 3003): 2750-1469P.txt file - cDNA_ID_3087382; gDNA_ID_2926304; Annot_ID_205815
taaccgtatggagatttatgttttagctttatctcagcatcgtggagttaaagaagttactgaatggatgtcaaaggtgtgacttttttctactatagtgttcttcttgtggtactttggtgggtgactaatgctttagaacatgttaagagtggtcttgtatttatatgtttaattctgtggtgtctactacagattgatcataccatatgcagagaatctatatataatctgttcatatactattgagtgtttaacgtggctgttttacagtcggtatcaagggctaactaacgagtcttatctcttttttcagacgagtgggatcccagtttcagagatttgtcaacaccgttttctgttgtacaacaaggatgctacacagcatatatttgaagtctcagctggtcttgactctcttgtcctaggagaaggtcagatccttgcacaggtgaaacaagttgtgaaagttggtcaaggagtgaatggctttgggaggaatatcagcgggctgtttaaacacgcgataactgttggtaagcgtgttagaacagagacaaatattgcttctggtgcggtttcggttagctcagctgctgttgaacttgctctgatgaagcttccgcagtcttcaaacgtatctgctaggatgtgtgtaattggcgctggaaaaatggggaagcttgtgattaagcatttgatggctaagggttgcacaaaagtggtggtagtcaacagaagtgaagagagggtttcagctatccgtgaggagatgcctggtattgagattatatatcgacctcttgatgagatgctagcttgtgcttcagaagcggatgttgtgtttaccagcacagcctctgagacgccattgttcttaaaggagcatgtagagaatctccctcaagcttctccagaggttggaggactgaggcattttgttgacatctctgttccgagaaatgttggatcttgtgttggtgaagtagaaacagcacgggtttacaatgtggacgatctcaaagaagttgttgctgccaacaaagaagacaggatgaggaaagcaatggaagctcaaaccataatcacagaggaatccacacagtttgaagcatggagggattcattggagacggttccaacgatcaagaagttaagagcttatgcagagagaatcagagtggcagagctcgagaagtgcatgtccaaaatgggagatgatatcaacaagaaaacaacgagagcggttgatgacttaagccgaggtatcgtgaacagattcttacatggtccaatgcagcatttgagatgtgacggaagtgacagtagaacgctgagcgagacccttgagaatatgcatgctttgaacagaatgtacggtcttgagaaagacattttggaggaaaagcttaaggcaatggcggaacaacaacagaagtaaaagagaaaaataagaagatgttcatctcttttgacatataagattagcttccccacaaactctgagtaaattgcatagatcctatagcgatggatctatttgattcatttaatttgtgtgcaagagactaacaattctatcgtcaagtgtaagtgttgtgaagctataagcgagcttgttgcatgtttgttgcttcatagactcgagtgtaatggtattggtcccagtatcgttacatatatgtaataatgtataaactttggttcttgcaatatagagaaatgtttttttctttctaatcttataaactttggttcatggaatttaatggatttgaaaatccaaacaaaaattatgtgttatttaatcattgattttagtgttattggttctatgatttacaaataatagttaaaatattgagtttacgtatagagcaaataataaaaaccatttttcgttcatagttgtctttaagatcacatgccatgtgcatcattttgctgtcacgtctccaagattgttaatttgtatgtgtaatatgttttcgacctgtttcagtacctaagtagcaattcaatcatttcaccaaaacacacacacaaaaataaaacttcatctctaaaaatctaaacgacacctatgtcattttcatagcttaacttatgaatattcattgaaactatttccttacattaaccgaaatatatataactgaaactaacgatatatgatctattcgtagagatgaagaagaagaaattatccaaatcagaaatatgggggaaaattcgcaatttcatctgaagcgggctgatcaaacttggttaagattaatttggtttaattccaatttccccggtatggaatttaatttggtccactttcctagaatttttttgaactgtcttattgtacattttttgttatgtatttgtcaataataatatttaataatattttgaactgctaaaaattgtttcaaaagatagtgtttctaatcataattcttcttgtttacaattttattcataaatagtttttaaaatcttttggaaaatattaacggtataacattaaacattgatataatttatgtaataattcaaatattagaatatatcattacaataatttaataaacataataatttctgtttttataatttaatatataaatacaaaattttattgaaaatgagtttcctgcgatgcgggattcataacctatatgtaaaaactaacgtaaaaatttcattgcgtacatggaaactatttgattagttttataagtggtgtatgagtgtgcatgactaatagttcagtcgggcttaaaactatttcttagaatttctcattattagtttcttttcttttagtcatcacattaattcaagtcaaacagaaccacaacaaatggtgcttgccgcttggacaccactagttggaatttcgaatattccaaaggttctactcatgtaataaacaaaagttataataggaaagttagtaaacattaacaattaaagaaaagcagaaaaagttaaactcggatctctatg

SEQ ID NO: 35416 - DNA, 3003 bp, Unknown
  misc_feature (1)..( 3003): 2750-1469P.txt file - cDNA_ID_3087386; gDNA_ID_2926304; Annot_ID_205814
aaagggcagagaatttgagtagggatttggagtggttcaaggaacaaggttacgagattccagagtcaatggttcctggtaaagcatattctcagtatttaaagaatatagcagagaaagatcctccagcattcatctgtcacttctacaacattaactttgcacatagcgctggtggtcgaatgattgggacaaaggtagaaaatagtacaacttaattctctaagaaagtcacttaatgttttttataagtttacaatttgtttaggtagctgagaagatactcgacaataaagaactcgagttctacaaatgggacggccaactttccgaattgttgcagaacgtgagtgaagaattgaacaaagtggctgaggtatagaacataaaatcaatgtgaagaaagaaaattaatgtttggtgcattctaattctaaagcatattttatgatgaatgggcagttgtggacgagagaagagaagaatcattgtttggaagagacagagaaatcgttcaagttttattgggagatttttcgttacttattgtcctaatttgtgatgagcttccggtggcaacaaaaagtggcgggaaggccatcaagtgtacgtatgaaaacaaaatctaaaataattggactaagtctccaagcacatgtctttactctatggcataataataataataggaagtctatgtggttaccgaaatgtaggaatcccacttccttagttgttcacttgtttcttttccacttccacgtttatatgagctaaacttcgattctagtttaattaatcttttggctctacaatttggtcaattggttagcatccagctaatgccgtcaactattaagaaaactccaacaaagagaaatcaaaagagatgataccaaagaaacataagagaagaaagagagagacatcgtgatgagaaagattggagattccaaaggaatcgaaagaacaacaactatttggtcagagcctttttttttttttttgatcagatttgatcagtggcttaaaaaacaacaacttctacggtctctcttcgctgttctagatttgtttatctgttgaattatattcggtattgattaataggatctcttcgtttcatgccactttcctaattttactacggtcaaaagtgtcgagtatgaattttatgtttctaatggcaatatgttgtatgagtgttagcgatctgtctactagctagtttattgtttcagagttatctgagttaatgacatattatttatgccactatattttgacatattatttatgccagaaaaaaaaaatatatgccactagcttgttttctctaatttaatactgttttaagttctcaaaaatttcaaaaactacaagtcaaacttttctgtaatgcatgttacatacataatattttactaattaattttatttttatagtacgtcttaggtacataatcttttgcttattagttggactatcttactataataattattcgtgaaagttattccacaaatctatccatcggttgcttcatgagattaaatatctccgctttcgttttaaatatattagccggactcaacatatgtaagaaacaaatataattacatgttaagaagttagtaaacaataaattaaaaaataataattaattttaaagattaattttaagctcatatattttgatatatgtataaacttcgcatattataatcaatatattcataggttgacgcatttacaatgttaaaataagagaaattttgaaaaatcctaataacatttaattattttattcagaacttttcatataattctccttaaatctacatagattcctttcagatatcatttacaatttttttttttgttaaagcagatatcatttacaatgttcaaatataagatatcatttacaatgttcaaatataagaagaattttgagaataccaacaatatttaattattttattcagaagttttcatatttttcatatggttctcctaaatcaacatagattcttttcagatatccggataattcctatgcacacatatttttccaatttatttcctcatcagaaacaaattaattaatttcaccataaaatctcataactcataagagtcacaagtctactaagaaacaaataaataaatacttatatgttgccgtgtaagaacaaatgccaccaaatacgcaaaaacgagtgtggataaaacgtgttctccacccgccaatcaaattccatcaaaatctcaatgcattcctcattacatatctttagattaccatccaatcataatcctcaatttccagttctactaaaccggttttgacccgatttgatttttcagcctcaaatctgacaaatcatattcacagcgatctccttcttccacatcgcaacccaatccctctctgtctcttcctcaattcttattctctctcgcaaaggtttggttttttgaagacagagaggagatttgagattttgggtttcaatggcggtttcaagtgctttcgttggttgtccaaagcttgagactttattgaatcaccataatctatctccttcttcttcttcttcgtcctctgtttcacagacaccattgggtcttaatggggttcgtgttcttccgaagaacaatagaaccagacgaggtttgatccaaaaagctcgttgtgagctctctgcttcttctgattctgcgtctaatgcagctagcatctctgctcttgaacaactcaagaactctgcagctgatcgtatgagtctctatctcttaatctactcaaatttgaatcttttgtttgatcaaagttataaagtttgaatctttgtttagtgatgtcgtgattatactgaagacagtttttgttatgaattgttgttctgacttttcatttgtggttgttaggatatacaaaggaaagaagcagtattgttgtgattggacttagtattcacacagctcctgttgagatg

SEQ ID NO: 35417 - DNA, 3000 bp, Unknown
  misc_feature (1)..( 3000): 2750-1469P.txt file - cDNA_ID_3087404; gDNA_ID_2926304; Annot_ID_205809
ttgtccctcaaagcaccaagagatacttcaccgtgtgtgttttttcacttacgttgtactgaaaatcatagttcatccatcctataatactacagtttagacacaattaacaaaggaacaggttatgaaaaaaaaaattgcgatcaaaaaaaataccaattgtttagacatccacatgcaaacgtcaattttaaaaaagtcttacaatcacttcactcataaaacgtattgcatattgcaaaaaaatgttactattaccctcaaacgatgtgagcatacaatgcttgacgctcatctaagtttggttatgatatcacttggaaagatccgactacaattatttgtggacctttctgttcactcctagcccgtaggcttcatccacgtctgaccaccgatgtcaaacttttgaaacctctaagaaacttgttattggtcatatatttcaccacaaacgtaaaaatacgtgtttttacatctcatgatattaataatcatttataataggtcattttctttagatatctctaacttagacacacttaatgtgtaggtttttcaaaatgagtcacgaaaaagttaattacactttggtgatacatgaaaaatcaaattaataattttgatcatctcaacacgcacaactatttttcaaattcaagttagtacaaatactatacgatcctcatttactagacaaaggttatattcttaaaaccaaattaactccggaaaaactttgccccctccaaaaccaaattatagcttcagatcatgtattatgtatatgaatcacaaaatgtgcaggtcaactagttgttctccgttgccttaatttctcttcttctccacatgtcgttccctcaccatcagactcccaacacatgttaccatatagatattaagccataaataactcgtcatacaattgtacaaagtatttatagttacgttgtacaagaaaagtatttagaattggttaatttgcgataagacctttagtctacttgatatatttttgcatacacgtgagaaatttggtcaatagaaatgctgatctaccgataacggttttgatccttttcacgccaaattttatagaaaatgatcatatgccaaaaacatatacaacaaatgaaattgcatgttgtggtaaaatattgatacaacgttttaattaattgtaatcatttgatagaaaacaagctattttaacattaataagttatatataataaataagttactattaatattttacatttacttttataaagatttatttattttaaatagtttttaggtttcatggtatggtggcaatgaacatgctttcaagccattttctgcataatagtgtttaacattacattacattacatatattcattaaacctaaatgttaaaattatatatgctaaagttgcaatagacatgcaatttgaaattggaagaaaatgctaaattaaatctcatgccattttacagcataatttgatattttagacataggaaaaacttaaattttatcttgattgactaggaaaacttaaattaaccgttagtgcaaaaaaagaaaggattatcttcacagaaagtatatagactaatctagtgcagtttcctgtttgacatcattacacctaaccttaaaattttcggagttataaaataggaccgacctctgtttctaaatgtttcagcggaattaaagaaaaacaaaatggcataaaatttgtaattgtgtcacaaatcacaaatgatataaaatttcattttttatcaaaaaaaaagaaaaaaaaagaaaaaagaaggaaaaaaaaaaagagagaggcaaaattggcatattaataggaccgaccttagttggttttgtttgtttttaatatttgctatggagtatgtgttttagcaaaaacaaatcataaatgtatatacattgttaagtgtataaaaattgtaaatccgtaaaatttgagtcaaatagcatacaatatctataaatgccataaaaatgtaaaattcatttaattataaatctaaatcctaactactattatataaatccaaaccgatatataatctcgtttaattagaaaatttaaaacctttattatcttttataaacctaaatcaatatttaaacttgtttaattgtaaaatttaaatctgtttataaactcaaaccgatattcaatctcatcaatcataaaattgaaatcttaactttttcttataactgatatataatttttttatggcaaattatattttctaattaaattaatttaatattatttattaggtggtagattttgattggctagaataaaaaagttcacccaagtatttttcaaaacaagtactaaccccatcaacttatgtgaccaaccgttattgaataaatgctttttatcctctcagcctaagaggtaacaacagcctgatattctagcacttaggacgactgtgaattcgccagccgacataaccgaaagagttcaatatatagtgaagcccaaagttgagttaaagattaggaaagagatttgctattattaaaggtaatgcgatgtattttaaaatagttaactaaaccaatttttatgtctttcttcaaaagtgaactcttgagctatcctaaacctgtgtgtcgttcttctcacagacttatttggtggacacacgatttgtttagtcaaagcaaacaaaaaaagtcccacttccctattagaaaatcaattctttgttaaaaagaaattaaaactaattttcgccacgtgtagaaacgatatcgcttctttacaactataaatagtcagcctttctcctccaaaaggcccaaccaattccatattaaaaatattagttcctctcggttccttttatcatttgcataaaatcgttttgcctccaaaagactaaaagctctagactttgtctctttgtccttttatctctactcccaacaaaaccagtttactcctcttaagaatcatg

SEQ ID NO: 35418 - DNA, 3003 bp, Unknown
  misc_feature (1)..( 3003): 2750-1469P.txt file - cDNA_ID_3087408; gDNA_ID_2926304; Annot_ID_205808
gagtatggagaaaagtactttgaatttgtatgacaatttgtttggggaacccaaattctcatagtccacctcccaaaaagaacttttgaatttgtaactgacaaaaaaacactcaataaaataatgaattcagagagacagcaacaacaaatctaaaataaatgtaaacatagactgttatgtatttgttgagacaattaactctgaataaaatggacggtgtatcgttaagtaactttagtgccgacttctacgattaataatagtcacaaaataataaaataagtttagtttaaaactttaaataataaacttggtgttacaaatatcactaaagctcgggatcttattttcaggtcatatcaccagcactcagaccctatcgactggagtagttcaaacacgactcaaataatactttagttcattgttagacttgtctagtctttgatattgattgatttaatgtttgttacatttatttcaaatgatttatgaaaagtttcaatgtcgttgacaaacaaatttcaaactgtttggttgactaagaaaaataaaattcaaagtaattaagaaaacaatttatattcaattcaatttatgaatgttaaaacgtttggatattcatcatagtgaaattttcttttgtgtactacatcatagtgtacagatattcatatgtccagtaccgtctctcgatttatacatatttttttgtactactaaatatagtattcaacaaaaacaattgcattaaaagtggaaattatatgtttcttttttttaaagggtttattatatgtttctatatggtcatgatataacatgcgaagatatttttcattagaattatatccatttatttaagttttaatagtgaatcaaaaatagttgatattcgtaaaatatattaataagaacattctccgacctccgttatgctttacaaaatgtaatgttggagtagcatggtctaaaaggaaagggaaactactagtggggcttattgggtgctccatgatcacatgtgtaaggttttgatgcatgatttgctcggcccgttatactttatttgtttaccacatctttgctaattaaccataagttccgaatgtaactctcgaccgctatttttaatactacggccaaaaactcgtgttattacattataggtattaaaacgtttccagggttttatcattccgagataagggaaggatataattttctgaaatgctgcaacaaaaccaaactacgtactaggattttagaagctgaactaaattgaacgttggtaaatttttctttgattgccattatcaaaatcgtcacgaaattaacttcaaccttactcctcacatttttcacaactcttttccttataccaaattttctaagaagactcttgggattcatctgtagacccattataaacatatggcaaatatttggaattatgttgttgaagggaacatagtaaggccctgactcctgagaatgtctctcgaaactttggaaactacttagaatcagcctatatatggcaaagtcggaggtgaataagattggctaaaggcttcatgccatgacagaggagagttcgaatgaagaaaatggcgacgaatttaagaaaaaattcaaagcctctttaggttaatttgtctaagttaaggtaccatttgtgtccacatatgacatatacgatttttgttctagttgtatatatatacaaaataaatcttatgggctgaatacacattcttatctactaaattaataaaatgacaaaataagcaaattaaagaatcctaatggaatgttagattctacatttgaaaataacattaaaatttaatcttgctaaacaaatttgataagaaatagatgaagatgccactcgtgatgctaacgatattcttcatttagctttacaaaaagatgtgtctctttctaacactttgttctttaaatctgaaggaatctacaataatggtccatgattccatatacaatttaattcatttagtactactacattatcaagtccatgtacaattttaggataaaacggaatttgaagataggatacatctaatcttttggccttttgaagatgccgtgaatatattttagcatcaaatgaagatatatcgacttgataaaaccgatacatcaatacaaatgaagaaatattagttttcgtagttggaggaaggtttaatttgatcatatgatttgggcctaagataatagcccattaagtataaccaaaggcttaaaactaacttagtcaaataatccgaaatttggcgggtcaaatcttttaccgtacgaatcgaaaaaacaagacagcttggatcaaaggtgaacattcatccttccttacccgacaaatttactcaaaaatccgacctaaagttttgatttttataatcaaatttcctcgaattgctcgacaaaagtttattcctttaccatcacaatttgtagtttacccagatccttttctcctctgttttttctttcgcattgttatcttcagtgtctgtctcattgttcccttttcccagaagctgaaacaaatctgttttttttttttttgttttgtttctgtgaatcttcagatcttgatctgagagaccctacaggttctgtttctgctctgcgattgatttaattacatttttgattgatgattataactaacaaatcatgggtctacatttttcaagaaaaaaattatgttaaagaaatgtttttgctaaatctgaaatgtttgtgaatatgtttctctaagtgtgcttattgctttatctgcagattctcttagtgttttggttcactggaatgatcaaggatctagttatgtagaaatttcttagtttgggagatttcatgagattgctaagagttgagtgatactaagttcaggattaatattgtttttgagaagaacacagtcaaagatttagaaagtgatgtgattttttgggttcacatatg

SEQ ID NO: 35419 - DNA, 3000 bp, Unknown
  misc_feature (1)..( 3000): 2750-1469P.txt file - cDNA_ID_3087413; gDNA_ID_2926304; Annot_ID_205805
cttctttttttttttttttttttttctttttttttggtaaaccaagtagaaatctcttcagaaaactataaatgatgctaattattggtttcccgattcgcttactcacaatttgctgctttattagaattttagtacaatgtttctctaaaagtaagtttttttcgtccgggatatattttcataattatagttttttttttgggataaaatgtaaatattattaccaaaaggaacaatttctttacaagagcttggcgtagctagtggttacaattagactaaaaaaagaagattaaaaagcctaattatgaaaagaagttgtgaaaaagcagagattactcatgcgcaaaccattgttgaagcagatttgcaaaagatggatgtttacgacgagctaaaattgtgtctctaatgtctatcgacgtctttgaaaaccttgaggatcgtggatgagacatagttgtgcaaacggttgttcctctccttccaagtcatgttgaggaaccgtttattttttattttattgaaacaacaagttaaaccgaactactatttattgttatttgttaatagagatgaaatttcaaatcacatttttttcttcttcttatttaactaacaagtaataaatcacgatttgtttataagaagcatcatgaatataaacgagagcaaaaagacgatgatcttcatatatacaatttcaatgatttgctgctcattcgttgaaagagttaaattatattaaacactcgacacaacttgacttttcaaacgtggttagagttagatgaaaaatgagaagtcttttgagaaaactataaatgtttttaattattggtttccaaattcgcttactcacaatttaattctttattagacttaagtaccatgtttctctataactaagctttttcatatttagataaatttttttttttttttcgtaattaaaacaactagttaaaccgaactatttttgattgctaataaagatgatactttgttttttgagaaagaatgaacatgatatttcaactcgatttttcttcttcttatattaaacaagtaaataaatcaccatttgtttctaaagaagcaacatgaatatatatataaattaaagaacgatggacatctatgtcacggtctaacatttttactggcaaagggcatttgcattatttgacctgattgagcatgattaacctttataagataatgtaatctcttaatagccaaaacctacgtttacgcttttacccttcatccgtttttttgttcaactttttactttttgtttcagtcaacacacgtttactcttcatcaaactcaaaccttaaatttgtttattttttagttttattttggtagaacattgaaaaccaaaatttgaagatcaaataaatcaaagttatttatggtagataagtagcttctctcgtcgtttcaagatgcttaaataagtagtatcttctgactttctgattccctcaattaactgaaagaatggttcaaggatttgttagctcttaggatacattatatataagccgtttgaaaaacaactaggtatgttcgaccaagtagtacgaaaaactaactcctaactaaacgagaaaaaaacattaagagaatgagagttccaacatgatttctattattcttgtatgaatgagtttatgagaatttggaataattcatgaatctacccaaattttcattatatatggatttatgaaacttggtaattgatacgaaagtattttgttattttattctcgatatattaacattttttttttttttttaaaaatagtgtttttttttaacatgggagagcacttaacaggacgggttctcgcagaaacgatatatatttaggtcaaatctgttttatcggggttattagattctcttggcccaactgtagtgtcaaatatcaaaccgatgttatcttattaaaaaattatattaacatcaacttaaattgttaaatgatctacatacatgaattttaccccattatttatttttatttgtcgtcttcgattgtccataatttctaatctgtaatgccaaatttgatgatcttcaactcgttaaaaaaaccaaaccatagagattttgtatatccaatttagggaattcattagagttcaagaagtcttcataattaggttgcatctttgaatacctttttctcatttaggcataacaatataataatttgttttttgttttcattttcttttggtgtcatcttcaaaaatctgtaaacccaaaagtttgtataacttgtttattaagatatttttaattaaatttttttttttgacatttttaaaaaattataaagtgttttatgaatttaaggagtaaataatatttatttagaacactataaattagttttacaagttcttagaaatgtatctgtaaatttcaaaaaggaaaaatatagcatttaattttgaagatttttttctacattatatatatgataaaaatattgtattttgtactttgtagttacaaaaagtcattatatcaacaaatctaaatataaaatatttttctatatattactccaaattaactgtcagaataaaaaagaagaataattattacagaatctgaacattaaaatcgtccctccatatgtggtctctgtctagtccaaaagcaatttacacatcccaagccgaaactatattaaataaacatttttttttctttaactaaaacatttataacatttaacaataaaagttaaaaatcgaacacgtataacgtatttttttacgtatacgtcttgttggcatatatgcttaaaaacttcattacatacatatacaagtatgtctatatatatgatattatgcaaacacaaatctgttgactataattagacttcttcatttactctctctctgacttaaaacatttattttatcttcttcttgttctctctttctctttctctcatcactatg

SEQ ID NO: 35420 - DNA, 3000 bp, Unknown
  misc_feature (1)..( 3000): 2750-1469P.txt file - cDNA_ID_3087417; gDNA_ID_2926304; Annot_ID_205804
aaatgggtcaaaattcatgggtcaactcaacttaactcaacccatgaatcctaatgagttaaagtttttgactcaaatgagttgatgggtcaaatgggttattgggtcaattggtttgatgagttaaatgagttgggttgtaatgtttaatggtttcaatggtttacccaattaacccatcaagttttgtaaaattgaattaaaccaagtaaaatctctaaaccaatgccaatttaagcttaaccaacacatctaaaccaatttaataaaattaatatttttccaaatttcttaaatatacaagcgatgaaattgagaaaaagtaaactcgtaatttttctaccaaaaaacataaacccatgattttcccgccaaaaacgtaaacccgtgattttcccgccaaaaacgtaaacccgtaattttctcgccaaaaacgtaaacctgtaattttttcgccaaaaacgtaaacccatgattttcccgccgaaaacgtaaatccgtaattttccgccaaaaacgtaaaccgtaattttcgcgccaaaaacgtaaacccgtgattttcccgccaaaaacgtaaacctgtaattttccctccaaaaatgtaaacccgtgatttttccgctaaaaacataaacccgtgattttctcgccaaaaacgtaaacctgtaattttcctgccaaaaacgtaaacccgtgatttttccgccaaaaacgtaaactcgtaattttcccgccaaaaacgtaaatccgtaaaaagtggaatccgtaaatattctaagtttgatgataataaattaataatttattaataatgataattatttattattatttcataataataattaattaaattattacttagttgggtcaacccataactcatttaaccctaaactcatttgattatgagttgagttgagttgggttacccattttgacatccttatgcatgtcgcaccattagacaacaacctaccaccgtcagaaggcaactagtctatcgaaatgacttctttgcatctagttgtagcatctaaacgtctaaaagaacagtaccaaaatgaatgaacacgtcgaggaaagcattgtagaagtccgttactcctaatctataaaagatcgacacaattatgaagactatttgtatgatgtttattacttatatttttttttcttgaagataactcattttgtaaccaactagctcttaatttagtggcgcttcctaggaccttgttagtacccttagttcaagtacccattggaagagatttaagaaaaacttgcatttcgacagagatatttaagtaaaacttgggtccttggctcacaattacttgaaagttaacctaaactgctaaaccaaaaaagaaaagaaaaaaaaatacttattttgtagataaagcttcaaaaggttgagtcaatgtactaatatactagccatttgaataaagatctttcgaaactaacgttcctcgaatgattagagtacaaagcaatagtttgcttctaatccaagctatccaagtataatcaattagaagaaattagcaagttgggagatcaaaccaatctttgaagttttgttcttcctcaagatgataacctcttaccttccttttccccttttgtttctcgcaaattgttaacagattttactttaagtcatcaacaaaactaacaacttggccggtcctaaagttttatgggttttagtcaataataaaacataaccaagtatcgttaattatatcaacttgttaagattctaggcgaagcttagagttcgctggttcgaattattaagactctaaacgaagcttagagttcgctggttcgaatgatgcttgtgacgaaactaatattacatgctttaatttcgaatctcgaaggattatggatttcggcgcaaaacctcctagtattaaaaaaataaaaataaataataaaataagtccattataatactgtaagtccgtccgcttttactttttgtctttttacccataatcttttaattctaggactcgagcatgttaagttattatgtccaaagttgaggttttcttataaaagaatcatctagtacattagttcagctagtgggtgttgggtttgttaattgtgtatacttaacaaataaataatctttaccttttgtaattaggtaatacttaacaaacaatgtttcccttttgtaacttgttattttttcaagggttaatgattttccaaagaaaaagaaaaacgattactacccatggatatggcttaaagtaatcagctatccactttcttcttctttttccaatgcgtgaacggttatgtaaaatatgacatcttgaactcgaactcaagcgtatttctgacaattttaaattatggttgaatatttgtatggctatgtataagtttcatagcttgcagtatttagctgtagaactcaccttaattagttaaatatttagaccatcaagcaaatatcaatttttaaaaaatatattgttgatgacatttcatttttctataatgaaaaatgaaataatttatttcaccaatatgatcaaattattttccaaaacttgaattaattatgaacagacggagtaggaaatttaatagtaaaaggaaataatttattgttttgcaaaaaagtaataaatataattaaattatacttaagtactactaaaaatatgaaaaaaacaaaagacaaaattaagacttaaaaattatataatgtctgccgtatttaaatagctttaccgactttttcagagcacaacctccaagagacaacatcaaaacccagaaaactgaacgctttatctgctcttcaggtttaagaggtttagaaagaaaaagaaaaaaataaaaaaatttggttggttagctggtcccgcgagtttttcttggagttcacttaaatccttgcgatcaatttgaaaaatccaccaagaatcacacaaaaactgatctctgtgcgtctatataatg

SEQ ID NO: 35421 - DNA, 3000 bp, Unknown
  misc_feature (1)..( 3000): 2750-1469P.txt file - cDNA_ID_3087421; gDNA_ID_2926304; Annot_ID_205803
acaaagagtggatacatttgaaagggaagttcctcctcaacggttctgcatcgcgggtagtcatttacatcgaaggtccacctccaggaaccgatattcttctcaatagcttaactgtaaaacacgccgagaaaattcctccttcaccacccccgtctattgaggtaagtccaaagatccagttcacattttcaccgccgtaaaattataggtgaacaaaatattctaaacaaatataacattttctaaagaataaacaatttagcaaaataattttgttctgaagactgttgtttaatttggaaaacgtaaacaaataatcgatgtcttaatccgtgttgttttgtttttttctcgtagaatcctgcatttggagtaaacatactcacaaatagtcatttaagtgatgatacgaccaacggatggttttcattagggaactgcacgctaagtgtggcggaagggtcacctcggatccttcctccgatggcaagagactcgcttggagcacacgagcgtctaagtggccgctatatacttgtgactaaccgaacacagacatggatgggtccagcacaaatgatcactgataaacttaagcttttcttgacgtaccaaatatcagtttgggtcaaagttggttctggcattaatagtccgcaaaatgttaatgtcgcacttggtatcgatagccaatgggtaaatggaggacaggtagagatcaacgatgatagatggcatgaaattggcggttcttttcgaattgagaagaacccatctaaggctttggtttacgttcaaggcccttcttccggcattgatctcatggtcgcgggattgcagatttttcccgtcgatcgactcgcgagaataaaacatttgaaaagacaatgtgacaaggtaacacaaaaactctgctttcaaacaagcaatgagacttaatagtaactttcttgaaatgcagatccgtaagcgtgacgttatcctcaagtttgctggtgttgattctagcaaattttctggagctagtgttagagttcgacagataagaaatagcttcccggtggggacttgcattagcagatcaaatatagataacgaagatttcgtcgatttcttcttaaagaactttaattgggcggttttcgctaacgaattgaaatggtactggacggaaccagaacaagggaagcttaattaccaagacgcagatgatatgctcaacttgtgcagtagcaacaacatagaaacaagaggacattgtatcttttgggaagttcaagcaactgttcagcaatggatccaaaatatgaaccaaaccgacttaaacaacgcggtgcaaaaccgcctaaccgatcttctaaaccggtacaagggaaaattcaaacattacgacgtgaacaatgagatgttacatggatcattctaccaagataagctaggcaaagacattagagtcaacatgttcaaaaccgcgcaccaactagacccatctgcgacattgtttgtgaacgactaccacatagaagacgggtgtgacccaaaatcctgccccgaaaagtacacggaacagattcttgacttgcaagaaaagggtgcgccggtaggaggaatcgggattcaaggccatatcgacagtccggtgggtccaattgtatgttcagccctagacaaactaggaattctcggtttaccaatatggttcacagaattggatgtctcctcggtcaatgagcacataagggcagatgatttggaagtaatgatgtgggaagcttttggacatcccgcggtggaaggtataatgttatggggattttgggagttgtttatgagcagagacaactctcatttggtgaatgcagaaggagatgttaatgaagctggtaaaaggtttttggctgtgaaaaaagattggctctctcatgctaatggacatattgatcaaaacggtgcgtttccgtttagagggtatagtggaaattatgccgttgaagtgattactacttcatctagtaaggttctgaagacgtttggtgttgataaggaagattcgtctcaggttattactgttgatcttcaaggtttgtgattgtgacgcttgtacatgtgctaatgtatgtctagatttccagtttgctgaaactgtggtgtttatttattgaaaacaaaataaaagtctctcttgatagtttcattgttctaaatagaaaacaagaaacgttttttactttaatcttctacattgataatattggatcaaaggactgtttctgcaagacacaacacaacataaatatacttatactagtttacttatactaacttcattatacatacacacacttgcacttacacctataccttacttctagacatcattaccccgtagaaccaagtttacaagcaagtttaccaacaactctagtctttagcctttaacttggacttactaactagtcattagttgtttaaattttttaatttccatccatatgtttttgttatagattcaaattaaagtcggttgcatttaataaatgtcacttcgttctcttgagataaaatttctctatagtattgtgtttttttgttgtaaaattttcgagtctttttcctaatttgataccatgttttttttctgcacaaattcactcactgttttaacttactatccacttattaatgattttaccattaggcgtcagctagccctgtcaaattggtaaacaagccaagctatctacataattagagatatcattaacgttaatcgtcgtcaattcgaatttgaaagcatagatagctttagcagtacaatgggcaatggtaagaagaatagcaaaaggcccaatatttggtttgcagaaattaaagccttaaaaaagcccacagatatttgtcaaagaatcttaataacctttttgttgctcaagcgccgttcctagggtttttctctgaggaagaagcgtttcatttctctgaatttcatcgaaaatg

SEQ ID NO: 35422 - DNA, 3000 bp, Unknown
  misc_feature (1)..( 3000): 2750-1469P.txt file - cDNA_ID_3087464; gDNA_ID_2926305; Annot_ID_143696
ttcttctttaagtgttgcaggcacacaggcttctccgtttgtttgcagtgaaatccgatcaagtaccacacctttgttccctgctactgattttcctccattgtcttcagtgaagaactctttagtgttgtccactgttgctagtgaaaagagttctgagtgtacggagagcactgatctcttacctataggcaacaactcttctttgcttagtaacaggacgaatcacactgatacttcttctgcttcaagctctacagcatcctcaccaagtgtaccagttgtttctgagtcagaaactagctctaccatgccagcagctcctgcaactcagtctacacatccgatggtaacaagatcaaagaaaggcatcatcaagcctaatccccggtatggacttcttacacataaagtcaagaatgcagagcctaagactgttacagaagctcttaaacatccggggtggactgctgcaatgcatgaagagtatgacaactgtcaagaggcacaaacatggagtctagtcccttacactccagatatgaatgtacttggcagtaaatgggtattccagaccaaactgaatgcagatggatccttagacaagctaaaagctcgtttggttgcaaaaggttttgatcaagaagagggtatcgattacttggagacttatagtcctgtggtaagatctgcaacagtttgaatggtgcttcatgttgctacagtcatgggttgggatgtgaaacaaatggatgttaaaaatgcgtttctgcatggagatcttacagagactgtgtacatgcttcaacctgctggctttgtggacaagaacaaacccactcatgtctgtcatctacacaaagcgttatatggtctcaagcaggctcctcgtgcttggtttgataaattcagcaactatctgcttgagtttggttttagttgcagtgttaaagatctctctttattcatctatatcaaagggaatgatcttatacttttgcttctctatgttgatgacatggtgttgacaggaaacagctctgcaacattggctaaacttctagaggatttgaacattcacttccggatgaaagatctcgggcaaatgcactatttcctgggaatacaagctcatttccatgaaaatggtttgttcctctctcaacaaaagtatgctgaggatcttctcactattgcagcaatggaggactgctccccaatgcctactcctctgccacttcaactcaacaaggttcctcatcaagaagaacttttctctagtcctacttattttcgaagtcttgtagggaaactgcagtatttgaccttgataagaccggatcttcagttctctgtcaactatgtgtgtctaaagatgcatcaacctacagtttcagattacaaccttcttaaacggatccttcgatatgtcaagggtactctagccatgggaattcacttctccaaaaactctgactttcagcttcgtgcttacaatgaaaaggagcctgaaacggagtctgatttcaatcttcaagcttacactgacagtgattgggtggctgtaaagaaacttgtcgctctacaggaggctattgtacgttccttggcactaacctcatttcctggtcttctaagaagcagccgactgtctctcgcagctctactgaagcagagaacagatcactttcagaaactgctcaagaaatgacttggatttgtcatgttctccgagagttagggatacctcttaccgttacgcctgagctttatggtgacaacctttcttctgtctacttaacagcaaatcatgtgtttcatgtccgaagcaaacactttgaatttgattaccactatgttcgtgaaagagttgctttggggtctttggttgtcaaacacattcctgctcaccaacagatagttgatatgttcaccaagtcattgtcatttaaagctttatgtgatctcaggttcaaacttgacgtggatttgccacccacaccgcgtttgagggggagtatcagacaacctcttcaaaacgacagcattttgtcaacttcatcagttgggcctgcgacagaaacaaatgaattgggccacagaacacttaaggccaaaacagaaacatcgtcgtgcactgtgcaacggtcttctccactctcgcttaaagacaaaagaaacagaacagaggtgacgaaagcttgtaaggagaagatacagcttgctaatcaattctcagcccttgatgacttagagactacaggatgaagaaatctggagagttacctatgatttagaagcttataatgtctcttatataaataccaaaatgtaagccgcatgaaaccttaagggaaatgaatgaaatctaaagttcaagtttaaaactttctcaaagattcataaaactcttcaaattggagataaaaaaatattgcatagtgtaattatatcgattaatataatttttattaagaaatataaaatgtttttcgttattcaattttttttttttttttttgttgttaccataaactaaaatcctaaacgttcatatctaatcaaactaaacgtacattaatttcaaatcactagttttgaaatttggaccaaagttttaattattgttaaacaaaaaactcttctcgatttagttttagtaattaattaaaaaaataatcatgtatgaatctcatggcaagttggtaaccttttaatttatttacataaagaaataaatcaaatctcatgactacctttaaaaaacattattataaaaaaagaaaaatataaaaatctcacgaacaacaacaacaacacacacaagtgactacgaaagggcaaaaaccaaaaagagaatcaaattttgcctcttctatataaatcaaatcaacgacgaagcgtcgctctcgttttctgtgtgtctctctctttgtcccaccattttcaccgcttctcctccaatcactcagatctacagattcctttaaaacaacaatg

SEQ ID NO: 35423 - DNA, 3000 bp, Unknown; identical to SEQ ID NO: 35422
  misc_feature (1)..( 3000): 2750-1469P.txt file - cDNA_ID_3087464; gDNA_ID_2926305; Annot_ID_205840

SEQ ID NO: 35424 - DNA, 729 bp, Unknown
  misc_feature (1)..( 729): 2750-1469P.txt file - cDNA_ID_3087514; gDNA_ID_2926306; Annot_ID_205879
ttcatatataaatgtcattatttcattggtactagagtatagtttgctgagttccatgaaaagaacggtagaggcgagagcaggtgattaaaacccatcccctgtgaacggagtgagtgtaggtgtagccataaagttgtcgtcgctcctctgtaaaagtttcttctattcgacgattcctctcgacgttatcatatttcctctccaggttggtactatcatcatccttgttctctttgtttgcatccctccttccttccttgcttccttgtagatctgccattgccttttttaatccaaatcttatatttctgatttacattgcttccgtcagatccgacgatctcactttctcatcatctgtcgtcagcttttttgtttcttcttttatctctttttatttttaaaataaatatattgttgattctggaattttcctagtagctcacgtcacgttacgtcatgtgtgtgctttgaattttaaattgactcgcaaggctggttttgattatgtgtaagtgatcgctggacttcacacacactaacaagtagcacttgaatgaagctttcctttaatggattgattatttaataaattgcgactttgacgtctttgagcatccatccatgttgaagaatcccattattcgtatgcttttcttctatggccttgcatcagtcagcactcaacttgtttgaatgtgcaggagcgtgtttccagaggggatg

SEQ ID NO: 35425 - DNA, 3000 bp, Unknown
  misc_feature (1)..( 3000): 2750-1469P.txt file - cDNA_ID_3087518; gDNA_ID_1974091; Annot_ID_180609
tgcaatacatttaagatgatgcgttgtgatgaaattacaatcataatttgggtacagagacgttgatccctagatctgagagatccttagcgagcgaatctgcattctcaaagcataacccacccatccctatctctatagcacacttgacgttggttggcctgcgtatcagacactccttcagatcaaaatggtttctttcttttaagttataaaggcattgagttcatgttataacctgtcatcaatgaatatacagtcgcaaggttcaactccgaggtgtcccacaacctcgaggtagaactctggatcaggctttctcttccctgaaagatataacacatgaggagctttgtatgtagtaggaatggtttggatctgacaagcaataagtagtaaaaagaggcaagagatgtgtgatgtaccagcaatacaggagcaaaacgtccatgataagtaggcagaaagctttaacttgtcttcgataatgttgtacctatggaaacacgacaagagtaaacaaagagacatgaagctccgtttcaaagagtgaaaggcaagggatggaaaccagatgggatagttagtgaaagcatgaatctcgaagtcgtcagctgccaaagtttgaaggagctcttgcatgccatctaagtaggagtaacctgacctcatgcactccttaagccctgcaataaagaggattgaaataggtacgaggaaaccctctctctgtgtatttacctatctatctatatggcaatctcaccttccaaatcaaaatccctcccatctataaagaagtttctagcaagctcctcctaaaaccaaaagtcagaggagataatatgaagaaaaaaagaaagaaagagtggtggtacctcacctcatcaatcaaacccttttcaaattcgatccagaccatcgggtgcttgcactctagtagttgcttcattggcattctgatccacaacctcagtttatcattgatgaatcgagaaataaattcgaggatttcactttctcacccgaagaaggccggaacgtcctggtaaaaggggtcacggacgatggtgtccatgacgtcgaagaggagaatcggaagcttccttttccgagagatttcatcaccactgctgctgcccagacagcaagaacccgaggcccgaacaggattcttcttccacatgttgggtttcagattgatgaattccgccgatgtgtgcatcgccgccgccgccatcagaaactacctagtttctagttccgatcatcatcatttgtaaatgacaacaggggagtcgaaacgcagcgtttagagagaaaatcgcagaggagaaggtgattggtccacgtcagtaattaggatgacgtggtgaagaagaagtggcccatgacttgcagcacgaaggagaatgaatgaattaaataaaaaccgtttcaaattcatctccacgactcctcggcctcggagagctcaaccgccactttccttctccttgtttatataaagcagagccagccaccttcatttttacacacaaccatcaaagctacgtacgaattcctctcaaacatactatatacttacaaaagaacaagaagatgatgatgatgatgatgagatctacttgtaatctaacactaatgctctgcatttgtgcccttgtggtggcttccatggcggcggaaggtcctagggatttcaaggttggagacgagttcgggtggagagtcccactccagaatgattcagcggtttacagccactgggccagcagcaaccgcttccacatcggtgattcactctgtgagctagcttgttcccaacttgtgttttcttttttttatcattcatgatcggtaataattgattggtttctaatcaaaaatatgtcagcgtttgtgtacgacaaggactcggtgatggaggtagacaaatggggtttctaccactgcaacggcagcgatcccattacagcctttgacaatggaaacagcacattcgaccttgatcgtcctggtctcttctacttcatcagcggctccaaccagcactgcaccagcggccagcgtctcatcgtagaagtcatgcatatccaccaacaccatgaccatgacgcttccatgcctccatccatgtcgcctctttctaattctgcctctccctacgcatccgcatccgcatcttctgctgcctcctccctgcctacggcttgtcttcttattcctcttttcttaaccattgctagctttcgtttcatttcttattagtcaaattgtttcccttatagttcttctcctcttttacttttcttcatctttttgtttcattcatcgaacccttatggtataatccaatttatgttcttctctgacatttattataagttttacttttcactgttcaaaacaaatcaatcaacaaactgtggaaaaaaaataaaaaatctatcaacaaactacacaagagcatcgttattaatagtttcttaaaacaattcttaagttaagagacagtcttataatagcttataattaacaaagtctcataaataagagactttaatacaattttgttagatataagacatatctcttaactaagagtaatgttaagagatcatcaataaggataattttatgtcgttagtactaatagaaccgggccctagagtttgtaacagatatgggcctttttattgctatgggcctatttttggtgatatgggtctttaataccatatgagccttttaagacaaaataataatctgataaaagtggtgaatcaagaagactaaacaattttgaaagaagaagaagaaaggaggagacatggatgaatctctgtgggtgtgagtgtgagacaaagagagaaaacaaacaacgtagctgtagattggaaaagacggtaagaccctcgtcgggcttcatcaataaacaactttgccttgttgtctatcgccggaattacaaaccctagccctgctacaccgccaatg

SEQ ID NO: 35426 - DNA, 3003 bp, Unknown
  misc_feature (1)..( 3003): 2750-1469P.txt file - cDNA_ID_3087518; gDNA_ID_2926306; Annot_ID_205878
tgatgcaatacatttaagatgatgcgttgtgatgaaattacaatcataatttgggtacagagacgttgatccctagatctgagagatccttagcgagcgaatctgcattctcaaagcataacccacccatccctatctctatagcacacttgacgttggttggcctgcgtatcagacactccttcagatcaaaatggtttctttcttttaagttataaaggcattgagttcatgttataacctgtcatcaatgaatatacagtcgcaaggttcaactccgaggtgtcccacaacctcgaggtagaactctggatcaggctttctcttccctgaaagatataacacatgaggagctttgtatgtagtaggaatggtttggatctgacaagcaataagtagtaaaaagaggcaagagatgtgtgatgtaccagcaatacaggagcaaaacgtccatgataagtaggcagaaagctttaacttgtcttcgataatgttgtacctatggaaacacgacaagagtaaacaaagagacatgaagctccgtttcaaagagtgaaaggcaagggatggaaaccagatgggatagttagtgaaagcatgaatctcgaagtcgtcagctgccaaagtttgaaggagctcttgcatgccatctaagtaggagtaacctgacctcatgcactccttaagccctgcaataaagaggattgaaataggtacgaggaaaccctctctctgtgtatttacctatctatctatatggcaatctcaccttccaaatcaaaatccctcccatctataaagaagtttctagcaagctcctcctaaaaccaaaagtcagaggagataatatgaagaaaaaaagaaagaaagagtggtggtacctcacctcatcaatcaaacccttttcaaattcgatccagaccatcgggtgcttgcactctagtagttgcttcattggcattctgatccacaacctcagtttatcattgatgaatcgagaaataaattcgaggatttcactttctcacccgaagaaggccggaacgtcctggtaaaaggggtcacggacgatggtgtccatgacgtcgaagaggagaatcggaagcttccttttccgagagatttcatcaccactgctgctgcccagacagcaagaacccgaggcccgaacaggattcttcttccacatgttgggtttcagattgatgaattccgccgatgtgtgcatcgccgccgccgccatcagaaactacctagtttctagttccgatcatcatcatttgtaaatgacaacaggggagtcgaaacgcagcgtttagagagaaaatcgcagaggagaaggtgattggtccacgtcagtaattaggatgacgtggtgaagaagaagtggcccatgacttgcagcacgaaggagaatgaatgaattaaataaaaaccgtttcaaattcatctccacgactcctcggcctcggagagctcaaccgccactttccttctccttgtttatataaagcagagccagccaccttcatttttacacacaaccatcaaagctacgtacgaattcctctcaaacatactatatacttacaaaagaacaagaagatgatgatgatgatgatgagatctacttgtaatctaacactaatgctctgcatttgtgcccttgtggtggcttccatggcggcggaaggtcctagggatttcaaggttggagacgagttcgggtggagagtcccactccagaatgattcagcggtttacagccactgggccagcagcaaccgcttccacatcggtgattcactctgtgagctagcttgttcccaacttgtgttttcttttttttatcattcatgatcggtaataattgattggtttctaatcaaaaatatgtcagcgtttgtgtacgacaaggactcggtgatggaggtagacaaatggggtttctaccactgcaacggcagcgatcccattacagcctttgacaatggaaacagcacattcgaccttgatcgtcctggtctcttctacttcatcagcggctccaaccagcactgcaccagcggccagcgtctcatcgtagaagtcatgcatatccaccaacaccatgaccatgacgcttccatgcctccatccatgtcgcctctttctaattctgcctctccctacgcatccgcatccgcatcttctgctgcctcctccctgcctacggcttgtcttcttattcctcttttcttaaccattgctagctttcgtttcatttcttattagtcaaattgtttcccttatagttcttctcctcttttacttttcttcatctttttgtttcattcatcgaacccttatggtataatccaatttatgttcttctctgacatttattataagttttacttttcactgttcaaaacaaatcaatcaacaaactgtggaaaaaaaataaaaaatctatcaacaaactacacaagagcatcgttattaatagtttcttaaaacaattcttaagttaagagacagtcttataatagcttataattaacaaagtctcataaataagagactttaatacaattttgttagatataagacatatctcttaactaagagtaatgttaagagatcatcaataaggataattttatgtcgttagtactaatagaaccgggccctagagtttgtaacagatatgggcctttttattgctatgggcctatttttggtgatatgggtctttaataccatatgagccttttaagacaaaataataatctgataaaagtggtgaatcaagaagactaaacaattttgaaagaagaagaagaaaggaggagacatggatgaatctctgtgggtgtgagtgtgagacaaagagagaaaacaaacaacgtagctgtagattggaaaagacggtaagaccctcgtcgggcttcatcaataaacaactttgccttgttgtctatcgccggaattacaaaccctagccctgctacaccgccaatg

SEQ ID NO: 35427 - DNA, 3000 bp, Unknown
  misc_feature (1)..( 3000): 2750-1469P.txt file - cDNA_ID_3087525; gDNA_ID_2926306; Annot_ID_205872
ttcaccgcctctgagcacagtccgcatatccacttcccaaagaacttctccctcaccctctctatgtactccatcgtgcactcctccctcatcccgcagcactcgcactttgccttctctacctccactatcgtccccagtcctttctcttcttctctgtgataatccagcgatatgtctgacagggacctatgcagtgactttttccctacctttggcgggggcggcttcaccaagcttccgctcacgctcttccttctcccgtttgctgccatatccaatcttctttttttcacctagagcgtctgcgctaagctttggtatttataagcggtgctgtctgtgttgacatattcatgtgtattgtgtggttcagcattgccatctcacgtacgtgctcacgctatagcgacctagctctttacttactctttgttttacttttcacaacaatactaattaatgaagccactaattcacgtgctacattgcaactggatcctagcctttaatacaactcttctaaattggtatatctctctctgtattgagttcatgcatatatggggatatatacaaacaaaaacattatttattttttgtctgccgtcactaatcgatctcaactaaacttttgtcatttttttaatgaactgtaaacttggtgttcatttcgttctcattaatgtagtttccttagagattgcaaaaattagatacattttgtagcatgaaatctgaattatagaaggaaatcagataagcaagtgtgcaaatatacaaaaatgtgctattcgagctaaaagtgaagatacaaacaattacgtaccaaaagcaagccctcaagaattgtgtggaggtaagtaaaaggaactatatggatcgcagagacaacgatatataggtcacgtgtgtgggagttttgtctaaccacacatataagagaggaacaacatggactcgaggaagaccactcgtaatgaagttaaaagttgaaacttgtaaatattatcaatcccaacaaaaagaagaagaagaaaaaatatatattggttgttttaaactcacttttgcgataacttggaaagtgggaggacgctcacgtgcatgcatacatttcttgtctattatatgtagctgattcaacataactctatatatcttgttgtctatattgcattatagttacacttacattacatacgtagtgtgaaaacgatgcatagcattactatacatcaaatctgtgcatatatatacacgttacgtttcttgcagtgaaatactcgaaggtggatatgtgctcttgcaccacctaattaatctcgggttatgtaagaattacttcagagttcagagtatatatctatgtgattcttgcgcagtgtcaagtggattgggcatgagattgataaccgaatgggtgaggggtcaaatatcgttatttggatatagcgggattttaaactgaatgattgggccatgcattgcttgggaaaaaggctaaaattaaacaagattgagatacacattacccacttgtattttagtttccaaagaaaaaaaggaaaaaaggagcaacaaggcaacaagtatgtaatgatcaaggaagtaaaaaagggaagaggagtgtgagaaagagagcaaagaggagctgttggaagagggaaatggtcttcttcttcgtccttttggtaatttttctgcttgtgttgtggagagtggtagtactagtgtagagaaaggatatggaaatcagattgtgatgaagatctgatttgtaaagaaggggcctccccacaacgcccttgaatcttccgctccagccttgatctccgattgtgacgatcaccgcatcgggacgtggggagaaggagacccaacctcttttggagtagacgtggaactctgcatggcagaagttgagacatagagaatgtctttcgtcatagcctcttagcagcatccttatggcttcttcctttgattcgtttttaatattatgcctcttcacgtagcaaacccctaccccttccttttggcttcttcctcctgctcctagcttttctctcaccgccttccctatcctctctgcctcacccatcaactccctgcatcttcaaatcattacttactactttattttaaacaatatatattcctaatcaattactatatatagtaaattttgctgccttacctcaaatctgaataacaagccgtgtgatcatcagcattaatatctttattaaacacgaactcctccgtctcatcgtggaaaatggttttgtccatggcggctttcaccatagcctctggaacaccgtggttaacgagctgaaaacaaccgatggtggcgatggcatcaagcagagccgagagggagtccaaccggtggaaatcgaaggtgggagggttgagaaggaatgtgtgcttggggaagactttatcgggcaatacaagatttgggactcgaccacacttgtccaggaactccgagaggacgtcttcgttggccgtgaaggaggcacggcggctggatgctaccggggacggaggaggggctcggaagtcgggagaggaaactcccatttttgtttggggtcttactcgtgataatacttgtatatatgtagagcaaggatcgatcattggccaaagaaaaagtttttgttaaataaagcgagagcataatgatgagatgcaattctcttgtttgcttttattcattgcaacttttccttttccaaaaaccagagaggatgacactattcatcatattatggatggacccaagttgggccttaagcggccttttgtttacccaattgacgtggatcctcacaggatgggcatcgagtgtgacacaagtccaagttggaagagtccttttctgtcacataaataaaaaaataaatgtcaagtagagagggcaagtggtgaatctctctcataccaattccaaaccaactaaatctacttagtaccagtacattgatg

SEQ ID NO: 35428 - DNA, 3000 bp, Unknown
  misc_feature (1)..( 3000): 2750-1469P.txt file - cDNA_ID_3087529; gDNA_ID_2926306; Annot_ID_205871
cttatcccaattactcttctttatcccaaattctctttgatttcttgctacttggtcttctccgattagatcttcgaatctgtttctctcctctccgggaaccggtggctacgtcatgtgtctttctcatattccggcaatcctcaagaggaaatctagaatcctccatacatttcttatttccttactagggttttgtgtgtgttggcaggtggaagctgacgaagaacaacatcatatatcattcaccaagtaagtaatgtaaagtaaagtagcagctctatttattttctttcctatgattgagatgaaaaattcgattgttgttgtgtgagacagtggtacgagaaaaagatatctgctgggaatacgcagagaaactagatggtaacaaggttaaatgcaagttttgctctagagttcttaatggcggcattagtagattgaagcatcatctctctcgccttcccagtaaaggggttaatccatgtgccaaggttagggacgatgttactgatagagttcgttccattttatctgccaaggatgatccccccattaccaacaagtacaagcctccaccacctttatctcctccgtttgatgctcctgcgtccaaactagtctttcctagttctcctcctaatgcgcaggacattgcagagaggagtatttctctcttcttctttgagaacaagattgacttcgctgttgcccgctcaccctcttatcaccatatgctcgacgccgttgccaagtgtggtcctggatttgttgctccttctcccaagactgaatggctggacagggttaagtcagatattagcttacaactgaaagacactgaaaaggagtgggtcaccaccggctgtactatcatcgctgaggcatggaccgacaacaaatcacgagcactgattaacttctccgtctcttcaccttccagaatcttttttcacaagtctgtcgacgcctcctcatatttcaagaactcaaaatgccttgctgatctctttgattctgtcatccaagatattggtcaggagcatattgtgcaaatcattatggacaacagcttctgctacactggtatctcaaaccatctcttgcaaaactatgcaaccattttcgtctccccctgtgcatctcagtgtttgaacatcatcttagaagaattctccaaggttgattgggtcaatcaatgtatatcgcaagcgcaggtcatatctaagtttgtctacaacaatagccccgtgctagatttattgagaaagttaacaggcgggcaagatattatccgaagcggtgtcacaaggtctgtctccaattttctatcattacagtcaatgatgaaacaaaaggcaaggctaaaacacatgttcaattgcccagagtataccacaaatactaacaaaccacagagcatttcatgcgtgaatatcctagaggataatgatttctggagagctgtggaagaaagtgtggctatttccgagcctatcctgaaagtgttgagggaagtttctactggaaagcccgctgtaggttctatatacgagttaatgtccaaggccaaggagtcaatacggacatactacatcatggatgagaataagcataaggtcttttctgacatagttgatactaactggtgtgagcatttgcattcacctcttcatgcagcagcagcattcttgaaccccagtattcagtataacccagagataaagttcctcacttccttgaaagaagattttttcaaagtgttggagaaacttcttcctactagcgatctacggcgtgatattacaaatcagatattcactttcactagggcaaagggaatgttcggctgtaacctggccatggaggcgagggattcagtttcaccaggtatggacaataaatacatttatattttctttaagtcatgactagtgaacagagatgtataggtagtctgagtcgggagaaaaataatccacttatctatgaccgcaattaaagctatggtcttattacacaactaaataagtccaggttgatatagcctggcacgtagtaaaccgaattgcaaaactagtagatatcttcccctcaccaggctattaggggtatggtctgggatctttagaattggtaacgaagcactagaagactagaagttgatgtctaataatggtttgcttagtaatgcaggtctctggtgggagcagtttggtgactcagcacctgttttgcagcgggtggccatcagaatactaagccaagtttgcagcggttacaacttggaacgccaatggagcacattccagcagatgcactgggaaaggcgaaacaagattgacagagaaatattgaacaagttggcgtacgtgaatcagaatctaaagttagggaggatgataaccttggagacagacccaattgccctggaggacattgacatgatgtcggagtgggtggaagaggcagagaatcccagtcctgcccagtggcttgaccgttttgggaccgcccttgatggaggcgacttgaacaccaggcagtttggcggtgctattttcagtgccaacgaccataacatcttcggcttgtgaagtcctggtaagaggttttcataagttggtccagcgtgttgagtgtttaaccacacacctcggttcgctatactgtacataatgtttgagtaattatcaatgtagaaaataaatattttgtgttcctcacacagtcacacgtcgatgagcttggtggtacaaagcatgtttcgttcatatttgggattcataaaacggtgagcttaagattgtttttgtttgtattgaagccgtaattatcagaacccatatgatagtagcggttattgggccgctagtgaggcccaaattaaagtaaaaaggaaaaatcagtctgaccggagctatataattaatatatatcaagaagactcgttttagttggtttaggtgattcagatcacaaagtacaccgagaatg

SEQ ID NO: 35429 - DNA, 3003 bp, Unknown
  misc_feature (1)..( 3003): 2750-1469P.txt file - cDNA_ID_3087533; gDNA_ID_1974091; Annot_ID_180618
gaattttgatggtgctcctatagctgattctgaattctttggcaagttggacccttcaattcgtgatgcacatgagtcacgggtgagttatgagttaccgatatccatgagtatggtccaattatctctggtctctatcatagggatactttgttcctgagagaaaagatgactgtatcaactatatcgtttttgttgcttacataagtgtacttgaatgaggataggatatatgatatatggggctgaatcttaactatggttgattgccttattttcatattgatgacgagctctgacctcatactccacaggccattttgaaaagctatgtggtggctggatcagacactgccaatccagaaaaatttctggcgtacatggttccttccttggatgaggtagacatgcctctccataaactgatctctcttttacacaaattttgacaagtcaagaaaagttcagtttgattgatgtgttatcaatttatgttgctgtgccagttgtctaaggatatccatgatgaaaacgaagaaatctcttacacttgggttcgcgaatacctctgggatgtatgtactatagccaatgtggtttaagtgaaattttgattgtttgagttgcagattgaaataaatatgtcacctgatgttataacaggtacaacccaatgcaaacgatcctggcacatacctggtatcatttgacaatgggaccgctagctatctggtattgcatcggtttttgttacatattccagttgtgtatcttttttttcttctgtctataatactttgggatgaccgttgagaatttggcagcccctacccatgaggttgaacttgaggaagaaaagggccagggaaggaagatcttctgatgagattgaacactttccagtaccttcaagggtaactgtaaggcggagatcaactgtatcagtgatagaacataaagattcaggggtatagtaaatccatacatttagcctttaaaagagtaacacgtggaaagttctagttctcttaccaattcctttggactttggggctttggatgtaggtttactcttctagggttggtgcttcgagctccaagatgagaagattagaggacgaaggcggccttggtagatcttggaaacacgagccggaacaagatgccaatcaatatagtgatggtaatgaggatgattattctgaatgaacgtttcgtgtacctcaaactattgaatcggttttgcaatggttttcctgcaaggctattgtaggctaatttaaaagcgtaatatggcctccaccacagctttgtagtttggcaagtaaagaaattttgatttggatagctggcgaagttgaaaaacgattttacatgtacacgtccataattaatgaattggccatttacgactttgatcctatctaatgtggcagctccgttcatcttcagtggctatgttcatgagaacacatccctgagagaattccttgtacagagaagccttcttagatacttacttacactgtctttctaccagagctgattagaatctgtaataatattatacaggttctactaccagtaattaattaggatggattagagcaaatcttgtactgtagtagatcccagtgttgcaattgtggttattttacaggttcccgaaaatatgacattttcaaaatttcttgtacaaatgaaattattatggtccactatgttttcttttacgaagggctttttctattaggtgggcctattattatatgaaactgggtttcctcttgtgtagcccagtgggcagtataaaaatcagcccaaaacataactgcgaaattcaaattcttacccactcgcacaattagcgcgtcgacgccacctcctcaaaatctgtggaccgtttttggctgtttttggtaaaattaaaaaattgggcgcgtgagggagttttctattgaggaaaaaagcaaccgtttttgactaaataatgtaacgttttatttgtgatttgtttgactgggaagctctgcaatgtgaatatattttatttacaactttcttctttcgatatgttttttacattatttttaaacaagtttacattcttattgtttcatttattatttatttatttagttatttgctttttataagtatcttaatgtagagattttataaaaatttaaaatgtcaattactgaaatgaccaatcacatgtggacttcgaatatagatttaatattttcctttcctaataatatggataataatatatattttaataacaaaattttgcatttttcttcttttcatatgattttttttttcttttaaaattacattttctctttgtatgtctattaatttttttctcttataaatatcttgatatggaaattttattaagttttaaaatgttaattgctaaaatcagttgtgttgatttgtgattggctgaaaaaaaatataaaaacagaaaaaaaaaaaaaagagacaatgccttgtttttagttatgcttaaatctaatcattattcaagctattgttgatacatacaaatttccttaatcactgctatcaatttcaaacgtttatagattttaaaaaatctgtataataacatcaaagattaaaataaaatggtgagaattttagcactagcggccaacacttaacatcagtagcaccaccatctcacgttgaattttatttttgtaacaaaagaaaattaacatatactaaaaaaacaaccaaaagacattgcaagtttttagtaatttggtaacaaaattgcagtaattcacgtgaatccccaataatttgatctcatgcacacatagtggggtccaatcttttttgttcatttgccacttctcgccagcctctcctcttttgttctcttcactacctccaaacttcccaagaatctctctttctctcctctcttctctctcgcctcttctttaatttcctctgaagagaatcctccttacgaaaatg

SEQ ID NO: 35430 - DNA, 3000 bp, Unknown
  misc_feature (1)..( 3000): 2750-1469P.txt file - cDNA_ID_3087533; gDNA_ID_2926306; Annot_ID_205870
ttttgatggtgctcctatagctgattctgaattctttggcaagttggacccttcaattcgtgatgcacatgagtcacgggtgagttatgagttaccgatatccatgagtatggtccaattatctctggtctctatcatagggatactttgttcctgagagaaaagatgactgtatcaactatatcgtttttgttgcttacataagtgtacttgaatgaggataggatatatgatatatggggctgaatcttaactatggttgattgccttattttcatattgatgacgagctctgacctcatactccacaggccattttgaaaagctatgtggtggctggatcagacactgccaatccagaaaaatttctggcgtacatggttccttccttggatgaggtagacatgcctctccataaactgatctctcttttacacaaattttgacaagtcaagaaaagttcagtttgattgatgtgttatcaatttatgttgctgtgccagttgtctaaggatatccatgatgaaaacgaagaaatctcttacacttgggttcgcgaatacctctgggatgtatgtactatagccaatgtggtttaagtgaaattttgattgtttgagttgcagattgaaataaatatgtcacctgatgttataacaggtacaacccaatgcaaacgatcctggcacatacctggtatcatttgacaatgggaccgctagctatctggtattgcatcggtttttgttacatattccagttgtgtatcttttttttcttctgtctataatactttgggatgaccgttgagaatttggcagcccctacccatgaggttgaacttgaggaagaaaagggccagggaaggaagatcttctgatgagattgaacactttccagtaccttcaagggtaactgtaaggcggagatcaactgtatcagtgatagaacataaagattcaggggtatagtaaatccatacatttagcctttaaaagagtaacacgtggaaagttctagttctcttaccaattcctttggactttggggctttggatgtaggtttactcttctagggttggtgcttcgagctccaagatgagaagattagaggacgaaggcggccttggtagatcttggaaacacgagccggaacaagatgccaatcaatatagtgatggtaatgaggatgattattctgaatgaacgtttcgtgtacctcaaactattgaatcggttttgcaatggttttcctgcaaggctattgtaggctaatttaaaagcgtaatatggcctccaccacagctttgtagtttggcaagtaaagaaattttgatttggatagctggcgaagttgaaaaacgattttacatgtacacgtccataattaatgaattggccatttacgactttgatcctatctaatgtggcagctccgttcatcttcagtggctatgttcatgagaacacatccctgagagaattccttgtacagagaagccttcttagatacttacttacactgtctttctaccagagctgattagaatctgtaataatattatacaggttctactaccagtaattaattaggatggattagagcaaatcttgtactgtagtagatcccagtgttgcaattgtggttattttacaggttcccgaaaatatgacattttcaaaatttcttgtacaaatgaaattattatggtccactatgttttcttttacgaagggctttttctattaggtgggcctattattatatgaaactgggtttcctcttgtgtagcccagtgggcagtataaaaatcagcccaaaacataactgcgaaattcaaattcttacccactcgcacaattagcgcgtcgacgccacctcctcaaaatctgtggaccgtttttggctgtttttggtaaaattaaaaaattgggcgcgtgagggagttttctattgaggaaaaaagcaaccgtttttgactaaataatgtaacgttttatttgtgatttgtttgactgggaagctctgcaatgtgaatatattttatttacaactttcttctttcgatatgttttttacattatttttaaacaagtttacattcttattgtttcatttattatttatttatttagttatttgctttttataagtatcttaatgtagagattttataaaaatttaaaatgtcaattactgaaatgaccaatcacatgtggacttcgaatatagatttaatattttcctttcctaataatatggataataatatatattttaataacaaaattttgcatttttcttcttttcatatgattttttttttcttttaaaattacattttctctttgtatgtctattaatttttttctcttataaatatcttgatatggaaattttattaagttttaaaatgttaattgctaaaatcagttgtgttgatttgtgattggctgaaaaaaaatataaaaacagaaaaaaaaaaaaaagagacaatgccttgtttttagttatgcttaaatctaatcattattcaagctattgttgatacatacaaatttccttaatcactgctatcaatttcaaacgtttatagattttaaaaaatctgtataataacatcaaagattaaaataaaatggtgagaattttagcactagcggccaacacttaacatcagtagcaccaccatctcacgttgaattttatttttgtaacaaaagaaaattaacatatactaaaaaaacaaccaaaagacattgcaagtttttagtaatttggtaacaaaattgcagtaattcacgtgaatccccaataatttgatctcatgcacacatagtggggtccaatcttttttgttcatttgccacttctcgccagcctctcctcttttgttctcttcactacctccaaacttcccaagaatctctctttctctcctctcttctctctcgcctcttctttaatttcctctgaagagaatcctccttacgaaaatg

SEQ ID NO: 35431 - DNA, 3003 bp, Unknown
  misc_feature (1)..( 3003): 2750-1469P.txt file - cDNA_ID_3087537; gDNA_ID_2926306; Annot_ID_205869
ttgacgtcttcgtcataactcggcaactaaaagattcaccaaacaacacgaaattatctttaatgaataaattattgcaagtatacgcatgtattttgtttttgttcttttgttctaaaaactagtaggcgagaaccgagaagattgtgtagctaattacaaagatcatgagagaagtagttcattaaaaattaagttttaccaaaagtaatactccctctgtttctatgtaaatatagtttaagggttttattttttttttcaatttaagtgttgttttcaactttttatgcaaataataaatgtatttaatattctttaactaattatatttaattatttatttttttattagttaaattggttataataaatgatattattatataaaagagatagattaaatgagatttttatgattttttaatttatgtttaaaacccttaaactacaactaatatgaaacagagagagagtaatatggattgggagaaacattacagggaagttcaagagtgtgtctcgtccccagtacttcaatgctgctaagtcgtaggcacgtgctgctgcttcttcttcgtcgtaagccccttatccataaaaccatatattaatttaataagaattatacaatattgtttgaattatatttatataagtcgaaaaggacatatacgaattgcattggatttggacccaaaaaagaacagctaataataaacaggttctaccaatttcggtggaattcattctttaatttacagccatatcacacatgtatatatggacttttttcatcactttgtcgaagagtatttaaaagaaaaagtgacaggaaaaaaaaaagaaaaagaaggaaaagtacaatactttatcaaaatgtgtatttttttgcaacttatataaaaaaataggatattggcaagaaaaaaaaaaaactcacctagataaactgcacttgatgagtcagcattcatcatccattgcacatcaccatcatcaaaaataccaaattaaaaaaatatatgaaaaagatcaagaatcaaatcaagaacagtcgaaggacaaagtctggtccgaagaaaaaggagtctccgagttcatcggaatccaatctaagaccaaaaagatctaacaaattcttgttagttgttaccaacatatacgtgttaagtgtagacaaaccttgacgtcctttcttggtctgtgtatcgttccagctgttcttatcccacaaatgcgcttcgtatctcccagtccatctatgcctattattattcaacaatcggaacaattaaattacctgataaagaacgatgtcgtttatggtattatgagaggagagagaccttgtgacgcctctgtaaggggagctgcgttgaagaggagcgtttcgaggcggcgacttacgtttgcgtttggatgttaaggcaatggacgcagactcagacgcagacgctgttttatcgctgatttcatcgtcaacgattgttttcttgctcctcccagagacttttgccattaccggtgaatgagaagaataaaagattgagagacaatcctgaaaatggaattatgaaaatgagagacagatagttggaaatggttgagtatatttatattaaatccgtcacatcttttttttcgtttatatatatatatatatatatgttaaaattttagaacaattttttggtttaaatacagattctcagccgaatattttaaattgtactgatcatatgataaagtcactaagattatggcactaattatcttgtatttttttttaatagattttatttccggtgatataaccgtgtctagtccactgtcacgttttcttaattagattcatatatgctaccatttttgcacttttcttagtcagattgattattaaacaccacggttaagaatttctcaaatcagaattaatgaaccattttctaaattgattatgactagcaaaaaagatccatatctgtattattgtttttatctgctcatttttgtcgaagaacctaattagccaaagaaaaaaatggagtgcctcaagttttatcgattcttggttgatctacttcttggtcggcccatgagagatgtgatgccgaactagcaagaaactttgttatattttttcattttttttgtacatatttacctgttctcccaataatttagcacttggtaaacaaatatgacgttttgatcataacagcacacacacacacacacaaacaggagaaattttatcacacaataaatttcataacttccaaaccattatctgttttattaatgtttgtatgaataaaagtcataatttattaaatataatgtgtctactacctgccctcatttttatgcaggtggaaggagttgtcaacaattatggtaaaagtttgccaattagagtccaataagcacccttcaaatcaaatgtatttggtagtgacaggtgaggaatctatgtgattgtgaaatttggccatctgaaatcataagtaagcatttaaataaatactttgtttattttcgcatgaaattattaggtattaacattgattctagaatgacaaagatgaacctatgacaaagtatcaacattaaagaccctcttactaagacagaggctttgcctagtttggaacagacaggacatgagccaaatgaagcccacaagacgtctacagaaacaatgggcccaaataagcctaccgaacgactaaagaactaatgggccacaaaaagcccatctactctaatgttctatatctttagaataagtaatttgaaaagattggaaccaaagtcccattgatcttgagtttgaaattccaagacatttttgtgtgcgtgcgtgatttcgtcatccgtgacgtcttcaaacattggttatttaacaagattctctgatttttgattcgtgtgctttctatatagttgggtaccaattcattagtcagatcgcttgttcgtcaacttctctctctaatg

SEQ ID NO: 35432 - DNA, 3003 bp, Unknown
  misc_feature (1)..( 3003): 2750-1469P.txt file - cDNA_ID_3087544; gDNA_ID_2926306; Annot_ID_205867
cgctatgagcatattgttgtcgccaaggtaaaaagggtaacctgtcatatttaaaagtgatccaaactcttgtccgccacttgagcatccctttgaagctattgggtttcttatgcgaattgacccgtagcctacgttaaagaaccggcgatacatatccgaaaaagagatactcacaacttccctgttaatgatggaaagaaaaggaacagagttgttgacacaaataatctcgtaccatttctcgagatagcaacccgttccgattccaaacgggtacgggatgtcgattcctccacatgtcttaggacaagagctagcaacggtgagatcaatgatcagaaggagagagaagagactcaaaagagaacaactacaattagagctcatattaatgttttctgtttatgatctgctcaagaaaagctaaaagcagagacgggttttgtaaggatgagcgaaggaaaaatcttgtgtttagtttgacccagcaatgaatcataagtcttcatctttgaatttcgctttcatattttcttctctggtcagtctttgtttctctagtcctcctagtgaaagcttttcttgctttcagtgagcctccttgtttgaatttcaatattttatattcctccatttatttacgagaaaaaagaaaaatatcaaaacgtgactggtttaggtcgcgaggagaaatttccactgtaactatcacaatccgactctagattaaaacgtggctaattaaatatcaaaaagagaacaagtatctgtagagctcatgcatgtttattatgtgttatgatctgctgaaacattagtcagagttgcgttttttggattttcttttgtaaggtcacacgcatgaacgcaagaaacatagagaagtgaatctagctcagcttattgttttaggcttattagaatagtagacactttttaaaaagtaatttgagaagtaggtagtttttttagaaatttgtgaaatagacactttttttactttttttgtgaaatagaggttatgtgtaataagctaaaagacaaaaaatatgtcaaataccattttaccttttactttatatgaaaaaatatgggtcaaactttttatattatttaactatttagaactatttttattatattatagttattttttttttcatattcatctttttgaattttataaaaataaattatttttaaaaaataatttcttcttccaaaaacaagatgatttatatgtttttaattataattctcgtacaccagcattaaaacatagttttgtacactaacacttatacaccaaatcattttatacatatcttctaaaatatttctatttatctcatatttataaaataaaataataattgttcataaattaataaaaatataatggtgtacaccatcatgtatactattaaattaaccataatggtgtataccattaaatgaaagtaatgattatacatttttacttatgtacactaacatttgtacacttttatgtacactaatctcatattattattatttaaactttgttttgtatattatcacttgacaaaaatggttttatcttttgaatatgaggtgtacacaataggtgaaggtgtacgatattatatacggtgtacaaggtgatttatggtttgatttattatctcattattgcatgtatactattaatatcatgtacaccatattttacattttcgtacaccatcttattatgtagttatacatcattgtatattatcgtttgtacatcactttgtacactgtctataccgtataccacttcttagatcattaagaaacaaaagttatttttgactttatttgactatatgacaaaacaacagaaggctataaaggtcattcactaaaatctctattagatagaaaattgtattagaaaggaaagagaaaagtgtctattctccctatttctaaaaaaactacttactttgcaaattatttgtgaaaaaagtgtctagtttccaacttatctctattgttttctgctacaatatttaataaatcgtactttctcctatacctaaatcaacacggcctttatttgttagagtatctccatgggatagatacccttgctagtttctcaacaaaagaaaaaattattattttaattatataatatattttgtttcaattataatacttaaactaatatttgattgacatgccgcgatttaggctgagaatcgtttctccttgattctcaagtgagaaactcttcttccactctctcttacttttttacttttgggttattattttattattaagtttctcattcagaaatgatgaagatggccttacgtttacattttaaaacaaagaagcatgtagtacttttgaatattgtttctcaccattattgtacttgtggaaaacacaaaagtagttgttgttactttcatcactctatgagcaataaaaatgcagtcctcgatgaaaatgtggctaagaaatgttagggaaatgatccaaaaacctttttgactaactcgttttgacctgtcattactattattacatagttatctcatttttggtctctattgcaagaatcatgaaatcttcttataagagactttggtattacccacaaaacaacttaataattttaccttttgatattatataatccacacaactaacatgaactaactgctgacataatcgtcttaacattaaaaaaaaatgaaatgaatgcatgcattgcatataaatgtacaaatgttggcttgatctcttgacccctacctaagacgtaagaaggtattttagagctgtgaaatgtgtcaagctgagtctcggagtgaaaagggtccggtttagtgaagccaagtaagcaaagccccttgtttttgacggacattatatctcctcctcttctcttctataaattgggcacctttttccaattttacgcacagtcacggagatagatagtaagagagagctatg

SEQ ID NO: 35433 - DNA, 3000 bp, Unknown
  misc_feature (1)..( 3000): 2750-1469P.txt file - cDNA_ID_3087548; gDNA_ID_2926306; Annot_ID_205866
attgaggttaattcactggaaaaacaactccaaagaagagctgatcatgaagaaaaaaatcccaaatttttcagcttaaactttttttaaaaccaaaatcgaattgaaatttctccgattgacctaaaactctttggtcgagtttgttgtgtagttgatagggtcaacgaagcatcaaatcaaaccccaaacctaagaaaaggatgactttttccaacaaagacgtaaaatttcaatgtgcaaacatctcagcgtacgaattcgatttccgagtacttttcatcaaacaagaaaagggaaaacacatgaacaataaacatgcctgggtttggacacaccggtcttctcaccggatttagtcagaacgtcgaagtgctcctccgccatagctctctcttactatctatctccgtgactgtgcgtaaaattggaaaaaggtgcccaatttatagaagagaagaggaggagatataatgtccgtcaaaaacaaggggctttgcttacttggcttcactaaaccggacccttttcactccgagactcagcttgacacatttcacagctctaaaataccttcttacgtcttaggtaggggtcaagagatcaagccaacatttgtacatttatatgcaatgcatgcattcatttcatttttttttaatgttaagacgattatgtcagcagttagttcatgttagttgtgtggattatataatatcaaaaggtaaaattattaagttgttttgtgggtaataccaaagtctcttataagaagatttcatgattcttgcaatagagaccaaaaatgagataactatgtaataatagtaatgacaggtcaaaacgagttagtcaaaaaggtttttggatcatttccctaacatttcttagccacattttcatcgaggactgcatttttattgctcatagagtgatgaaagtaacaacaactacttttgtgttttccacaagtacaataatggtgagaaacaatattcaaaagtactacatgcttctttgttttaaaatgtaaacgtaaggccatcttcatcatttctgaatgagaaacttaataataaaataataacccaaaagtaaaaaagtaagagagagtggaagaagagtttctcacttgagaatcaaggagaaacgattctcagcctaaatcgcggcatgtcaatcaaatattagtttaagtattataattgaaacaaaatatattatataattaaaataataattttttcttttgttgagaaactagcaagggtatctatcccatggagatactctaacaaataaaggccgtgttgatttaggtataggagaaagtacgatttattaaatattgtagcagaaaacaatagagataagttggaaactagacacttttttcacaaataatttgcaaagtaagtagtttttttagaaatagggagaatagacacttttctctttcctttctaatacaattttctatctaatagagattttagtgaatgacctttatagccttctgttgttttgtcatatagtcaaataaagtcaaaaataacttttgtttcttaatgatctaagaagtggtatacggtatagacagtgtacaaagtgatgtacaaacgataatatacaatgatgtataactacataataagatggtgtacgaaaatgtaaaatatggtgtacatgatattaatagtatacatgcaataatgagataataaatcaaaccataaatcaccttgtacaccgtatataatatcgtacaccttcacctattgtgtacacctcatattcaaaagataaaaccatttttgtcaagtgataatatacaaaacaaagtttaaataataataatatgagattagtgtacataaaagtgtacaaatgttagtgtacataagtaaaaatgtataatcattactttcatttaatggtatacaccattatggttaatttaatagtatacatgatggtgtacaccattatatttttattaatttatgaacaattattattttattttataaatatgagataaatagaaatattttagaagatatgtataaaatgatttggtgtataagtgttagtgtacaaaactatgttttaatgctggtgtacgagaattataattaaaaacatataaatcatcttgtttttggaagaagaaattattttttaaaaataatttatttttataaaattcaaaaagatgaatatgaaaaaaaaaataactataatataataaaaatagttctaaatagttaaataatataaaaagtttgacccatattttttcatataaagtaaaaggtaaaatggtatttgacatattttttgtcttttagcttattacacataacctctatttcacaaaaaaagtaaaaaaagtgtctatttcacaaatttctaaaaaaactacctacttctcaaattactttttaaaaagtgtctactattctaataagcctaaaacaataagctgagctagattcacttctctatgtttcttgcgttcatgcgtgtgaccttacaaaagaaaatccaaaaaacgcaactctgactaatgtttcagcagatcataacacataataaacatgcatgagctctacagatacttgttctctttttgatatttaattagccacgttttaatctagagtcggattgtgatagttacagtggaaatttctcctcgcgacctaaaccagtcacgttttgatatttttcttttttctcgtaaataaatggaggaatataaaatattgaaattcaaacaaggaggctcactgaaagcaagaaaagctttcactaggaggactagagaaacaaagactgaccagagaagaaaatatgaaagcgaaattcaaagatgaagacttatgattcattgctgggtcaaactaaacacaagatttttccttcgctcatccttacaaaacccgtctctgcttttagcttttcttgagcagatcataaacagaaaacattaatatg

SEQ ID NO: 35434 - DNA, 3000 bp, Unknown
  misc_feature (1)..( 3000): 2750-1469P.txt file - cDNA_ID_3087552; gDNA_ID_2926306; Annot_ID_205865
tgacaaatgtcgagccaagtattgtgggatgcgagtctacttgcagcacaaatcaagatatacctataaatgattatctcggggtactctactgtaatgctaggtatggcgattccgagtattgtaaaaatatttccattatgaatgatacaagctgcaacggtattggatgctgcaaggcaagtttgcccgctaggtatcaacagattattggtgtggaaatagatgatagtaacacagaatccaagggatgcaaagttgccttcataacagacgaggaatactttttgtcaaatggatctgacccggagaggcttcatgctaatggatatgatacggttgacctaagatggttcatccatacggcgaatcattccttcataggctctctaggatgcaaaagtatagacgagtacacaattctaagaagagacaatcgtgaatacggaataggttgcctttgcgactataactctacaactacaggctatgcaacatgttcatgcgctagtggtttcgaaggcaacccatatattcctggcgaatgcaaaggtatataagtaattgcgctaattatcctagttttctatgaccatgcatgataaaaatattccaacgagatcattgtttgataacatgttaattttaataaaatcagatattaatgaatgcgtaagaggcattgatggaaacccagtctgtacggcaggcaagtgtgtcaatttgctgggcggttatacgtgtgagtacacaaatcatcgaccacttgttataggtaagtcatgaaaattttcatctcaagtacactcacatctatctaaagttttcttttatatatacatatataagattgtgtacaaatagtgttgagccatatagaaaatgtattttgcttttcatttttcttttgtgggtttgtagggcttagcactagtttcagcacattggtattcattggtggaatatactggttatacaaatttattagaagacaaaggaggttaaaccaaaagaagaaattctttaagcgtaatgggggtttattgttgcaacaacaattgactacaactgaaggcaacgtggacagtacaagagtgttcaactcaagagagttggagaaagccaccgaaaactttagcttaaccagaatactaggcgaaggaggtcaaggtacagtgtacaagggaatgcttgtagacggtagaatagtagcagtaaagaagtccaaagtcgtagacgaagacaagctagaagagttcatcaacgaagtcgtcattctctcacaaatcaaccataggaacatcgtaaaactcttggggtgttgcctagagacagatgtccctattctagtctacgaattcattcctaatggtaacctttttgagcatcttcatgatgattccgatgattatacgatgactacttgggaagtgcgtcttcgtattgctgtagatattgcaggagcgctttcatatttgcactcggctgcatcatctccaatctatcacagagacatcaagtctacaaacataatgttagatgagaaacatcgagccaaagtgtccgattttggtacttcaagaacggtgaccgtggatcatacccacctcactacagtagtttcaggcacggtgggatatatggatccagagtatttccagtcgagccaattcacagacaaaagtgatgtttatagctttggagtcgtgctagcggagctaatcactggagaaaaatcagtctcttttctgcgatctcaggaatataggacattggcaacttatttcactcttgcaatgaaagagaacagactctccgacattattgatgctcgaataagagatggttgtaagttgaatcaagtgacagcagccgcaaaaattgcaaggaaatgtttgaatatgaagggaaggaaacgaccaagtatgagacaagtatcgatggaattggagaagattcgttcatattctgaagatatgcagccgtatgagtatgctagcgaaaacgaagaagaaaaaaaagaaacattagtggacgttaacgtagagtcgagaaactacgtgagtgttaccgccgcatcatctcaatacagcattgctacaacatcttcgtcgcggtcagatgttgaaccattgtttcctcggtaatatattaaccatgcatgcaaacaaatttattactacctcatatctttgcatttacgttctgttttggtctttacgtgtgaagttatttctataaatgtcgtcactcgtcaatttgtgttattaaccatacagatctgtttgtaaccactttgtagtttgtactttgtactatacacttcccaatacataagaataatttcatagtttacttctttaaatattttggcaataattattacagaatttactcaagtatttgttatctggacatgggctctcttacataattatacatgtccaaaacataaaaccgttgagactgtttttaaaaaaaaatttatactacaattatatgagaattttgtgaatccggtcagatcatggatcatgttgaaccttaatccgattcgactcaatgaccaattcatttcggtttaacagaaattatgttaattgacaatgtgatggaaccttaaccaacataatttagaaatttcgactgatgaaaaggatcctttagtttaagaattaagatagtcaacttttccattgcacacatatgaatgatttgcgttggtgaatagtcaatttcctgatattaataatctatgtgaataatcaactttgttatatcatctgggaaaaaaaatgatagtaaaatcgtataactaaaattaagattctaattatgaaaaattacaaaattgatttggacaataagttgtgtaaacttgtaatgataattgatcccttgaccgttgacaaaatagaacttccaaattccaacgagacggctcaataatttctaaaatagaactttcatacataaaagtcattagagaaaaaaaaaatg

SEQ ID NO: 35435 - DNA, 3000 bp, Unknown
  misc_feature (1)..( 3000): 2750-1469P.txt file - cDNA_ID_3087558; gDNA_ID_2926306; Annot_ID_205861
tacagtgggaggagatgacgtaccaacggagatggctgttaaaccacccaaagcagcatgtaagcatttacagaaatttctttatacttgaaatccattctaaacatccatgtggatcaatgcatttctgattaaataaatttgtcccggtatcagcaagcctagatgaatctgatgacaaatcaaagccgccagttgtgcagcaaagagggcgttttaaagtaacttctgaaaatctcgacatcgagaaggtaacttttttttttttttttttggttttaagaggaaaaaagagctttcttgtatcaatcacgtttgtgaggttttcctttgtattcgctatctctttatcaggtggtggcgccttcgccaatactgcaaaagagtcacagcatgcaggtttgtaattgttttgagttcaacttgatcagctgcagacgaacaatcaaatgtgttttaccacaactattcatctcaagttttcttaatgaaaacaaataatatttttacttgcggttatgtaggtgctctgccaacattcctctgcttctctacctcactctgatgtcacattgccaaacctaaccagctcatatgtttacccgctggtgtatccagttctgcaaactaatattttggaaagggtatggcttttgcttcttagacgctacttcctttctttatatatctcataacaatatgaaagttcattgcataattgaaattgtcccttaaacaggataacattttgcatatgatgaaagtactcaccaacagagagttgacaggtttatttcgtgcaacttcactccttttccatctcaattttcccttttgattacatttttccttgccactggattgaaatttcctttatttctttgatgtagatggacgtgcagttgaacaaggaagtatacaacaacctactgtgcccccaactgagaaatccatggtatgcaattgtttgcaagaaaaaaatgtattgaatcacattccttcagacttttgagcttaatggaactgttcttctgttgaatcatagcttgaagcagcacacgaaagagagaaagaactgctccatgacataaccgacctgcaatggaggtaactatcgaaaccatctccttgtatagtttagattaaaatccatcattctcacttgtttttgtgtgtgttcataggctcatttgtgcagaagaagagcttcagaaatacaaaaccgaacacgcccaagtaagtatgagtaactaaacacaatcgttcttatatgcaatcttttcaattccactatatgtcaaagatcagtaaaactcatcacttgcctgttaaaattccaggtttgatttcctaagaagcctgagaagatatgtgcttaagtaaagaagtttgatttcatcatcaacaataagtatttttaataagataatacatctaatgaaggtaagatttgctttcagatgttttgtcatttgattcataaaatacatcactccctagtccctactatcattctgtgttatcttttttttttttttttttagttttttaggtttgtttaaggaatatgtattatgtaccatggtagctatttataaccatggttacataaggatttgtgtaatattgatgatacaaaaagcgttattgagaaacattttcgtgagatggtgattaaaaacatagcatcttgataaactaatggggtgtatgtgtttttggatgcgtgtgaatgaatgcatctctctctctcaacaagtcagtgggacaactaaaacttgtcgtcgtgtcgcattggccagcacacaatccgtgaattctattacagtcataattgcttctcttttaatgctgctcatatgtgtacatctttatttatattttgtgttatagattagatgcttataccatatatatgaagatgtgattaacataggttgttcaatctgtataaattaaaacgatttaattcataccaaaattgaaaaccccaattggttagtaattatgtacttcccaaaaggccaaatcaagtaaacaacacattagatattatcaacatttatttgattttaaaatttgttaaaggttaacacaagtggatacttcaattatatcattttttggaagaaagacaaaacggagttattatatttttttccaaaacttggctggcttcagaaatcagaatttaggtttaataaaggcagaaaaggacttgtggctgatcaattgtgaatacttaactaaccattaattaacaatcaaattcgaaccattacacacagacagacgacaactttgacacgtggcaaaacgtaattgggttattttcgggtgaaatggatgatacgatgcagccaagaaccaaattttcccacaattattattgttcagaaaagaaaagaaaaaacactcaaatgaaagatctcacgtgcggaaccaaactatgacctttgtctgaccattgcgtttctctctctctctcaattgttctatgaactttttttggtaattctctctatccagaagtggagttagtagtaaacgttggtctttgttgtgggtctgaaagtattagcgtcgctgtttccaagtaatcctaaatcagttcacaagaatctgatttgaacagattgtgatgttctgttttctttctcttttttccttttaattctcgcaatatgcaaaagtatgagtctttttacccgagaaaatagcagttttcccgagaaaataaaccagaggtccctaaagctaaagctaaaactaaaagctaaagtagtgtggattttctagatgccaagtttcgttttttgagccttttaagctcttttctggatttcgtttttctcgtttcgctctattcttcgccgagcaagtaatcattgccgacaacccccagaaaaatcgtagatttcttcaatcggcgatttaaaaaatttgaactttttctttaaaagctttgagctcttttttcttcggattattttcaaaatg

SEQ ID NO: 35436 - DNA, 3000 bp, Unknown
  misc_feature (1)..( 3000): 2750-1469P.txt file - cDNA_ID_3087562; gDNA_ID_2926306; Annot_ID_205859
tttcttcaacaatgatgattatcttcagatacagttggcacttttcccacctatgggcaagtattttaacagaactgaagttcagagaattggatttgacttgagtaaccaaacatataaacctcctcctttgtttggaccttactacttcattgcatctccctacacattcccaggtaacattacatacgaagcttatacacctttttggagttaaacacatcgtctaacaatcgaataatttttggcagctgatggtaacggacattccttgagctctcggatggtcactgggataataactggttgcagtgctttggtcctgtgccttgttgcgttaggaatatacgcaatgtggcagaagagacgtgcagagcaagctatcggtttgagtagaccatttggtaagtccgatgttctaacaggtgaagttatcttagaaacactaccattttagattctctgaggttcacctgaaaaaaaagaaactctacattaacttacatgatagatttactgttaagtagaagactgacaatgatattttgattcactcagtttcatgggcatcaagtggaaaagacagcggtggcgcaccgcagctgaaaggggcacgatggttctcctacgaagaactcaagaagatcacgaacaatttctctgtgagcagtgagctgggttatggaggttatggaaaggtgggtttttgaaagatcgatcttgaaactatctagggcttcactttcagggtttgacaagtaacgctcctctgtttctctctgtaatctccgcaggtgtataaaggaatgcttcaagatgggcacatggtggcgatcaaaagagcacaacaaggatcaacacaaggagggctcgagttcaaaacagagattgagttgctttctcgagttcatcacaagaacctagttgggcttgtcgggttctgcttcgagcaaggcgagcagattctagtctacgaatacatgtccaacggatcactaaaagatagcttaaccggtactgaaaaatctggcctttaggtgctcaataaatcacaaacacaaaacttgaccattacgtattgtttttagggcgatccggaattacgctggattggaaaagaaggctgagagtggctctaggatcggcaagaggactcgcatacctccatgaactggcggatcctccgatcatccacagggacgtgaaatcaactaacattcttttggatgagaatctgacagccaaggttgctgattttggtttgtccaagctggtttcagactgcaccaaaggccatgtttcaacacaagttaaaggaacattggtaagttttagataaatcaacgagtcatattgctttcaatttttaggaacttttgtttctgatgattcaatggcagggatatttggacccagagtactacacaacacagaaacttacagagaagagtgatgtgtacagcttcggtgttgtaatgatggagctgatcacagcgaaacagccgatagagaaaggcaagtacattgttagagagatcaagcttgtaatgaacaagagcgacgatgacttctacggactgagagataagatggatcgttcgttaagagacgtcggaactctgccagagctcggccggtatatggaactagccctgaaatgcgtagatgagacggcagatgagaggccaacgatgagtgaagtggtcaaggagattgagattatcatccagaatagtggggcgagtagtagctcctctgcatctgcgtcgtcatccgctacagattttggtgagaagcttttgtacggaggtactttgaagaagaaagaagcaagagacggagatggaggcggagcgtttgattatagtggtggctactctgttccgaccaaaattgagcccaagtaaatatcaacatctcttgtgagattatttgtcgttactttttgtatgaatgaatggaaaagtcatattgatgaaaacttgtgcgagtattgttgacctgaaacactgtgaggctaggcccattagtaaatcgtgattactaaaagaaaatcttagtagttgggccaaataaattagaactgtaaactgtccatgtatagacgtcatttgccttttcagcccaaaaacggtagcgtattaacatgagccaccactgccactggacatatacacatttagcccatgtttttagtaatcgtgtttattagtaattgggctcaagtaaatcagagtagttgatattattaggcccataaaagcccaaaacggaaagccacctgagaagcagtggggacgcagattcctataaaaagcaaaatgcgtcctcggaaaggaagaagaagaagaagtctatctcacgagttcccgtttcgtgaatttctctctctctgtgtgaacaaagacgaagaagacgaagtaacactgatagaaaccctagttttttttttaaatccgtcgaggcgtaatgtcgtcggagctgcagatttcgccggcgattcacgacccgcaaggtcaagagaagcagcagcaagccgccggagtcgggattttgcttcagatcatgatgcttgtcctctcttttgtactcggtcatgtccttcgccgtcataagttctattatctacctgaagctagtgcttctcttctaattggtttgtcttcttcttactcctcctttgcattgcgatcgtccttttcgttttccatcgattgttttgtttgattccttgtgaaatttgtggaattgtagggctgatcgttggtggtttagcgaacatctcgaacacggagactagcataaggttcgttgaactttttctcatcagtttttttagtattttctcaattatttattactatttttatgtcctttcctccattgacctggaaactcaaacgattgtaaattactcactgattacatacacgaatacatgtttatatgtgtgtaagtgttcttcaatgctaatctattttgtttcttctgcaggacatg

SEQ ID NO: 35437 - DNA, 3003 bp, Unknown
  misc_feature (1)..( 3003): 2750-1469P.txt file - cDNA_ID_3087566; gDNA_ID_2926306; Annot_ID_205858
atctttttcttcgacactatgtttcgttttttgtttctaattaatatcaagttcttcgatttacatatttgtacaaatcatcgagtataaatacctagatatacatctaaagaattgtgtatactatctttgacaaaaaaaaagaagaagagaattgtgtatatattacgtattagatagctacaatattattattttctactgtgacgtaagtatgattatgaggattaactatactaatcagtaatcactatggattacagctgttatatagtaaggctgactaatttgctttgaaaacaagtaggaatcgattaatgagaatgaacttcgaatactatatagtacatggtaaatataatataatacaagatctggtttatgtatcccaaggacaaaacaaaacaggaattgaagcttctatgccctcaaaattgcagtcaaatgttgggaagaaaaatgatgtatcgtaccttgaattatgctcccacttacttttttaatgcatcaatttcagtgcagtttcgttggaaatttagaaataagattttctacaaatgatcttaatccttaaagttccatatttgctccttacttaccatattagttatatgaataacgttagagtgttcatcaaaaaaaaaaaaaacgttagagaaactatgggatttaaatgaacagctaattatactatatgattgaacgtgcaagtaatattggcgcatttccactagcgtttttttttcttaacattttgtaagacaattttcatgtaattttcttctgctaatttttttttagtttaaactttaaagttgaaatattaatacataataacgtacgttcagttcacagacgttcttaaggttctgcaaatagcaggattactattaatgtttccctataatgtgtatacacatgatttatctgcagttgcgtcaaacaatcataactgaatttgtatatataaaaaggcatgggggatcgatcttcaaaactgtggatatgatttcctgaaatataactcttacaagtttatgaaataatccatttgatataaataaaaaagttcactaaacgaacaaatagatatagagactttagagcctttgacaaaaagaataagaagaagaattggaatgcaaagaagaaaaaagcaataatggaaaccggtacgtaggaggaggagtgtggcacgtgcggtagaagaagcaaaatcctgaaaggccgtggaggagagcacgtgatggtccaacaccaaatccacaattcaaggtccctcgtttgacttcactctctcttcttgagattcgcctcaaaatttatcttcttctcacttttttccccaaacgaattacataaaactattaaagataaaaacgaatatgatatgaatggtaacttttaatttcctaaattccatgtaagatacacgaaacacataaaaacattggattctcacggtaaataatctcttcgtaaaacaatttatgaaacttacaagtttctgttggcccaatattatcttattgagatgtgccgttgccttcacgaagacgtcatgcattaaaccccttattaatgagcgtttaatcatatagagataccaacatgttctgaaacttataatcttattttagaatccccattatggctaattaagtgtacgtataaaattcaaagtgatacgcaattacctttagtatacaatatatatatatgtgttgtacaccgtttggttcaggtgaattactgaatcacctggctattttataacaaggagggaaattaaatactaccatttttcgggtatttattatataaaacattttatgaaaatttatattagccaaacaatctaagagatttcatttaaattaattacaagtgttcattgttgatggataaattgcatattgaggatgaataccaaaaaggtaggtagatgccaactagaccaatcttgtgcacggcgtcgtttcatgagtatattaaatgggccttaaaagtattaccctttttatgacgacccatttaatttaggaagcccaaagatgaataaacctattattattgtttatgtgtttatacttttgaacccataatttatttctgttatgtcatctcaaccctaactttatataatcagtattaaatccaggcatcttcaacgagccgtcaacaaagataggaaaacgtagtcgtttgatacagctggtataaaatctgaattcattcttcaaataaattaaaatcttcgttggcgttgttgttggttgcgttacagattttggactaatcattattttcgtgcctgcaaagtcagcacgacgatcgcgtttcgatcttcaaagtagaagaagacccgccacaatcacaaatcgcggtgcatatagtctaaagggtaagcttttcgattcctttcaccatgtaaatttaggtcaattccgtcgcttctttgatttggggtgtttttcctggcgcgaaatctttccgattttccctgattatgaatttataaataatgggtatcgcagattttgggtctcagtggctgattcttttcgactctagtttctgcttccgccgtctcatttttttttctacgcaacagtaaagtttttatttttccacctgaattttcggatgatggccgaagattttgtgtctatgctgatacctaatttttccatctgaaattgattttattcactgctattttcattttgttttcatatcattgtgactcgctactaaaagcttctaaatttgttgcctttttgtgaaaagctctttacacggtctatggtaattgtgttaagattcttgttcatcatgtacgagattttcattgggtcacaagagtttcgttgttgaagctactagtttttttcatgatcaaatacttctttgagctacttgtgattctctttacatgatctttatgtagaagataagtattgctgtgttttaattagttaggtacttgttttcaggtcaatg

SEQ ID NO: 35438 - DNA, 3003 bp, Unknown
  misc_feature (1)..( 3003): 2750-1469P.txt file - cDNA_ID_3087578; gDNA_ID_2926307; Annot_ID_205909
agaactcaaacaggtataattaactaatatgttatgattcacaatagtaatacagttattttactatttattttcttgttatgacgtttgtttatttttcggataagggttttaaatcgagaatcgaagatgtaagagaagagataatgaggaagagaagggctgggaaattgccaggagacacaactactgtcttgaaaaattggtggcaacaacattgcaaatggccttaccctacggtgagtactctctatattttacgaacaacaaatatagtttccgtctaattgtttgtttgggtttacgttttcatgaaataatatgataatcattataacatgaaacaacaaatgaagatagatatgtaaatgcaaagaaacaatcaagacccattttggttacactcaaagtcacaacatgcattttttttctattcttcaaacatactgaatttgttactaatactcaaaaacactatacatctctctcccgttcaatatttggcacaagccaaaaaggtggactacagtctaaagttgcatgctatagtggaaaagaaatagcctttgacgctatcagatctgcacatgcattggcctctcttcgttgaaactgaaactgattgtttttgttttctttcctaaaatgtcattaacaacaacaaatttataatgtaaaaaaatatgtgtcttgaacaggaagatgacaaggcaaaattggtggaggagacaggattgcagttgaagcaaatcaacaattggttcattaaccaacgcaagaggaattggcacaacaactctcactccctcacttccttgaagtccaagcgcaaacactaatctcttcttactatattagttactacctctacatatattcatactaattacactgctaagacatgcatgatacatacgtaattcatgttactgataataacgaggtgtgatcattaatatcatgtacttacttagcttattagatccaccgactactatatgatttgtgcgttgcgtgattactggttgttactagattgtaattcattttgtttgtattgtgcattcaaatttatctttttggtaagaacactgattttgtaacgtgttttccgtggatgactagaccatcatttggaaatataaagtaatgatgccgacaaaaaaggcagtgttttataaaatataagccatatcataatatctttggaccgatcaatgaaagaaatcgtccataaaaatggattagtttaattccagtttagattattggtattctcaaaaactaattaacgtatagttttctagttctttatttgataccaagatttgtgtaacttaatattttcaaacgagtttacaaacacaactagaccgagaaatagatatatgatgtattcattaaaaaagaaaaaatagctcttgagattgagaacttgggatcttactatcttagaaaagtcaccacatgccgccatcatttgtccactacgattcagacagaagatccgatctgtttatatatatatatataaaagtaaagacattactttatgccttatggtaacccccgattactataacattaaactactaattaatttgacaaaagaagttggactgactgcttaataaatgaatgttagtgacatacgtatatattttcgataacgtgtatggtatttaagggcagggggatttgtacatttggagttttatatgcttaatatatcaaatgttgtatagatccagatctttggtttaaacctcattagtttcgatgtcaaatcaattacaatatatatagaaactttgcaattacaatatttagtaccaaaaatcggtggaattatgtacatatgaatatgatataaatcactacattaatttgtaattgagatgtatctgtatatttattgaaatgatactatgtttaaagggttaccgattcgttaacgggttcttttgctaagttagctctttgatctcataagattcggatgcttaatataatatacgcatttatagtcgataattgtgaattgtaaattcaaaacagtaacgtgttttaagtgtttttttctttttcttcgaactttttaattttcactattaaaaaatagtatgagtagtagttgaccagaaaaagggtggtaaaaagaaaaaaaagagattctttaattaaaattgcaacgaataatacatattttaaattcagacacccaatgaagtggaatctcctttgtgtttaactaataatttctcacgccaccgctttcacagatctctgtctaaaattcagacaacaataaactattttaaacacacaaaaccactacgaaacacaataattcatgtttagggtgatctgtcacatattatattcatatattgaaataattttttgttattcctactaacacatttttttcaatgacatttccacgaaataaaatttataaagtcttcttatatttactgaataaaagttctacattatgctattaaaagtgtataaagtaacaacaaatttatacataataacaagttttcttataaaaatattaatagcatttttttttatccatagaactatttttatcatataattttaaaaacgggataacttgtttattttatgttaaatttaagttaactagttgtataagtactaatgaaaacattttcttaaattcaataacaaaaatttatcactactccaattatctacacatgttttgcttaatttttggtaatgtcacctaaatttaacaatttcctaaaatattcatgaaaaaaaactcatgggtcacaaatctcaaataagaaacgatgggtggtcaaaagaaaaaaactaaaaagattattgcttccccgagaaattgggataaaaagaagcaacaccgatcacaacgtctccctataccatctccttcagatccacacactctctcttatatctctccggcgaaaactttccgatcaccgacaaaaaaaaaaaatg

SEQ ID NO: 35439 - DNA, 3000 bp, Unknown
  misc_feature (1)..( 3000): 2750-1469P.txt file - cDNA_ID_3087591; gDNA_ID_2926307; Annot_ID_205910
ttgtgtacttctattaaatcaggagaatatctgactgacaccatacataatcatataactgcagataaaatatcggtttttttttgttaaagtgtcgttaagttacttttggttctatagtttgatcaagtgagtatttaaacactactaagtaagttactattggtactagataaaattttggaaatatgtatgtgctgccaattaaattatctgtctcagtggagtgttgcaaatctacaaagtactattgggtattaattagtacacaatagtactttgtagatttacacgtattcatttatttttaacaccagtaattttttttggttacatacttagatgcaacacactaattgaaaaagaaacatgcaaaatacacatgtaatagcaccatgacgaaagtagcatatatgcatcaatagctataatacatgtataaattgataaggaaacaaaagaaatgattggcctagcaaatttaacgagtatcaactttggtcatattttgaaaaacgagtatcacgtgaaatcacggttgtgaatattttaggtaacttatactaaaagcattgtattgtaggtggccaaatatgtgtatataattttctctttattcttggtaactttttttgtccaaccctatttttcattataattttgtccacattctcatcatactaaattactaacgcacatacgcaataagaaaaaaatgtctgccagattattaaatattccactttccaactaaaattgtgtcgctatcttttgtaattatgtaaaaataaaataaaaaaaaacaacgatacaaattgtatacctacacatatgacatgtccattacaataccaataaactgaaggcaaattgaatacgattccatgactttcatttattatacatataaaattagggaagttgtaaataatttaggatttttctcaaaaacaaataatatttcgggttatgtgcttaattagatcatgtgtaattagaacacgtataatatcactatcggaataacgttataaattagtagctatcaacttattatacacataaaattaaggaggttgtaaataatttaggatgtttcataagaataaaataatatttcggatcatgtgcgtaattagatcatgtgtaattctataacaacacgtataatatccctatcataataacgctacatgagtagttttctttattaatatgcagccgtcttaaataatttattcctctttgaccccaaaacttacacattaaccaaaaaacaccccatagaagttttatagaatcacgcaaaaacccccttttacaaaaacgtgccaatttgaggacttaaagcatccacgatttgattgatatttcctcaatgattgggtccgagagtaaatgcgattgataaatgatcacattactcgcgataagagtctgcgatctactataagcaaactagtcgtcttttgattctcctcttcttcacctttttaccaatttcctcgcttacaagattcaaagggtttgtgattgagagaagctttaaaaaacccatctttggtgtttgattctctgtttatttaattcataaaggaaggctcttttttttttgtttatttcaggctcattacgttgatggtcatctaaatctcaagaagacaaagttgcgatttttgcaactgggtttctctcttcaggtactgagtttttgttgttgattgtgagaataaaaaggaaagtagacaaaagaagagaatctaggtttttgattgaactccattttagaaaaagttgaaaactttttggcgtttttcatttgtttttcaagttgtggaattttctgaattggcaaaaaaacaattttgtgactactaaagcaacttgtcttggctgcttctttttatcaatcatatatcattgactccactaagatctagtatttatataatattttgtgtaggccttattaccttcatgctaagctcgtgtcttctgatctatttgtaattattttaatctattttttttcagagatttaatctgtataagaagatctcaagatcagcttttgtgtattgaagaagaactaggaagaacgaggatagatacaggtattatttttatatatcaagatctctgcttttggcttatttgtttatcatctttttcacttgaaatgcacgagttttaaagtataaataagctttgtgttcttgttcttgaggctttgtgttgtgtgaagtagaaataagctgaatttggatttgatttgatttggtattaaattgtcctcactggttttgcgtgattatatcatctatgcacatggcttgtagcgctgacttgcttataagtatttttataaaacgtgttgcgttcttgttttggcttctataattgtagttttagaattgtgcttgagcactaatcagattcacagcaattcaaaaatccatttagaggtataattccttttagatgctctttgatcttttcgtgcttgagtcagtttgtacttttgtccttgactctttctaaaacaggttttgtgttaatcccttgaatctgctttatcgcttatgtctcttgaaatctatctatgttgctctctttgtgactgtctgatcattagttgcaaaatgtgaaattgtctgtgtaatgatcaggtcgagttttatgaaatgttgttagcttccattgagtaaggcttattgtggattggtggattgaaatcttcatgtaactataagtattgaggagctttgaatgtggatttaaaactgttctggagtgtcattgactttggatactattattatgtatttgtattaaattcatattatgtatgccacagacccattctctatttccttcaacaagttgacagagagcaaaatctttatatacgtgatatcaaagtgttctaatttccacattcttctcacttctcaggctttaatctaaactttgctctctgctttctgcgattaaaagatg

SEQ ID NO: 35440 - DNA, 3003 bp, Unknown
  misc_feature (1)..( 3003): 2750-1469P.txt file - cDNA_ID_3087595; gDNA_ID_2926307; Annot_ID_205908
gtgtgcgccgttaaaaccaatggacattttggtttagtggtgacggatgatccaaaatcgaatggtggaggagaaaaggagatgaagaaggagaagatcggacggtggaggaaggttgttggagggcttgttgggtctgtgacggtgggggtggtgcttttagggctggtggtggcggctgctgtagtgacggcaaagaaaaggagaagaagggcaaaaagggaagaaatggagagaaaagcttatgaagaagaagcttttagagtagtgtcaatggtggggcattctagggctttcgttgcttctgctacaaggacttctccaggtttcatggaatatgagtttgttcctaattaattaattatatttacgtgtgattccgtttttgtggattgttttcttttttttttcttttgtaaaaacggttttaatttatgttaaaatgcatgttgttgggggttttgggacatatatatatatttcgttggtgacaagtaaggtacgtatggtgatgattttttctttctttcacggtgatgaatttacaaggtaacaccgctagtggcctagtagtaagtagtaactattaaagaaaatcaaatgagcaaagttacattcaaagtcattgataaacaataaaacatggtcattttttacaccaaaaaaaacaacatgatcgttgcctacacgttaattaacgaggcatcaagaattataatttgatgaaatatgccgtctggcgtcttcataagaatacaatatgtttgatgaaaatctacctctaatcaaatggtagtttttttttttttttgaggagtcacatagctaggaaacgttttatgctagtaatatcacacacggaaacaattacgaacccatgtgtacaagtgtttaggctttgagaccttaatgaagtgcccaatgagaattatttttaggtccaccaaactcacaatattatatggcccgtacattaaatcactaaaacttagtatcgtgtcactaatagtatctcattgttctctgattaatggccgcattattataagtttttttttgtgtcaaaagcattattataagttgagaagtcgttttcataggaccacaaattgtttcagatgtgagatgtcttaaatcttaggcttaagagaacgacaattctgtccctcttttctttgttcgaccaactctgtctttgtccctctttattttgtttctttcatttttctatacgaacgaatatttttgatgtcattgcgtaaaacaaaagggaatttgtacataactacataaaaagggagaaatggaaagtagtttttccatattggtgaaggcgtgcattattctctttttcatttaataatatgcaaaatcctcttttaatttgtattttttatttttgtttatagaatatattatgtgctattattttagttttttttgtgtcatgtattattggcattattaaaaatatttgatctaatcctattacgatataaactacatgcaacatatgcaattacaacgaccaaggattccattgttatgatgaaatattattttagtttttgtaattaattgcagttttttttttgcaaaaacttaagactacttggatggctattggctccaatatgccaagccggaggaaaaccagaagatttaagaatatatttttttaaacgatgaagtggaaaaataatttttttaacgtccaacatgtatgttcagaagatttgtaattctgaacggaactattacatgacgttacaaaaaaccatgccacaagagtatccggacttaacaacgtttcacaacacatcaattttttttttttcagttttatggatatttctgaaattctagctaaaaactattagtatatattaaagttcatatatcaaactattgtttgtgtgctatattaacttcatatcaaactaggaaaaatatgaaagcatttttctatctatcaaataatactgcaattaaattatcagagtgttactgttttaaggttatatgactaagaaatggtgcatcaaagctgtatcacattttgtccaaaaaaatttaactgtatcacgtaattgagtatttaatattttaaaagaataactaattatatttgttctttaccaaaagaagaaaacaaatatactatatttctatactattaaatagtattatcaattaggtgttaatactatttgttaagtgggcgttagaggattaggtgtgtctaccggtcctgtcgttaaaggtgggaagatattttattttcctcattctttttcaaaatttcaactaatttttaagttcaagttgttgatcacttattaggtcttaaatcattgtcacgagaaggaaaataaaagtgtttttaatttttattttaagtttacattttatatacatacatatacacgtatttatgatttttgtaaagcacgttgttaacgtgcacttttttcataactttacgtcaaggtatatatcagcatattgtggaatcaaacatatatatagtagcagttttctagactaaagtaattcagattaattgtaaagataacaatcaccgtataaaacaatcaacgtccgtgtgtttgtattcacatatctgatgaaaattagtaattctagttttcagtctttcgattaacaatacaaaaataatactttcaatataatttgatctatgtaaaaataatatatggtatggccggaccagacccgtgtataacaaacattgttttaaatgtattttgtatacaaataagacaaaataatctataaacaaataatgtatatttttagaaaagaatggagtgaaaaacaattaaaggggaaagaaatcaggacagctttatataggttgatttcatctgacaattctctctctctctctttttctaatcatacgaacacaatctgcttcaagaattagggttttgatcagacacaaaaagtatctctctccggtcttgtgtcaaggttatg

SEQ ID NO: 35441 - DNA, 3003 bp, Unknown
  misc_feature (1)..( 3003): 2750-1469P.txt file - cDNA_ID_3087621; gDNA_ID_2926307; Annot_ID_205899
aagacaaaccgagatgaatcccaaaacgaatacggacttattgcgaggaaggaatcgagcatgagagatgacccaagaagagtcgaaagatgattaaattttctgataacttttttttatgcttaaccggatctaacattttgttaaaccaacctaaaccatgctcaattccgattccctaatctgataagcacgaatcacatctgttctctatttgcagagctcgaaatttaagagagaaattgagaagccaaatcgagagaatgcttgcaaaaatatcatcttcagcgaagagatttgttcatcggagtcttgtggtgagaggtaatgctgcaacttttcctctctctttttccttttgccggagaagagctttttctggtaagactagttatgattacagagaggtacttagaactgggctgagtgatattgaattagatgatgcaattggtttgttcggtgttatggcacagtctcgtcctttcccttcgattattgagttcagtaaactgttgagtgccattgctaagatgaacaagttcgatcttgtcatctccttcggggagaagatggagattttaggaatttcacataatctctatacttacaatattttgattaactgtttctgtcgatgttctcgactctctcttgctttagctcttcttggcaagatgatgaaactcggctatgagcccgatattgtcacgcttaactcgctgctcaatggtttctgtcacgggaataggatttctgatgccgtagctttggttgatcaaatggtcgaaatgggatataaacccgatacggtgacattcacaactctaattcatggactttttcttcacaacaaagcttcagaagcagtggctttaattgatcgaatggttcaaagaggctgtcaaccagatctggttacttatggtgcggtagttaatggattatgtaagagaggtgatactgatttggctttaaatctgctcaacaagatggaagctgcgaaaatagaggccaatgttgtgatctacagcacagtcatagatagtctctgcaaatatagacatgaggatgatgcactcaacttgttcactgaaatggaaaacaaaggagttagaccaaatgttatcacctacagctccctcataagttgcctttgtaattacggaagatggagtgatgcttctcgactactcagtgatatgattgagaggaaaatcaatccaaatttagtcactttcagcgcattgattgatgcatttgtgaagaaggggaagcttgtaaaggctgagaaattgtacgaggagatgatcaaaaggtccatagatcctaatattttcacttatagttcactgatcaatgggttttgtatgctcgatcgccttggtgaggctaagcagatgcttgagttgatgattaggaaggattgtctaccaaacgtagtcacttataatacgcttataaatggattttgtaaggctaagagagtagacaaaggtatggaactcttccgcgagatgtctcaaagaggattggttggcaacacagtcacttacaccactcttatccatggattttttcaagctagagattgtgataatgcccaaatggttttcaaacagatggtttctgttggtgtgcatcccaatattttgacatacaacattctgttagatggactttgtaaaaatgggaagctagcgaaagcaatggttgtattcgagtatctgcaaaggagtacaatggaacctgatatttacacatataatattatgattgaagggatgtgcaaggcagggaagtggaagatgggtgggatctattttgtagcctcagccttaaaggagtgaagcctaatgttgtaacctacacaacaatgatctcaggattttgtaggaaaggtttaaacaaagaagcagatgccttgtttagagatatgaaagaagatgggactcttccagatagcggttgctataagatgccatcttagagaatggtgacaaagcagcatcagctgaactcatcaaagaattgaggagttgcaggtttgctggagatgcttcaacctttggcttggtcactaatatgttgtatggggagattggacaaaagctttttggaaatgctttcctaaactatccttgaagtgagtaagccttttttaataagttattacttctcaatagtcaatacaatccttatgttcatgagtatgcctgattagctttctgtgaaccagcattgaagttttagtgaacattttgagttgtgatttggttttttatcttctgtatccaatattgttcatatcttataaacgagacattctcaattatgttaatcaaatttggaaacttttatctttgtttcgtgcattaggaaacttgcaaattgttaatttctcctatagaagaaaatggttctgatgcgaatcatgtatgtaccagaagctgtctttgaacaggtggagctgcatcgcactccatttcacatgggaactcttgttttgcaggctcaatgacggtttcagaagatgatatccaaactaatgtgagtatatgagagagtgtagcagctgtaatctcatcaaatgaaagatatttcagtgttcaagtattacttctcaatgcagtcagtatgttcccatggtgtagttcattgcacattggaacagttcgttcttttttgtgttgaacttgaattactatcgttgttttttgtagttcctagtggaattatgaacatgtgtgtggctggacaaacatacacgtagtaccaggtttagtacttgaattatgaacttgcagagatggttcaatggcatagttcccatcgtcaatttcattgattgaatttcccttgccagaaatttctgttttatcataaattttgagaagtagttttggttttacggggtttcttcatttctgaaattagggattttatttcagggtaagaaatcccaagaagaaatgaagaagaaagttagtacgcatgcatatg

SEQ ID NO: 35442 - DNA, 3003 bp, Unknown
  misc_feature (1)..( 3003): 2750-1469P.txt file - cDNA_ID_3087633; gDNA_ID_2926307; Annot_ID_205895
ttatagattggtttatggatatttaacttattcaattttttaaaaatagtaaaacttaaaatttaaatttgtttatcctctgtataaaaaatatagcagatggtaggaatgtaaaaaaagaaaaaataataattacagatataacaatagttaaagtatacaagtggagattagtaggagtctagatttaattggtcaatgtgttaatgtcagaacagccacacgtcacaactgtctcccaccttcttgagtacgatcgtataatgtacttatgattatacaataattttgtaagaaaatggaaaaattgtattatgttaaatagaccaacccaaatatgaaaagatgaatggtccttaatttgagaattatcctttgtggtataagttgtaacatatcacccgcaagcatccggaggttatctggtaagagttatttagattgtcttaaaacattcaactcaataatttggactaattattttattcaactaaaaaaagatactgttattgataataataataataagataatatttataaacggttatttgaattctaagttatttaactaatattttgaaaagaatagtattctaaatattacatttttggtgattttaaattatattgtggaggaagtgtttacaacaacatcaaagagactcaaattacgatattatcgacacctatcgatatcaagtactccaaaagtagaaaaaccccaacaaaacttaagctctatgttttttcttacaatttaacattcatatgaaaagtcattcgactaatatataaatataaacaaaacaaaagtcaagctttgtctcacgtgagagaagtcatattcttttctccaattaccccgcagcacgtaccaactcattttgtgccatcaaactttttaatagcgaaagttttcgtaagaaaccaaggattagctaacaaacaaacaaagaaggattacacaaaatttaataattgaagagaggagtaaaagtagacaagaaacactaactaaatttgactctcgtaactcgcatgattttgtccttacaaaagtcacatcaaaggcatgggtagttacatttgtatacaaaaaaaaaacgttttttccccataaattattcccactttaacaaaactatggtctatggttactaaatagtaaatactacttactactactggtattatagtaacccaatgatttcataagtttacgtgactagctctcttgaaggtaagttggatttagcaaaattagtaacaaaatataacataaagtctgtatttttcttagtaatactatatgtacagtttgaaaccaactatttaaaaatgaatttcagattagtttagatttgaatacatcattagattacatgcttaaaagttcttaacatcataagtttatgacccattgaaactaaactagcccttgttaagtgaaatatagcattgtaatttacttttttgtttaaatagatggttgtgtttttatgtatgtcggcatacgtgtattttagagagaaagttttgattgtaaaaaaaataaaaaataaataagaaaactatttaaaacatagaaagataactatatcagaataaaatactaagatgacaattaatttgcttcatttacaagcttgtattaggaattctctatgccaaccactccactacgtttgtgagtagagcttgcttgatcaatacaaacaacaaaaagatgaatttataattatatattatactatataataaaatacaagtcacaaaagcatatgtttggaataaattattgttatgaacttggatagtttcattctttttgacggcaaatagttatcattcattttttgtatcattcagtctttaatggttccaggtaagttgcaaaagaagtaagcaatattcatgtattctctagagatttttgacggcaaaatagtatcattcattttctttaaagactacaatttgattagatattaatagattaaatggagtagtagtttttttttcaaagatgattttaactaaagattattcttttcattttgattgttttatttgtatagctcaaaactttgtatataaaacatccttcttgattagtaaatttcgcatttcaacaaaaatggaataatgttgtgcgacgattaaatggaatagttaaaatgattaaagaaatgacactcgttgagccatgagattgatgattagttgattaccaccaacgtgtacggtgtggatctactgcatacgtgcaaaatgttttccatgatttttcataatggtgtttctttatgagtttatatatcagtaactagaattcacaacccaaaataaaattcatatggaaagtccatgttaaaatttttgttagtgaaatggtgaaaaaggtactactagtaaacttcatattttatttccctttttaaaaaagtagaataagttaactaaaacaacttttaaaagtggcaattacattaggccaatttttttaaaaatgtattgagacatatagctaaaacaaaatttgttacaaaaaaaacacactcacacatcgaaaaagctggattttttcaatcacatgattgaaggagctctgggttccacattcagtaaaatttttaaaaagataaaaagtaatttctgattcagtgttttcttaattgggcttaatttatgacccatgggcttaataattcggtacgatcataatatagaaccgtttagaaccgggaattgatttcatcggttcaacaaaacataaaaggtcaaaaaccaaaagaacgtaccttcttcttcgacactagttcctccgatcagcgaatctcgaagaaagagattgaaactaaactgttgaaattttccgacaataaacttatctcttttcctcattcaatcctagagaccaaaaagcttaaaagcaaaaaagaacacaaggaaatttactcagaggtaatcgtcgtcggagccaggaggaagaggagggatg

SEQ ID NO: 35443 - DNA, 3000 bp, Unknown
  misc_feature (1)..( 3000): 2750-1469P.txt file - cDNA_ID_3087643; gDNA_ID_2926307; Annot_ID_205892
taaattaactcaagtcaaaatagtataacaaataaataatgtaggaaatgtctcattatttatagaaaactacataaaatcaaaaaattactaatgtaaattacccattgatatgaagaatctaaaacgagtacatgtgttctaatttctaaggagcagcagatcacagcttcccacgtataaaaaaaaacactgtagataaaacggcgtcgcagagctgacaaggtctttttctatcgtgtggcacgtgcggtcagaagacctctctgaatgactgcaagattcaagaatctgaagtttgaagaacataaatgtaaatataatatttgtaggtaaatatttctttttttcccctgaattacctgataattaataggtaacgtaaagaatataattgttcatgtagagagattaattatgtcccttgtttttaaaatatttgtttaggagctagtggtgatttttttttgatgatattgctactacgaagaaaatacaaaaaagaagttacgttgatgtgaatatagttataatacaaaaaattagtagaatatatcacaccattgttaattttttttatttttttggaattttagaactaaatagttttctttcatgtgaatttattaattatagtaactatgtagcacatccatgtagcaagcattggttgtgaagagttttgaattgttcatttcgatctaagaagatataataaccaaaaaaatgattatagacttgtagttattattaatgttaagaggaatgttttctagcgatgctacaaagataatataaaaattggagttaatatctatttttcctatttcatctatttttagcagtatctatatttaggcagttatttggtaaacaaatataatatatatgtcgtatcttaatatacaatcgggtttcttatgagcctaattgttattccatgtttagttatataagagacagaaatatagaatatactatgtgaaaagatagaccattattacttacggagagttgatatgaactgtatgatgataacaactaaaaagagattgtgtctattttgaattatgacttcgagtaaaattataaatcttgtttttcttatggagcatgtgaaggaattatttcctataggtttccttgtttgtagcaaatcatgaatcaacactataggctaaacaatacatatttaaattttttattttcatctcattaatcaaataaaatagggttaatcaataatcacaattcacaaactttcttatttatttattaagagccacttttgatttatttttattttgttttcacataccaaaaaaagtgccatattttagctacttagttcaatataattgtttaaaataataaataaatatgtgaaaatagattaatctatatatatgtatatgtatgcataattgtataaaacgtgttgtgaagtttatgttaaagctaaaaacatggctgagaactctattccacaactgatatttttatgacaaatcacattcatcacttctagttttacaaatatatgaattagagttagctttaaaaaaagagttacatgattttctttcttccaaaagtagcacagttcctatagtcatatatagatttcatgcgatagctcacaacaagaaaaaattcacactaaaaatatgtatactgttttcgttactaacccggacaagaggtatagtaacagtagcaaatgtacttagattatagccttgttacaacggtttcaaaaagtagaatgatcaaattattttagttgctaaacacagtttattagctgataaagattttgtgtgttcactctgattgatgtcattttaaagttttaaaaattaggttcaggtagataagaacaataacataatttgagctctgatattctctaactatcttatttggatcatatatctaagaataactcatctgtatttagttacttaaaatttttgaacaatcttctgcaattatgttgtagaaagctcacttccatcttcataaaaacacaaagatcattatctattggttcatttggtttcgttgcatatgacaatgcttaagaaattaaagttttgctcttctcgtgtctaatttcttctgccatatttggagctaaaactttgaacatataattcaagaacttaaagttctgcctttgagaaattatccatcattaaggatctttattttatttgttttgttacacaatgctctgttaattttcttttggctaaatgttaacaaaaaaggttctaaacgaaatttgaagttgaaccggccactgtgccaatcaaattgaaccggtcactgtgccaatcaaattgaaccggtcgtcgtttactcttttaagggtttacactttacacagacttgttagctcctccatttgttgttgttagagtttagagacaacgaaaatcaggcgagtcgaaaatgttggctagggtttgcagatctgaatcatcttctggtaatgctgctgctgtttctgcgagattgttcagtacgagattagttcatcgccgcgtcgccaagaaaactagtaaggttgaaaagagtatgccttctctgaggagcttttgaaggagagagtttgaaattgagaagtggatctcattatatcagaagcttagatgatgcgatcgatttgttcgatgatatggttagatctcgtcccttgtactcagaaattgatttctgtaaattaatgggtgtcatcgtcagaatgaaacaacccgatattgcgatttctctctatcagaagatggaattgcggaggattccatttgatatctacagcttcaatattctgatgaagtgtttctgcagctgtcataaattgtcctttgctttgtctacatttggcaagatcaccaaacttggttttcatcccgatgttgttacgtttagcaccctaatccacgggttatgtctggaaggtaggatttctgaggccgtagctttttttattatatg

SEQ ID NO: 35444 - DNA, 3000 bp, Unknown
  misc_feature (1)..( 3000): 2750-1469P.txt file - cDNA_ID_3087686; gDNA_ID_2926308; Annot_ID_205930
tattgtccctacggaaagcacccaattcaatatttaattaagtatttcacataatactttagataaaacaaattacagagacaccttctttgatcgatatcttgagatacattcactgtaccagaatgttgatttgttttttctttttgttataaattattcatgaaggaaatatgataaattatatagaaagcccacgtcccagaaaatgacagaggcatgcaaaatcgtgaaatccagcaaggtatgtgagacttataatcttattgctatgttcttttgtcccctatttgtgtgaaatagtactgtcgtttgatttttcttgttctccattatagattctcaaaatctttaagattttatttttttgtaaggaggtatatatagaaatgggtgatgcacacgagggtacaattaaccctaacatagagacatagttggctccacaaccatctcctttagtctgattttcacgtgcattttcatccccacggttccctcttcttattgtttaaatgtaaatgttatgactattttacatgcaaacgatttggccatttctcataataacatcggatgtttaagagaagttttgagaaaattcagattatttccgatcataaatccatgattcatgaagctaatttagtcacacaattcaattattaaaaatgaaactaataaagttgcatgcacctattgatttttctaattaatcacatgtaggaagtttttctgaatggagtaccatcttaatcttaaatcctcgataaccatgaacaaatttgtgatacacaattttcaaattgcatggatcggttaaactatagcccaaagatcaagttccataaacgattgatatttgaaagaatgtatttgttcaagttactgtagattttatctaatacaataacaaaacgatattgataagattactttgttattaattacatcaattttatatcatgattgatagagatacgatataagaataatctaaattcttaaatggtgacggagaaaggcaatgtttggtccagcacggctaaccatttgctttgtcctatttgccggctctaaattattttaaaatatatccatcttacatgatacttacaaaaccacacatttgcttctcatagacatagtcaaagtctcaaaacgaaaatgaagtcaaataaagaatctgataaatatcaagaaaccaaatgaaatgcaatccgatttatggtcggagactcggagtgtaacctaatcagatactttgttaagaaagttattaaaaattttttgttcaaagaagaaagttattacattttccaagtaaacaaaacgttagcagagtagaaaatttagtacagtgactgacgcgatagaaagcccatttttagaatgggcctatttcagagctgaggcagtgaggcccggtttctttgactgagtaagattaggtggtgactgaaacataattgtttctttttttgtgaagaaagaaaaatgtatttccaattactcttttgacttttcttttttaataattgattatctttctgacattttgtgtaaatgattagcaaagtaattttacgtcttacttaactatttgtctttatattatcccaaaaaattaccctactgaagatcatattcaattctcttatgaatgctaaccattaaccaatatgaagtctaaaaaaagaaaagaaaaaaggaaatgatacatacccaaatttgatgaaattgcatagaaagctgcacctcttaaattcagtctaaattcaacattttgttcacattgatattaattgaagagtggtgccaaaaactggaggcatttattggtctgacccaacggaccacgtcgaaaatgaaactcgatttggaagtttgtatgatttgtaacaaaatttgcctcatcctcaccactctatttttattcatttagttgttcttatccaactatatatgtcttttacacaaaacgatccaaaaaaaataaacatgagacacctagtcgagtagtcccacttccaccatcttctatcaaatgtctcaacgtagaattcttttaattttcatacttctctctttaagactgttacttgttctgtgtccctttttttttttgtttaaatctaaatacatataatgctcaatcagtatcaatggtatttaaaatctctattaaaaaattatattcggagtcttataattttttttgtttgttttggaaatgttttttccaagcatattattgtgaatgaaatggtaaaaaagtgtccttaaaatttgtcattcgtgaccacaaaatattagttactactattttatgtctcattgtcaactcttttatggatggtgttaaattgtccccacttacctagttgttatgagatcgactgcattaactgcttgttttattatatttctccataatgcaatatataccatactataaaaatatatccttatgttttccataatctatgcaattcatattattatacatttcttatgattcattgcattatttcaaaagtacttgagtttgtgagcactgaacaagtatcagtgtattatgaatttttattaggagctaataaacgtcattaaagaggaaacaatattaagttttctgtggtctgacataaataaagactagtattaaatcttgatttgtatagaatgattaatactcgggatactagtgtatctggtctgaagtcccgggaaaaatgtcggtttcactttcctgattttctcgctcattttcccggaaagttatgaagaaaaaaacatcttctttttaacaatttttggagtcttataaacgacaagccaaaaagactggagcttttcgagatatgctcttgagacgtctcaaaggaagatactttgatgggatgtcttcttaattttattataattattcactcatactcataatattattctctgatgaatctctacaaacagacaagaaagtgcgagaaaatgatg

SEQ ID NO: 35445 - DNA, 3000 bp, Unknown
  misc_feature (1)..( 3000): 2750-1469P.txt file - cDNA_ID_3087688; gDNA_ID_2926308; Annot_ID_205929
cattatttcaaaagtacttgagtttgtgagcactgaacaagtatcagtgtattatgaatttttattaggagctaataaacgtcattaaagaggaaacaatattaagttttctgtggtctgacataaataaagactagtattaaatcttgatttgtatagaatgattaatactcgggatactagtgtatctggtctgaagtcccgggaaaaatgtcggtttcactttcctgattttctcgctcattttcccggaaagttatgaagaaaaaaacatcttctttttaacaatttttggagtcttataaacgacaagccaaaaagactggagcttttcgagatatgctcttgagacgtctcaaaggaagatactttgatgggatgtcttcttaattttattataattattcactcatactcataatattattctctgatgaatctctacaaacagacaagaaagtgcgagaaaatgatgggtctctgttctccttctccttcttctcacgattgttcttcatcttctccaaggtaaaccgatgattacattatctctttctgcaatttagtttcgttgaaatcaatttggggcaaataatgtgaaatgggtttggtcacaggaactcggagaagaagcagaatgtgattgttgcatcaccttcaagattctctacctacactaaaccggttagtttcttctgagcaaccaatttcatttctcttttaaaaagcaaaacttttgtggttctaaagtcatatttttcatggcagagtttatcaattgagaagagattacttacttaccaggattctaattgcaacgttacgccaaaggtttgatctttattatagctttgaatgttcatagattcttttggtaacaaatgtactgttagttctaatgttgtgtgttttttgcagtcttcagaagatttgaggaaagaaattgcttcacttgagtttgagattctgcgtacagaacaatatctgctctctctgtataggacagctttcgatgaacaagtttcttctttttctcctcacactgaaacaagcttagtttctaatcagtttttacccaaatccgagcaatcagatgttaccagtgtgttcagctaccattatcaagcttctccggcctctgaatgttcctctttgtgtcctcctcggagtttccaagccagcttaaaagctttgtctgcaagagtaagcaacccccatttgcattttcctcgaacaaaccttgtgatgaatctgacaagaattatacaatgcatttgtaggagaagagtagatatgtttctagtagtcacactactcttggagatcttctgggttctactcttatcgtagataacattgcgaatccgagtaggctctctgaagatatcttaagatgcatatgttctgtatattgtacactctccagcaaagccagaatcaattcttgtcttcaggcttctccttcttcaccttcatctgtctcttccaaagccacttttgatagcttgaactcgcgccatgaggaacgcaaagaagcaaatgtgccaggcgttgttgtaatagaatctctagaacttcacttggatgatggtagtttcaatcacgctgctgttatgctccaaaacttcaggtatataagatacttaaaacagtaacaatttgcttctgtgacattacaattaattaggttggtctaaaatgttactcaattgttgtgtataatagatcactagttcaaaaacttgagaaggttgatccgagtagaatgaaacgcgaagagaagctagcgttttggataaacattcacaatgccctcacaatgcatgtaagcaaacaagaactagtctcttattgattctgtctcttgtataaaagcttcaatctttttcttgattccctctgttgcaggcgtatctagcctacggaactcacaaccgtgccagaaacacctcggttttaaaggttttgatctttacatcttttagactgattgatttattatgtttttgctgttacttaagacactttttatatgtttcaggcagcttatgatgttggaggctatagcgtaaacccttacattatccaaagctcaatcttaggcattcgcccacatttttcacaacctgtatgcaacacacactctctttgtttcttttgcttcactttcactacgtttcataacttgtaactaggaattattgcaaaaacagttgttgcagacattgttttcgccatcaagaaagtcgaaaacttgtaatgtcaaacacatttacgccttggaatatcccgaggcattggctcattttgctctttcttcaggattttctactgatcctccggtaagagaactggctcatgattactatttttaacagattctttcttgaaactcttggattttaatcttttacagttatgttgtttatcaggttcgggtttacacggcagattgcgtattccgggatctaagaaaatccaaagaagagtttataagaaacaatgttcgtatacacaacgagacaaagatattgttgcccaagattgttcattactatgctaaagatatgtcactggaaccatctgccctcatggaaacaacggtgaagtgtttaccggactccacgaagagaacagctcagaaattgttgaagaagaagagcagaaacattgaatattcaccggaaaactcaagtttccgttatgtaatcatccaggaaccaacaacaagaagacatgattctactataatataaagcgaaatataacaacattaaaaaccggcatgtagtttttattttgagaaatgagaggtgaactacatgccgtttatagaaatcaattctaaggcccagaagcaaagtaaaatgagaaaaatgaatggtgatgatggtgaaagtgaaaggccttattgggaggttttggtttggagttggaggtgggattgtgttggccattgttgttgttattattgggcttagaggaacacaaaaagctatg

SEQ ID NO: 35446 - DNA, 3003 bp, Unknown
  misc_feature (1)..( 3003): 2750-1469P.txt file - cDNA_ID_3087691; gDNA_ID_2926308; Annot_ID_205927
ctagcaatttccccaaataaaagaaattcacaagttttgtaacgaattaagaaatgcgtaccgtgaaggaagtggaattaggtttagtaagaagagtggcttgagtaaagttgcagacattgaatgcatctttgtttctgaagatgtagagatcgtatccgtacttatgtctgaaaactaaagtaagatcacatcattaatattaattaagagaagaatttaacaaaaataggaaaataaaaggactggttttgtaattaacacttactaacagagtcgccggtatgaacagtgggggatttccagacagagacaccgtcgacgagaaacgtggcggaaagagaagggcgagagaaaagagagaggaagcaaaagaagtagaagaagagcattgaggtgagatgtttctgagagcaacccatgttttttagcttgaaatgaggagatgcgtaggtttaagggagattctgaaattaaaaagaagtaaagaagcttcaatgatgtctaccctttttatctttagcaggcctctctctcacacatttaggtcaaaagagaggtttagtgtctatggagcttagggagaagagaagaagaaaaaggggtgagagacagagacagagaaagaagtattttgagaagtgtgcagtgagtgtgcagtgagtgtctctgtcttttttactttttatgtgttgaagaaatggagaagattgagaattttgaggactgttttattttattaatttgttccatacctatacttgaaatcaagattggaatttcattttctttgaattatgagtaccagattactaggtacaagtttgcattttacatgacattttgactaatgtaagtctataataagttcttcttggatttattttcctagactacaaaattaggtattgaaaataacatttaatttacaatgttcatggttactaattactttcttggttcaaaactaagaaatggaagacaggtaatagtaatacacagaagagaagtaggcatctctctgcaagtaattttagtaaacggtaaaaaaaggtaccatcatttttatcacgggaaataatgctctggtagtaaaaatctgacgaacaaaagtgtaaccaacaaaaaataacatgtactccaaaaaggaaaagagaaaaagtaacaaagtgagaattatataacaagataatgatggtgattattattcttaaatcattacgcctgtgacttaaccccaacatgtttctgatgatccctactttacaatttagttttataattatgtaggagtagtatcttctatcgtttttgttaattacaaaactttttccatctttaatcaaacgaaaatagaaatactataaccgtaacttttcgactcgatctatatcgacactactttattggctggaagcaattatacacatatctttgttttatgccagaggagtcatcaatgctaatcttatcttttgttaatataatgactgtattattacattaacatttatataacacacacggtcgaattttcttgcccccatataatgttcaaatgatattcgtatcagcaagtaaaataagatattttgctaaaacctacttggttttttattgtcagtatatttccacggtagaagttaaattgtatcgatcaaaatcaataggttccaaacacaactgttgacaaaaccaaacatctgcttgaaaacaaacaaaataacaacattaattaagctcaaggggtttgtctttgcatgattttgtttgtatgttgtgtttgatacttctaagaaagggttttcaaaaaacaattgcagtcttcgaagaatttgtatagcaaataatcggagaaaacaaatggcagcggcacgagcatggtgcaccttttcctttttgtattgaaaaccacacgaaccacacagccttatgtgttacacgtctcgtcgtatttgtgtttagcttttttatgctaaaacgacaactactacatgacaaaacgcgagcttcggccaaacccccaaaaatctcttcccgttgcttttgatggacttcatagtctattaatctttgttaagttggactatataaaagaatagtttacgatactaaatagaggtttctgtaaacttacgtttaaatcaaataggcaaacgataacatggagtaatatatattaggtccacaatggttcaagacttgaagttattgaaaattgacctctcttggcttttatgtttacaagttcaaaacatgcctgccggtttctagccttgagttcaagtttcattaagatgtttatgataataaattctgaacggcataatgtctctgctacctccacagatttacggcacttgttctaacaagttattataaaccaatcaatgtatgattttgtattacaaacgatggtctttcactcttttgtaacagctaacaaatcttatataattagtcttcaactcaattaaatttgacttcttaaagagttaaaatcaatcactgattataaattaggtattgattgaccaattaaacttttagttttgtcacacggagaaaccagaaggtcgagaatataaattaatatctcaaaaattaccaaatgtgacccaaaaacaaaatctttaagataatgaattaacgattagactgaatttttttttgtttgagagaaaaggaatccaagcagagagatgctgacgaaaaaacgcgtggcgaataataatgtacgactggatatttcaaatgaagcgtcaattaaaagggaaaaataataataaaataaaaaaagaggaagaagaaaaaggagcggttgagttgaaatttgctggcgcgtactcgtcaacgtaacgcgcgtggagtgttttcgtgtccctcctcctcctcctcctcctcactaagacaaatattttgaggttctctttctcgtttgtgtgatctgtctgacaagctagaagaatcgtagatcgtgatcggattgatttgataattatg

SEQ ID NO: 35447 - DNA, 3000 bp, Unknown
  misc_feature (1)..( 3000): 2750-1469P.txt file - cDNA_ID_3087695; gDNA_ID_2926308; Annot_ID_205926
tggcgtgcctgtagaaaagagacaaaaaaaaagccaacactcagcagcaaattcgtaattgtctgaatcgatcaagctaactcatagtaaacattaaagaacttctgtccattagacaccattgcaaaactccacacacactgaaagctcttaagaattgagcttacctgtcatcagattcaatctttcacaaaactagggaaactaatcaaatctcgtgggtgggtacccccaaaatcgacacttttcagctaagaactcactgaaaattacaaaactttaaacaaaaaaaaaaacagaaccgtaagaatcagagagattggaaatgaaaccttgatgtaataagctttcttaatctcagcctccgtagcggtggggctaacgccgaggacatcgtaaaactccgtctccttcaccataattatcaaatcaatccgatcacgatctacgattcttctagcttgtcagacagatcacacaaacgagaaagagaacctcaaaatatttgtcttagtgaggaggaggaggaggaggagggacacgaaaacactccacgcgcgttacgttgacgagtacgcgccagcaaatttcaactcaaccgctcctttttcttcttcctctttttttattttattattatttttcccttttaattgacgcttcatttgaaatatccagtcgtacattattattcgccacgcgttttttcgtcagcatctctctgcttggattccttttctctcaaacaaaaaaaaattcagtctaatcgttaattcattatcttaaagattttgtttttgggtcacatttggtaatttttgagatattaatttatattctcgaccttctggtttctccgtgtgacaaaactaaaagtttaattggtcaatcaatacctaatttataatcagtgattgattttaactctttaagaagtcaaatttaattgagttgaagactaattatataagatttgttagctgttacaaaagagtgaaagaccatcgtttgtaatacaaaatcatacattgattggtttataataacttgttagaacaagtgccgtaaatctgtggaggtagcagagacattatgccgttcagaatttattatcataaacatcttaatgaaacttgaactcaaggctagaaaccggcaggcatgttttgaacttgtaaacataaaagccaagagaggtcaattttcaataacttcaagtcttgaaccattgtggacctaatatatattactccatgttatcgtttgcctatttgatttaaacgtaagtttacagaaacctctatttagtatcgtaaactattcttttatatagtccaacttaacaaagattaatagactatgaagtccatcaaaagcaacgggaagagatttttgggggtttggccgaagctcgcgttttgtcatgtagtagttgtcgttttagcataaaaaagctaaacacaaatacgacgagacgtgtaacacataaggctgtgtggttcgtgtggttttcaatacaaaaaggaaaaggtgcaccatgctcgtgccgctgccatttgttttctccgattatttgctatacaaattcttcgaagactgcaattgttttttgaaaaccctttcttagaagtatcaaacacaacatacaaacaaaatcatgcaaagacaaaccccttgagcttaattaatgttgttattttgtttgttttcaagcagatgtttggttttgtcaacagttgtgtttggaacctattgattttgatcgatacaatttaacttctaccgtggaaatatactgacaataaaaaaccaagtaggttttagcaaaatatcttattttacttgctgatacgaatatcatttgaacattatatgggggcaagaaaattcgaccgtgtgtgttatataaatgttaatgtaataatacagtcattatattaacaaaagataagattagcattgatgactcctctggcataaaacaaagatatgtgtataattgcttccagccaataaagtagtgtcgatatagatcgagtcgaaaagttacggttatagtatttctattttcgtttgattaaagatggaaaaagttttgtaattaacaaaaacgatagaagatactactcctacataattataaaactaaattgtaaagtagggatcatcagaaacatgttggggttaagtcacaggcgtaatgatttaagaataataatcaccatcattatcttgttatataattctcactttgttactttttctcttttcctttttggagtacatgttattttttgttggttacacttttgttcgtcagatttttactaccagagcattatttcccgtgataaaaatgatggtacctttttttaccgtttactaaaattacttgcagagagatgcctacttctcttctgtgtattactattacctgtcttccatttcttagttttgaaccaagaaagtaattagtaaccatgaacattgtaaattaaatgttattttcaatacctaattttgtagtctaggaaaataaatccaagaagaacttattatagacttacattagtcaaaatgtcatgtaaaatgcaaacttgtacctagtaatctggtactcataattcaaagaaaatgaaattccaatcttgatttcaagtataggtatggaacaaattaataaaataaaacagtcctcaaaattctcaatcttctccatttcttcaacacataaaaagtaaaaaagacagagacactcactgcacactcactgcacacttctcaaaatacttctttctctgtctctgtctctcacccctttttcttcttctcttctccctaagctccatagacactaaacctctcttttgacctaaatgtgtgagagagaggcctgctaaagataaaaagggtagacatcattgaagcttctttacttctttttaatttcagaatctcccttaaacctacgcatctcctcatttcaagctaaaaaacatg

SEQ ID NO: 35448 - DNA, 3003 bp, Unknown
  misc_feature (1)..( 3003): 2750-1469P.txt file - cDNA_ID_3087699; gDNA_ID_2926308; Annot_ID_205925
tgccgccgcctttccaatggttcttaaagcttccctcgagctcggtgtctttgacactctctacgcggaagcctctcgcaccgactcgttcctttcaccatctgagatagcgagtaagctaccaactacaccccgtaaccctggggctccggtcttgttggaccgcatgcttcgtttactcgctagctattccatggtcaagtgtgagaaggtctccgtaggaaaggagcagagggtctatcgagccgagccaatttgcaggtttttcttgaagaataacattcaggatattggatcccttgcttctcaagtcattgtcaatttcgacagtgtcttccttaatacctggtaattttcacaaatcatctttataacaaatctgtttgtcgtcaatgttagaatccttattattaaatcttactttatctatacgaaaatttcagggcacaattgaaagatgtggtgctagaaggaggagatgcgtttgggcgtgcacatggtggcatgaaactctttgactatatgggtacagatgagagattcagcaagctttttaaccagactggattcacaatcgcggtggtgaagaaggctcttgaagtttaccaaggcttcaaaggtgtgaatgtgttggttgatgtgggaggtggagttggtaacactcttggtgttgttacttctaaatatcccaatattaagggtatcaactttgatctaacttgtgccttggcacaagcacccacttatcccggtgtggagcatgttgccggagatatgtttgtggatgtcccaaccggaaatgctatgatcttgaaagtaagctcaatagaacttattacttatatgttttggaagtgtatacatgctagctagaactttatacttatgtgtttaaatatgtttttacagcgtatacttcatgattggaccgacgaagattgtgtcaagattcttaagaattgttggaaatcactaccacaaaacggtaaagtggttgttatagaattagtcactcctgatgaggcagagaatggtgacatcaacgcaaacattgcctttgacatggacatgttaatgttcacacaatgttccggaggaaaagagagatcaagagctgagtttgaagctttggctgcagcttctggcttctcccattgccagtttgtttgccaagcttatcactgctggattattgagttctgtaaataatatgtctaaaattataattaaaactaaatcctcataattgttaatttcatctgtatttcagttttttgtttgaaatggtcatgcctctctttgtctttcgagcaatatgaaataaaaatcttttctatttttgaattctaccctttaagaaccagtttcaattgattggtcatatgattccttttcaagatttgacgagtcacaagaccagctgctttcatttgcttccttattcatctctcttagttagttgtttgtccctatccacttacatatctctctaataacttttcttcggtaactatctttctagttactaaattgtttcatgttaagtaaattgcaaaggcttgtgagaatcttgctcatgggatatgattgtttatgttatcaatgtaacggacactataatatatttctaatcacccgttgttgaacactggttaatgtactattcgtctctttcactagctaaccccaaccctcctgaagccaccaaaacatgatctcatttattatttctattgcaaattgcaatctgtgtttaggtcaagaaaggctaatccactcggacttgatctaaaataattaatattttgacaaagaaaccttcaacccctaatgatgaaaacattaaaggaaaccctataacaattgagatgggaaacaataaaatatgatattgttcatacacacagattctagataatggaaaagttaatttatgatatgccatcgcaccagtgttgtttcttcccacaataattgcaacgaccaacaaatcgatataatcattcatatcacaaaaatagtgatgctagtaatgtccaaagtgattgtccggttgtggtcaatggaggaatatcgccgttgttgactcagacctactcatacacaatttgagatttctcgatgactgcatacagtaacattcgctcggatactcaattaacctaaggtggtccattatgtgttaaaattttcaaatctcataattataggactaattaaccctatagtatatactgattgagtccagttaatgaagtttgactccaaaaatttgtgaccttcctggaaggaaaattcaagatggggcacactaaggacaattgtgacgttgggtccaaattaaaatatgaaacgtttaaagcgtatttgatatttatcaagtagtataagtttaaagcatatttgatatttcttgccctgtttctttaaactcattcgtcctaatatacgtgtcgctgtatgtatgtataaacttattataatatcacgtcgataaaattgacgagaaaacaaaacaaatgaaaactgccgccaaaaaaagagtatataaataaacagacaattcgcgtgataccatttttctaatgatattaaactgcgaagataagatagactttatgtatgtatctatcaagcgataaaatcaagtgagtctcacctttgaaaattgacttttgctattgaaaaaaaaaaaaacaaacgacgtgaaacattctttagctgtttctttcaaccaaaaaaacaaaaattagctatttcagccggcacaagaggctcttacttttctactagaggcccattaggaccggcatgccaacaatataattaaataaagatggaggaggctaagtcttggctataaaacggagtaagatccatcaaacaatacaacaaaacacacacacactcactctcaatatctagtttttcccttgtttctgatcagtgtgatcacgtagagtgccttgaaggagaagaaagaaacaaaaacaaaggaaaatg

SEQ ID NO: 35449 - DNA, 3003 bp, Unknown
  misc_feature (1)..( 3003): 2750-1469P.txt file - cDNA_ID_3087703; gDNA_ID_2926308; Annot_ID_205924
aaaatatattctttacaagaacaatatttttaaatcttagaaccatcaaacagttatattgtatctaatcggatacgaaatttcttataggtttagacatgatagtacataaaaagtgaactaaaaatttcctagttaatggggttaagcgatccaaacaaaccctttgatctagttcaattaaagtttcataaacttctacacatataaatcataactttaaatttaacactttttatatagtcaaaatttcatacagataattttgtttataatggtcagacaaggactatatccgttcttgactcagacactactcatacacaatttgagatttctcgacgactgcataaagtaacatttggattttggttggagaaaaaatcactcgtcgtgtaaaaaaattaacaacactaattaaccaagaagataagtctcttttggatatattaattattaagattattttaagagtagcaacgatcgatacgatgatataactatttttgctaaatcaaaggttgtgaccgagaaacaaaaaggaacgttgtgactttcctggaacaaacctataaaccaattcaaacaagactaacggccgaaaaggcactggctgcctgaaggggccataatagagacaattgtgatgttacatgaatttggtccaaatctccaaataaacctattttatcacaacggacggctttaaaactattaaagattagcatgttttttcatatattgatgatgatgacaaaaaaaaataagatgtctccaaacttacttgaaagaatttggaattctataaatattcaaaaaaaagttgtgaaaaacaaatttgaaaatagaatatttgatttactgagaatctgagatagaaatagaaaaatgctcaaggtttatatttcgtaagaaattgagatgataattgttagggttaatttaaattaactactgataaaataatttatttaatttttttggtagaaggccttctataaaaataattacgtgaaatattaatgggtatatgcagtagatgaccatgaaatccataatattatacaaactaaccatggacgtatagtacctgtcggaaaccaactttaaattactctcatatccttataatagggttttggttgaggggacaaatagctttataggcaaatagctttactactaaagcttccataacctcctcttcccttacaacaataaccaccactagatctgtaacaccaccgcctcctccgtatttagtattactagatctgtaaacactaccgcctccgtattcaccaccatcatatccataacaccaccgcctcttccgtattcatcactatcgccgtttacttttgttgacatgtatttttattctaaaacattgtatttttcaaagtttcttttaaataatacttgttctttactaaaattacaatgatccgtgtgtctcaattcaaacgatagcatgtaatttttgaataattcatgctatttttttatttgatatgtatattttcctataacgtttgtattttttgataagataatattttttaaagataatgtgcattttactaataatccatgttttctactaaaatcacaagtaagttactgattcatgattcatgttttttttataatcacatgcaaatttgtacaatcacatgtaatctataaataacacatatgtggtttgcttatctctgttgaaaccatttaccatattgtcaaaacaataaacctacgttctaatgtaataaaaataaatagcatgtccttaaatatcttatgcaacacttctatactcaatcacaactgtttctaaatggctatcttttaactaagtttttttttacgtatacatttttaaggtataagagatattgcgtgtgattttaataagtagtggtctaatattgcatgattttttaagaagtagcggtgtaatcattacttcatattgtcttttgttccctacatgtagcagctattgtcggaaagaaagagtttctctcatctgtaaagggtaaaatagttattttgcaggctcaaaaaagttatttacccaacttttctgcacgaacgctattttcttaataatgctgtcaaatttggtcatcctctaatattacccaatattaatctcaaacgtaaaccctttaacaaaaaaaatattaatctcaaacgtatatgaaaaaaccgtaacatgttatttcacccaatcattttctttttatgatacgtcggcgtacagttttgtcattaaaattattttacatgtaaatcttaaaatctcaactatctaacaaatcaactattgttagtcttcggtcttccataaaagaaattgtttgtaaaatttgaaggaaagtgacaaagcaacaacaattgagagaatcaatttccttggcccagtcctggtcgacgtgatcgtcgtatcaagtgatacctatgcgtgactctgagtggccagtggcggatccacgtccctgtgaatggcacccttagaagattttattggttaattaagtaataaatataaatgctcttcaagctgcgacaaaaagatatactaatttagacacttggtcagactaatagagtaatagtgatgaaatattagtgaatctctcctttgaacattgacttttggtatatccactaacgtgaggcaagtttgagctatttcagccgtcaaaaatagctcttaccctttttctacacagagactactaactcagtcagcccccgaggtggaccggcaagccaacaataatttatatgaaaatattataaaataaagagaaatatcaaagcctttaactataaaaggagaaacaaggatgcatcaaaaatatactaactcatcatctcaacactacaaacaagaaacacatactctctctcaattcatatttcctcacttttgatcagtttgatcacgtagagtgccttgaaggagaagaaagaaacaaaaaagaaagagaaatg

SEQ ID NO: 35450 - DNA, 3003 bp, Unknown
  misc_feature (1)..( 3003): 2750-1469P.txt file - cDNA_ID_3087707; gDNA_ID_2926308; Annot_ID_205923
aagcaccttcttatcccggtgtggagcatgttgccggagatatgtttgtggatgtcccaaccggagatgccatgatcttgaaagtaagctcaatagaacttattacttatatgttttggaagtttatacatggtactagaactttatactaattttattatgtttttatagcgtatacttcatgattggaccgatgaagattgtgtcaagattcttaagaattgttggaaatcactaccagaaagcggtaaagtagttgttatagaattagtcactcctgatgaggcagagaatggagacatcaacgcaaacattgcctttgacatggacatgttaatgttcacacaatgttccggaggaaaagagagatcaagagctgagtttgaagctttggctgcagcttctggctttacccattgcaagttcgtttgccaagcttatcactgctggattattgagttctgtaaataaaatgtgtgaaatgtaaaacaaaatcgtcgttaattatatatttccatctttgttgccattctttcttgatatctttgtcttcgagtaataaaagtgttttaatatgtcatattgtctcttagaactagttttattcactcagacgaagttattcaccaacaacttacaaagtcacaagtgcatattcattgcccaatggtcggctgctttctcttcatgacttcattacctattgtatccctagcagaaaatatgactacctctctaacttatactgtaattgcaaaggtaaaagctagagagaaactttatcttggaaattttcataggaaataagatttttacaagtcaatggatttcttatcaaaaaaaaaaaaaaaaaaaagtcaatggatttagtcaaagttcaaagtatatatagattcgacttaatttcatcactattgatagaagttatttattgtaacaaaaaaaaaaagatacaggattcttatccactttttactcttgtaaacgtaacaacggctgtcatgtttaaaagcttttaaatatataaagctatatttcagttgaaaagaaagaggcaaatatgccaaaaagctaaattgtagtgatattatactgtttaatctttacagaaacaatattttttattccagaaccatcaaactgtcggactgtatctaatcggatacgaaattcttattgtttttttgttgttaaagacgaaatttcttgtaagttttagacagcaaagtacctaaaaagtcaactaaacttactaattaatgtgggttactcgatccaaacaaaccctttgatctagttcaattaagttttgtaaactcttacacatataaactcttaattttagttttagaaatatatatattatatagtcgtatttcataaagataatatatattgtttataatggtcagacaaggactatatattaaccgttcttgacttagacctactcattacatacacaagatttctcggcgactgcatagagtaacatttggattttggttaagtgaaaaaaacgtcactcgtcgtgtaaaagaattaatacagtaattaaccaggaagataagtctcttttggatgtatactaattattaagaactatttttaataagagtagcaaggatagtattaaataattataatatatgtgagtctactgaaattgataattactaaaattttgctaaattaaactttgtgactttcctggaatcaaaccgacgatgaacaaattcaaaatagactaacggccgaaaagggactggctgcggagcccataatgaagacaattgtgatgttacgtgaatttggtccaaatctccaaataaaccaactttatcaaaatggacgcctttaaaagaagatcaacaagttttttttaattaaatatgtgattaaattttgaaagaaataggaattctataaatatccaagaaaaaaaaatcatatttgattactgaaaaataaatgataaatattctatttgccttggttggagcacaaatgatgtattattcacttcgatacaaatttataaattacgtcgacgtacttgtcctcgatgtgaggagatacaaaaatgctcaaggcaatgatttatagtacttcattgaaaaattgagatgataattgttagggttatttattagatgaaaaaatctcgaggttaatttataaaataattacgttaaatattgattgaaaacttattttcattaaaaaaacatgttattttatcgataattttcaaattatccaattttcaaaatcttcaaattttcaaattttaactatctaacaaaacaactctaatttttagtagtctttccataaaagaaattgttcgtaaaaatttgaaggaaatgccaaaagcaacaataatagagagaatcattctccttggcccagtccttggtcgtcgtatcaagtgataccaatgcgtgactctgagtggcacccttataagaaattaatcttcatatctatcaagaaagacaaaaacatttaaaatacataaaatttcgattttattggatagtttagttatctatcaaactgagacaaaaagatatactaatttagatacttggtcagactaatagagtaatagtgatgaaatattagtgaatctctccgttgaacattgactttttggtatatccactaacgtgaaacaagtttgagctgtttcagccgcaaaaaatagctcttacctttctaaacagagacgactcagtcagcccccgagatggaccggcaagccaacaataatatatacgtgaaaataattttaaaataaataaaataaagagagaaatatcaaagcctttaactataaaaggagaaacaaggatgcatcaaaaatatactaactcatcatctcaacactacaaaaaagaaacaaatactctctctcgatacatatttcctcactttgatcagtttgatcacgtagagtgccttgaaggagaagaaagtaacaaaaaagaaagagaaatg

SEQ ID NO: 35451 - DNA, 3003 bp, Unknown
  misc_feature (1)..( 3003): 2750-1469P.txt file - cDNA_ID_3087711; gDNA_ID_2926308; Annot_ID_205922
gtggttggtagttacattttttagaagaaacgtaacttggaataatatatcaaaagctttctcaaagtgtcaaattttgtctttttttcttttacataacttgaaacaaatcagtagcgtatatgtcatatttattttatcctatccccttaattttagaacacgtaaactgtgaaagcatttttctagtaaataaaaatgaaacaacaatctcattcttttactttctgtttatttttgttggttaattataccttttttctcgacaaagaaacaatcccaaaacagaaggggggcgaatcaatcacacatagtgtttggatctctggattttcttagagtttgaccaaaagtgatcaacggataatctatttattgataagacactgttatattttggaattgtttgataagtgtaatcatattctacatcttcttttcattgaatttaataagagggattcattaattaggaagaaaaaataggtcaaaaaacatggattagttaatacagctccttgttgataaacggacacataatggacgattaaaatatgaaatagtagaatccaactatcttatatatgaaggggatcaaaattgaatcagatacttttcacactatagattctttgatccagcgcaattagagccgtatacaagtgaaaatcataaacaacaaattaatagtagataatgaacacattacacataaaagctagggttttttttggttatataaataaaaaaaaataaattttttgatggattggtgaattggaaagcacttagagatagatttatggtgagataaaataatagagagagatcataataatattaaagaaagagggacgagtgtggtttccacacgaatagcaccacatttcaccatcatcgtcacttgtttgcacacacactaacacacatacgtagacatctacgtattatgtttcttcatgtatatgcatgcatacgtagtcgcctacgtacatatatgccagcacattattaacattccagaatttacaatttatatagcgcatactaactataaggtaattctttttggttttttttccctatgattcacacactgcattcatataatggacagtccgaaataaatagacaatgaagacattagtcgaaattactaaaccgcttacgaattatgatcacgtatgttttcatgaattcaaagtgattgatttataattcgaatgttggagtacatgttataatgtctccaatatttttcaagcattgtatatattattactattagtagtatacactatagaatttgtagagcggcttgatcaaaagcaaaattcattaatttattatttaaatttgaaaatattgatcctaaatcaaaataatgcatggtaacatatatgttaattgtatattccttattatctccctatatatgtagtgaaaagtatgttattgtgccttttataatgataatgatggatatagacatgcatatggatttcaactttactattgtggtccaagtcctagtcctactgatcatgaaacgctaaatatcatgtaaactcggtatactttcagttattaacagttgaatacgacacgtaattttgctatgtcgatggtgaatctgtgcgtagcggtagcttagatgagactcgaatatataaattttgtagggcttgaaaataaagagttttgtgcaaatatttttaaaatgaaagccacaattcttgtctacgtaagtatatcaacaaaaaaaaaagaaatacaattctgataaatatatatcaacaaaaaaaaatgtttataatcaacataaaactttcaattcttgtctaaataaagttaagatagcagaaattttgaaacttaactgggccaagcataaatgggcttaacatgatgtggattaatgataaatgggcataacgtaacagaccaatgaagtatatgttaatccaacgacccgtttgcggtgtggtataattatggtcgcatatcttttggaaatataaaaataagtagagatagataagtggacaggtgttcattgtccgttctgatccaaaataagttcgtgtcttcgtggaactgaatctttatgaagagtttgccttggcatgggacaatgcttctccaatctgaaatagacaggtctttgtcgtcttggagctgtcttcactcttggccgagacacttgcgcagtcaagatggacacaccagaattaatatccacacctactaatatctttgtatgaatataattaccaaatcatttatgtaaagagatttcggactctctatgtcgatagaaattgtttattccggaaagtctttgagaggctcaaaaccaaaaaatgtttttgaacttatgattattttttgggggtatctgaaaaactaaatgatatgagaactgcaaatcttgtttcaaatagtaagtggatttacgaaaaaggtgaaaaattcaacaatagaggttcaatttaatttcttcactattagacggacaaagtgaatatataaatatatcttgatgtacatatcatttttgtgacattattgatatgtacatgaagatatatttatatattcaattggtccgacttggtccgtctaatagtgaggaaattaaatcaaatctctgctttgaattttgacttaaatatcgtctttacttcaaacagaattttagcagccacctcttacttttctacggtacattacatagagactattcagcaaccaagctggaccggcaacgctagccacaatgatttatgtgaaaattttataaagaaaaggaagaaatatctaagctttagctataaaaggagaaacaaggatatacatcaaaaacatactaaatcatcaacactacaaagaagaaacacactatctctctctctctctcaatacatctttcctcacttctgatcagtgtgatcacgtagagtgccttgaaggagaagaaagaaacaaaaagaaataaaaatg

SEQ ID NO: 35452 - DNA, 3000 bp, Unknown
  misc_feature (1)..( 3000): 2750-1469P.txt file - cDNA_ID_3087715; gDNA_ID_2926308; Annot_ID_205921
atgcgaccataattataccacaccgcaaacgggtcgttggattaacatatacttcattggtctgttacgttatgcccatttatcattaatccacatcatgttaagcccatttatgcttggcccagttaagtttcaaaatttctgctatcttaactttatttagacaagaattgaaagttttatgttgattataaacatttttttttgttgatatatatttatcagaattgtatttcttttttttttgttgatatacttacgtagacaagaattgtggctttcattttaaaaatatttgcacaaaactctttattttcaagccctacaaaatttatatattcgagtctcatctaagctaccgctacgcacagattcaccatcgacatagcaaaattacgtgtcgtattcaactgttaataactgaaagtataccgagtttacatgatatttagcgtttcatgatcagtaggactaggacttggaccacaatagtaaagttgaaatccatatgcatgtctatatccatcattatcattataaaaggcacaataacatacttttcactacatatatagggagataataaggaatatacaattaacatatatgttaccatgcattattttgatttaggatcaatattttcaaatttaaataataaattaatgaattttgcttttgatcaagccgctctacaaattctatagtgtatactactaatagtaataatatatacaatgcttgaaaaatattggagacattataacatgtactccaacattcgaattataaatcaatcactttgaattcatgaaaacatacgtgatcataattcgtaagcggtttagtaatttcgactaatgtcttcattgtctatttatttcggactgtccattatatgaatgcagtgtgtgaatcatagggaaaaaaaaccaaaaagaattaccttatagttagtatgcgctatataaattgtaaattctggaatgttaataatgtgctggcatatatgtacgtaggcgactacgtatgcatgcatatacatgaagaaacataatacgtagatgtctacgtatgtgtgttagtgtgtgtgcaaacaagtgacgatgatggtgaaatgtggtgctattcgtgtggaaaccacactcgtccctctttctttaatattattatgatctctctctattattttatctcaccataaatctatctctaagtgctttccaattcaccaatccatcaaaaaatttatttttttttatttatataaccaaaaaaaaccctagcttttatgtgtaatgtgttcattatctactattaatttgttgtttatgattttcacttgtatacggctctaattgcgctggatcaaagaatctatagtgtgaaaagtatctgattcaattttgatccccttcatatataagatagttggattctactatttcatattttaatcgtccattatgtgtccgtttatcaacaaggagctgtattaactaatccatgttttttgacctattttttcttcctaattaatgaatccctcttattaaattcaatgaaaagaagatgtagaatatgattacacttatcaaacaattccaaaatataacagtgtcttatcaataaatagattatccgttgatcacttttggtcaaactctaagaaaatccagagatccaaacactatgtgtgattgattcgccccccttctgttttgggattgtttctttgtcgagaaaaaaggtataattaaccaacaaaaataaacagaaagtaaaagaatgagattgttgtttcatttttatttactagaaaaatgctttcacagtttacgtgttctaaaattaaggggataggataaaataaatatgacatatacgctactgatttgtttcaagttatgtaaaagaaaaaaagacaaaatttgacactttgagaaagcttttgatatattattccaagttacgtttcttctaaaaaatgtaactaccaaccacactccgatcaaaaagttcattttttcaaagaaaaatacaatgtacatgaatacgaagacgttcctgaagatttcttttcccaattgattattcaagaaagtagattaaagcatttgccaaatttgaatatggtgttctctagtcaatatagtagtacagctgccaaaaggaatgttaatttggtaacttggtaataaaagtaaaaccaagaaaactaaagtattatatgtttataataaacttttggccaacacatttcgtgtaacattaggtaatcgtttgggaggttgagatttcatttttatatattaattttgtataattttttgccaagaagacatatatgcatattatggctttgatcttgacgacgacttaacaactccatagtgtaagtatgtaactgcatgcccctttcggtctctcaaattgatatttgttttttgtccttcacgaatcaaatgaaatgaaaaagacacataaatgtatactttcacatttcctttcttcttatatttgattatttgtaactttttttttgaaaagtattaagttccttttgaatttaattcaattgagatccatttttgggggtacagttataccaatcgttgtgctttatctttaccgatggtacgcggcaatcaacttttttttttttccttctaaagttcatttgttcgtttcaaacttataatcatagtgtaaaaacgattagatgtttgttaattcgatttcctaatctaaatttttgaaaaagacagaataaaaagtatttccgttagtggtgatgatgctccccatatattaatcgtcgactccaccacataaattattttaaaaagttaaataaaaaaagctaaaaactcacacaatctctccataaatagaacctaggcgtgtgttctccacacttcacctatattctctaccttcttatttcagcacaaaccaaaaacataaagacagaaagccaacccaaaagactttaccatg

SEQ ID NO: 35453 - DNA, 3003 bp, Unknown
  misc_feature (1)..( 3003): 2750-1469P.txt file - cDNA_ID_3087719; gDNA_ID_2926308; Annot_ID_205920
gctccagttccagcaaaagcctcacagtgttttccagctaaattaagcaaaaacaaatagcattaagcagaggaaaagaatggggagacaagatacatgaatgtttattataaacattaacttgtgactcatagtcttacaaaagggaagcatgaaaacttcaatcattctacacttgggaactgatgatgatattataacaaaagaaacaggatcccaaacatattacaatgatggaatgttcattcattccattagtaatccacattagaatagaagtggtaatagtgaacttacactcgtaaaatctattttcggatcttccatagacctgtaaagggtgcctttaaactcctgcatcactttctcaacctcctcgagtacgcgcttgagtaaatttacctgtaaccaaagtgttactctatgctttcaagagctttgtaatgcaagtgaataatatggtaacaaacaagcgaatactaggagaaacatgagtgctatctgtctgaagagttggataatcgggcatgcatacatgagaagggagagcaatagacttcgccttcttgtattcccgaacagccaaatcatactcgcctttgctaatactactacgaattatactgggtaaattgaagagtgtacggaatctctgaagcattccttgtacagacctgatcttctcagcttgggcctatgaataatggtgaaaacagtctaagcagatagcaagaggctaggaaaacaccaaaaaaacaatagtacgtgaccatacaaacctgtctctcaaaaagtggctcaaaagcacgattagcccgtgatgtcacactcttcatacaattaaacaaatgagtagttcccgatccgtctgggtcgtcttcaatccgtttcagttttgattcaatatctgtaaagaaaggcagtaatgttcacatcaacaagagagaagagtaaagttcaaaatagataattgagtgtaataatgcataccatcaattgttgttttacacgagacaaagcagtcaaaattatctttcaccaattgtttcctttgtagattacggccctttaagtcacttttcagggcaagggccccagattctaagtctgctgcacttgtctcttggtgaatgcgagaaataaatagcttgggatcgaaatggtcagaggtgtacaccaacttttctgcaaattctcagaccagttaaagttagaaaaccggaagttgtacatcgagtaatcccgcataaagttcaaatcaaactccaaattccaagtatggtcatgaagaaatacatacccctaagtgcattatccactttctcagcttttgaaagactttcagatgactcagtgattaatctcagtgtcttgttatctattatcctacaaggtacacaaaagccatatttagataccccctaacatacagtgttccccgagatagactaaggtattcgaatgacggtagaggtgagcagcacaaacgagaggaagtaccccaattttagcggatcaatgcattccatgccacgagggaatgattgcaaactggtaagaaccactttcttgtcagctccagatacctttctatcaaggttctgagtcacggatggtgctgttctcgactcccgcatatcacgaaccttgcgtgcaagctgccaaatgtcattagcatttcagtaaaaatgttcatatttccaactaaatttttcgtcatgccatgattctaaaataactaatggccttgagctgaggtcttctacacctcaattccatgaacagataattaaaggccatacaactaatatcacatatacgaattgattcaatttcaaatcttcaaatcgatcaaagaagcaaagattacttaagactacttcaaatcaaaacaatgcaattgaaattcgtaggtcgaaattgcacacataatctctccaaaatcaatttaaagccagataaatccaaacatgatagaaaccgtacctcagcttcattaacccgtttccagcaatctggctccactccatcccaagctctatcatcttccttccgcgctcgtcctctctccttaccacttccacctcttcctctacctccgccaccgtcaccaccaccacctcttccccgatcatttccctcatcttcatccccgctcgaaatgctaagcaattccacctccgattcatcatcctcatccatcgatggcttccttgacgccttcgcacctcccttagacggaggagctgccgccctcttttgtctccgtggctgctgcactaaattggtgactggcttacgggaattagcggaaggaggcttctgataggtaacatctctctgagattgctccttcaacgccatttgaagtagctcatcttcatctaaatcatcactgctagacattgttatctctgacttagatgatcgtctttgtcttcctcccttgagctaatcgcagagatctgtgcagttcttatttgaatttagttttgtgactttttcctttgaagaatttttcttctgttttcgactttttccaatttccatgtattaatgaaataaaaactggagactcacaaaacgcagtcgttgattattttaacctaaaagttataaattctccttactcaagctttcttcttcgatcgaaatttataaatacgacgcgacaaacctgaattgcgttcagaaaccctaaagctctcaaatatatctctgcaacgaaaagaaatcacctgcttactcttctcctgaaagacctgatcttctccggtgaattgttttttgttccgtcaatcttccgagtttgtttttgcctaatatgaagttaaacccattacagaaaaaggtaatcttctctatcgctctgaacattgtagttgattttgttgatttattgttgttgtttctagagttaatgatcggataccttattgtatgttttgttttcggtattgggggttaatcacaggctatattcatatttgatttctatcaatg

SEQ ID NO: 35454 - DNA, 1249 bp, Unknown
  misc_feature (1)..( 1249): 2750-1469P.txt file - cDNA_ID_3087727; gDNA_ID_2926121; Annot_ID_196692
tgaaaatttataaaagtgcaggaggaccagttattttttatctccccgtttgttgcgcaggttagatgttattgataggtgtttctcaaggagaacagtcgaagaaattatatctgcacttgtaagcttttcatttatatatagagatgttgacttgcgatcctgagttgactgatttacctttgacaacgcactctaccatcatatgtgttgcttaggagagagaggccactcaagaagcagatggttggatctcagctaccattcaagcattgaagaagggttcaccagcaagccttaaaatctctcttagatcggttagttcccagaatgtgcatcacaggcaatgttgacaaagagctgactgtgagtatatatttcagataagggaagggcgattgcagggggtggggcagtgtcttatccgcgagtatagaatggtgtgtcatgtgatgaagggagaaatcagcaaagattttgtggaggttttgcaagctttttccatctgaaaccgtctttgttgtagaccgtagttacaacagcgtgtctttacttatgcaggggtgcagagccatattggtagacaaagataagaacccaaaggtttaacaagtctctccatttgttatttgtggttggtaatatgtgacattgttgataacaatatctgaaattatagtgggagccaaggcgactggaggacatgaaggatagcatggtggagcagtacttcgagagagtggaacgggaggatgatctaaagcttccgccaaggaataacttgcctgctttagggatcgcaaagctgtgaagtggagaaggtgatggagcactattgtttacgtctgtgggaaagaaaaaagaaaataaatgtaacaacacttgtgttgaataggacttgcatacattacataaatcattattgtatttgagaattgacaccaaagcagcagagcagaattgtgttaagatttgttaatggtgttggaggcacaaccatggcaaacggacgtggaagcacgtctatagtcattgttcatttatttgattgagattcctccttggtctcatcttctgaaaacgaaaaataattagaaaatcaggtgaatcgtgaagtattgaatgagaagaggcaattaaaaatctcccgtgactctcgtctccccatctctctctctccctctgcccaaatttctggggcaaatttgttcatcagatctactacaatctctctttttcttcgggtatg

SEQ ID NO: 35455 - DNA, 1249 bp, Unknown; identical to SEQ ID NO: 35454
  misc_feature (1)..( 1249): 2750-1469P.txt file - cDNA_ID_3087727; gDNA_ID_2926121; Annot_ID_138620

SEQ ID NO: 35456 - DNA, 595 bp, Unknown; identical to SEQ ID NO: 15279
  misc_feature (1)..( 595): 2750-1469P.txt file - cDNA_ID_3087735; gDNA_ID_2926122; Annot_ID_196695

SEQ ID NO: 35457 - DNA, 595 bp, Unknown; identical to SEQ ID NO: 15279
  misc_feature (1)..( 595): 2750-1469P.txt file - cDNA_ID_3087735; gDNA_ID_2926122; Annot_ID_138621

SEQ ID NO: 35458 - DNA, 3003 bp, Unknown
  misc_feature (1)..( 3003): 2750-1469P.txt file - cDNA_ID_3087743; gDNA_ID_2926123; Annot_ID_196702
ccaattgtttatagattatctgtatacacaattacacactctactaatcaatgtactttagcatagaataatacttttacttctactaagcttgtttcactaattataatgtttagttagagataaaaccattgaaaaatctcaaaaagtaataatcaatataaacaaatagagagagcaatgataataataagatatataggtcatagtcttgtcaatcatgttaatgataaaaacgacaaggctacaaaagtagtagtagaagtagaagaagaagatgatgatagtgaagacaaacttgtgtcataagtggtcttacacaaatccgtcttggaaactggtgtttgcctaatggccctgctgggcttttgcttcagtcattaccgaatcctcttgtattggcagctttaatcccaaatctattcaactcatgcaatgattttggacgaagaaacttctcaatcccaaatgacccttacttcacctttcactttttgttccatcgtaaagatttgaaactttttagatcttatgaaaaggcaccacatcttcatcaagtattttctttaaaatgtaggggaaaaaaaaatctagttcttttgttcatagtcaacctggaccagtaggtcgttgggccttgggtcttcagtcacgtcggcaatcaacattcacttacccatttgaaacattggatcagcgtgaccaatgccaacccattaatctaaatggtttaaacaatcaagcgtgcaaggataaatgcattggacttgagagaacaagatatggaatttgaaatgttgccttaccagttaacaagtgtctctgtttcctcccaagttaatgtaccaaaactctttggtgcttaattgtgggggcttttataatattgggtacattttgggccataaattagagaaagagcacattatgattgagtttatgaagataggcagtttttgggaaataaattgacgaaattgcccctgcgatttcactcattctcctaaattgtttttgcagaatcttttcctgaattgtttttgcagagcctcatattggatcgattcctaacttgtttcaatggatgatgtattaagtacagagattgattatcctatttctctacttaatcaatgtttctttctacaagacaatatatacacaaaagatgtatttacggaaacaaaatcgatagagacaaaaattagaaaatctgttaataacatttcatcaccatccaattcagataaaccccaataaaatcagttaaaagctttttgatggaagaaagctaacccctaagaaaatattatataacgaacccaaatatactaatcttaaataattggaatcgattaaaattttcaattatttcttatccctctttgaaattgaagaaagagaggatgaaattaattcagatcaaacaattcaaattcaaaaaagctatggaggattaccacctgcatcgtcgaggaagaagattggccaggcatagactgaattttgtaaggtgatggagagcaatggacatcaatggtgagtttagaggcaatagattccatgccattagagaaagagaaagagagagaaataatcgcacatttctgagatcgattgatattgatgaattctcctcaattagattgaaggtacaaggagaagaaactcaattagattgaaggataaaacagtcatccatataatataaaagtatctaaatttgtaaggaacatgagatgttcctatatctacaaaagcacagactttaatatgctaatcccataattgatcccttaattgtgtgtgtattcaaaataagcccacttcttataggcaatgtaacacttgactcaaaagccaaagcagccacttaaatagttaagttacattaaacagagaagcagccttccctaagttaagcattcttaatctaaccaaatataattcatatctaacaatgttaacttctctttctattcttaataataacctaacaaattaacttgggtggtgtactattctgagtttgttacttgtcttgtccatgcacggctagctgtggtgctgtcttagaagggcttgaaggtacgtggctgttgatacagaaaatgtttaaagaggagacaagtctttgtcaaagtttgcggatgacggctatgaaatcgaaaacgaattttctttcagtttttcttaaaaatttttttttaccttaaaacaataagttaaataaataaaattaaatcggatttatcttctcggtcgtccgaaaatggcagagttgaatccaagaagttttgtgtgggagttgaggtgggaactacgaaattaaatataatctatgcgctattttacaaatttgttagtccaaatccactatgttgctaatatttaattacatgtttagatcctaattagtttgatgattatataatcaataccaaagaaagtgaagaaataacctaatttatcaacttgccagctagtgaagtagctccttggaggtttcagtaaaaaaataataaaagtcgataaaaaaatactacccaacttcatggtttattattaaatgcgatgtggtcgagacaaagtaccacttgagtaccgtactaggatatgctcaacatatttaaaattttgaccaagtcaaattaaccagccagagatgttaacagttaatgtagtagccaccggtccaatgaaattgcaaatgaacaaacgtagcacctgaaaactcgccaccgatcacgatcagcacacttttatgaattggtcaagatattatcttctatcattagatgaatacttgcatgttagtattctctactatcagacggtgtgtatttttttatttatagggttgaacgctttattgtcccatgcacacgtaaaagtcgacctccccatcattttttcactataaatagtggttgatttcaagcagatttcttcaaactaaaacatatatacatcgaaaacaactaagtataaacaatagtcatg

SEQ ID NO: 35459 - DNA, 3003 bp, Unknown; identical to SEQ ID NO: 35458
  misc_feature (1)..( 3003): 2750-1469P.txt file - cDNA_ID_3087743; gDNA_ID_2926123; Annot_ID_138626

SEQ ID NO: 35460 - DNA, 3003 bp, Unknown
  misc_feature (1)..( 3003): 2750-1469P.txt file - cDNA_ID_3087747; gDNA_ID_2926123; Annot_ID_196699
aaaaacagaggataaaaaacgaacaaacggttaaagctggcaaagatcccatcttccccacgctgtcaaattttgtcactacttcccaaaaaaaactctcccgcctctctctctccctctcccttcttattctcctccttcttctccttcaccatctccagatcccaaaatcttcatcgatcatcatcatcatgagagaaatcctccacgtccaaggcggccaatgcggtaaccaaatcggttccaaattctgggaagttatctgcgacgaacacggcgttgatcccaccggacgttacaacggtgattccgccgatcttcagctcgaacgtatcaatgtttattacaatgaagcttctggtggtcgttacgttcctcgtgctgttctcatggatctcgagcctggtactatggatagtatcagatctggtccctacggtcagattttccgtcctgataacttcgtctttggtcaatccggtgccggaaataattgggcgaaaggtcattatactgaaggtgctgaacttattgatgctgttctcgatgttgttcgtaaggaagctgagaactgtgattgccttcaaggtatatatatgaatcgatttctcccttttgatttatgaatctgctggtgctttgatcatattatctgattgatttgtgaatcaaaactgcaattatccgatggtttcgatcatttaaatctcgtctcgtgagtgttaatgtagttgcatatttagtaaccgatgatttcgatttcagtttgatttttgatcatcttcgcattgcactagtgaatctctcacatatcgtgttttgatatttgattaacgtttctcttcattgatctcttcatggtcatggttccaattacagtttatgaattacatgaacatgatccgtcgatgttcttgtgtttgatttgcgtttttatggtgtttctctcctgttgattactgtttaagagtgagctgttaacacttaatgattggctaggatttagattttgtctattctttatagtaaaaagttaacatcattgaaactaaggacaatatcctaatttggcggtagtgtattagtgtcccctaatgttttgttccagatttgtgactgtggatcaacaatatcacgtgaaaccttaaaaccatatcgaattttataataagaactttagggaatactcttgtgttgacactttcgaggtgaaacatatcactttgtggggatataattgaataagcaagtgggtcatgattggtttcagcaattgttaaataacatctcaatactttttggatctggtttaggtataagggacttctttagttttgtagtacattgtttcacacttgttcttaacatttctgtattacagggtttcaagtatgtcactctcttggaggaggcacgggttcaggaatgggaactctcttgatatcaaagatccgtgaggaatacccagacagaatgatgctcacattctctgttttcccatctccaaaggtctcagacacagtcgttgagccgtacaatgcaactctctcagtccaccaacttgtagagaatgctgatgaatgcatggtcctcgacaacgaagctctttacgatatctgtttccgcactctcaaactcagcactcctagctgtaagtaccatcaaaaccttaatgtttgttactttgttttcttggttcctaaattctaagagttcatatatatatatacattttgcagttggagacttgaaccacttgatctccgcaactatgagtggtgtgacttgctctttaagattccctggacaactcaactctgaccttaggaaactcgccgtgaaccttatcccattccctcgtctacatttcttcatggttggtttcgcccctctcacttcccgtggctctcaacagtacatctctctcacagtcccggagctgacacagcaaatgtgggacgctaagaacatgatgtgtgcagctgatccacgccacggacgttacctcacagcttcagccatgttccgaggaaaaatgagcacaaaggaagtggacgaacagatcctaaatgtccagaacaagaactcatcctactttgttgaatggatcccaaacaatgtgaagtccagcgtctgcgacattccaccaactggaatcaaaatggcttccacgtttgtcggaaactcgacttcgatccaggaaatgttcaggagagtaagcgaacagttcacggctatgttcaggcgtaaagctttcttgcattggtacacaggagaaggaatggacgagatggagttcactgaagcagagagcaacatgaatgatctggtctctgaataccaacaataccaagatgctaccgctgatgaagaagacgaatatgatgaagaagaagaacaagtttacgaatcttgatcttacaacacaaaccaaaagatgaaaaaacacagaagtcacatctctatctcttttattgaaatctctattcctactattaccactatatatatatatacatgtatcaagttgaagaatctgggaaatgtgtttgtttgtttgttactttatctttgtggttctctcttattgtattttgcaacttagtttcttctcattgcctttataataaagagtctgtccacgtatctccctctttagcctttatttcatagtattcaaaaaaacgattcttagaatcctttcagtttatagtatagacaaccaaaacattggaaacttggttgcatattcgttacaaaatcctgctatttctgctatataattatcaccccaaaaaaaggtttatcaaaaactacttaaattgataagaagagatgaatctattaaaaagcttctactataaagcacacatcttcttcttcatctctctttcgctctcagaatcctcttttaagtctctgtttcataaataaaactaataaagaagaagaagaaaacagagcaattaaagtccttaaatcttcttcttctccaattcaatg

SEQ ID NO: 35461 - DNA, 3003 bp, Unknown
  misc_feature (1)..( 3003): 2750-1469P.txt file - cDNA_ID_3087755; gDNA_ID_2926124; Annot_ID_196709
ttgtagcaagtttgttgaaggcggcgtgaactctctcttctgtgaacagtctatggttttcataggaatctaatatctccattgcaatattcttaacctgccaatatgttcacacattccgatgaccaactaagcaagaccatgccttctagtaacaacagagataacagtgcatggacttacaatgttcatgtcgacagaaagctcttcaaaccatgtctttatatctttctctttgtgtacagaagcaatgtaaatgcaagcgagtgtgatgagaaacggcggatgtattaggatgaggtccattctgtatatgtcgttgacaagacccctacagtttccacacaaaactttaagcatcaagagagcatttacttttttgcctgcaaatcaaaacctgtttagctctcttccaatttcagatttactgtgttgacttattgattacaacaacacttgatcaagaagcttaatgaaggacaaaagttttggacacttaccaagttaaatgggtcatactagtgtcattgattccagaattctgcaagaacctgtaagtaatgcaagaaggataattaaaacgaaacacatagtatagtcgcaaaaaacatttcgacatcgacatatgagatcctaagcaaacaacttactcaggcagggatcggtatgggtggaatacaacaagatagaagttcaatgcttccaaaaccttcatctccatttcccgaatatctttaatctcatatctaaacttttcatgaaactcagacaaaaaaaactcaacaaagtttgggaagcagaaaacaaaaaagaatttacaaagttttttcatgtagaagacaagaagtttggcatgcaccactctctcttctgccttgcaagccaaatacaagcatgtaggagcaacaagccgaggctcatattccgtcaaactctttctgccaaaacacagtacccataaatcaaatgaccaagcctcgtgctacacaacgattaccgaagaagccataccttgtgtaaacaagacgcatatacgttactgcagttgcaacaactctgaatcatttttattcaaaaaaaaaaaaaaaaactctgaatcatagaagtgctaaatcagtgagccttgttcaaattgccaatgcctaatcttaatatgtttagatatatccgaaatcgaacaacaacaagaccatgaatatgaattaatatcacatacatcaaaactaaaactaagaaaaactaacaaaaaaatggagactggttattgttccatttattagacctcagcttaagaaagtcaaagagcttaaactaagatttaaaacaattataagagataattgatggacacgtgagagtgaaaaggcaatcaaaagtcttctccacactttttttttttttttgattttgtaacagcttttaatttcttgtttacagatgagatttaccaacctcaattaggttccatgtcttcgtgtttggtgaggttagattggttttacaactaaatgggagagaacaaatttggtgttggctactccaatgatcaatgtagtgaaggtgttcgatgaaatgactaatagagactttggggaaattacttcacctgaagtgtgttcatttcatagaagagctagtgaggaaagaatctttgttgacttgatactgaattctagaagcgattatgttaccaagcgttgttgccaaggatgctactgatgatttgagtgagtaaagatcttcctgcaggctgcagctttactaaagctgttgaagaaaagatacacagtgacgtggtggtcttgtctcttaatggctttctcttccggctgaaacggtatcctctgatttccttttgatttgtatgtaatcatctgtatataatatatatagcttattaaccgatcaatatgttgctattttgccctgcttgctaactgctgtagtagacagttcatgtggtgttgtaataccctcttatgataattttgttaagagtatttataagctcgtggaatcctgatcaaggattgtttatgttcagttcaagtttgattttgcaaacaccaggtttcaactatgttttctgattacaaccccactaaactgtattcaagtttcgtgtgcatatatataatataagcctctcttgaaaatttagcctctgaagttaacaagctacacatgtaatttttgcagagttgaagcagcagtgcgaatgagctggaggatccaataggcaatgataggattgagtcatcagttcaagttacatttttgcaaacaggtttcaactatgtccttcaatacaatccgctaataattttcaacagtgcatggttttgtgctcttgaaaatttagcctctgaagttagcaagttttattgactgggggatcgaataggcaatgatagcaagaaaaattgttaccagaaataatcctcttttctttctaagctcacgatgcagattagcaatcacgacaacgagttggcctgaaccaaagaacatagctgattttagaggtgatgtttcttgagattaacaggttatgggaagaagatgcctgggagtgaataaaaggagtgtgtccgcggaaaagaggtgagatattatggtacatacatcaagtaattattttttgaatttcattagtgatgtaaaaaagagagatatgaaacccagtggtcacaaattacttttgttccttatcatgaaaatggatatgttgatgcagaattgcagatggtgttggcctgacagttgtagacaagttgaaataatttaatagtatctaacctataaaatcacttttatttaatcaaaatgaattactatatatcttttctttaatcaaaaccctcagccaatagactcgtagctacataaggttgacttggggtaagcttttagctgattcttgatctatttttccgagaatctgtaccattgacattcttgtactggttcatcgtaggtgattgtcgacaagtagttgttatg

SEQ ID NO: 35462 - DNA, 413 bp, Unknown; identical to SEQ ID NO: 15287
  misc_feature (1)..( 413): 2750-1469P.txt file - cDNA_ID_3087761; gDNA_ID_2926124; Annot_ID_196711

SEQ ID NO: 35463 - DNA, 681 bp, Unknown; identical to SEQ ID NO: 15286
  misc_feature (1)..( 681): 2750-1469P.txt file - cDNA_ID_3087770; gDNA_ID_2926124; Annot_ID_196705

SEQ ID NO: 35464 - DNA, 681 bp, Unknown; identical to SEQ ID NO: 15286
  misc_feature (1)..( 681): 2750-1469P.txt file - cDNA_ID_3087770; gDNA_ID_2926124; Annot_ID_138627

SEQ ID NO: 35465 - DNA, 3000 bp, Unknown; identical to SEQ ID NO: 9196
  misc_feature (1)..( 3000): 2750-1469P.txt file - cDNA_ID_3087806; gDNA_ID_2926128; Annot_ID_196769

SEQ ID NO: 35466 - DNA, 3003 bp, Unknown; identical to SEQ ID NO: 18602
  misc_feature (1)..( 3003): 2750-1469P.txt file - cDNA_ID_3087810; gDNA_ID_2926128; Annot_ID_196766

SEQ ID NO: 35467 - DNA, 3003 bp, Unknown; identical to SEQ ID NO: 18602
  misc_feature (1)..( 3003): 2750-1469P.txt file - cDNA_ID_3087810; gDNA_ID_1972020; Annot_ID_178036

SEQ ID NO: 35468 - DNA, 3000 bp, Unknown; identical to SEQ ID NO: 7693
  misc_feature (1)..( 3000): 2750-1469P.txt file - cDNA_ID_3087810; gDNA_ID_1621157; Annot_ID_173568

SEQ ID NO: 35469 - DNA, 3003 bp, Unknown; identical to SEQ ID NO: 18600
  misc_feature (1)..( 3003): 2750-1469P.txt file - cDNA_ID_3087814; gDNA_ID_2926128; Annot_ID_196765

SEQ ID NO: 35470 - DNA, 3003 bp, Unknown; identical to SEQ ID NO: 18600
  misc_feature (1)..( 3003): 2750-1469P.txt file - cDNA_ID_3087814; gDNA_ID_1972020; Annot_ID_178035

SEQ ID NO: 35471 - DNA, 3000 bp, Unknown; identical to SEQ ID NO: 9189
  misc_feature (1)..( 3000): 2750-1469P.txt file - cDNA_ID_3087818; gDNA_ID_2926128; Annot_ID_196763

SEQ ID NO: 35472 - DNA, 3000 bp, Unknown; identical to SEQ ID NO: 9189
  misc_feature (1)..( 3000): 2750-1469P.txt file - cDNA_ID_3087818; gDNA_ID_1972020; Annot_ID_178032

SEQ ID NO: 35473 - DNA, 3003 bp, Unknown
  misc_feature (1)..( 3003): 2750-1469P.txt file - cDNA_ID_3087818; gDNA_ID_1621157; Annot_ID_173573
tcacacgtcgctagcgtttcaaaactgcttccactcatccttcctttgatggactcagaatctgtgcattgtggtcgccccaaaagcaaatcatatggaagaggagcaggagcacaaaaggtgtcaggtatagatgtctccaaacctatatcaaccaagaggcctgtggtgaatgctgatcccacaccagcacgggttcctgaagggacaagctcttcaaaagattctggacactgcgtaacaaacttttaataaatagaaactttgtagagtgtcacaatcaaataactgtagataattcagaagacatttttcaaacacagctcactcacgacctctagtagtctactatcgaccactcaagcgagattgttacaagaaattgttgagattctaaaatcatgctcttgtcccgatttgttttaactaaaatcataatctatagatagtcagtagtgcaaagcaacacaaatgcaagatggtgaaaaggattactgacataatagtaaacaggtgttccaacaagatgtgacttcctcgaagaactacagcaacctcccattttcaccagctatagtaataattaagcaagagtagcgaacaacagtccttgaagcattttacagatgcactgccactgcaggaaaagagtgaactgaacaacgattacttgaatgcaacaagattaatcaaaagtactcttaagaaaccccaataaaaaaaaagtgattattacagtgttagtaagcaaaatgacaaaagaaaagttggtctgatggcaaagtcatccataagaaacacaaaggtatgggaagagtgaatagtgagaagaacattacgaaacaagattaatcaaagcagacttgagaaatcccaataacaagtgattattacagtgttaataagcaaaatgacaaaagaaaaagttgatctgatgccaaagttatccataagaaacacaaaggtatgggaatgttccttatgctctgttgtaatgtcccatcaatagctgaaacttgaatctatattctaaaacaacctctaggattcagtcaagttgcaatgaaaacagtgacgcgagcaaaagcatttcacacttgagccaattttaatcaaacacaacacaataaccttcaaaattggtaacatcattgatatgtaactctaccataagatcttctcataagaatagacgacaacatgaacacagtaagcacatctaaatcagaaactaaacaacactaaacagtacgcgaaccctaaaattgaagaagccgaaaagaccaaaaacaaaaagtacacgaaagccgactccgggaaacaaaaaaagagatggaataattaaccgatgagagcagtaaacgaagataacctgagatgtcgccggagaatttgatgttgtcgtgattctccggtgaagaaaagtgagaagaataaatgctggcgacggagggtttcgacacacagagctccttttctctagtcgaataacctcatcatagtaagtaattatactgtaatcctactttactttatttagtttgcctaattattctcaaatctcattaaataccttttaaatagtacgacgtcggttaaggatacgggctaatcattgggcttttgttttctgaaacatgggctataaacattttagaccatggtccattctacagaaggtcaaaccctctgtcgctatcagaggctattgaatattttgctggtaaggtctcaattctcatcatccttcacctgcctatgaatcttccttgttaaccgtaacctaatattgattgacttctaatcaaagtaatttaatctaccattttattatttcctctaatctaagcctttttcatataaaatgtatctaatagtaactttataagaaaaatattatacctttttcttggtatctttgttgtaaaaaaaaatacaaattaaatgcgagttcgattattgcattaatagagatagacccatctggcatttaatatggtggcggcggaataatcgctaacaagatattagttgaaaattttcaaatcattcggatagattacgtctggcattgaactaattatcctctataaattcaataatgacagaatttagtagatgttctaaatactaaaattatttaataatcttacatatgcaattttccatgtacgtgctgttttggagcgtttaaaccgaattaaagtactactgtaaataaattgaatcgaatttaccgaaccaaaattgaagaaaaaaaaaattaaatcgaaccgaaccaaaaattggaaactagtcgaataaatattaaattctataaccgaaatatctgaaataaaaccgaataaatacaaaccaaaatattttgggtaaaatatctaaagtataaatatatttttaaaagtgttaattatttctagactaaataactaaaaatacttgaaaatataaataaaatagtaaaaatatttggaaatatctaaaaatatttaaaaatattcaaaataaccgaaatattttaaatgaaataaccgaatggatactaaattttaaaatcgaaaccgaacagaactttcaaataaccgaatggatactaaactttaaaaccgaaaaaatcgataacggaatggataactgaacgccgagaactactattatatacaaagtatttagttattcaataaaatttgaaaccaatcgttttttttcaaaattaataattatcgaatttaaatctaaggaataaaaaagcttattacaaatcattagacaaaatgtaataaaaaaaaaggaaattatacacattaattatcttagcttgtcgagtttaaattttgttaatcagagaacgtcaagttgtacagctggcgtcaataaatacccaaaacagtcgtctttttcaacggagaagaaaaagttgaaaaaattgtaaagtcagtctctccgactcttccttccttccgtgttcaccattgctacacgttctccacgaactttccgatg

SEQ ID NO: 35474 - DNA, 3000 bp, Unknown; identical to SEQ ID NO: 9187
  misc_feature (1)..( 3000): 2750-1469P.txt file - cDNA_ID_3087830; gDNA_ID_2926128; Annot_ID_196756

SEQ ID NO: 35475 - DNA, 3003 bp, Unknown; identical to SEQ ID NO: 18595
  misc_feature (1)..( 3003): 2750-1469P.txt file - cDNA_ID_3087830; gDNA_ID_1621157; Annot_ID_173582

SEQ ID NO: 35476 - DNA, 3000 bp, Unknown; identical to SEQ ID NO: 9186
  misc_feature (1)..( 3000): 2750-1469P.txt file - cDNA_ID_3087836; gDNA_ID_2926128; Annot_ID_196749

SEQ ID NO: 35477 - DNA, 3003 bp, Unknown; identical to SEQ ID NO: 22034
  misc_feature (1)..( 3003): 2750-1469P.txt file - cDNA_ID_3087840; gDNA_ID_2926128; Annot_ID_196747

SEQ ID NO: 35478 - DNA, 3000 bp, Unknown
  misc_feature (1)..( 3000): 2750-1469P.txt file - cDNA_ID_3087848; gDNA_ID_2926128; Annot_ID_196740
tattccatccactatgtaaagtagttctggtttgttagaggtcttgaaaagatgtgatgtcaagtgaaatgcaaaacggtggcatggcgaagataagtggctagaaacgggaatgttaatgaaactaaagagagacatatacacgtgcatatatacactcagatgttgattgttttccaaggtgtttgtgtgagaaatgacatctctctctctcacccattcaggcggtggaaaaattcaataacacttttaaaaaagatttttgttcaataggttttgacctgaaaatacttagaacaaaaaataacacaagagggaaagtgccgtaaaagtaaaaaaagaaaaaaaaaaagagagagatcatgtcgctgacatactatacatgcctagctagctcggtacatttatatataatgtttgtgtgtaaggtagattgagatatatgaatggtcaaatcggaaataaaacagtatatgttcttaaataagcttctcctttgttcaacttttttgctttcatttccgttacatgatttcgcgattaattactttttataattagtcaacttcgacgccttgtgtcgtcctcgattttaatgttctgtctttctctgcattcatagtttatcttatttcatttcatatccttacttcttttttctacaaacaataatttctagacgaattgaaacaaatttccaaaactttatgagtatatataggatatttttagtggcaaaggacgacttaaattgtaacgaaaagaatttgaacttttttccattagtccctacgatgaatatttcatcctatagaacatcatatgaattgattacttaatgaagttaaatttttgaaaactctattagggacaatgtcccacatcggaagttgagtaggatcttaagtggtatatataagatatgagcctctccacctattgccaattagttttacgttggaagcccacagtctgatatggtatcagaccccgatccgcacatactcaacccgatccacatcggtccggcccaatacttggcccgccgatccatgcccaaacatatcgagatcaatggctagaagaaccatcatctcgagggggcgtattagggataatatcccacatcggaagttgaataagatcttaagtggtatatataagatatgggcctcttcacctattgccaattggttttaggttggaaacccacactctaatatggtatcagagcctgatccgcacatactcaacccgatccacatcggtccggcccaatacttggcccgccgatccatgcccaaacatatcgagatcaatggctagaagaaccatcatctcgagggggcgtattagggacaatgtcccacatcgaaagttgagtaggatcttaagtgatatatataagatatgagcctttccatctattgccaattggttttatgttggaagcccacactctaataaactcaatacaaatactaaagttgcaaacaactatactatatttgcttgaagttctattgtgataggattttgacttacaaaaatcatattctatgtctacactatatattgtgaaaccggatagccataatatttacaaaaacttaaactaatttcagatataaataaatttaaatttcactatgacctagtaattatcacgaacaattgggaagttaccacaaaatggtggtcctgtattatggaatttagcgaaaccacacacttgcgggtaaaaataatgatgacaaaatgatatacattggaatgtagagaaagtatatacaaatactaataaatagaaaagggcatggaattgacgaggatcgagggaaagtgtggtgtggcagaaatgttattaagtgtgaaaacaactgatgaatgagcctttgcttaatcacttccatgcacaagtccctttcctcttcctctctctcccacttcatcgaactttgcgtcctttaaagaaaagaaaaaacaaaacatttttcatccaattgaattcaaaccgtaaccagattagatttaacttcgtttattttacattatcttcttcttcttattttgcggagaagacttgtacaatgacctcaatacgctgaagagttggattcactgcgagtgtatatgtgcatatagaaacaaaatatctagctatatgaccacttttaactctaaatatgggtgtaatatgccaaggactttctggagatccaccacaacacacattcaagttcaagttctgctgcttttaggtctatgaaaacaacaccaaccttattttcatattgttctctctttatctcatgcataagtatattttcatattgttccctctttattttcatgcttttagttgatattttttttgttattgtattatcattagtgcgacgacacaaagtcacaaaccatgtaacaaaatgcttaaccaaaatagaaaaccttaacaattccaatatattttctgttattgcattatcaattatcatcaaatttttttccactgttgcattatcatcattgcgacgacacaaggtcacaaaccatgtaacaaaatgcataaccaaaatagaaaaccttaacaattccaactttaacatgtgaattaatattatcttaatttttggatgttcgacattcaaataaactcctaattaaaccctatagatatggttaatcttctatacatgtgtcacgtacgacacttattagccaaattgaagttttgttttttccgcaaatatataagcggtttaaatagttggtaaaaaaaaaaaaaagttagcatgtttgtcgtatgtacatgtttgatgctgcacaaatcttgtcgttataaaactttgaaatctttatatctattattcctcaccgatcggctactaattcaatggtacttgataatgataattagtcccaaagtagagtttttatctgattatatagaaacaaagactagttccggtttgatatatagaagaaagaaaaaggatg

SEQ ID NO: 35479 - DNA, 3000 bp, Unknown; identical to SEQ ID NO: 35478
  misc_feature (1)..( 3000): 2750-1469P.txt file - cDNA_ID_3087848; gDNA_ID_1621147; Annot_ID_173102

SEQ ID NO: 35480 - DNA, 3000 bp, Unknown; identical to SEQ ID NO: 7480
  misc_feature (1)..( 3000): 2750-1469P.txt file - cDNA_ID_3087852; gDNA_ID_2926128; Annot_ID_196739

SEQ ID NO: 35481 - DNA, 3000 bp, Unknown; identical to SEQ ID NO: 7480
  misc_feature (1)..( 3000): 2750-1469P.txt file - cDNA_ID_3087852; gDNA_ID_1621147; Annot_ID_173101

SEQ ID NO: 35482 - DNA, 3003 bp, Unknown
  misc_feature (1)..( 3003): 2750-1469P.txt file - cDNA_ID_3087862; gDNA_ID_2926128; Annot_ID_196732
ttgtctttcttctaaaccccacggtttcttcgacattttcttacaagccctttcaacggccttgatttgatcttagctaggaaatatgagctggatacgataaatgacttcttcaacgttctctttatgatttttggtgtcaatttctagttcttaagttgttttatttgacgatttaacaggatctctcccccataactcattacacgaagtggggacggcttctttcgacattaaggtattgcccattgtttaaattctcaagtggataagtaaacttataatcaccactaattatatatataagtatattactaattaatcggtctaattaagataccgtctaaatgtcgttgtccacatgaaatttctatatgttgcgttcatttcatagatttaaaatcgacaaagctagaagataaattttcaaaatgagacctcacatcttcttttcacattgcctttaatgagttcaagacaaaataccccgtttcatgcattaatgttcatacttgttatattcatcaacaatataccagtactatgcaacatcaattaattataagcttcctactttcgtcctttttattagttaatacaacacttgcaattggagtaactcttacaacgagagaatgtataatcttataataaaaatttaatatgatgagatattttttttgcctacggtgatattaacataaggttttttcttttacaaaattagaatgttcagttcaaacaaaagaaaaggatggatatggacatatggtatttgcattattctagtagtcttcaaaagctttaagggtcaacaaccggatagtagatggatatgtatttgatacaaagaaataatatattactatgacgatttcccaaatcttctattttcaaaagaatgaggatgagacttttctttttggaaataacatatattccgttaataatatttaactttgctcactaattatcattttgttacttctaaagcaaaaatcttcggcgagaaaatcgaaacaaccaaacgatttggattccaaatttccaaacagaatcatgcgtgtatttttactcgctcgcaacgatttggattacacactttccaaaacgataattttttaattgaattaacccctaattaaaattaataaccaatcagattaagataccatttacaaccaaatcttctattttccaaaattttagtatgatttttttttggaaataaataaatattccctatcccattagtggccatcagttgtcattttttgtttctccaaaatcataatcttcggcgacaaacaatgattagatcttcatttttacgatcatgttagtgatttaatggacttgttagtgattttgtcttcattttatattatgttagtgatttttatcgacttgttagtgatattttttttccatttttacgtgcatgttagtactttttgaggggacgggtagaaatcactaacataaacgaaaaatgaaaaaaagtttactaacaagtcggttaaaatcactaacataaacgtaaaatacagacacaattactaataagtcgattaaaattactaactttaacgtaataatgaataaataactgttttttgtttcgatttttgtcatcagaaattatgattttctattcgatttttgtcgtcggagattatgattttgtagacgcaaaaatgaaaactgatatacactaagctactaacaagattataaaattgtttatataataatttccttaaaacaaatctaactcaaaataatgcatattataatttttaatagttatttaaagtatatatataactaaccggaaaaataaccgtatatagttttacggaaatttacgataaaagatacaaccgaagaaaatcaaccgccaatattaatgaaaagtcacgacaaaaagtaaccattaatattttaataaaaaattgtgctaaaaaatacaacggatagataacagtcaataagataacagaaaataacgataaaaagacactaacaaaaaaagtgtcaattaatattttaacgaaaagttgcgatgaaaagactcaacaaaaaaaataaccatcaatattataaccgaaagttgcaatgaagagacacaaccgaggaaaaataaccatcaatattataaccgaaagttgcaatgaagagacacaaccgaggaaaaataaccatcaatatttttacaaaaagttgtgataacaacacaaacaaaaaataaccgataatattaacgaaacattacgatgataaacacgaaaaaaaaaaaccccatcaatattttaatggaaatttgcgataaaaagataaaaaaaaacaaaaataatcgtcaatattataacgtaaagttgcaataaagagacaaccgaggaaagtaatcatcaatatttttatgaaatttgtgatcaaaagatactaacagaaaaaataaccatagatgttaacgaaaagttattatgaaaatagaaaaatgaaaagttacgataaaaaacactaacaaaaaataaccgtaaatgtttacagaaagttacgatgaaaagacatgaatgaaaaaaataaccgtcaatattttttacggaaaattgcgattaaatacacaacctttcagagtacaaaatgcatttattgagattgttatttattatattttttttgtaaactagcgagattgttattattagtcgaatcaatattgtaggaagaagacctaaagacaaattcggaggtcaattaataacgcgttaaagtatgtgaggcacgttcgagtggaatagcgcgttggacagcccaacatgaatgaatgatcgacttttattgaaaaagcaaaactagggcaagaaaacgaaacgtccacattagcctataaaatcactaaacctaagagcaaagcacattcacggcgactggaaagtagaaaaccttattgcttcccgcagatctctctctctctctctcgtaactgtttgttcgatg

SEQ ID NO: 35483 - DNA, 3003 bp, Unknown
  misc_feature (1)..( 3003): 2750-1469P.txt file - cDNA_ID_3087862; gDNA_ID_2926128; Annot_ID_138662
ttctagttcttaagttgttttatttgacgatttaacaggatctctcccccataactcattacacgaagtggggacggcttctttcgacattaaggtattgcccattgtttaaattctcaagtggataagtaaacttataatcaccactaattatatatataagtatattactaattaatcggtctaattaagataccgtctaaatgtcgttgtccacatgaaatttctatatgttgcgttcatttcatagatttaaaatcgacaaagctagaagataaattttcaaaatgagacctcacatcttcttttcacattgcctttaatgagttcaagacaaaataccccgtttcatgcattaatgttcatacttgttatattcatcaacaatataccagtactatgcaacatcaattaattataagcttcctactttcgtcctttttattagttaatacaacacttgcaattggagtaactcttacaacgagagaatgtataatcttataataaaaatttaatatgatgagatattttttttgcctacggtgatattaacataaggttttttcttttacaaaattagaatgttcagttcaaacaaaagaaaaggatggatatggacatatggtatttgcattattctagtagtcttcaaaagctttaagggtcaacaaccggatagtagatggatatgtatttgatacaaagaaataatatattactatgacgatttcccaaatcttctattttcaaaagaatgaggatgagacttttctttttggaaataacatatattccgttaataatatttaactttgctcactaattatcattttgttacttctaaagcaaaaatcttcggcgagaaaatcgaaacaaccaaacgatttggattccaaatttccaaacagaatcatgcgtgtatttttactcgctcgcaacgatttggattacacactttccaaaacgataattttttaattgaattaacccctaattaaaattaataaccaatcagattaagataccatttacaaccaaatcttctattttccaaaattttagtatgatttttttttggaaataaataaatattccctatcccattagtggccatcagttgtcattttttgtttctccaaaatcataatcttcggcgacaaacaatgattagatcttcatttttacgatcatgttagtgatttaatggacttgttagtgattttgtcttcattttatattatgttagtgatttttatcgacttgttagtgatattttttttccatttttacgtgcatgttagtactttttgaggggacgggtagaaatcactaacataaacgaaaaatgaaaaaaagtttactaacaagtcggttaaaatcactaacataaacgtaaaatacagacacaattactaataagtcgattaaaattactaactttaacgtaataatgaataaataactgttttttgtttcgatttttgtcatcagaaattatgattttctattcgatttttgtcgtcggagattatgattttgtagacgcaaaaatgaaaactgatatacactaagctactaacaagattataaaattgtttatataataatttccttaaaacaaatctaactcaaaataatgcatattataatttttaatagttatttaaagtatatatataactaaccggaaaaataaccgtatatagttttacggaaatttacgataaaagatacaaccgaagaaaatcaaccgccaatattaatgaaaagtcacgacaaaaagtaaccattaatattttaataaaaaattgtgctaaaaaatacaacggatagataacagtcaataagataacagaaaataacgataaaaagacactaacaaaaaaagtgtcaattaatattttaacgaaaagttgcgatgaaaagactcaacaaaaaaaataaccatcaatattataaccgaaagttgcaatgaagagacacaaccgaggaaaaataaccatcaatattataaccgaaagttgcaatgaagagacacaaccgaggaaaaataaccatcaatatttttacaaaaagttgtgataacaacacaaacaaaaaataaccgataatattaacgaaacattacgatgataaacacgaaaaaaaaaaaccccatcaatattttaatggaaatttgcgataaaaagataaaaaaaaacaaaaataatcgtcaatattataacgtaaagttgcaataaagagacaaccgaggaaagtaatcatcaatatttttatgaaatttgtgatcaaaagatactaacagaaaaaataaccatagatgttaacgaaaagttattatgaaaatagaaaaatgaaaagttacgataaaaaacactaacaaaaaataaccgtaaatgtttacagaaagttacgatgaaaagacatgaatgaaaaaaataaccgtcaatattttttacggaaaattgcgattaaatacacaacctttcagagtacaaaatgcatttattgagattgttatttattatattttttttgtaaactagcgagattgttattattagtcgaatcaatattgtaggaagaagacctaaagacaaattcggaggtcaattaataacgcgttaaagtatgtgaggcacgttcgagtggaatagcgcgttggacagcccaacatgaatgaatgatcgacttttattgaaaaagcaaaactagggcaagaaaacgaaacgtccacattagcctataaaatcactaaacctaagagcaaagcacattcacggcgactggaaagtagaaaaccttattgcttcccgcagatctctctctctctctctcgtaactgtttgttcgatggcactgaagaaggcggaagaagtgatcgagagccctcctacttcaagtgaagaagaggaatctggctcataatctgagtctgaaggcgaaactgaatcggagcccgagcccgagtccgagcctgctaagacgatcaagccgatg

SEQ ID NO: 35484 - DNA, 3003 bp, Unknown; identical to SEQ ID NO: 35483
  misc_feature (1)..( 3003): 2750-1469P.txt file - cDNA_ID_3087862; gDNA_ID_1621147; Annot_ID_56783

SEQ ID NO: 35485 - DNA, 3003 bp, Unknown; identical to SEQ ID NO: 35482
  misc_feature (1)..( 3003): 2750-1469P.txt file - cDNA_ID_3087862; gDNA_ID_1621147; Annot_ID_173089

SEQ ID NO: 35486 - DNA, 3003 bp, Unknown; identical to SEQ ID NO: 21207
  misc_feature (1)..( 3003): 2750-1469P.txt file - cDNA_ID_3087872; gDNA_ID_2926128; Annot_ID_196728

SEQ ID NO: 35487 - DNA, 3003 bp, Unknown; identical to SEQ ID NO: 21207
  misc_feature (1)..( 3003): 2750-1469P.txt file - cDNA_ID_3087872; gDNA_ID_1621147; Annot_ID_173084

SEQ ID NO: 35488 - DNA, 3003 bp, Unknown; identical to SEQ ID NO: 32241
  misc_feature (1)..( 3003): 2750-1469P.txt file - cDNA_ID_3087875; gDNA_ID_2926128; Annot_ID_196727

SEQ ID NO: 35489 - DNA, 3003 bp, Unknown
  misc_feature (1)..( 3003): 2750-1469P.txt file - cDNA_ID_3087875; gDNA_ID_1621147; Annot_ID_173083
ctagaaaaggcatagcttaatacaaaaaacaaatacctgcaaaatcttcatcgctactgttaacagtttcttctcttggtgggattttatttaaatcaaacaaaaattcatctccatcatcactataaacagttttttctggaatttcatttaaatcaaacaaaaattcattctcttcacttagaagtgacatactcaaataaaaatttggaattgtgaagaaaattagaaatcatttttttttaaaaacttacataaacatgaatgattcagaaaagttttagtttggctccgatgtaaaatttttgaaattttttgtttaaaattaattatgtaatggttgcacaaaaaaaataatcaattatgtaaaaagttgctccattttttcaagtaatttgggttgtttgagagtttaatgcgtaacgtttaatattactctttaattgttttaattactttacttgattgtttttattaaataatagttttgttaattactgtgctaaacctcaaaacatctgatatattgagtaatttatatatccaaataacctaggagaccaaaagtctattaggttaaatgaagacgagttctagaactctcataaaacctttgaaaaaagctattaaaaaaaatctttttttttttgagttatatatcttgatactgtctagcctaattatcaatgcttaattttcgtacttaaatactatcatcaattcatcatggatttcagagcggatactccaatcttctttgcattttatcttttttttaccgtttaaggttaacataaaaaaaaatatattctaaattttttttttactgaaaaaagattctattagaaatctaagtgcaaaaaaaaatgttgattgatggaggttaagatcaaaatatgaattttgtcttcttgcatattaaaaatctaacctatattttacatgaacgtaaatagatgattttatgagtggcaaaaacgaactcaccataaaaccattagtaacacatgtagtacaaacccaatattgaataggaaccgtactacttttctaattatttaaaattgcaggagtggtatgtcttggagaatcgaggagacacgcatcgagtttaaatgtgtggtcggagagaataaaagtgtgtgcagatttgcttaaagagtgaagggaaggtgctataaaaaaggatcttgttggccacgagcttcttccttttcgtcttctccgccgcaccctttgggtcaacagttaaaccctctccattacgcgtgtgaatatacacatataatattcacattatataagattatgtttcataacgtagatcctgcctgttctatatacaacaggttttggtatgagacgttagatactttaattcatctggtcaaatgcctagctagaataaatatctttaatcacgttcaaaattgattttatacgaatacacttataattaatttaattatgatatatggtacttgctttaccggccttcttgtaaccttccttcaaactctagctgctcatcaattgaattaacaaacaaaaacaaatccaagtcaagtgatcttaaatccagctcattcttattcacgtgccatgcaaaatgatgcatacagtatatataagggacacacacaaagacatgtaaatattataccatccaccgattaagctacatatcctctcagttaattctctaattcgccatggcggctaacaacaaattgttctttgtattactctccctgttccctctcatcatcttctcggcaaccgccacgtcatcaaaagactacgacacgaaggcttacgtgcactcatggtgccgaacaaccttatacccgaaactatgcgtccggtcgatgtctcgttacgtgcgttcacgcgcggtgcaaaatccacgggatctggcccgatttgcgctcaaagccagcctatatagagctaagtacacaaaggcgttcttgttaaaagaggttaagaacttggagacgacgttgaggccccaatactacgcgtcggttcacgactgcttggaccaaataagagacagcgtgaaccagttgagtctagccatagcggagctagacagagtcagcaggagacagggaaagagccaaggggatctacactggcatataaataacctgcagacgtggacaagcacagctcttacagacgccgagacttgcgtgagccagttcccgggacgtaggatgagcaaacttaaggctacgattaaaggaaaagtgaagaatgtggaggaaacaactagtaatgcccttgccttcatcgagcactacgctgctgctaggtaccgagccagacgtccttaagctgagcctgtgtgtgtgttttgatcattttgccttaaatttcttcttacttcttgatatttgtgtgtgtaattgttaaccagtcgtgtaaatccaaaagttcatatatgaccgtaaattgatataattcaataacaaggaaagttctaagcctaaaacaagcaagaaaatacctttgccgtatacaaagattattaccattattatcgacatcacagaatgtagcccgtctagctcagttggtagagcgcaaggctcttaaccttgtggtcgtgggttcgagccccacggtgggcgatagtgttttttctgttgtttttgtaaagagctgaagttataaatgggctttgaaattaatgggttcgaacaccaacggtgggcctttttttctttctatttttgtaaagagctgaattttaaaatgggctttgaaattaatggatcagtgaggttaaggcccatatttctaataaaattagaagtagttacaaacccgacccgacccggttacgtgtatgcggagatcactctcctctccataagctaagctctagaaacaccgcctttaacgtctcgctgcaccatttttcatcgttgatcagtcgtcgatcctcttgagtgatttgattttagactttctagttatcaaactcgaaagatg

SEQ ID NO: 35490 - DNA, 3003 bp, Unknown; identical to SEQ ID NO: 27929
  misc_feature (1)..( 3003): 2750-1469P.txt file - cDNA_ID_3087887; gDNA_ID_2926128; Annot_ID_196724

SEQ ID NO: 35491 - DNA, 3003 bp, Unknown; identical to SEQ ID NO: 18492
  misc_feature (1)..( 3003): 2750-1469P.txt file - cDNA_ID_3087891; gDNA_ID_2926128; Annot_ID_196723

SEQ ID NO: 35492 - DNA, 3000 bp, Unknown; identical to SEQ ID NO: 15290
  misc_feature (1)..( 3000): 2750-1469P.txt file - cDNA_ID_3087903; gDNA_ID_2926128; Annot_ID_196720

SEQ ID NO: 35493 - DNA, 3003 bp, Unknown; identical to SEQ ID NO: 31948
  misc_feature (1)..( 3003): 2750-1469P.txt file - cDNA_ID_3087939; gDNA_ID_2926129; Annot_ID_196813

SEQ ID NO: 35494 - DNA, 3000 bp, Unknown; identical to SEQ ID NO: 28373
  misc_feature (1)..( 3000): 2750-1469P.txt file - cDNA_ID_3087957; gDNA_ID_2926129; Annot_ID_196805

SEQ ID NO: 35495 - DNA, 3003 bp, Unknown
  misc_feature (1)..( 3003): 2750-1469P.txt file - cDNA_ID_3088000; gDNA_ID_2926129; Annot_ID_196830
atcccttgtaaatctttcagaacacttttaaaccctttaaaaatctttaaaaaatctttaaaaaacctttctaaatcttttaaaatcctttaaaatctcttgtaaatcttttaaaatccttttaaaacaattttaaaccctttaaaaatcttttaaaaacctttgcaaatcttttaaaacccttaaaaatcccttgtaaatcttttaaaacctttttaaaatcccttgtaaatctttttaaaacgttttcaaatgccttgtaaatcttttaaaagccttttaaaatcctttgtaaattttttaaaacccttttaaaatctcttgtaaatcttttaaaaccttttaaaatcccttgtaaatcttttaaaaccttttaaaattccttgtaaatcttttaaaacccttttaaaatcccttgtacaacttgtaattcattaacgaccgtggaagttgtactcaagaacagtgatcattttgtctttcattgacaaccacattgacccggctggttggttcccatgggatggcgagtttgcgctctccacattgtattatggagagtatgcgaatactggtcctggagcggatacgagcaagagagtgaattgcaagggatttaaagttattaaagactcaaaagaggccgaacaattcactgtggcgaagcttattcaaggaggattatggttgaaacccataggagttactttccaagagtggctttgattttaatgtctacttgttcttgtactttgtgttgtgtcacctctgttttagtttaatgtattttctgttttgttttgtatgacttacccaataaataacatgctctgtttcgcaagtattaggttaatgcatataatattttgaataactttaacactaactaattgaatattttcaatatataatcatactcgcactcatcagtcataacaccatcaatttaatttttttttatggggttattatatgtactagatgactaaaactttgagaatattttcatgaataatatgaattttgtttaagttgattacattatttatcaggaacagtagttaccaaaaataatagtttcatattaaattttacacgttggtcatataggggatccttgcttattgcattctgcatggcatgtcagcacagtgtatcagcatgtgatataattttactataagtagagcattcatcggtcgtaaattttcggaatattcagtgtatttattttctatttttttccgttttctattatttctgtatttctcaatacaataaaaattcaaactaaccaaaaattcagaaaagatcactatattatatataaaatcaattgccgcccaaaaagaaatctgttttacaatgaatataactgaacaattatacatatatctagcaaatctatcttttggcatttctaaattaataatctccattgaagagctgcaactttgtgcttgctaaaactttttcacctgcaacaaaatgagtattatgggagatttaaaaatcaacataggcatacaaaaatattccagaaagaagagagagacaataaggacaacaaattttgagtcatatcatatttgttgtgatgggctccatcccattgataaataccttaatcaaccgattgtcagctgaattcctcatgctaatacctaactatacaatattataattgccatatactggaaaactagcagattgcacaacaatatagaaaagacacaagcataagaaagaagcctacgcgacaattactacaacatctccatattgaatggtcttctgatatacaataccattccatgcgcgcagactgagactttgtaagtatgtgaagcatctcacgagagttctcagtcaaatgcaactcaacaaagaaatcataagaaagcattaaatattgaaagcattgagaagcaaattagttcatgaaccacatcacatcagcatcctggagaccaaaaaaggaagacaatgaatcactcaatagaagaactgataagtttttgctttcactgccaagagtgtaagaaacataccgcaaaaacagactactaaacccttttcaagaacaatccgaaggaaattgattcttctccacatcatttagcatccaaagcaatgaccaccatctttagttgcagctctacgcagcacatctaaagctttcttgttcttttaccaattctaaaaatctcaaagaagagatcgattccagatacaatagctgcataagattcattcaaagttgtcaaaattacagtaccatttttttacggaggaatgacaagttatgagagtgcttttattatatcttttcgggtaaacattgtaacgtagtgaaagttgagagtgaattgcctaacaaccgatagaatcaaccaaaaagaaaaaaagaacatcttttctaacgaccaaaaaaaaaacctaggggttttctatttattaggtgtatattgtcttttctagtactaaaacaataatggctaagtctcatcctcacacgtaagagattaaggttgagaatatattgtattgttgttagcataacctaaaatggatgaaaccaatttctaccaaattcatttttttttagccatttagagtacagtggaaaacaagtatttcaactaaagtactctaagacaattcttcttctatcttttatgagctgaaaattttggaccacttttcttttctgttctttgtggataataaaaccaaacttcactgaattatagcttcaattcacattgcactgaatttttagattgatctcaaaataaagtttttttcctaaatattgtcatttattgaatacaattaattaaatgtaaattgattaagttgctttgctttgtatataagaccaccatcgctccctcctctttcatcagttaagataatataaattcagtaattaagagagaagaaataaacacaaaaatgttggttaaagttttctcttttttcatccttatgataacaatg

SEQ ID NO: 35496 - DNA, 3000 bp, Unknown; identical to SEQ ID NO: 7978
  misc_feature (1)..( 3000): 2750-1469P.txt file - cDNA_ID_3088000; gDNA_ID_1621178; Annot_ID_174223

SEQ ID NO: 35497 - DNA, 3000 bp, Unknown
  misc_feature (1)..( 3000): 2750-1469P.txt file - cDNA_ID_3088109; gDNA_ID_2926130; Annot_ID_196850
tttgaatttttttccaataaacaaagaatcagcatcacttagaccagttgaaaacgcagaactagaatactgttgatcaaaaatactagatgtttcagatacacacgcctgaataatcctagaggttaacctcggctgccaaaataaaaagcttaccttaaacatcaatctatctttaataatgattttacaaggatttttaaaaggggtttaaaaacgttaataatgattttacaagattttttaaaaggattagtacctgagtagtagatgtagaatgagaagcaaaatgatttgaagtcgtctaagcctgtaataaacacaatcactgacttaataatgattttacaaggatttttaaaaggggtttaaaaacgttaataatgaatttacaaggatttttaaaaggggtttaaaaacgttaataatgattttacaaggatttttaaaacgattagtacatgagcagtagggagagaatgagaaacaaaaggatttgaagtagtctcagcctgtaataagcacaatcactgacttaataatgattttacaaggatttttaaaattataacacaagaaggttattgaaaaatctgctcaactgtcacagaaatttgctctacagtcaaacataactgaagcaatcctccactctgtgagaatttgtgcataaaagttgcaagctgtctatcgtttctaatataaagaggatgagattgtatggttgtagatgtggagactaacttgtaactaagcttcaaagaattggttgaactatctatttgaaaatcctctacaagaatatccaccaacgcgtgataggtaatgtgctcatcaatgaccattaaagaagctcccaattcaatgtctaattcaaattcccaagtcatattgtttgtcaacttccacaagccacaaacaggatacaattctagcattataacctgataagataaataacaacaatatcaacacccataaaaacactgtcactacagagagaagcatggtttacaaatcgttttaaagcgtaagtaagtagcatagaataatttacaagggattttaaaagctttgaaaagtggttaacatggtttacaaatcgttttaaagcgtaagtaagtagcatagaatcatttacaagggattttaaaagctttgaaaagtggttaacatggtttacaaatcgttttaaagcgtaagtaagtagcataaaataatttacaagggatttaaaaagctttgaaaagtggttaacatggtttacaaatcgttttaaagcgtaagtggcatagatctatcacgaaagcatatgtaaaagaggtaaacactaaatcagaaccaaaatctattacgaaatagtataacgaattcacataagcaaatctatcacgaaacagtataacgaattcaaaaggtattaacgaatttacaaggattttataaacaaattcaatcatcaaatctcaaacaaaattcaaattcgaagctgaagcaaatgtcaaactgtcgattgaatcaggattcaaataacgaattcacataatcaacaacaaaaatcgaataaatcaattcgaaatcgaagatttaagctaacattataaaatcaaaccggggaaacgcaagagattcgacggcgacacacagctctacttccgacggcgaagatgggttttcacggcgagtaaactcactatttccgacggcatgggattcaacggcattcacaatttccgatggaggaagaagagagagagtgaagaaatgaattaggtctgtgggtagctcattaaaggtaatttggagagaaaagtattagaaagggtagaaatgaaaatgggaaaaagggtagagttgcaaaagggcattgagaaaagggcattacagtgaattattcttaaaaataagtatataactgtttgtttagcaagctaacatatataataacgtggtaaatttacatattatatgttaaataaatgtttatctacttaaaattatgaataaatatttttatttatatatatatcaacaaaataaaatacatcatgttacataattaacatgataacgattataacaacattttacatagaataataacatgctaacatactaaatatcgaaataatatttgtctcaacacggtaagataatcgatatatgaataataacatggtaacatactaaaaatcaaaataatatttgtcttaacacggtaagataatcgatatatggataatatttatttgaacgtactaatgttttagttaaggtactaatgtttcatccaactttttatttttagtttaattaatttaggggtataagtgtcataaaattaaaacagtagaagacaacaatgttttttttttgtcagttaattatcagttcttctgggtatagataatcatattacccaaaactataacattagttacttttattccaaatatatatgaattactaaataagtctagtatatttggatttataattttaagggtttgttacactatgaggcactttcggagaaacttaattcactttagacactttaaaaactagaggcactttgccttgcttttggagtgaaataagacatatatacccccactaattcgtttgagatatttctacaaaccggtttatggtttcgtttggtattggtctaaaatatacggttattatggtcggtttagaaaaaacagtttgggcgtgacgacgatcgtcggatttcagtaaattaaacggccgagattaatcattgtaacttcccttgcttttcgactttattcaaactgaaacacgagatccattgaaacacataagattctgggtttcaatcatcgatctttggccaactgtcgtgtccaaggaggtacgattgtagaaaactgatatcatgatattaaaacgaaatttcgtgcattctatttgttacgggaatcagaatataaccaaatttatttttttcgtttatctgtacagggatcgatg

SEQ ID NO: 35498 - DNA, 3000 bp, Unknown; identical to SEQ ID NO: 15372
  misc_feature (1)..( 3000): 2750-1469P.txt file - cDNA_ID_3088151; gDNA_ID_2926131; Annot_ID_196919

SEQ ID NO: 35499 - DNA, 3003 bp, Unknown
  misc_feature (1)..( 3003): 2750-1469P.txt file - cDNA_ID_3088168; gDNA_ID_2926132; Annot_ID_196999
cctcttttttttttcttttttttaatgaatattgaatttttatcataactctaaagaaacctaaactaatctctgataaatatattttctattttcataaaaaaaaatgggcatgcttgcatttaaaacgtctataataatcattttatgtatatttaaaaatattggtatgcttgtccgtattagtcacgtgtataggaaagtgcagacgggttagctaactatgcttttttttgtcattagagttttattctttggaggttgttcctattgattttgtttctgttgtaagcgatgatgtgcttaggttgggtctacgtgactaaggcaagtgtctatgtagtttttttttgaagttttaataaaatttagatagattttttcccggtgactagaagcttcatcgagataggagcgatactacgaataaggtatatggggcagagtgccctaccaaaaaaaaaacactaaaaaaataatgaagatatgtggagtttaatgtagttattttgaaaagaaatgtgattgaatcctaactatactcatctaaccaagcttataattcgtataattcgtataattcgtattgggctgcatgtttgagaaagactgaccatattttttagtatcataaagttcgatcagtaaaaataagaaatgatagcttagttagattctagtaatactatcatgttttaattgtttatatataacaattgtatcttacgtaatataattcatataacaattgcatgttgtaaaattataaaatatcttttcatttaaaagattcgactaaatacatatctcaaaaatgacatttttagtatttattaaataacaacaattgtttttaaaacacatgcaatttgaattgaatgaatgaaaataacacaacatcactagaatataaatcactactttagaaaatcatagtcaatgacatactttttaaacaatatttttgcaggaggagagagctggattaagatatgagataacttgcacaaaatgtgatggacatctaggtcatgtcttaaaaaatgaaggttttccaacaccaactgacgaacgccattgcgtcaacagcgttgctctcaagttctcttccgctatcacatctcagtgataaacggatccggtttagttctccggaatcaactctatctatctatgaacgttgattactaagagacctttctacttctgttagaatgagaacgttgtgttcttcaattcatcgcatttatgaactattataaaattgaatgttttgtgttttcattatttttagtaatgcttatgtacgtatcattgaaattgtttgtgtcatatattgtgccatttttctattgagtgttaatgtattatcgtatttaccaaaattatatatagttattgtctaagtctgcgaatcatttgccatttggatacacatgcatgtctaaacaaacgtacacatggggatgtgaccgaactatttttttgtttgtttgttcttttaatatcattgacgtttttaccttacttctcaattgttcttctttttccgtaatcgacaccgtagagtttcgacgatgacatgacgcggccaaattcaaagcaattttaatccattcagttcttgtctatgattagatgccttgagttccttcctgtcatcaaaacgaatttaactagatccattggattttcaatatgttggtggcggagatgtatttttttaatcgcaaacaaaagagataaagtttgtgaaattggtagagaatgtgttgatggagttgacagatatggtgatggagttgatggagaatgctttgatgaagaaatcacggtgttgatgaagtaatcgcggtaaaacaaagtgatggagacaggaaaaaaaatgacggaaacgatgatgaacggtgtttgagatagggtaaaattgtcaataaaattttaataagtatccaatcctgtaaacccaataagagagtgtcatttttcaaaatttttggccccaaatatatctgattgtataaaagtccctaccaatcacaccctatgttttccgttattgttttagtcatatataccatattcaaattttatgtaaattttatgtaaatatgttcttcaaattttttaaaaaatcctggctgacccggtccaagtatgtcagttagctaatagttgtgtttgttagtcggagaagtctatttagctatataccacctttcatgatactattactatcccctgttgttttttttactaatacgttattgggatgagatgccatctaaaaggggaacttctccaattctgttcgttgggaccactccagattttacaatcccggcttatgagttttgagaccactctcacttattttatctacattttgtaagagtgccgtgtttcatacttagttatttctctgataacaaacaaattggggttctgttcttaaaatatataaaagcccgtgaggcccaacaaacggaaagtttggcccgtgaaagaaagaaaaacaaaacttatttattgaaaaatgacacgtgcagaatcatttactaaaccagacaataaccggttaacggtttaatagttagcaacagaagaaccaaaggattgtcttcttccacaatcagaatctgtctgtgtggcttgtaacgcttcaatgtcagtgaagtctttagctatatccacaaaaataacataacaagattaaaaaaaagagagaatattttatctctctagacttgacaatttccctctctttctcactccctatacctgtatatgtatatagaatcgtatatatctggagaaatacacgaggtgttctcgtctctgacgacgtggtctattgtcttcctcagctttagtcaatttcttctttcggaaacttggttctgtgatattatccaaacttaaagtttgagtctttagggtttatgggtgacaacaaaagtacatgcctttaggctttagttttgtgggtttcatctcaaaatg

SEQ ID NO: 35500 - DNA, 3003 bp, Unknown; identical to SEQ ID NO: 35499
  misc_feature (1)..( 3003): 2750-1469P.txt file - cDNA_ID_3088168; gDNA_ID_1621196; Annot_ID_174747

SEQ ID NO: 35501 - DNA, 3003 bp, Unknown
  misc_feature (1)..( 3003): 2750-1469P.txt file - cDNA_ID_3088172; gDNA_ID_2926132; Annot_ID_196998
ccatgttttcaaaggagaaggttacggtaatccaaccgatgaacgtcattgcgttaacagtgtttcgatcagttttaacccggcaaaatcttcctctataatctgaggatatgattgatcgatcatacaacatcttctaatcagattgtgttgttaaaattgtcatcatgtagtgaatatgcactttctgtggtggtcaatataatgcaacaaataataagactcattagatattggatggttactggtttctcttaatatgttatagaacatttaataacgatttaattatctaagggatcattactagtgtttcttaattataactctttagaactgaaaaaaaatattatagagatttcgttttgacagaaaaaaactcaaaccgatccattttactttccattttgagtgtgttgattttaaaaaatatgatacgtttttattactaatgaaaatagaagatattatttccaatagtggatctcatatgtgtatccatatcattattttcataattgcgtaaaatatctcgtttcatatatatttgtgtgagataatgggttgagattaggagtgggcattcgagtaagcgggtcgggtttgggtaaaatccaatcgggtacgggtttttcgggtagataaatttaggacccaatagggtaaatataaaatatcggttcgggtttaatcgggtttggctataaatttttgggccttattttgaaactgatagccggatttccgggtaaatacccagatttttcgggtaaatacccggattttcgggtaaaatttcgtgtttcaggtaaaatttagatttttgattaaaatattcgggtatttttgggttcgggtttggatcgggttcggattcggtttttcggatagaggaatttaggacccaataaggtaaatcttcgggttcggtttcggttccaattttttgggtcagtttcggttctggttgttggttccgattttttcccagcccctaattgagacgttggtttgtttgccaataatttgtcatgtggaaaagtactcgaatgtgtttttgattcactataaatggttgtcccgttttgagtttgataattcattagcatgtgactatatcatatatctatttattacactagaagcattattctctttttaaagcaatattctctgttcgaattaaactctagctatcttttacatacctactaatggatattttcatttgggatatcgaccaatcaaaaccacaaattttagctgatcaagatgggatctcaagtttggtaggtatggaaaaatacatacgtacacatccagagagcgaagaatttgtgatgaatttctaataaatatatgagttgttgagaaaacaatatttcaactaatcttatatttataatggtcccatgcatgatacaaacgtggtcgttatctcgtccatatgaccagtgaccacatatgtttcaatacgtgtttcatctcaatgcttcacaacctccatttgtattgttccgcacaacttaatgttatgtacaagttgaatatgcttattatgtagtaaaatgtaaaagacataaatcaattcattagtagtaaaacaatatattctcgttgtcatcagtcattactcatcatttggcaccaaaatgcggaagccaagccagctgtgaatggtaagtatattaatctctattcacatgcaacatgcactagtgtgtcagtaatttggtccatgacaatacacatgtgtgatctagatgtccttgcttcttcaaaggttacagcacaaccatatctagtatattactagaaagagaaaagaaattttgttatagcattcatctaaaatgatcagagaaaagaaattttgttatagcattcacctaaaatgatcagaacaaatctgaatgaaaattcagtatatatatatttagacgtttagattgtgcagacaaaatgtatttagtgctacaactgatgtgtaatgtatggactactttcataaaaagtgcagaataatatgcacggaacaatattattacaagttctaagattattcatatctacaaagattgatatttttaataataaataattcgagtttccaaatcgatttttaccatttttattttaaattgaaaaagcaaaacattcatgcaagaaaagttaaaaacaagttagtggaaccaacaaaaaaaaaacagtgttaatgaatgtcccaagtccgaacttttataatggtatcttttcccatgatttattcatgatttagacaataatagggatttacggattttgccattttttgctataatttttacgaatttgttattttgttaaaattttacggatatactatttttctatatattaaaaaatgttcacatttatgagtctttttttgcttaaatacacattttataagttataacaaataataaattctataaacaaatagaaccgattaatttaaatataataggtaaaacacatgttaaatcgtatttttatattataaatttttttttattcataaaactttagacaaaaattgcaaaatccataaatatcactaagaaaatggcaaaatccgtaattgattccaaaaatatgacaaacttttgaatcttttaaccaaaaaaagaaaacagaggtttttataacaagttcagtttacaattttcaacgtgtggtttctctattagaaccaaaagaataatatatatccaaacgtgcacaacgtgtcaatttttttgttacaaaatgtgaagaacaaaaaaaagtgtgaaaagctggttatgagttatggatctgcgcctataaatatacaaacatttctccatccactccatagccaaaccatactctccaaagtccaagctcacaatgaacacttcgtaagtctctctccctctctcaaaatgttctttttgtctgaaatgtaaacacaattttttgttgctctcgttgctcagcccaaaaatggaaatggaaatg

SEQ ID NO: 35502 - DNA, 3003 bp, Unknown; identical to SEQ ID NO: 17643
  misc_feature (1)..( 3003): 2750-1469P.txt file - cDNA_ID_3088172; gDNA_ID_2926132; Annot_ID_138798

SEQ ID NO: 35503 - DNA, 3003 bp, Unknown; identical to SEQ ID NO: 35501
  misc_feature (1)..( 3003): 2750-1469P.txt file - cDNA_ID_3088172; gDNA_ID_1621196; Annot_ID_174746

SEQ ID NO: 35504 - DNA, 3000 bp, Unknown; identical to SEQ ID NO: 8151
  misc_feature (1)..( 3000): 2750-1469P.txt file - cDNA_ID_3088178; gDNA_ID_2926132; Annot_ID_196994

SEQ ID NO: 35505 - DNA, 3000 bp, Unknown; identical to SEQ ID NO: 8151
  misc_feature (1)..( 3000): 2750-1469P.txt file - cDNA_ID_3088178; gDNA_ID_1621196; Annot_ID_174741

SEQ ID NO: 35506 - DNA, 3003 bp, Unknown; identical to SEQ ID NO: 24393
  misc_feature (1)..( 3003): 2750-1469P.txt file - cDNA_ID_3088186; gDNA_ID_2926132; Annot_ID_196990

SEQ ID NO: 35507 - DNA, 3000 bp, Unknown; identical to SEQ ID NO: 15396
  misc_feature (1)..( 3000): 2750-1469P.txt file - cDNA_ID_3088190; gDNA_ID_2926132; Annot_ID_196988

SEQ ID NO: 35508 - DNA, 3003 bp, Unknown; identical to SEQ ID NO: 21606
  misc_feature (1)..( 3003): 2750-1469P.txt file - cDNA_ID_3088205; gDNA_ID_2926132; Annot_ID_196981

SEQ ID NO: 35509 - DNA, 3003 bp, Unknown; identical to SEQ ID NO: 21606
  misc_feature (1)..( 3003): 2750-1469P.txt file - cDNA_ID_3088205; gDNA_ID_1621168; Annot_ID_173901

SEQ ID NO: 35510 - DNA, 3003 bp, Unknown
  misc_feature (1)..( 3003): 2750-1469P.txt file - cDNA_ID_3088209; gDNA_ID_2926132; Annot_ID_196979
tgtccttcaagatagactcagtagaacgagagacgccggagtggagacgttggtttctttctctccaaattgcataaacacaagagtgaaaggccagcctgataatgagacaaatatttttttcccttgagggagataagagccagttaagacagtccattaattgggcaggaggattaaggttggttgaggctgtaaaaaacctccacacgacaccactaaactggcactcaaagaagagatgtgctctcgaatcgtcatgagcattgcaaagaagacactcagcagggatcgagagaccccaattctgaagcctatcccttgtgtgcaatctattccacgccacaacccaacaaatgaaggcgtgcttaggaacatggttcttaaaccagaccgccttatgccaggggacggtgtgagattgcggatgcagagcagaccaagttcttggagcggagaatctgtttgatggtgcatgaaggtccgttttccaaagaaaggagtcgtcatgctgacagtcaagcaaaccctgagcctccgggagaagatttttaagctgaacaatgattggattcctgctacggcttgatgcaatccaccaagacgtgccccttaacgcatccctaaccacagcatcaataggcaaaccaactgtacgagggcctagaggaccgattacctctataagggggccaaggccaatccaattatcatgccaaaacttagcggtgaccccggaaccaacctcacaaacaataaagggccttgccacaactctgagcttacacatcttccaccatcttggatatcatttcaacaccttcaaggacatcttcgtcctctacatgagaggaaaggttcttcacataagtggagtcgaatcctgtaattgtggagttaaaatagaaaataagacaaataatgaagtagttcattaaagagttttattaaaatgcgaggaaccaaaaagaaaaaatttatatttgttttagttcataaaagattgaatgtggctgcaccaataatcagctttggctacattaatttacacaacatatatatggacttatatatatgaacccatatatatatatttatatatatgaacccatatatatatatttatatatatgaaaaactcttattataaaacctaataacattgatttagatggactacactaatgataatatcttgggtttttatgtgtgctcttatactattgtcgattgtatgatttattcttcatcggatctaaagcaatactcaaaaaggtttatgtgtgctcactcaaaaccttaactaggggttcaacaaaacaaaacaaaaaaactcaaaggagatggatttcgagttgagaaaactttcaagaacattttcaaactctagaaaaaaggaaagcttcattctatgaatggagttaaatagaaaataagacatgaaataaagtgattcattaaaaagttttttttttctcataagtgttatactttattttaaaacttgtgttgtaaagatacaactgtggaaccttccacttacaaatcttgacagttgacacatattaaatcttacaacgttggatcaactaaagtatagtcatccatgttgcataaaaacaaacaagtctagcttataagcagatgcccataaagaaagcccagtccaggaaacaaaacccttagagaaagtaaatttaaagattgccttccacccaaaagccacgtgtgatgtgaagaaacaaagttgaaacacgtggactgaagaagccttagtcgtcgctgttcatcgccgaactggttagcaactcagagaactccaaaaccatggaaaccgccagagcttcaagagaagtctatcaatttttaattagagaaccccaccaaacttcatcagcaaatcaggaaaggaaagatctaccaaaggcaattgactcccgaaatccaaggaacatcgacgtagagtaagtctttgagctttcaacaacacctaaaaacaaacaaaaaagcactcgtctccataaaacggttagagaaatagccacaattgcattagattcaaccgagaggcgtaaaaaactttaatctgcaactcaatttgttcctaaaaaattgaaatcgataagcttggaaaacaaatcgagccctttaaacaaaggaggttcaaggaattatattccaaatggaaacacaaaagacctcaatcaaaccaaatataaagaaatcgagagatgaaaacataaatctaaaccggaaatcaatttggccaaaagctagacgagacaccgaagataggcggtgaaactctggaccttagctagcccaccgccgctaaagaagccaacggaagccagacgcaagcagaccaccgccgtaaaaaaccggacagtgtcagaacgaaaacagatcaaacgttgcccaaaacgtcgctggacaaaagccagacatccatactgaaaaagccataaattctggacagaaaaccggccaacaaacgttgaagaagcgattattgtcggaaaaagaagatccagtgcttcctctctctaaaagatgctgatgagagaagagagagaaccaccaagatttatttaaatgcaaggaacaaaaaaatgtttgccttcaaggataaaatagatatagatttaatctctttaaatttaatcttcgtcaataaatttgcttcatgagttaacgcgatcaaactaaaaaaatctttgttctctcacttagcagctcattttagaaattctcatcgccgttcgtttgccgtcccgtttctgttgggcttaagaacttctcctctgtagtatatcattatacttgagcggagcccttgtccgaagaattaccagttttttgttggagttctgattcagttggatttcatttgctactttcaaaagttggtttgctgtttcaattaggctcgattctctgtgaattgattgcgcttggtttcttatcgaagttgattcaagtggatttctcgtcatgaatatg

SEQ ID NO: 35511 - DNA, 3003 bp, Unknown; identical to SEQ ID NO: 35510
  misc_feature (1)..( 3003): 2750-1469P.txt file - cDNA_ID_3088209; gDNA_ID_1621168; Annot_ID_173899

SEQ ID NO: 35512 - DNA, 3000 bp, Unknown; identical to SEQ ID NO: 6114
  misc_feature (1)..( 3000): 2750-1469P.txt file - cDNA_ID_3088222; gDNA_ID_2926132; Annot_ID_196972

SEQ ID NO: 35513 - DNA, 3003 bp, Unknown; identical to SEQ ID NO: 28497
  misc_feature (1)..( 3003): 2750-1469P.txt file - cDNA_ID_3088238; gDNA_ID_2926133; Annot_ID_197066

SEQ ID NO: 35514 - DNA, 3000 bp, Unknown; identical to SEQ ID NO: 15415
  misc_feature (1)..( 3000): 2750-1469P.txt file - cDNA_ID_3088254; gDNA_ID_2926133; Annot_ID_197060

SEQ ID NO: 35515 - DNA, 3000 bp, Unknown; identical to SEQ ID NO: 15415
  misc_feature (1)..( 3000): 2750-1469P.txt file - cDNA_ID_3088254; gDNA_ID_2926133; Annot_ID_138827

SEQ ID NO: 35516 - DNA, 3003 bp, Unknown
  misc_feature (1)..( 3003): 2750-1469P.txt file - cDNA_ID_3088258; gDNA_ID_2926133; Annot_ID_197057
ttagaaaaattattgattgtagagaggaactaccttttggattaaatttttgtaaaaaattacaaattttttaaaatctctccataaattaataattattaatttatcgataaattaatacctctctaaattaataaatttttgtactattattacctagaaagtgaaaattgacctacaaatatatcttcaatttgattcacatatacgaagtcacgtatgtttctataaatttagatccaaaatgtgtgaaaacccatctgtttttgcaaattcttgcaattgcaattgcacatgtttctattacgtttaaatcaatcgagctctaagtgatttatccatagtgatatacagatccaatatccatgaaacatatttaattcatgaaaaggctcaaacattatcaacaaataagatatggtcaactatgtagtaactagtaacacgtaggctgctgctctttgtggcaaattcatgcgcaagcaaagcctctagatgtttgacaagttactaccctaatatagcatcactagctatcttctaatttttttttttagttattttaatcctgtattcttttatttatttatttgataaagtgatgaaattttattctcctttttcttatcaactaatatacttattcattcacataatttcgcactttgcggagttttcatttgtcgttaaacccgacagattcttgaaccgcaaggaacgagacattaacctaatgtacttatatttaactatagtattataatagcataaatgtgacaatgattcgatcactactaatatattaatcaccaatctatatcgtcgtccttcctgattatttgaagattttgtctataaactagctgcttttgtttatgtatttttattacttggatgcttttgtttgttggaatattcgaatgaatttttgtttgcctgaaactatgcatatataataaggccatatgcgccaataatatagaatccaaatattcattaactataattagtttgttctagagttttagctactcatatattcaaattcttaggagatcaaaaaagtacttaattagttaataaaatccatttttattagttgtaattaaatgtaaagtgtcgaaacacgaaagggaagatgagttgcacaactcgtggttcctataagagtgataatctatctgacgtcacgccatgcaaaatgtatcaatcaattttcttctcacatttatatttacttcaaaatgattataaagccacccaatgaataataagatatatatatatatatatataactcaaaatcaaaaatttcaaatggaatttggaagcatcacaaattcacaatcatgtattcaaaatctcacgtagaaaaagctaataagtccaaaagattggtcttcatttttttcttgagaaagtttgatgggatagagagagagacagagaggaacagctaaatttgctgtgtatgtatttaatacttgaacatttatttatctattttcttatacatcaaactcacgaatttataggttggtaatgtcgtttttataacattaataaaaattgcaattgtagtttttattgaaatttacccaaaaaaaactattatacgaaaatatgttatttatttaaaatttgatattagatgaatccagaatcttttataaaacttggtgtgtgtgaacctgcgttaatttgttaaatacttttcacgtaaaaatcaaaattaattttaaaagttatgttaccaaacagtattctgatagttttacaaattttatccattgtatatgttttgtttttgcaaaaaagtccaaaggaaaaaacaaagcagaagggttgaattgtgaggaaagagagagtacgtggcatcataactttggcgacagctaatgtgaaaacagccaaaagctacggagagcgacactcctcgacgacgtccatgtctctttagattgtgattgcattgttaattatcatatttatcaattgattagttaagtcttaagtatcatcacacaagtttatacattaatctatacagtgtttaacactacaaaactccccaaaatcacgtgtttcatatcatacgtacatttgtctaccgtctttattaacaatattaaaacagaatttatcaattttctagttgaatagactatatactattatagagactcttataaattatgaaactcctaatcaattaaaaatagttaatttgaaacatatcactcgaaactagggtattagttggattgacgatatttttcttattaatatcaacgagaagaatcaagtgtcgttagctcaattggtaaaaaatttaggcaaagcttagagatgtctatttgagtgacgcttggaacaaaaattacatgctatggtttcaggcctagagaaatgcttcgatccagaatctcttgatattcaaaaaaaaaaaaaaaatcaacaagaagaatgtataaatggtttctatactatctaagttatgaaaaatatttttggttacccaaattacaagatttgtaccgaagtgtcacactagattcacatgcatgcatagttataattaacttaaaacataaatgacttacaaaaatacttacaaacaaaaaccaaattaagttatttagtggccagctttgttactagagttttagccattatcataattcacaataaggtgtaggaaaaaacattaatatatagtatgtatacatccaaaaaaaactttttggaaaaaacaaattttgggattataaaggacacgtagcccaatcgatgaacagaggacggcaccgaatcaatttgacttcaccttttttccccatatgataagagtctcatctctttcctatatatatttcgtacctctctttaaggaccctacgtctctctctttctctctactctctgtttcctcataattcaatcactatatttttttaaaaacatttgacttcatcgatcggttaacaattaatcaaaaagatg

SEQ ID NO: 35517 - DNA, 3003 bp, Unknown; identical to SEQ ID NO: 35516
  misc_feature (1)..( 3003): 2750-1469P.txt file - cDNA_ID_3088258; gDNA_ID_2926133; Annot_ID_138824

SEQ ID NO: 35518 - DNA, 3003 bp, Unknown; identical to SEQ ID NO: 21613
  misc_feature (1)..( 3003): 2750-1469P.txt file - cDNA_ID_3088281; gDNA_ID_2926133; Annot_ID_197045

SEQ ID NO: 35519 - DNA, 3000 bp, Unknown
  misc_feature (1)..( 3000): 2750-1469P.txt file - cDNA_ID_3088281; gDNA_ID_1972068; Annot_ID_178497
ccaccactttgtctttctcttctccttctattcccacaaacgtcactcctgctccgttatttaaacatgagaatatgagatcattccatcaagcgaattagaacgaatataatttgctatccatagcatcagtgccggctctaggggggtgccagaggagcaaaagcacagggtcattaaatttttttccaattttacttgaggttttagggtccaaaattttcagtaattaaaaaacagtattaactaaagccaatttctataaatcagcacaaggtctttaagaagtttgagccggccctgcatagcatagtcaaatgccggttcgatatatatatttggattctaattgatatcttaccagtggttttggctccgatcttgagggcttctgaacgacatttgtcgcacctcatacttaccgacatcaagattttctgctcatgaaaattccaatattacaaataataatactgctacgtatatacttcatcctaaaaccttccgtatatatgttagacttttagaatacaaatgtttttagcgtaccttggccattttggaacctcttggagaaaatgaaaccttattttttttgtccttttggtataaatgattactataatttacgtgtgtaaatatagaagtgcttctgtctttgtctcattttcttatggcacattgcttaacatgtattaatatgcatattttatttgtactattatttgctacgaaatcgcagagtaattttcatgcaactgcttcgtagttaatattagtataaatgttgacgtttaagtggacaatataaggtattgcttgactcataagggttagatttggttaggtaaaggttagatttttatcatgcacatctaaaaagtcagtaccgtgaggaccacgaccggtcctgaattataaaaggcccgaaaggaaactagtcccttatttcgtgtttctgaataaaacaaattattaaccttaaaaccaaataaaatttagcaaactgaaaattgtaaacaaagaaacggcactacatcctacttgcaaagaggtgtcgaacggaccggcccacaatggccattagttttagatggactgcaacggagcagtccgctaggaccgcagacaaaataactttctccaggttcgccctgctaaacccaacaagtttatggaccgatccgtaggcttagtttttatatttaaaaaataataaatatatatattttaaatattaattttagttatttttaatttaatttaatttttaataaatactttttgtaaatattacaatttaaaaaatttaatttcttcatattgttacatattttacatattataataggattcataattaagtaaaattaattattcttacaaattatttatttatttttattgaatatttgtagtctgcaggtcaatccgccaaaccgtgggtcaagtccactaaaatccgtaatccgttttggccgatccgcaagacccgttatttttcggatatataatatagtgtccaaacccgctccatcatggtactagcccgtgagtctttggcccgcttgacactgatacatacatagtttaaaaaaaaaaaagtatattcgggtaggtccaaaaacgggttgatcagttcgcgggtaaaaccggttcaaccaccggttaatggtttaaccgtcgttttaagttggttttgtttttcctcctgaaacgacgtcgtgtctctctctctccctctatcttttgcgactctcctcgtcttctctgttcgtctgccatatgagtccttcccaagcccaacttttctgaaattgaagtgagtttcttcccgaatcccttaaagtttcaaacttttcaattaacttattcctctttctcttgtttctatccgaatcgtgtgagggttttcattttctatgctctgatttggtctcaatcgatgtacgtttataatgaatgtgtgttctaaattgtaataaaaaatgactagtaggtactagttgacagctctccacagttgaaaatctctcttttgtatgaggtaccaattgacagtctttgagtctttccttgttgttttgttatcaagggttctgagctttgtgtctttaggttaattttctatgttgtgttatggaaaattggtcagtgaatagccaaaccaaagattgtgaaatctgcattttgattttggtgaaaaaaactgtatagaaatgtcttaccctcaagaaacttttatattgcataaatgaatagcttagttgttatagggtttggttgtttcaataacaaagaatagaatttggtttcttatactttataaacttccttctttcagtcttttgggacagagatggcattaattcagaaaccagtggtgtgcaaagacactaataagatcttcatgaagcaaatacttgcgtttactgaacaggtataatatagaagtgttcatgtatatctttctaatagtgtgctttataacttgtaaatcaggtcttttctgaatctctcgctttccatatgaaacctctttgtgaattacatttctagtttgagacaatgtcatgtttgaggtggttaagacgataagaacgttgacattttctgattgaaaataaaagacctggcttccattaactctgcattggatgcttactctaattattttctgattaaagaaagacattcccttaatttataggtgaccattacacagaacagtaagctctcgccacgcacatggcacaaggaagtgatataaacggactaacttgtagtctctttcccctgtcaagaattagcaaatcatccttcttttacttggtatcattgacttttttttttggtggttggggaacttaaatatgtgttttttggtatctctctctctgccccctcttcttggtatcattgacttttttttttggtggttggggaacttaaatatgtgttttcaaacgatttttgtgtgatgattttaggattgtgatg

SEQ ID NO: 35520 - DNA, 3000 bp, Unknown
  misc_feature (1)..( 3000): 2750-1469P.txt file - cDNA_ID_3088305; gDNA_ID_2926133; Annot_ID_197028
taaaaggcatgttcatcttgatgatcctggaagaagtgaatgggaaggttttccttctggaactaaggctgctgctgctggtaatcaaatctgtttctcttactgagactgttctagttgcatgagtgtgttctgctttgtctcttcgcttacgtgctttattcagcttcttaagaatgtctttgtctggcagggggaataactacattggttgacatgcccttaaacagtttcccttcaactgtatctcctgaaactttgaaactcaaggtaaagccatccactttagttttccagttggtaagctcgacactattcttacagctttttgcctttacagattgaagctgcgaaaaacagaatacatgttgatgttggtaaacactttttgctatcaaaccttaccacatctgttgattcaagacaacacatggtgtgccctaaatctttgtttccatttttctccagggttctggggaggtctggtacctgacaatgcactcaactcaagtgctcttgagtctctcttagatgctggagttcttggtctcaaggtagatatcaatctatcatgtgtcctataaagctgtggcttgcttttctgtctataatgacttgtctcaatctttgttcagtcctttatgtgcccttcaggaatcaacgattttccaatgacaaacatcactcatataaaggttttgtttcttgagtcttatgatccttctctcatgattcaatagttattacaaaaacctcattggcccttgtctcgctgatactgtttgtttatgcaggaaggactatctgtattagctaaatacaaacgaccattgcttgtacacgcagagatcgagagagacttagagattgaagatggtagtgaaaatgatcctcgttcttatctgacttatttaaaaaccaggcctacttcatggtgagatattgcatcttttcactctatatatataagttcctacagagtcatcattgtacctgaaaggaatatttatttgagcaattagggaggagggagcaatcagaaacctattatcggttactgaaaacacaagaattggtggttctgcagaaggagctcatcttcatattgtacatttatctgatgccagttcttccttggatttgataaaggtattcaagagttcaagcagtagaagcactagaatttggttgtatctcattacatattttttttgtctttggatggagtaaaggaagcaaaaggcaaaggagacagtgttactgttgaaacatgtccacattacctagctttctcagccgaagagattccagaaggtgatactcgtttcaaatgctcccctcctatacgtgatgcggcaaatagagaaaaattgtgggaagctttgatggtataatatatattttacgcaatctttgttgtgataccttactcgttgattctgaggttttgatttgattaggaaggagacattgatatgctgagctctgatcattcacctacaaagcctgaactcaaacttatgagtgatggcaacttcttgaaagcttggggtgggatatcttctttacaggttcgtttagtcttaaaaatgtaatatgtagaaactgtgagagcacaaaaaaactcatggaagagccaattgcagtttgttcttcctatcacatggtcttatggaaaaaagtatggagtaacgctcgagcaggtaacttcttggtggagtgataggccttccaaactcgctggactacactctaaggttcgttattataaaaaaaaacgcagcttcagtattctcttttttgtccatacacagcacactggcataatatagacgtgtttttattaggattcggggtccatttatcgcagcttataagtaatggtttaattatagggagcggttacggttggaaaacacgcagatcttgttgtgtgggaacctgaagccgaatttgatgtagatgaagatcatccaattcacttcaaacaccctgtaagtacacagttttttctagaaagatagctaatggttaagctcgaataacacgaatgtgtaatctttatgttatgtttgcttcttgtggtgtacaatagagtatctcagcttatttgggaagaagattatcaggcaaagtggtttcgacatttgtgagagggaacttggtttttggagaaggcaagcatgcttctgatgcttgcgggtctctgcaacttgcaactacttaacttaaaaagggatttaaaagatcttgatctgcaccatttaaacaaatgtaaatatgcgattaagagttgctctcatgttgcaagatggttgatgtaatgagtgagtcttttttgccaattgtaagtttaagactctctaaatcttgttgttggctttaaggttagtggactcatgtatatattgttgatgcaaataatttatatcgcttaagtaaatgatgtatatattgttgatgcaaataatttaaaagtatacataatatttgcattgcttgttgtaactaatgttaatttgagtcaactaaaaaaaaagatgttatctttttaaatcactttttgtaagtgttctaagtatttgcatcagtttatcaaaatcatatatatgaaagttggtcaaaatcatatatatttgtcatgtgtctattaaataattaatgtaagctcttcaacttctaatttataggttaatgatacatttattatttatttttatattattttattttacatatttaatgtactattactaaatttattttaatattacatgatttttcaataaaaccattttaatagttttttcatactcgaatattttttttgtaatccaaactcaaagtatgagtatataataatcatggattagttagtgatttgagtaggttattctcttaaattgatatttatataataaatcaccgagggtgtagaatacgtacaaacctccatcatttcgtctgaaccctcattttgcgccgattctgtcaacaatg

SEQ ID NO: 35521 - DNA, 3000 bp, Unknown; identical to SEQ ID NO: 35520
  misc_feature (1)..( 3000): 2750-1469P.txt file - cDNA_ID_3088305; gDNA_ID_1621171; Annot_ID_173983

SEQ ID NO: 35522 - DNA, 3003 bp, Unknown; identical to SEQ ID NO: 17540
  misc_feature (1)..( 3003): 2750-1469P.txt file - cDNA_ID_3088309; gDNA_ID_2926133; Annot_ID_197025

SEQ ID NO: 35523 - DNA, 3003 bp, Unknown; identical to SEQ ID NO: 17641
  misc_feature (1)..( 3003): 2750-1469P.txt file - cDNA_ID_3088313; gDNA_ID_2926133; Annot_ID_197018

SEQ ID NO: 35524 - DNA, 3003 bp, Unknown
  misc_feature (1)..( 3003): 2750-1469P.txt file - cDNA_ID_3088380; gDNA_ID_2926134; Annot_ID_197098
tcccagacgtgttatccaagagaccagtaagattcaagattcgtctgtgacggttcaagtgcctcaaatggagcaatctccagcgtcaaactcagtcaaagagatcactgacccgaagaagaagattaaagtatatgtggtggcagcttcaagtgagtgtaaaggtctgaagagatttattgaggtggatgtgaactcgacggatcaagtgaaaatactgagaaccgagttggttgaaagtggtcggaggggtcatataagaatgcctcacgaaggatatttctttgtggacagaaagaaagagagagtattgaacgaagatcagtcattcgagtggaaccgtgttcttccagccgaaacagtttatatggttagtggacgtgatacacattttgcctcgtcttttactcgtggctctaaagtcacaatgctttgtgctcaaaaagttctgtagaaagtctgtatatatgacacagaagaaaccaaaaactatgatacattcagcaacagaaagttatgtggatctttaactctttgctaataggttttaatctttcttcaagttttcttctggcccttaagtcacaatgctttgaaatttttgagtatatgtagatacatagaagaaacaaaactatgatacatttagtaacagaaatttatgtggattttatcctatttgtaggtgtaactcttttcttctaggttttaatatttttcttcaagtaaacttgttgttattgaattccctttagtcgaaagcagcgatcaagcttctcttataagttacaaaccctaatttcagcaaacacaacttggaaacactagcagcaacaactttgttattttaaaacattagcaaaagaaatctcattgcaacatcaaatggcaaaactggaaggtaaaaaaagcagaacttatcaaacaagactaccaatatgatgaactgatgatttttttttttttttttttggctcaacaacaaactttccattcacccatttatggatacacagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagatg

SEQ ID NO: 35525 - DNA, 3000 bp, Unknown; identical to SEQ ID NO: 9304
  misc_feature (1)..( 3000): 2750-1469P.txt file - cDNA_ID_3088380; gDNA_ID_1972068; Annot_ID_178445

SEQ ID NO: 35526 - DNA, 3000 bp, Unknown; identical to SEQ ID NO: 15447
  misc_feature (1)..( 3000): 2750-1469P.txt file - cDNA_ID_3088384; gDNA_ID_2926134; Annot_ID_197095

SEQ ID NO: 35527 - DNA, 3003 bp, Unknown
  misc_feature (1)..( 3003): 2750-1469P.txt file - cDNA_ID_3088384; gDNA_ID_1972121; Annot_ID_178987
atgtaacaagaatgatacacaaaacattctttgaataagttcgctatgaagaagggaacttatccggtcctagatcatcagttcatacaaacctccatagagttcaacatcttaaacaagaatatcctgatctgaagaatgtggaggctttagtcccttggatacttgggaggctgtggaagaacagaaacgagctggtgcttaaagggagggaatttggaaccaatgaggtattagtaaggacacaagaagatgcagatgagtggattagaaggaaagaggctcagaatgtaaggaaagcaccaaccacaacaccgtcgggacagacgagaaacatgggaagctccaccacaatcttgggttaagtgcaactttgatggggcatggccaacagaaggattaaaatgtggcttagggtgggtgcttcgcgatcatacagggaaggtgttatggttaggtgcaagagctgtggtaaaagtaagaagcgtgctggaagtagaagtggaggctcttagatgggctgtgctgtcattatcccgattcaattataggaagatcatttttgaggtggattctcagcaacttgtgtctttggttacatgaaagttatgcttgtcaagtctcaatccaattatccaagacataaagtatctacttagcaagtttgaggattttatgcttgtgcatacaagccgagaaggaaatggagtggcagatagaatagctaaggaatctctttcttttgagaattatgatctaaagttgtattctattgtaccaatttgggttaaaagctctgttgagctagactgtgtatccataaatgggtgaatggaaagtttgttgttgagccaaaaaaaaaaaaaaaaaaatcatcagttcatcatattggtagtcttgtttgataagttctgctttttttaccttccagttttgccatttgatgttgcaatgagatttcttttgctaatgttttaaaataacaaagttgttgctgctagtgtttccaagttgtgtttgctgaaattagggtttgtaacttataagagaagcttgatcgctgctttcgactaaagggaattcaataacaacaagtttacttgaagaaaaatattaaaacctagaagaaaagagttacacctacaaataggataaaatccacataaatttctgttactaaatgtatcatagttttgtttcttctatgtatctacatatactcaaaaatttcaaagcattgtgacttaagggccagaagaaaacttgaagaaagattaaaacctattagcaaagagttaaagatccacataactttctgttgctgaatgtatcatagtttttggtttcttctgtgtcatatatacagactttctacagaactttttgagcacaaagcattgtgactttagagccacgagtaaaagacgaggcaaaatgtgtatcacgtccactaaccatataaactgtttcggctggaagaacacggttccactcgaatgactgatcttcgttcaatactctctctttctttctgtccacaaagaaatatccttcgtgaggcattcttatatgacccctccgaccactttcaaccaactcggttctcagtattttcacttgatccgtcgagttcacatccacctcaataaatctcttcagacctttacactcacttgaagctgccaccacatatactttaatcttcttcttcgggtcagtgatctctttgactgagtttgacgctggagattgctccatttgaggcacttgaaccgtcacagacgaatcttgaatcttactggtctcttggataacacgtctgggaacaatcacaattgtatccaagggtttaacactgttacactcgtatgactgatcttcgttcaatacttgattattgtgcgtaaagatgtacccttcttgagccagtttcataagacctctcagtgttttcacctcatccgtaactttcacttgcaccagaatattcgttgggacttcattcataccaggatatggcgacacatatactagcatctgccggactcttttttttccgttagtgatctttttgactaagtttgactgtggaaattgcttcgttggaggcacttgatcgttgttgttcttactcgcaaacttcacagacgaatcttgaatgttaacggtctctttgactgagtttgacggtggagattcctctgtttgatgcgcatcttgaatcttactgatgtcttgggttgtctcaggccgataactgtaaatctttctgatctcttcctctgtcaaaggccaatcttgctccgcaaagtactcttcaactgaaatccacggtgctggaggagattgctctgtttgcgggatttgatcgtcgttgttgtgaatagggttcacgtcaggagagacttcgagttggatttgagaatcgtggaagatctggcattggtcgaggttaagatcttctcgaagaataaaaatgccgtcgacgataagggtttgtttcgaaactgggacacgttgagacttctcgatcttctgtttgaccactaacaatgtatctgtgcgttccacttcaatctcgaacgatgaaccacccagaatctcgaccacaaacttcatgactctatcaatggtgtttcaagatcaatggagactaatgaagaagagagtcaagaaacagagagagcgagagagaaagtgattgttttgtaaagatagttcacgatagaatttggttttaatatcattcattcacatatcaaatgaaccgcatttgggcttgacccatttttattgggttacgtggctcttaagtcaatgaaagcctcacataaaatcatcagtatctatgctacagtatattcttacttatattatccaacggtaatgttataaaaagattgattaaaactatctagatccgacccattaaaccgtaaatctacaaatccgacccattaaagattcttgccggagacgaaaggtattccgattgaggagatg

SEQ ID NO: 35528 - DNA, 3003 bp, Unknown
  misc_feature (1)..( 3003): 2750-1469P.txt file - cDNA_ID_3088388; gDNA_ID_2926134; Annot_ID_197094
tacactgcatattaactttataacataactcaagtgataaattgatttgacagccaacgcttactaacacaagtatgacattcatttcaaccgtaattgccccaaccaaattcacagtagtggttattaaagtgaagaaattactgacgatctctgactatctcatttcaaacatggttaacccgactcttcccgacgatttactctcgaagatagctaagaacctggctaaccaatgctggtccgaccttggtccactggtacgatccggcactcgtggaagagacattgtctaccgtccggatgtcctcaaagatgccaatattctcaccttgtgtaactcgcccgatgacttccaagcttgagggggccacaatccctccggatccgctgatgaaggccgacatcgaccattttttttacggtgttttgcagctaataatcccacggcagtgtattacgaaggtattcgtgttctaacgcatgaacgaaacatcaatggagccatcaggctcttacagcgtcatgctccagtacgagcaaatgcaacagttacatgcgccattgtattcatatgtgctgggtatgattatatgggcgacttgtttctacagctcttcacccgcaaccattatccattggactcggttgccactcgaatttgggtgatgagtttcttcaaggaaataaagaagtttgaccctgcatacaacaatacatatggtcctacgttctcttatcctaccagccatggaattagtatgcctccttgcgccttatattgttacatggtatcaggagctttccaaaacgtttgcaaccgctgttacctctgatcgtgtgccaggcgtgttagtcaaatgctatagttaaaatctaaagttgaatatttttcagccaaattcgcatatgatatttagttcccgaagtaaatgtaaatttggatattaaaatctaagcgtccacaactacgtacacgtgcatctaccaaataatacttaaaggttttttgtttgtctcggaaaactagatatgtacgtacactagcatgagatatcaactctaacgtacactaaaaaataacacattcaaacatatgaggtctttggtttgtctcataaatggtgatatttatgaatggacgtacactgatagtacactacagcgtacactgtttgttgggtaaatgtagaaatgtaaatgtggacgtacactacaacgtacactgtttgttgggcaaatgtagaaatgtaaatgtggacgtacactaaaacgcacactaaaacgtacacgtctagttttaagctgttattaaaaagtggttgctcataacaacaataacaaattatatatggaatactattacgttgatttgacaatatgaatacacatcatcacttaatacctttgcaataaatacaaccataacttacccaaccatatcttcaatgatgcttatttaagtgttggaatttcattttgttaaaacaccttactcctaaatataacaaacccaaatattcatgatgatttgcttgcgaagatagccaagaaaatggctgacaaatgttggtggtacctcggacctatgttgaaatccggtcctcgtggaagagacattgtctaccgtccggatgtcctcaaggatgcaaacattttcagcatgtgcgacgatcccgatgacttctacgcggtaggccacgatccaaatgacatcaactccgaaggtcgctatagacccttcttcaaacggtgcttacaagctggtaaccccacggctatttaccatgaaggactgcgtctcgttacacatgagtctgacattcagggagctatcctacacttagagcgaatctccccaaggaacgccgctgcaacccttgcatgcgcaattctttacatatgtgctggtaatgctcacatgggtggtgtctaccttcggctcttcggaagcaaccattatgctttggaatcggaggaggcacgtgacatttgtgaggaggtgctagaagatataaagaaatatggtaatactttaaaatacacatacgctaacagtttttcgtacccggaatgtggtgacttaagcactcctgaatgcgcagagatgtgttacatgagatcgagactcttcaataatctttgcaaccaatgttacatctggttgtgtgctaaacggattagccagatcctgtagagctcacattcgccacgatcctgtcatatttataagtttttcatgcaacaatatgtgagctttttacgttgattatcagtaatggaagtttgtttttaataattatcactttgtaattgattcaaacatactagctcaaactactctaatatgagacatcattaacacaaaataataataaaataataaaatatctacgtacacggtatatgataatgtacatgtggtatagtttaattccaactataaagattacatagtgagcgacggtatagtttgtaaatgaagacgaaagaaaatttgatttgacgtcgtataacacatatctagaagatttcgctccatattaattactcgctgtcaaatacacactagaagtgacctccatcacactctcattaatatctctattagacatacacggttcccgagcaacgtactcaattgatttggcagataaaataagtaagttaatgtttatttgaaaagattgttagtaaatgcgttgacccctaatatagcactatacatgaagccatattgttccacttatatgcaatacaaacagacgttaactcaaccttctgtaagaaaacgtaatgagtattttatagacatacacggcgcgattatgagaggtacacagtagtttgtttaaattaaaagttactaatatgatgcactaaatatacatccacgtcacccacccacttacattgatgattattcccctctttaaaactcatgtcaaacacacttagttgaatacacgaatccgtctaaacctcctcgtttgaaaaacaatg

SEQ ID NO: 35529 - DNA, 3003 bp, Unknown; identical to SEQ ID NO: 27972
  misc_feature (1)..( 3003): 2750-1469P.txt file - cDNA_ID_3088392; gDNA_ID_2926134; Annot_ID_197092

SEQ ID NO: 35530 - DNA, 3000 bp, Unknown; identical to SEQ ID NO: 7278
  misc_feature (1)..( 3000): 2750-1469P.txt file - cDNA_ID_3088491; gDNA_ID_2926136; Annot_ID_197205

SEQ ID NO: 35531 - DNA, 3000 bp, Unknown; identical to SEQ ID NO: 7278
  misc_feature (1)..( 3000): 2750-1469P.txt file - cDNA_ID_3088491; gDNA_ID_1621136; Annot_ID_172670

SEQ ID NO: 35532 - DNA, 3003 bp, Unknown; identical to SEQ ID NO: 21624
  misc_feature (1)..( 3003): 2750-1469P.txt file - cDNA_ID_3088495; gDNA_ID_2926136; Annot_ID_197202

SEQ ID NO: 35533 - DNA, 3000 bp, Unknown; identical to SEQ ID NO: 24102
  misc_feature (1)..( 3000): 2750-1469P.txt file - cDNA_ID_3088510; gDNA_ID_2926136; Annot_ID_197198

SEQ ID NO: 35534 - DNA, 3000 bp, Unknown
  misc_feature (1)..( 3000): 2750-1469P.txt file - cDNA_ID_3088527; gDNA_ID_2926136; Annot_ID_197177
ctagaaaaaaattacttggtagacgtggggttttccgtttgtcacaattaaattttactttaacaaatccaaaacccttattagacaaaagaataatgtgatcgtctctgatatgcattttgaagatgtagtttagcataatagtactgaatacaccaaattgtgtgaacaatacataaaacattctgtgatttagaacaggttatgtaagaactttggattatgaatagtagaagttgagccaaaaataaagtaaaataatatgttctatagatattgttttaaaaaagacgttttcattaaagtcattgtgtcaaagttttatcttttggttaaaaagctttgcatttagtcaagttacatttttttgttatgtttgcttaacttttgcttatttttcttcttatgttttgcttaatttttgcttatttttcatcttatgttttgcttaaatatatatagatatatgtatttataaaatagccacttacatcaaaattgaaactacagaaaaattgaaaggttaattttaaatttattattttggtattttagaaataacaagaaaaatatgcactttcaagtttagaataccatcgtgacatagagagtaattcagaatgatgaattggttcaattcatatactttagtaaaatggaaaaaatatagtcggatacttgtgtccatgggtgattctggtccagccccagaatttgtagtcccgttctcgtgagaaacctccctccgtatcgcaatagttgcttcgagacatgtcaatcctatacaaagccacgtctgtcaggtaagttcatctccattttttggctagattaggaagattctttgactttcctgtattatatgcgtattcataaaaccaaaaacattatgatctttgaggagaggatgacggaatgccggctaagctaaaatgtctgtgcaatcatccatattgcaattagaactttattacattttgatagacgaaaatcagataaaaacaaaactgctgacgaatcatgaaagtaatacactaagaggagagttagctagatgttggcgttgtgcttttttttgttaaaaatgatgttgacgttgttgcatgtatatatatcctcatttatttcctctttctcctttaaatcttaattcttaagtacatataaatatatatatatatatatatatatatatatatatatatttcctttggtaatcacaccaaactccagaaccctttatatattatcgttacatgaacttttagaatatattcttttatacctttcttcttaacaaaaaaagagagctgtagatagggtgtttaggaggtcaaatcgacagttcaataattaattaaaagaggttaaaacaattcagcaaccttagtttatatgttttttttatataatcaatttcttaagatttatcataaaggattggatagtccgagttactcatatgtataggaaagttaatcgtcttgcagatgagttagcaaactatgctttttcgttggcagtagaccctcattcttttgatcgttgtctagagagtgttagctcggtgatattaaaggacacaagtggaactctgttttcacgtagtttttgaaattagtttttgttttattttgttcgaataaatagtaggggacaatgtcgccttcctttaccgaaaaaagaaaactttttgggatttatatgtcctaaaagagtttaaaacaattctaattgtttattagaatttgatcaaaatatgagatagaagattagttgcacacattcaaaataataaaataaaggattttgtttttcttcaacaaataaagaaaaactatgaaacattacataccaaacaaccattgctagcttaaccaaagatccctatggtcccagggatttttcccacgtattctatttatgcaaatttggatcacttattctcaagaatccctttagaatttgattcattcgcatatccatggataatttggtatatttggaaagcaagtaatgaaaacatatttgaaaatgtcgagaaagatcagttatatgtgttatgtctagcagaaaaagaggctcatttgtggcacctagctcaagttgagttcaatactgaaaactatgtctctttacaagctgaaaaacaaattcaagtgagagatatctgttattcaaatttagattcagttatatatgttactactaataaagaatgtatttaaaatatataattctacaaatatcaaagtacacatgatagtagtatttgtgataaaaagatagtttctcactacacggtttaagctgatattagattggttggtaataaaaaaaaacgatacaaagtatgtttggttatgaaaaagagcaatatataatttcttacacaaccatacgtgaatcagcttaattctacatatctaatatttgaaaatcggtggtgttaacaaaacaataaaataattatttttcatcttatgacaccgtattaatgtcaattaaactcattttaccatacaacctgagtcttgtaatattttttaaaaatattacaataattatatttttaactttttaagaatttaaaatttattatatctagtataattaacgatttgactaaagaaccaaactaaactaacaaaaacttttaaaatttggatgcttgtcaagttaagcttcatatgcactcggattttgaattcaattggttttatttataatatgattttcatccattgtgtaaacattttagtcgatgtgagaacatatatatttcttttataattgagtaatacatattggcaccggatatttttttctggtggtactagtcctgaggaggccgatagttggcagtcgtaggttgagcggaacttcggttcgagcagatgcccggtggagtatcaggtggatatgatagtatattttctagagggggatgtacatttgtggtggcagagtgtgaatgtcaggaggaggcaggcggatatg

SEQ ID NO: 35535 - DNA, 3000 bp, Unknown; identical to SEQ ID NO: 35534
  misc_feature (1)..( 3000): 2750-1469P.txt file - cDNA_ID_3088527; gDNA_ID_1621120; Annot_ID_172041

SEQ ID NO: 35536 - DNA, 3000 bp, Unknown
  misc_feature (1)..( 3000): 2750-1469P.txt file - cDNA_ID_3088531; gDNA_ID_2926137; Annot_ID_197241
tttgaaaaacctctcaaatggatacatccacctatattggacagggccacccaattcagcttcgtatgggagatggataggtaagtgttccataacatcaaaaaatgatggtggaaaaatcttttccaagttacagatgattaaaactatgttctctttgagaatttgaacgcgactcgtctgtaaagttctcgaacataggtcccggaaaaatgctcaaattcctaaaatatatgtgcaagttaaataattagataaaaaaatgttggcaaataaaatagtaagtactgtacctgataaggcaaggtggacattccgatcaaggagttcagcaaagataaatggaagtagtcgctccataaaaacatgacaatcatgactcttcatgcctgaaaactttccattctctagatctacacaactagccaaatcgctagaataaccatctggaaatctaacatcatgtttcacacattgaaataaactctgtttcgcttcgtctgtcaatgaatacgttggaaatggagctttaccattactatcaatatgtaagcctggccgagaacaaaatttctcaatatccaatcttgacatgatattgtcttttgatttatccttaacacgcaagagagtgttcatgatgttgtcaagaaaattcttctctgtatgcatcacatcaataatatgtcgaagattgaggtccttccagtaagacaactcccacaagatgctttctttgtgccaattatgttctttcccatagcctagcatcttcttttcatgaccgttcccaccaacatccttcgtttttggtggatttacactagccaaccactcgtaataaacttgcttccctgtcaaagattcgggtggatactcgctagaaacttctcttcctttcacaaagtcttttctgttcctacgggatggatggccatgaggaagaaatctacagtgacaatcaaaccagcatgtcttccgtccattgggtagagaaaaagactttgtactttccatgcaaactggacaagacaatttatcatgagtagtccatcctgataacatgctaaacgccggaaagtcgctaatcgtcaacaatagtactgcttttagattaatattctagcttaatgaaacatcgtacgcatcaactccagtagaccacaactcttttaactcctcaataagaggttggaggaacacatcaagactagctcgaggatgatttggtccagaattcagaattgtaagaaataagtactctgtattcatgcacataccagggggtaaattatatggagtcaggatcacatgccacaacgaatgattacgagacatgccaaatcgattgaacccatcagtacataacccgaaataaacgttacatggttcttcggcaaaccagggatgtaactcttggaaatatctccactccgctgcatctgaaggatgattcatttctccctcctttgattggtgctcagcatgccatcgcattgccgcaactgtcttatggctctgatacattctctgatacattctcttcaaccggtccccaataggtagataccacatatgactatatggtaatttagttcttcgacggttgtccttaggcttccatctttgtgcgccacaaaatcgatattgatcttctttttcgtcttctttccaaaatagcatacaattgttctgacaaacatcaatcgtatgatatggaagttctaaattgcgcatcaatttctcggtctggtaatgtgaagtggtaatctggtttccttctggtaaagaatttgtaaacatttcgcaaacggagtccaccaacttttcactcatattatactccgccttgttgtgcactagtcgagatgctaaggataactgtgactgcccttcacgataaccatcatacaatggattatttgcaccttctaacaagtcgtagaacttatttcaatggttacggaccggttcttccacattctgataactatcatcatgatgatagttatcatcataccccacgttaaaattaaatgcatcgttcaccatatccacatatggatcttctacaacattacccacttcttcataattcaaactaaaatacgtcctatccgtgtaagtactcgttcctatatccatattcatttcttttccatgcttataccaaacataataatcaggcataaatccttgactaaacaaatgactattaactcttctacccgagataatgtgtttttcattcttgcatacactacaaggacaatgaaatttacctcaactagtttgtactataggcttactattagcgaatgtcatgaattgctcaactcctgcgacatattcggctgacaaattccccgtcacttcatcaaatctcttgtacatccaatctcgataaaaactgccactacccgccataattgtagtttcccgccattatacaataaaataaacttatatttttttcttttaaatcgtttttttttctttgatgttgttgttgttttaatttgttggtgaaagaagagtgtcgtgaagttttaatatatcgacgaatttttatgacttatttacgactacatgtcgtagtcgctcacaagttaggtgtacctacttaaaatgcgaaacacgtttttcaacaactttatgctcgtttgcgactcctttgcgactacaaaagagtagtcatcaaatagtcgccaaatagacgactaactaatgtagtcggaaacgtagtcgtcacttaccgactacatgacgactaatttctcacttcagaaatgtaatcgttaaatagtcgtttaataacgactatcgtccaactaacctagttagtcgtaaatggacgactacttcacgacgaattttcttgttgttgtatcgtagtcgttaaactgtcgccacattgtcgcaaaataaaacgactacacatattgtcgttttacgttgtcgttttttgcctgttttcttggtggattagaggaggatatg

SEQ ID NO: 35537 - DNA, 3000 bp, Unknown
  misc_feature (1)..( 3000): 2750-1469P.txt file - cDNA_ID_3088558; gDNA_ID_2926137; Annot_ID_197273
ttctcaacgtccatgtttgtttaatatttaatttagaaaataatttgtttattttttaatttttgttactactaggactcggactcccctcgatatcgcgggaggaatattttaaatatatttatataataatttctttaaaataaatcatatattataaattttattaattatttaagaaaaaaagatatatataaacggaaaaataaccgtcaatttttttactattccaataaaaaaagatacaatcaaagaaaaaacccgtcaatattaacggaaaactacgataaaaagacactaataaaataatcatcaatgttttaacggaaataaacgaagaaaatatacaaacaggaaaaataactgtcaataagtaaccaaaagtaacaataaaaatatatgaacgaaaaaggtaattaagtgacaatattttaatggaaaagtgcgatgaaaagactcaataatatatcgaaaagttgcaacaaaaagacataactgaagaaaaatacccgtccataattttacaaaacaattgcaataaaaaacaaaaacgaaaaaaataacagttaatgttaacggaaagttacgatgaaaaaatatgatcgaaaataataactgtcaatattttaacagaaagttgcgataaaatgaaataatcgaaaaaataaccgtcaatattttaacggaatgttgcaataaacagacacaaccaaggaaaaataactttcaatatttttatgaaaatttgctataaaaaatactaaaggaaaaataacagtcaatattaatgaaaagttatgatgaaaagtcactaacaaaaagttgcgattaagaaaacactaacgaaaaaatgaatcgtcaatattaatggaaagctacgatgaaaagatacgaataaaaaaataaccgtcaatatttaacggaaagttgcgataaaagagacacaacaaaaaaataaccgtcactattataacagagagttgcaataaagagacacaaccaagaaaaaataaccgtcaatagttttacaaagtgacgataaaaaaaaaaaggaaaaataaccgtcaataataacaaaaagttacgataaaaagaaacaaataaaaaggtgtgataagaagaaactaaaggaaaacataaccgtcaatataaatagaaagttacgatgaaaataaactaactaaaaaagtaattgtaaatattttaacgaaatattgcgattagaaaacacaacaaaaaataaccgtcaatattaaaatgacaaagatataaacaaaaagttgcgataaaactgtagtaacggaaaaaataaccgtcattgttagcggaaagttacgatgaaaagacatgaacaaaaaaataaccgtcaacattttaaccaaatgcaaattttatgaagaatcgtagaagaaaattgttccttcccaaattttatgaagaacaaacaagaaaacaaattgttccttctcaactttcattttgcttccagtgcaatttcagagatatgttactggtgtttgtgtaaacaataataaaaaagaatagccaataagatatttcagataaactagagaccaagccatactcctcagcatcccaattacacagaataatcgtccttcgaggcttccatcctcttttctgcagcttatctagtctttgtgcaatctacaattgtttcaaaaatctctcattgcaatgaaaacattgaaaactttcaccaaatacatgttgcagataacttttactcgcctccataagtaccgcagtgccactgttcggatcaacagctctgaaagtccaagtgtctctatggtttcgaagaatcacatatctaaccaatccattcatatacaatccctagttagttactacaatcagaagtctattgccactcactattgaacatgtacctatcaggctcttcttctccctcaatcactccaataacattctgaatcttggctataacagtttgataagaatgaaactatgaatctctctttcttatccttaaaatcccaattacaatgaaacaaactctaaatcggtaagcttggagttacagttctccaatcttatctcctaagaacaaagcacataagccctaattctactcacaacatcaatatgatcacgcaggatagttctctatgtttgctctctatctctatttatactctgaattcttctcatgcttctgtttggctcttcccaagtgcctattcatctcacacgtgctctcttatcacagtttccccctgaaacaaagacccaacaaaactcaaatctaagtaagtaacacatatcatctgaaacacaaactcactcactatgtagctcaggttcaagatcccaggtccaggccccacatctccaacaattgtcttcagaatcacttcagcatcagcagctgagacaggcaacgacggtataagcggaacatcaccgctcaattcaaccgcctcgtcggataatctctcacacccatcaacacttgcccatccaggagtcgttggatcacctaacccattataaacagtaccaacttgaaacccactcggtggcatccatttactcgccggaaaccactcatctccaccgtaatctctcttgtttgtatatatcacaacaccgacagctcctgcctcgtaagcgttgttcacaatgtctactttgtatatctgaccgtacctcgcgattacaacggctccagagacattcacacccatatctttcttgagtctcacgaaatcttccactcgtccatagtttgcataaaccactagacttacctgacttagggtatccatgaaaagtatgtaagtgcggatggcagctggagaatgtgtgttgattgcagagccatcaacaatataacggttaagtattaggatgagagagggagatgaatggaaaactgcatttaaaactaaacatgggttatatgagtggctagtcatgccatttggattaactaatgcacctagtacattcatg

SEQ ID NO: 35538 - DNA, 3000 bp, Unknown
  misc_feature (1)..( 3000): 2750-1469P.txt file - cDNA_ID_3088667; gDNA_ID_2926139; Annot_ID_197376
attcaagttattataatgtttctctcaaatatttttgtttggctgaatgagaaagatgtattagacattgtcttctttagacattatatatatttactagtactaattatagtaaatatacacacgtatacaatcggagtagatgcgcatgttaattaccaaaaaaaatacgatttaagtgtgccatcatctccgttaatctagggttagctggataattatcatttacgttttgatgatgacaaaaaaggataaagaacaaaaaggtacatactaatatatacatatatgtaaggttaaagtttgtttgatgagtgcttaaattcgatattctatttaaaattatatctctattcgctaaggattcaaattcaaataagagaaaaaaaataaaaagtaaattatgcccaccccaaactttgctatatatacaagaaatatcaccttctctttaaaaccaattaaagagacgcatttaaaagcaaatgaccaacaagcgacttcaccatccatctcttacaaccctccaagaacactggctgttttccttcactttctagacaaaacaaaaaccatcttctagagaaaataaaccaacatgggagagacagaaaccatggcaacaaactaactaaaccatagtatatattatctatactaatattatcggcccatgggtaacggagacaaagtcatgagccactggagcttccacatcccacgtctccatcatcatgagcatgatcatgaaaaggtaccaaaagggtgtttggcagtgaaggtaggacaaggagaagagcaagagagatttgtgattcccgttatgtactttaatcatcctttgtttggacaactcttgaaggaagctgaagaagagtttggttttgctcaaaaagggacaatcacgatcccttgtcacgttgaggagtttaggtatgttcaaggattgatcgatcgagaaaacactagatttctcggtactaatctccttgatcatcaccatcatcatcacaaccatctcatccggtgttttagggtttgatgatattgttttggctctttttaaactagatattatctcatgctgctgattataaataaatctcggtcttcatttcatcttatcttaaggtgtggcttgttgttgttgttgttgttgttgttgttgttgttgttgttgttgttgttcatatatatatatatatatatatatatgtctcatgatgattaattgtacgcttatgcccgatcataaaaatagaaaatcatcatcttgtaataatattaaaataatatgtatgttgaacaattaatatttagttatttactatactcaatctcttctatgagttgacttgtcaattgaaattttataattttattaatgatttggagaagaaagtaattttacatttttccatttttattttaaaaatcatttttattttaaaaatcactttagttcaggttttttgttgctaaaatgtaaatattcataagaataaaaatgtttaggtttacagttatatattttagacttatagacttggtcttatggcaaaaaaaaaggattaaaacatggaaggaaaaacaatcagtttgtcgactcaacgtatgctatgaagcaaacaatgttagagaaaaagataaagtgatacaagattttgaagttcctccaaagtgagttacaaaagatgaaatttggcaatgaaaatttataaaaacttcaaaagtggaagcctttcactggaggccaatggactgattctatcggctttgccaaactattctacaacaggttaatcatttggagaagaaagtaatttagtggttatttcacatatataccaccattcatcaatataacttctatgttacgtttccgttcataaagatatgtgaaaacgaagttcctgtaaatgaatgattaagttaagaaatttattcgctaaatctataaattcatctgatcaacattgttgtctacgcaattgttgttcattaaatctttacggtcacaaaaataacaacctcatgatatgttagaaaaactttaatcatacacttgcaaaaaaaagtgaagcaaaatctaccataaatatgcaattgtgcagtggtcttctcctcttaattttgtttgaagtacgtatattcgaaactttatttcgattataatttttcgtacgattctttataagtaaagcaaaataatgatggattgaagaatcttgaaaatggaaagaaatggacgagaggcttttgaccatttgtatggccagaataacaacactcactaccaaatacaataacgtgattttgtttaatagattagatgcggtaggaatatattattcttcgtgaactaaaaccatgttttataacgacaaaaaaaaacccatgttttataagtttatgggccaaaattgggcttttgtattataaacatgtttacggaagtattcagctaagtatatataaaaaaaaacaattacactaatttatttaaattttattattacctacttacaattagtaaaatttaaaattaacaaaaaaaaaacttttacttacttttagttattgttttaagaaaaaacatcattaattaccctacttttttttttaatactaggaggttctaagccaaaacatcttaattattatattgtttatatgtctaataatatccataaatgtattaaaaaaacttaaaacataaactaaagggtaatagatcataatattattgaatggagtaagaaaatgtataaattataattcaaaaagagaactataatctgcttttctacccaaatgaagtaaaataagacatcaatttgcatttcaatggtcagttttaaaggtaaaattaaagacgttaaacacgtgtaatgtaaaagagatcactcatgagtcatgaccaaccatattcttagtttatataagtaattcacaccccttaaaaagaaatatagtctataatcaatcatacttagcatg

SEQ ID NO: 35539 - DNA, 3003 bp, Unknown; identical to SEQ ID NO: 17659
  misc_feature (1)..( 3003): 2750-1469P.txt file - cDNA_ID_3088681; gDNA_ID_2926139; Annot_ID_197368

SEQ ID NO: 35540 - DNA, 3000 bp, Unknown; identical to SEQ ID NO: 8160
  misc_feature (1)..( 3000): 2750-1469P.txt file - cDNA_ID_3088681; gDNA_ID_1621198; Annot_ID_174792

SEQ ID NO: 35541 - DNA, 3000 bp, Unknown; identical to SEQ ID NO: 17654
  misc_feature (1)..( 3000): 2750-1469P.txt file - cDNA_ID_3088685; gDNA_ID_2926139; Annot_ID_197366

SEQ ID NO: 35542 - DNA, 3003 bp, Unknown; identical to SEQ ID NO: 17653
  misc_feature (1)..( 3003): 2750-1469P.txt file - cDNA_ID_3088685; gDNA_ID_1621198; Annot_ID_174794

SEQ ID NO: 35543 - DNA, 3000 bp, Unknown
  misc_feature (1)..( 3000): 2750-1469P.txt file - cDNA_ID_3088693; gDNA_ID_2926139; Annot_ID_197360
atttgattttactatacattttaactatctattccaacataataaactatattttaattttatacgctataccttaaaattgatatttgaattttaaataataacttatacacttttcaatatttaatttaatactttcttaaaacaaattttaattttacaaatttgattttgcgatacaatttaaatataaactttatcataatacaaatattatttaattcgactctattttctccggtgaactttcccattagagcgatctcaaaaccttattcaaaccctgcaagttcgacttcggcaatgatatagtgctcattgtatgttttggtatagacactgctagcactaatttcgttagtgtcaatctccttgcaaaaattaggcacctgtctttccaccctgctaaccttgatgacacactttctaagatctcctcgaaaatctctttatttgttctcttttagagaaatgggcatcccaagattctttccaagttcctttgtcgacttgatcccgctcttgtcactgatcatcactaattcccgtgacacattctcagcaaaaaagattttggatttcttcaacctcactttttggcctgatgctacacaatatctctccaatattcgtcttataatctaaatttggccactgatccttccgtaaatagatcaagtcatccgcaaagcaaatatgagacaactttgttcctctatgtaatattatctcttcttatttctatcatagaaatataaagcattagctctacgttgcggctacaaactctagtctcatgtcactctcttcaaagcttcttcaaaaaaatttattatataaaaacaaactgaaattccttttgataatttttaaaatttacagttattggttttcgttttatttacttatgcatgaataaatttatcaaacacatgaactaaaccaaaatagaggtggtatgagaaaagaacaggactaaaagaactttgttcctcgaaaaaaagtttgaatttctttattatgtaagtatttttttttatcttagaaattcatcaaaatatcttcctcttttattttgaacatgatacacacaaatgtaagaacccaaagaagccaaaacatcattaaattaaacaaaacaaaaaacaaaaacaaaagaacctacaaagagacttggacatcttttaatcccaaaccagacctaatcatacaatcattcatgatttaacttgcgatatacaaagctccatctccaacacttcaccacgtaataaactattaggaacaaacatgacatttttatctttaggggtttcaaaactcacttcaagaattctcttcatctccggcgattcgtgacaacaagtgcgtccatcaaacgagtaagagattcgatatgagaacttctccacttcaggagccaatggtgcaatacaatttacagccacataaacaccgtttggctctctaaaacattgcacaacgaacaataaagtctttgtaagcgttataagaaccaaagacttatcgtttatcgccattcgcacatccctcggttcaccaaaggtgaaaaaacaatcgggttttaaagggtgggatatgatctctttgtataagccagtgtatttgcattctttgatttcagggcaagaacatagagagaaactgcaatattccttctcatgacttgagtctctcccataaggaacattcttagtgcaacctaactttgcgtttcggcatgggacgatgactgatttgagaacactctccattgctttgcaacgtttgtttccaatgggtaaagcacatgcaggacatttctttccgagtttgagccagcaaaaaccgcaagctacatgtccattatcacactgaagtacaaaaccaaagagttgcaatcaaattcatatcaaagcctattaaataaaagcaaagattttcaatttttgaatcgaaggtaaaaataaccaactcaaaattgtcgtcacagtaaatatcaaccaactcttaatttgcgctatatatataaactagcaatcatattaaaagataatgaaaaaatcaaggcactcaaaatatatgtaatctgtataaaactgaaaatgagatgctactgcatgtaaaagctaaagcaagcttacaaaatcaggatcgatcttatactaaatgactataaaaggaaactctatgaagtcaattagcaatgtaaataatcaaaacgtaacctgaaataaaggaatagtgagtggctcgtagcaaataggacaatcaagaacatcaagatctagcaacgtccccgttaccgaacattttcgttgcctcttttgtgatcaagtctttctcgaaccatctccatcttctaaagaacacttcatgtctcagaaaaaagtatgagaggcttgagaatagtagggaaacgaattaggtttttttttttttttttttaaagtaatgttaaattagatttaaaagaaaattgcgtttttacaacgagtgcaacttataatttatacgagagagattgaaaacaggaagtagaaagagtaagctttgcgattaacttcgactttgaagccatcgttggaaggtggcctcatatcgatggtccttgtggcgttgaatggtggtgattctgttgcgcatttgtttgtcgatccattgaataagaatgagagcagattttggagcttcattatgacgtcttcgattcctctcatgccagatggtataaacggaggtttggaagatgtatttcaccaagaaacaagttaccttatccttgcgatgggctgagactaggttgagcagttggtgcctatcacttgtgtagtgatgctgaagcaatcctcgagcaagcgcttcccaaattccagctgtatagctgcaagaaaaaaagagatgatctctggactccaggcagttcgtacagaagtaacaatctcccactgcatctttgttccatttttgcatacggtcaccggtagcaagtcgatcatg

SEQ ID NO: 35544 - DNA, 3000 bp, Unknown; identical to SEQ ID NO: 35344
  misc_feature (1)..( 3000): 2750-1469P.txt file - cDNA_ID_3088697; gDNA_ID_2926139; Annot_ID_197357

SEQ ID NO: 35545 - DNA, 3003 bp, Unknown; identical to SEQ ID NO: 31448
  misc_feature (1)..( 3003): 2750-1469P.txt file - cDNA_ID_3088702; gDNA_ID_2926139; Annot_ID_197354

SEQ ID NO: 35546 - DNA, 3003 bp, Unknown; identical to SEQ ID NO: 24687
  misc_feature (1)..( 3003): 2750-1469P.txt file - cDNA_ID_3088706; gDNA_ID_2926139; Annot_ID_197352

SEQ ID NO: 35547 - DNA, 3000 bp, Unknown
  misc_feature (1)..( 3000): 2750-1469P.txt file - cDNA_ID_3088729; gDNA_ID_2926139; Annot_ID_197340
agccaaacatggtcagaggaagctggataaaaccgggcgcagtcctcatcgatgttgggattaatcctgttgaggtgagtggaattttctttttgacatatggtcatggcgtaattcagtgatataataagtttcaaatcaaccagtatgcaacattcatacatgtacataatatgaattgcaggatccaagtgctgcgcgtggatatcgattggttggagacatttgctacgaggaggctagcaaagttgcatcagccatcacacctgttcctggcggtgtaggaccaatgaccatagccatgcttctatccaacactttaacatcagctaagaggattcacaacttccagtgacgtcacttaaaaagaagattgctggccttttgggaaacaaacaaatcgtactctgttttttgaagccaatgatttactttggtctttaaagaaagttatcgttttgttctatgaaacaaaacatgtagtttttaagtcacataaattgtcttcaacattgtttgtctcttcttggtattttgagtcagaactagttttaacttatcccagctatgatatatcccagcctcacccatcggtctcttcgtcattatactttatttataactacctttcaacgaaggttaatttgaaacaagaaaacacagtcacttgttctacattacttttgttaaaccctaacttgagctcgaagccacgaccactgttctgttttcctagtaaaataatggcgtcgttgatgttaaccgattgctccttctccacgacctcgcgtctcatcgatttgaaccgcctcaacggtgctttcctgccccgctggtgcgtcagccaactcaagctttcccaccactgcgcccggacgtggccgcatgcgctcctcttataccactgtgcccggacgtggccacattctctccattcgctcctcttgtatagactaaaccttttcatccaattgcttacgtattttcagatatccaactcttaagattttacttttctgttcagctgatgaggcgatggtatttgatcaaacggctgtggaactaagtatcatgcaggagatcagagtcgaaacttcaagaatggagaaactaatcagtcctggtttagcagtaatcctttttggggacagagagttctctgaagaatataaagaaatttaaactctagcatctttgctccaaaaacaaactctatagagtttaaatttctttcttcttttttacaaaagagggattatagtattatacaccataaaccccgtaaaattaaaagaaggtattcagttaccaaaatcggatttagtagcatttagtttttttgaattttaaatgtacaccataaaccccgtaaaattagtcaaaacaattaatgtgatttatgataattgtaattaaataaaaaagatattactcgattagtaattactgattaactgaatcattgatctcattaaacaattaaagaaagattactcgattagttagcatttagttttaatttttttaatatactaaaaataccaatcggaaattcagttaccaaaattagatttattaacatttactttttgaattttagatgtacaccataaaccccgtaaaattggtcaaagatttatgatacttgtaattaaggaaagaaccaaatgcaatatatggtttcggtgcaaaaccttaaaactgaccaacttctcaattttttatttaaaaaccctaccaaatttctctctcgtttctctccgatggccaagaacaagactttggttactccatcaacggtgaagaagtcatctgacgtcgcatctacgtcaaagaaactgtcgggagtcgcatctccagcgaagaaaccgtcgggtgtcacatctccggtcaagaagccgttggaagccgtcgcatcaacttcatctgaggaggaggaggaagatgagccttccagcgattcagagtcgggatcggagagtgagtctgacactgaagctgagccgatgactcttgctgctgctgctccttcttcttcgaatgagaagagacaaagtgaaggaaaaccagaggaggaacgagccaagactgaaacagagacggggaagaagccactgttgtttcagagattgtggactgatgaagacgagatcgtctttcttcaaggaatgatcaaatttgctaaggatacaggtaagaatgtttccgaggacatgaatggctttttcgaaaaacttaaagattcgattagctttgaggtgaagactgatcagttcgttaacaaaatccggtctatgaagagaaagtatattgagaacaagaaaactactacagagcatgataagaagtgttacgaattggctgagataatttgggtaagtgatggtgatgctactgctcttgtgaagccaaagaagaagaagcttaaggttgatgaagaaagtgattggttcgagaggtcgtttgttgatggtgcgtttaaagaattgggtccgggggttgatgaagagacatggaagaagaattggagtttggtaccggtgaagaagaggaagaggatagaagaaaaggtgaagtccatgcaagctgatgagctcaaaacgacgtggcagaagattgacgttgtgcatgagatgagatctttgatggctaaatatgtttagtctttatctgtttagagatgcatttgcctatgtttttctttttggttttgtgttggaacctttatggctttctcgtttattcatatgttttatgttaaagatgtttttttggataacaaaaataggtggttttttgtttgcatcttagtcttcttcctttgttactacagacatgaaatcgttagataattatgatatgatataaactaataatgattctaggagataattcctaatggatttaagataagtacatatcttctatatctacctttacacacacgttaacttagaaacaatctactttgttttcttctgtttgcctagtaaacaaatg

SEQ ID NO: 35548 - DNA, 3000 bp, Unknown; identical to SEQ ID NO: 35547
  misc_feature (1)..( 3000): 2750-1469P.txt file - cDNA_ID_3088729; gDNA_ID_1972140; Annot_ID_179259

SEQ ID NO: 35549 - DNA, 3000 bp, Unknown; identical to SEQ ID NO: 9530
  misc_feature (1)..( 3000): 2750-1469P.txt file - cDNA_ID_3088733; gDNA_ID_2926139; Annot_ID_197336

SEQ ID NO: 35550 - DNA, 3000 bp, Unknown
  misc_feature (1)..( 3000): 2750-1469P.txt file - cDNA_ID_3088737; gDNA_ID_2926139; Annot_ID_197335
aaaggccgtcgtacaggtatatatctcttactatcttctttagatttacctttcggttggaaggatgactaaatgattcattccatcattttagttcgaagatttccaagcgaaatgggctttcggaacattggaaagatatcggaagaaattttgcatgttcaatgatgatgtccaggtatgctcacaattttgcaatccagctgccttcctttttagctacttcttgtatgtatctttttcaaaaataataataataaggtttgtgtatgagttatcagggaactgctggtgttgcactggctggactattgggaactgtaagagctcaaggtcggccgatatccgactttgtgaaccaaaagattgttgtggtgggagctggaaggtacttggatattcacttgaaatccttttcttctgtatttatatatttacattaactttcttctcatcttctcattgtatatttcttttattactttcagtgctgggcttggtgtaactaagatggcagtacaggcagttgccagaatggcaggtatcagcgagagtgaagcaacaaaaaacttttacctgatagataaagatgtaagtttttgttttttcactacttgacttcagctgaatcggtttgtcttgcttgataataacaattaagcttgcgtagttccacggggcagttgactttgaaactgtcatattattgtaatgtttagtgcttgcttttggatgttggtttaatcaatccagtaagagcttacctagaaaaagtcagaaaacgtttttaaagttatccaaaagcctttctgttcttgcattggtcaacatattgttttctcatctgtttgcctcataagatcgtgctccttcgaatatttaatgaaaacgacttgatttgtacttcagggtcttgtcaccacggagaggacaaaacttgacccaggagctgtactttttgccaaaaatccagctgagatacgcgagggagcaagtatcgttgaagtggtaagcctaagccttattattgcgttcttacttgccttggccaatattaaactttgacttaatgtgctttctctactacatcctaaagcaacacaggataaccatatttttttactgtccccaaaagttagacataatcatatgataatatttctgtctaaatataatatgtcttcaggtgaagaaagtgaggccacatgttcttcttggtttatctggagttggtggtatctttaatgaagaagtatgtgactttcttagacaacaaatagtttcaagaagtatgaattttaactgttttacttatatcgttaactggtttcaatcatcaaaggttctcaaggcgatgcgagaatctgactcatgcaagcctgccatttttgccatgtcgaatcccactttgaatggtttgtgtgtttttagcttagcaaagtaatgttgttccatctttgaaaaatctgccctgaacatcttttcgtgtgacagccgagtgcactgctgctgatgctttcaaacacgccggaggaaacattgtctttgcaagtggaagtccatttgagaacgttgaacttggtatgttatggtgggattcattgatggtctttgtatctaatttgctataatctaagaataatcacattttcttgtcccactcgcagagaatggtaaagtaggacatgtgaatcaggctaacaacatgtatttattcccggggttcgttttctttcttgaaaactgttgaactgtattgcatttcaatccatagatatagttcactgtgttgcatttcaatccatagatatagttatcagaattaatttggtcattatcgtttccaggatcgggctagggactcttctctctggtgcacgtatcgtaactgatggaatgctacaagcagcttctgaatggtaataatgattgcgttttgttctcttcaaattttaaaaatgagcttatgacaatgctgacgattaacatattcaaacatacacagccttgcgtcctacatgaccgatgaagaagtccaaaaaggcatcctttacccttcaatcaacaagtaattcctctaaatccctctcattcttatccgttgattatattttagtatattaaaactgttatctgaagcaattggtttctgaaaaaattgcagcatccgacacataacagctgaagtcggggcagctgttctacgagctgcggtgactgatgacattgcagaaggacatggtgatgttggtcccaaagatctcagccacatgtctaaggtatgaatcaagtaactgagagatatatttgtatcagaacatgtataaggtaatttagaaaatggaatctaattgcttcatttaatgccaccaacaggaggatacagtgaattacattacacgcaacatgtggttccctgtttacagccctctcgttcacgagaaatagacaacaactctatataactcttctcaggtttcatagaaagccaaaagacaaaaaatcttcgcttcatcttttatttgtgatcaacattctttttttcttcaaaatgtgatatgttttaagaaaaacaatgccaaaaagagggcttaagaacaagaacagggttagttctaggtcaacctgtacttttcctttttttttttggacatttttccaacttcttacgattatttctgatgataatgattacaactttatatactgttttggcaataataagccaataatgatatctttcttctacattttcctgctttaccatttttgttctgataccaaaaggtttaaatggtttcgagattcaaccaactttgaagagttgttaatgcagttgcagaagcatgttaaccgaaaatcattccaaaccggagaatatcaactcgaaccagaataccaaaccggaaattccaacagtgatcgtgctatgtttaagttaaaatttaaattaagcaaacaccggagagtgattggatcggggaatttgggaaaagtatg

SEQ ID NO: 35551 - DNA, 3000 bp, Unknown; identical to SEQ ID NO: 9529
  misc_feature (1)..( 3000): 2750-1469P.txt file - cDNA_ID_3088740; gDNA_ID_2926139; Annot_ID_197334

SEQ ID NO: 35552 - DNA, 3003 bp, Unknown
  misc_feature (1)..( 3003): 2750-1469P.txt file - cDNA_ID_3088744; gDNA_ID_2926139; Annot_ID_197332
atcagaattatagcattctttcttccacatttctacaaatttctgttcgcttcttaccttatatattactttctctgccagtaaattcaaggaatctcatattttttgtacttctttcttgtagttgaatgtataccgggggttcaccccacctaatgctccaacctatggaaaggtttatggagggcaattagttggacaggtatgaaatttactcatgtaaggctacgtcatgtatttagtaaccctgctgatcatccatttgcatatgtagcttgttatgttctatttatatcaggcaatggaaatatatagtaatcactgtgacacaactgtctatgcttcgcaggcacttgccgcagcatcaaaaactgttgaaactatgaagatagtccataattttcattgctatttccttcttgttggagatataaatagtaaggggtagttttaatgtgcttttgcaagtaagcaagcaattgcttttcctcctaccttaaaaccatgcctgctgttttccccggatttctctaaagctcacacatctgttacactttgtaaattatcatagtttgctactcttgcagttcccatcatatatgatgttaaccgcttacgtgacggcaacaactttgccaccagaagtgtagatgctagacagaaaggaaaaactatattcaccttgttcgcgtcatttcaggtttcatgttatattcctgaaatatttcattatgaatctctgtgtttctcttactatgtcataatcagcgaatagcttttcacactttaacacaacagttaaaaaccttgtagcttctgtttttctttggttttacagaaaaagcaacaaggttttattcaccaggagtcgaccatgcctcatacaccagctcctgaaacggtaaatcatttctcctactttcaggcttataaaatgaattgcgatgattgtcagtttgatcccaacctactgcagcttctaccaagggaggagatgcttgaacggcttgttactgagcctctgctacctaggtaagtggaagtttgccagacctattattccaagagctcatcagagtcatacacttctcaattattccttcatttcagggattaccgaaaccaagttgcaactgaaattagtgttccattccctatagatattcgattttgtgagccaaatcgttccactaaacagaataagtctcctccaaggttatcctagttgtctaactcatgaattaatcaattttgttgtttacgtggttgctgataagaactaaccatttctttcctataatcatcttgcagactaaaatattggtttagagcaaagggaaaactttctgatgatgatcaagctttgcacaggtgagcaactctacttcagtggtattaaatagaaagccgcctaaaaacttggtacttattcatatctagacaatttgaattattgtagcgttcacctttagcattccaaggaattcacctatcagcgatatttaagtatcaccggttgatatagttgaaatgtaatccagattgtcttaacattggcaactagagcgtttgtttggacatgtatgatatatctcttgcagtctatctgattgtcatgcgtcgcccgccattgttttgcagatgtgtggttgcatttgcttccgatttgatattcgccactatcagtttaaaccctcaccggagagagggcatgagtgtagctgctcttagcctggaccactcgtaagctttttcttttgtcttagcgaagtgtgagtttgtatcattctccctacataagtacaaacgacttaattcatatatatacacgcaggcgcacacataattacatacctgctctatcgtctattatcttgattttaccatcttcgaaaacaatgcctcgagtaaaagtttcttacttttcttatgtccctttgcaggatgtggttccaccgacctgtaagagcagatgattggttgttgtttgtggtaagaaaagctcatgtttttcttcttctttttttctgaagagtaggagaagttttcttaagaaggaaaagttattactagtagaaaaccaaatgttttgtttaggtcaactgaaactcaaattgtctaaaatacttcgcgcaactttgagttgttttggagaacactagcaactatagattagaacaacttgcttgtttagctgatattcgttgaagtgtatagatcaaccacgtagggatatttatctttgtgtttacattgacatggtaaaagaagtaagccacaacatttttagtgttattgttattgttaaagatgtgactgaatccttaagaaatgaaaactctgaacaagaaaaatatactaacaacatttcccttgtgcagatagtgagtccaactgcgaccgaaagccgcggttttgcaactggcaaaatgttcaacagaaagggagaggtacgttgttgcatcgaagaagaatgaagaatctaatgtggtttgcaaaaatcgagctcttattcttttcaaacgttaatatatagtttgataatttgtgtgcagctggtggtatcattgacgcaagaagctgtgttaagagaagctgtgactattaagccatccttcggggccaagctatgaagccataggattttgatagtgagagaattgctgcatctgttactcctcacggtcacattccaaagagtcgtcacttatactacatttgcatatgtttttcgatccacaattattattttcccctctaaaagggtctacacatatgtttgtttgtaaccacgataatgtttcaacagcaatgaaaaagcaaacagtggttcattttacaggttaacgacgtcgttttggatacaccctcttttaacgttattatcattttatcacacagtcccagtcttcagagttaaagacgctcctcaattttgaaaaaaccctccatagtatctcttctacagaaccttgagttttcggagaacctcgaatctcaatg

SEQ ID NO: 35553 - DNA, 3003 bp, Unknown; identical to SEQ ID NO: 35552
  misc_feature (1)..( 3003): 2750-1469P.txt file - cDNA_ID_3088744; gDNA_ID_1972140; Annot_ID_179250

SEQ ID NO: 35554 - DNA, 3003 bp, Unknown; identical to SEQ ID NO: 31695
  misc_feature (1)..( 3003): 2750-1469P.txt file - cDNA_ID_3088764; gDNA_ID_2926139; Annot_ID_197326

SEQ ID NO: 35555 - DNA, 3000 bp, Unknown
  misc_feature (1)..( 3000): 2750-1469P.txt file - cDNA_ID_3088764; gDNA_ID_1621157; Annot_ID_173552
ttgtctcctctaaacagcccaggaagaagatgggaaaagagctcaactgctcacaagaagtctgcttcagcggatttcataaatcttgtgaacatcaagaaagaaactcatgcgagccaaccagaggaaaatactgatattcaggtctgcaatctaagcaaagaacctgatgattctatccaaccaatcgcaagtgaacctaatgagaaaagtgttgacattgaggatgaaactgctaacgaagataacatgttttctgcaggtaataatatttctgtctcatagtaaggctctctgttttgagtaacaataatttattttataacctttcttccaggttctgcagatgatgtgatgattcccaatgagctagatgaagttccagaggaagcaagctctacattgattggtgacttatcaaaagttgaagctcaggatgaacagagagatagtataaactcgaaacaggcaagtcattttgattgacccctagaacattaccttttttgtatggactttaaaatgaggaaatggtggaagacttaaattggttttgctgcttctttttttctacagacctctcttgaagagagccaaccaccactgtcttcctctgtggcctcaccatcccactgtttagctcaaactgaggagtgcaaatcagctattactgattttccggagtggtcaagcccaatatcagttcttgagccactcttcgtcgaagatgatataagcccagcaaaaatgcgatctcagtctggtatgtagaaaaagatcccaacatctactactagacttggattctagtacttagttcttcaatattgactcatttttacaactcaggtgaagcagaggtgcaaccgtggtgtatccacttcgatgaaaaagatcctgcacctacataccgagaaaattctgtgacaagtgacaaagaattggtgtttaagtatgtaaaagctgtcttggacgcagtagactcagacatcgaagagctctatctaaaggcgcaattctctgaccagcttcttgaaccagcacttatcagcaatataccattctgtccaaaccagctttgtcctgaccatgagctcctctttgactgcatcaatgaagctctcatggagttatgctgttgcccaccttgggcttcgtttgttacaccaagaaccagagtcttctctaccgtcaaaagcatcatccatgaggttcaagaagcggtttactggcatctcttgccattgccactccctcacgccttggatcagatagttagaaaagatatggctagagctggaaactggttagacatcagatgtgacattgactgcattggcttcgaaactagtgaactgattctcaacgagttactcgaagagctcatcctcaacaatactgagcactctctggtttcacctgagttgaagacggatgggagcatccttattctagaaaggtcttgaaagctgaaaactcttttcttaaagacaaagccattgttgatacactctgaacatagtctcactgtcaccattgctaattttttttagcacagaaccatgtagatagtttgtattactcagtcagacaaaaacctcacggagctcctgtctgatcagaaactactgagagggagaaggaggaaatcagatcctttcaaagaccagaccagaaactgttagtggtggggtcatcagagaatcactttcaaagacagtcttcttcctataggctattatatagtatatgatttattattttattttagagtgtttgtgtgaagatggagggatgtgatagtgtttgtttgaaatcggtttgtgtaacattttcagagtttgacataacaatgtattatggattaggagtatgacaaattcaaagtttttgttgttcatgaaaacaaaaagatataaattgggtatgttgattactagacatgaaactagaaagttttgttaataaaacctaggaagagtgttgtaaattgtagtctaacaatggtgggttgataacaggacaggataaatatcaatggagttttttttaagtaataggaaagaagcagtcataacacaaatctgtagagatttttactcaatggagaaatgaattttatggatcatgatatatgtatataaagttttggataatgtttttgtagttgttgcactttatgccctacttagtgaataacattttctttgatgggatatggttatgtggacacaatggacagtacacctgataaagatggattttaagaaattaacaaaactgaatgaattatatacaaactgataaataataaagggtttattctttttaatataaatatatttattttaatagttagtaaaattatttcattttgtttttgtaaaaattatgtataacacttatatataaaagatgtataatgcaaacaatcaacatgtcacttatatgttcttgttttagtattgatcctttggttacattattatgtgatatacaagcttattctatatgccattataaatgcttcttggggggatgcttgtaccatttagtgagtcaatctccgatctaatataacgaactgaacgataaaaataattattatcctttaaattatagtcgttgctatttaatatttcttaccttcattttcttattatctcacgttctttgatttgaataataaaaagcgaatgaaagtaatagataatattaaataataacggtaatttaaatacaaaaccaattttttattttatttttattttaacatgattctaaatactgatgaaaaaaacatgaatctaaaatactttcaactataaaatcaagagaatcaactctctctcaagtgctcacaagatcaacacaattaccaacctgcaaacaacacaaacacagtagcattctcaagctctggaacattaggcaaaggtctctctgctacacgagggtgtcgaccgaccctttagcaaaagagataagggctttgaaatg

SEQ ID NO: 35556 - DNA, 3000 bp, Unknown; identical to SEQ ID NO: 34352
  misc_feature (1)..( 3000): 2750-1469P.txt file - cDNA_ID_3088768; gDNA_ID_2926140; Annot_ID_197443

SEQ ID NO: 35557 - DNA, 3003 bp, Unknown
  misc_feature (1)..( 3003): 2750-1469P.txt file - cDNA_ID_3088783; gDNA_ID_2926140; Annot_ID_197433
aaaaccaaggtcctgctgctcctgatgctgaaatgaaacagatggtacaaccgctgctacaaggacaagcatctagctccatggaatttactaagtagttatctgaattgcaccataacctggactgcagctacaatgacctgaatgctaaagtggaggcattgaataccaaagtcagatacttggaagaacaatcagcatatacctctgcacctaaagttacaggacttcctgggaagtcaatacagaatccaaaggagtacgcaactgctcacgccatcactatctactatgatcgagagctgccaagtcaacctgtccctgacttaatccctagggacagtgatgttcaagaaggggagccttctactcagactgaggtctctgttgttgaattcaacaattctgatggttttggcgatctcattcaatccacctcggaagagaaagcaaccataattgagaggatggtaaaacgtttcaaacctactccattaccctcacgtgctcttccatggaaattgaggaaagcatggatggagagatacaagtctgttgtagcaaaacagctagacgagattgaagcagtgatgccactgatggaagttctcaacttgattcctgatcctcacaaagatgtgagaaatctaatactggaaaggatcaagatgtatcacgattcaaatgatgaatgtgatgctactccatctcgtgctactgaaaagaggattgttcaagaaaagttagaagatcctggatcttttactctaccatgttccattggtgaattagctttcagggattgcatgtgcgatctcggagcctatgtcagcttaatgcgactctttgtggcaagaaggttggaatttattcagtacagaccttgtgacctgactttgatccttgcggataggtcttcacgaaaacccttcggcatgttgaaagatctaccagtcatgattaatggagtggaagtgcctacagacttcgtggtgctggatatggaagaagagcataaggatcccctaatctcgtactttacgcgactgcgctactgatcgcagcgaaagaagagaggtcgagtatcctcagagcggtgctggccgccacagagctgatgaggtcgagtacccacctgctcgagctgatacagaacagggcggctcgtctatggcctgggagcaatcacaggcagccattgacgaccaactgataacactagattttaacctttttaagcccttgcttttcatgcatttagtttagtttcatgtcttttttcatgcattcttagtctcttttccttcttttgcacattttgcattgcattgcctagcatacttgcatttggagtgttttgcaggtgaattaggtacttttggactcaacttggaggtttctaagacaagggatggacaaactcgagttcgggggacctaaggaaggatttgaagtttactcggcctatgtactcggctggaggccgagtggagcacacgtgaaaaacaaggagcctactcgaccaaggcactcggctaaaggccgagtggtgcacttaaggaagaagagaagccacttgaccaagccactcggccaagagccgagctatgtgaccaagaccaagccactcggcttttctactcggcctagggccgagcgctcctgcgccgactttcctattttgtcttattcccaattagggcaacctaggattgtgtataaatagatctcttatgtttttacccaaaatatctttgttttgtcttctggatattagggttcttagatttcttttgcattttctggttgttgtgttgagaatttggatttcatttcttctggaaacttgtttatctcattgagatctatcatttgttaagtttataatgatttctgggttttatgaattttctgggttttgttctatgatgttcttcattgttcttgagtagtcttcttcagagttcttgaggatgggttaggtttaggtggattcctcttttctttagctagctaagtttataaatgcatgattcccttctgttttaggagttcttaatgctattttctttctgatcaattgaaaattgatttcagactttctccacctaataagtgtttgatgaaatgtctgaaccaactaatttcagagatttgtagattctagcccaagacattggatgtttagactgcttattgactttaatagattggtgtttaaagcctgctttattatgtttcatcaatgaaaattgagattaggaagttctaaagttatgagaatcattgtcacgaaagtggattgatttggttttgaatctattgtctagggatagcttgattgagtttgttagttagctaatggattgaggagtccactaagaccaattaccccattcttaagagctctgtttcgtttatttgtgcaaaactcatatttttagtactctgttcgtctcgtgcaaaattggtgtttttagtattgtactcgacctgtttactcgtttgctcgaccgagtgctttacctagtgcttggtttactttccgcttttgctgtttgagttctttattttctgcttagtgtagttttgtttctgaatttgatttgcatgttaacctgttgcttaggtttagtagaaacacaccaaacctattcacacttggcttgacttagtattctttgatcgtatcctgattgatagcaattacacccatttggattgacaccttacatgttgcaatgacataagatgcatttagggaattgacacaccgaaaacccttgtatcaatttggcgccgttgccatttgggtgtttttcttgttacatttagaatttctgagttattaagatcaagttctatttctttctttctggttactcacttgtttcttcatttgcttgtttttgttttgcaggtactcttactctactagcacgtcgagtataagcgtcgagtatcatcaaaactggattactcatttcaaatctggtcgtaatg

SEQ ID NO: 35558 - DNA, 3003 bp, Unknown
  misc_feature (1)..( 3003): 2750-1469P.txt file - cDNA_ID_3088787; gDNA_ID_2926140; Annot_ID_197432
cactgattatattttttgatcatttcagcatttagaaatgatggcaatgttgatgtggcataagaacggtgaacaactgctagcaaacagatgtattgtattggacttctccctgaggcatgaactttccaagcgggtggtcgacttcaggaagtgtattaataagaacgggttcaaatggggcaaatttatgtccgacattgctaatggagtacacataaaccgtgaacccactatgaagtgggtgaaggatgtaaagaacagcgaataactgtgtatgacgctttaatatcacacatgtgggagtcagctgtgaagtcgagaatgactcctatttacgaaatgatgtcgtacttagttagagcgatgtgccagtatgtcttgacttatgcgtactcacttaaaacttttgagtatgagcgttgtttaaccgttgctcaaaacccaactacaggagattgcgggccttacacgatgaagttcttggagttgctcgcgtttggaaaccctgtttcagacttgttcaccattcgagaagcagacatggtcttctaccgttagaaatactcggttgacatctacgagcacggaaagcgcgaggcgggttctgtgtattttgctataatcatccaagaacaataatctgaatctttgcaactaattattttgaacaaacctatcgaagatatttgattgcaactacatttaagtttggagattgtaagaagttaatttagttttcgttatcactctcttctcaaacaaaatgtaatgtgtatgtacacgttaaaacatatgtcccccatatatatctatatttctcgtacactgcaaatttactttctaacataactcaggtgataaattgatttgacagctaacgcttaccaacacatgtatgacattcaatacaactgtaattgccccaactaaatccacaatagtggttattaaagtgaagaacttactgactcttcccgacgattgactctcgaagataactaagaacatggctgactaatgttggtctgaccttggtccattgatacgatcaagcactcgtggaagagacattgtctacttataagtgtgcattttacatgttttgagcatccatttgttatcattattgcatcatatcaccactgttttataccatttctcatcatttgtcatcactttgcatgtttaggatagttttgcatgcatattgtatatttgtgttgatttcaggtgatttggagctgttaacgagctaattggaagaagcggacctgatcatgtcaaaccactcgacccccaggtcgagcagatgctccacgacatcaaaggaccacttgaccccctggtcgagtagaagacttcaccactcgactacctggccgagtaccaccatgagagtcactcgatcacttcactcgatcacaccactctaccatgaagtcgagtatcaccatcaccatcactcgattacatactcgattgccagctaatcactcgacctctcactcgaccacctgggtcgagtactgttcttaatccgtcccaatactgcgtcgttttgagtattagggtttcagaatatctcgctataagtagcatgtactttacattttcgtagggctaagttttattttccgcagacactgtgttcttgacattttgtaatctggatttctcttaatcaattcagtattcagcattttgttcttgatttcgtttactgttgttcatcatgttatcaccttgctattactctgttgttatcatgttttcattctattcaacgtgtatgttctctgcaatgatgtctgagtagtgaataagtttctgaggatgggttagagtagtttagaattctcagtatgctaggtggttgagtttgattgatatatcccttctggattagttgttcttaatgcatattgctttctgatcaactggaattggagcccagacatttctgcgcccaaaaggtgttcgatgaaatgtttgaaccactaattctagagattcgtggctctgtaccaaggtattggttgcagggagcgttttggctttaacttgttgattcgtaagcctgttaggttagctctcgtcaatggtgattaagtctgggactaagttaacttgagagtctctgttgcggtgacacttagatttggtttttgttgtctagggataatttattgagcatgtcaatcacctgtaaactgaggaaacaaacctactcaattaccccatcctcgtgaattctttatgtgattgatttctttgttacgctactgttgtttactgcatcttgtcatctgttgcttagtttctacaattctttcctgttactcgacctgatactcgaccacccagttgtctagcaacagactgtgcagtcgagtatctttgtttcggttactgcatgttactcgaccagtcactcgaccaccccagtgctctgcaacgagttgtgttggtcgagtgttttactgtatccgcttgattttctgttttctgcatgttcacttaggactgctagaacacaccaaaacctgttattgcttggcttgacttagtgacttctgatcacatcttgattgttagcatcacatccatttggattgacaacctaaaatactacaatgacatgattgatgttttaggataattgagtaaaaacctattatcaatttggcgctgttgccgattaggtgtttgtttgttacatttaagatttcaaacttgcttagatcaagttctttttcaattttcagttcagttactgactgtgtatttttgttgttgtctttttgatccaggtacacctctgctgtatgcaaactcgatcaccagagaaccagaacctctttttcaacaataacatcgaccacatggcttgcgaattcagagaaagaagaaacacagtccaccttttaccccaacaaccactcgaaatggctgacgaacagaatcaacagaatggtcctgccaacattggtgatgtagatg

SEQ ID NO: 35559 - DNA, 3003 bp, Unknown
  misc_feature (1)..( 3003): 2750-1469P.txt file - cDNA_ID_3088791; gDNA_ID_2926140; Annot_ID_197431
atttcaaactaaactgagtgaaataagcgttagggtcaacgaatctagaagggatctaacctaatcttcaccacctgaataacctagagattaacctaatataattcatcctcaaaaaccctaatcactactcaagcaacataatcaagaacacaaacccataaattactcatcaaaatgtagatttaaacaagataaacaactatactgaatgaactaaatgcaaaaacgaaatagattaagagtaattaaggtttcaagattctaaaacacaaagaaaaactatagaataaaagtttggtcctttggacaaaccccaaagtgacctatttatagtaaaatatgaaaaccctaaattcactagaagacaagagacttgaggcggtttagatgaatgatcgatcttgggatcaagcaaagagggtgctgcaaagcctgcgcctttgcctcgatgctacgagtgatcaattggtcgagtagttgcttcttcctctcctcttcttatgctcagctgtctcgttgagtggggaatgaggaggatctgaaggcaccttgaacgatcaacaagtcttttagaatccattgcccttgatcgagtatttggtcgagtagaggatcaagtaaagggtcgagtggttatctactgcttcctctatagatgccttgatagagtgattggtcaagtgaattgctctgctgcttccctcctggtctgataaagtagaggggcgagtgatttccttgtaacctccttttgaacctgaaaacacaccaaaacatccttagctaaatgatgacgaatacattcgtaaactaagtaaaatacagtgttatcagaaaccctaattagggttttttcaatcgagtttttctgtcgatttctttagaattaattagggttagttaatatcaattgattttcgttgtagatctaattagagtttctcgttttcgtttaattttcattgtagatctaattaaggtttcgtgtttccggttgattttcattgtagatctaattagggtttctcgttttcgtttgattttcattgtagatctaattagggtttcgtgttttcggttgattttcgtcgtagatctaattagactttgatttacaaatcgatttactaatgtttttttttattgtaagatgtcttttactcggaacgattattcaaggtttcgatctcaaggtagtgaaggaaacgcctcggcgattcagaataatcgccatatacattaccacagacgccaatcaatctgaaccatcaagcagatggtgcttctcctccacctgtcaatcaatccccccgcggttctacctatcacactactttgctagctgcccgactcaatgacttgacaataaaagagttacttgctaatcctgacgtgtaggtttgcctagattatgaagaaacagagtgtctgaagtacaacaggcgtgcctgaagcagtacagatcataacagagaaagtgggaaagtagcagttgcttttgccagcgtggcatgttgattggagtgaagaaaaggcgtatcagtttagacaaaggagacgaagtcgttagacataggacgtgggcctagttgtcaagataatgatgaggagctacacttggacctactggataaagtgaagcatcctgccttttccgtgaaatgatataagagaagtttcggtctcttattagggttagccactttacttgtgaaaagtggaagagaagaaaagttaagtagaacttgttcttgtgggtttcattggtgagtgaacaaagagagcacacggctgttgctgtgtttgtgaggtgggtagttttagtatctgataggagcaaatcaggttgttgatgttgcgtaacactgtccaaacttatctctgattgatcagtttgaaagttgttctaataaagtgtgtttattggagttgtgttctttgtctagtcaaagtacttagggatcttttacttcagattagaccctaaccggcctccgggaactctcgggtaagccactaggctctgatctcttcttgtctctgttcagttttgtctgtctgatggtgttttgatttgtaggtttgacgatgactcttcagttgcaactactgtccggagcatttttgaaagagatttcaaagaacctcatgcaaattggacacagacatcagaagcagtgatcgatcgatggtttgaaacctttggtgtaagtcaaataagttgtgttttgtttggtacaacaattgatcttgtctatttctaatgtgtcttatctttgttttgtagcaagtgtataactgggactctacaattatataatacatttcattgtattgattttgtaaacacacaaccacctcatcgatagcattcagagagggattccaaaaagagtcaacaaatctccttgtggcactacaatttatataaaatgatattattttaaatatcaaaacatatgaaagataaaaaatatacattaaatttttaagttcaaggcttgttaaaaacatcataaatttgtatttcaccaacactccttacataaccgagtatgcctgtaaaaaaaaagaaattttaacagaagttgaagaaaaaaaattgctctcaccgtttgtcaaagtgagaaatggtttccacagtttgtcttttcaatcaatttcggacaaaaataccctgggaaaatttcttaatggcatcaaccaaaccgtacagcagttggtatcggtttagttgatgcggttcagttttgaaaacgacaaaaaaaaacgaaacaaaaaaaccgaagaagaagaaaaagagaagagagaaacagaaagatttgagagagaattaaaaagctgttcgaaattcagtatccactccttcatatttcgacatcacttcgaattgttgggtagttgaattgaaccactaaactccaaaatccggcgaagagaaagttgtagttttttctggcgaagtaaggaacctccggcgagatagcaactttcgctatg

SEQ ID NO: 35560 - DNA, 3003 bp, Unknown
  misc_feature (1)..( 3003): 2750-1469P.txt file - cDNA_ID_3088850; gDNA_ID_2926140; Annot_ID_197412
gaaatatgtaacatgacatataatcatataaatatatatttacgttgagtttgtcaaaatatattgatcaaactaatatttgttttgaaaatcattaaaactcctatagagttatcataagtaatacgatgacaataatctatgataaaatatcactagataatgatatttataagtctatatgaaaaccatataattttgatcattaagattatggttattcattccaacgagatattgtatttgattgaaaatcatctcctgaagaagatgtttccgagggggagattgaatgatatgcgtggatgtaccctttttccttatcatagtttttatcccacatgatttttctatgacaaggtttttaacgagacattaaagaacacgcaaataatacacttgatgaatattaggaaattctatcaatcatccaaatgaatattatacactaatgatatttagagaaataaataagatggtcaagatgaatcatctaaaagatgatatgtatatttttcataagaaactattccaaatcaaaatcgtatacttactataattctacatatacatcccatctacgagattttatatgtatatgtgaatataatataattaagtagatattatatatcaattgattaatactgaaacatgttgacctgaataaattaatcaaatacacagcaaaacaactatggttaaaaaatacccattatcatcaatgaaggcgtgaacgtgtaacgaaataaaagtcatcgatttcgtttgtggataaccatatcaattatttatttgtactcgtactcaaataaccattaacaaaagcgaatagagacatatatgttctctatcatatcaatttaattagtatttatttgtatctaatgtacagaaacgagttctagtcatcaattaagaaattcactaaatcttaacatcgtaatctaattatgataaacgaacaagttcaagtgaattgtataattttgtttttctatgctttactaattagatttcataaatttaaacaagttaaaaacaaattacaattattcatctatatcaaaatatggatttaactagagtcaaattcagtattaaaaacatagactttgatactattgaaaggaatttgtactgttttataacgatttataaatactaacaacaaattcaattgcaaggaactgtgtaaataaagaattaaatctagatcataggatttgaatatacctggatattatgcagcggaaatatgaatcatgttaattcgagattggtttagcactccaagaattgtgcctctactggtatccacacgcatacaaactggatcaaacccagaatgctagttcctttgagatctaatctcaaaacttagaaaaacaatatttctctttgtttttatgagttgaagataatttatcaaattttcagagaacataaccgtaataacggtaaccgtggtcatgcctacatttaaaacatattaatcatgccaaaatagacataccatcatcagtcgttaaaacaatttgataaattatcttcgactttctttctcttctctctcttaatccttcagagagagaatgtctccgatggttgtttttggtggcaacgacatgtttcttcacttgcgttggctctcatatgcccaacacagttggttacctcaacgacggtgactggttttctcgtccgatttcggtggattcatctccgccgttggtcggctcccgtccggaattgtctggctcacatagtagaggtgtccggctttcgtccagcaccgtcgcgtttccacggtggcatgtggctagctttctcctatgcatcctctttcctttgtttatctgtgtttttacttttgtttgcttttaataatctcacatacatgggttggtaatgacagtgtaagtaatctagctttctactgttatgttccgatctatttcatgttgagacttaattgcagaaatcaaataagagatctgagaatgatgatgaagataagaagtggaatccgtcgcttattaatcattgccaatctgctgatgtatctttaattggagcctctttactatctaccggtgagaaacccttaagaatccatgttagatagtcctatcatcagtgattctgtcaccggaactgaagctccaacggtggaggttgaagtcggtttgcttaagattgctcatctgacacgtggttatgtcgacgtgtgtttcaggattgagtcaaatccagttttcttcttctgtgagcaagatgaaatcttctgatgggcctatttgggcaaaaaaacattttgtaatcttaagggttcaaaaacggctgcatctcaaaagtcataatgcatcacttttataataggttcacacaacctaatgcatataaagtcaatgggccaagcccaatccatgcaacgtgactttctctacaagaataaaccacatattcgtattagtgcacatatgtatattttatatacatatataacattatttatttaagtgctcaaatacaaatataagtatatctatatatcacatatatattatatacttttactttaatttatatatcatatatatataatagaaatcttttaacctaatattagtttaatcaaaattaaacttaattttatatttgatccaatttgcttaggtgtgtgaccatgtaggttcgtataatattaacaatgaattataaactcatagattataagcggtctctagcaaaacattataaccatctaatattatgtgaatgtcaaacctcgacattacaactttaactagagtaaagtacaaacgatttcaagatattcccaacattatttaggtttgatgatgtgtacaatgtcttgagttgtgtgtgtgtggattggtagattccttgatagttttttccctgatagtttttcccctttcctcttggcttatttgttttataggtgtcttctttgtatcgcacatgtacgtgctgatg

SEQ ID NO: 35561 - DNA, 3003 bp, Unknown; identical to SEQ ID NO: 35560
  misc_feature (1)..( 3003): 2750-1469P.txt file - cDNA_ID_3088850; gDNA_ID_1620796; Annot_ID_168477

SEQ ID NO: 35562 - DNA, 3000 bp, Unknown; identical to SEQ ID NO: 5501
  misc_feature (1)..( 3000): 2750-1469P.txt file - cDNA_ID_3088854; gDNA_ID_2926140; Annot_ID_197408

SEQ ID NO: 35563 - DNA, 3000 bp, Unknown; identical to SEQ ID NO: 8315
  misc_feature (1)..( 3000): 2750-1469P.txt file - cDNA_ID_3088959; gDNA_ID_2926142; Annot_ID_197541

SEQ ID NO: 35564 - DNA, 3000 bp, Unknown; identical to SEQ ID NO: 8315
  misc_feature (1)..( 3000): 2750-1469P.txt file - cDNA_ID_3088959; gDNA_ID_1971817; Annot_ID_176032

SEQ ID NO: 35565 - DNA, 3000 bp, Unknown; identical to SEQ ID NO: 8315
  misc_feature (1)..( 3000): 2750-1469P.txt file - cDNA_ID_3088959; gDNA_ID_1971715; Annot_ID_175169

SEQ ID NO: 35566 - DNA, 3000 bp, Unknown; identical to SEQ ID NO: 8554
  misc_feature (1)..( 3000): 2750-1469P.txt file - cDNA_ID_3088971; gDNA_ID_2926142; Annot_ID_197535

SEQ ID NO: 35567 - DNA, 3000 bp, Unknown
  misc_feature (1)..( 3000): 2750-1469P.txt file - cDNA_ID_3088971; gDNA_ID_2926142; Annot_ID_139000
ttatgttctgttaatgactttcgtttagcttcatgtggcatcttgttgtctatcacaaaagccaccatggcctgtgtttgttcaattggtgggtggctgaagttttagttgtgcattattaatggatctataagtaaattatttaatttgatgtttaaaatcgtagttgcaaagccattggttgctgatggaagtgcaaagtcacatgagctttcgctggcttacgatcaacactcccttctgaagctcgagcctcctcttgttcttcaggagtttgttaaccatggtatgagattttagtggttatcattgcctgtactagaacttagataatttgattacctatctaaatgcttggctttcgcaggaggtgttcttttcaaggtttacattgttggggaggctattagagttgtccggcgcttctccctacctgatgtctctagacgagaactccccaaatcagctggtgtattccgcttcccacgggtctcttgtgctgcagcttcagctgatgatgcagatctggacccgagcattgccggtaaaatcctcttcatcatcagtaaaaatcgtctgcatttttcctttgatgaggacctaacaatatcctcattctcgttgcagagcttccaccacgtcctctgttggagagactggcaaaggaactccgtcgtggattggtatgtttcagtcctctctactatatatccaagcaggagtattatatcaaactctactgatctctaatttgttgcagggtctaaggctgttcaatttagacataattagagagcacgggacaagagatcggttttatgtgatcgacatcaactatttcccaggcaagtttgatttccacacattttttgcaatagactatcacaaacatgtggtttaagaacaaaagaacttgcgcagggtacgggaaaatgccagagtatgagcatgtattcactgatttcttactgagtgtggtacaaagccaatgtaagaaacgagctttggcagatcaatactaaactcaacggagagaccattgttcctccccaaagaaaaaaagaagattagtagtctatgcaatttatttctgtacaggacaaagcaccgatttccctcgatgttgttctttagcttcattgtgctgtacaaaagaacaatggaagattgcatttaaaagaaaatccttgggacctttagagatttaaggatagagaattgtctgaatctcactacaatgtcaccatatcaaaaagtgaatagaccttatgtcacacactactcatatgggcatggcttcactttgtgactgcttctatcttttgatttggttggctttgtactattttgaccataaatgtcatttcttttggttttaatctgctcttatcttttgatcatgtccttgttagtttgtttgaaacttggagtttatagtttggatcagttttggatgcactcttttatgagtaatcttacaaaatttacatcacaaattgttgattattgactcttttatataaagtagcttttaaaccttatctagtacaacaatttggttagatcaatgtgaaccttctgaggatagaaaccattttgaaaccttaaaaaataggtttacttgcattgtaaggtttaataaacacaagtaggaaaacgaaacctgagcttcagctttgaattctttcgttctttcacatggttgtctatgacaacaattgaagccttctattttaattcaagcaaactacactttcctgggtttaagacaaagcaattgtagtttctctttttcttcttcaaatcacaaaatcaataatgttatttttttcaaagtattgtgtctagctcttgcttgtcttggagttcacttgaaactctctatgttctgtctttgacatagaagcatatattatatatatatatatatcagagcaagttcctcaacccaaccaaaaaaactaaaacctcaaaagctttttaacaattatcttctttttgtgtgtacttaatcttcttcgcttggaacttgctatggagaagaatacaaatacgaaccatacaagtgatgataataatgataaggttgtcgatatttaagcttcttcttaacaatagtgcgctaatgtttctacaagctagctaactagagttattttgtatttacgtctggcagaatcacactaacgaagagcaggagaagatcatcttaaaccctaattttgaggatggcctaaacaactggactggaagagcgtgcaagattgtcttacacgaatccatggacagtgggaagatcgtaccgctctcgggaaaagttttcgcagcagcaacgcagcgtaaagacacatggaatgggattcaacaagagatttcaggaagattcaggaggaagcgtgtgtatgaagtaacagcggtagttcgaatatttggcaacaatgtcacaagtgcaacagtacaagcgactctctgggtcttaaacgcaaacaaacgtgaacaatacatagtcattgccaagtaggtttcaccttttttcatcttctccattacataagtatcttgatataaattcattatactgatagagtttggtatgtcaatgaatcatattagtgttcaagcaacagataagaactgggtggagttgaagggtaaatttgtaatccatggttcgccatcgagagtaatactataccttgaaggtccacctccacgagctgacattcttctcaacagtttagttgttcaacatgctaaaaggaatcgtccatcgcctcctcctttctacgaggtttagtccctttaccaactaaactaaatgacactagactgatggttcttatggggatactaatctgttttgtttggcagaatcctggtttcggagtcaatatagtcgaaaacagtgaagttttagatgggggaactaaaccatggttcactctagggaactgcaagttgagtgttggacaaggcgctccgcgcactctgcctccaatg

SEQ ID NO: 35568 - DNA, 375 bp, Unknown; identical to SEQ ID NO: 5494
  misc_feature (1)..( 375): 2750-1469P.txt file - cDNA_ID_3088971; gDNA_ID_1620795; Annot_ID_50495

SEQ ID NO: 35569 - DNA, 3000 bp, Unknown; identical to SEQ ID NO: 8554
  misc_feature (1)..( 3000): 2750-1469P.txt file - cDNA_ID_3088971; gDNA_ID_1971817; Annot_ID_176025

SEQ ID NO: 35570 - DNA, 3000 bp, Unknown
  misc_feature (1)..( 3000): 2750-1469P.txt file - cDNA_ID_3088977; gDNA_ID_2926142; Annot_ID_197526
ctttctcttgatcatcaaaccaatgtactaaacacatggacatcagatgatccaagttctatgttaggtggaaaacgttcaaactgaattggtggaatggtttgattctcttgaaagatgattagggaaagatttaaaggaatccataaccttgtttggtttggttgttaaaaagataagagaaagatttttcagcttgaagttatgtgatttaaactgtgtttttcagcttgaagttatgttgttaaatagatgcggttttagaagcttcaagttagggtagggtgttaagttaaagctctttgatattgatcacagagagcaataaatcacatagagcttttacttacacttaacctaccaagcattcaataaaatagaccataactatgataatacttttacccaatgtaaaccactccaaaatacactagttaacatgcatttatcacagttaaaaaacagttagcttttattgcttagaccaattcagagaaattttgagcgcaataactaagagagagcttttaaaagcttcaagttagtattaggtgttagaatttttttttttttttttttttttttgatcaaaggtgttagaattttatttaaccatagagaacaaatactttcttctaagcatttaaaatattaatgtaatgctatctcaactcaaaaatatattgcatttaaacagagaaacaaataaactaatcaaaagcagacaacaaataatcaaaaccggacatcaaataatcaaaagcagacatcaactaatcaaaagcagacatcaaataatcacatatcaaaagcaaaatcaacaaatcaaactcagacaacaactactagatgaattaaagaaggctcagttctaccttcgtgttatcaagaaatagtgcaatctgtagagcgtggtaagggccaggacagacaggatatcagaaatgtacttctgcaaacatagcaaatgtaatttttaagccataccaatataagaattgttaataacttgaaatcaatgatgacataccttgagattagaatcagccattgtttcatgaaacgctttaagagttacatactggggacgcagaaactttagtggtttgggaactgaagtcattgaacttgttaaagctcggatttcctgcctacaaaaccaaaaaaaaattaaaaactccaacaagggtagaacacaaggagcagaaaagaaagaaaaactttataaattatgagcttcaaagacagtaatctgaaaacccgaagctaatcaagtcaagaattacctcatactctcaagagcagccttctgcaagtccggattaggatcctgaaccatctcaacatagagcttaaggttctgctttagttccaaatcctcttaagactacaatcacaacccaatgtaagtcgagtcattagtcctgtgaacatatataaaaaaaaaaactctcctcacagcacaagttagcaactttttaatccggctatactaatgacgaacaaaacattcactttgaacatgcttattgttttgtttttgtatatctccttatgctttgtaaaaccacgtacaatactgtaattgatatgttctcgtaataagaaaagaatacgaacccacttagtcttcataattagattcatcatatcgaatcaaagatgaaaagatttattacaaaaataaaccaaattaaaaccgataaataagtttttttctactatagacacaacattccaattgccatggtgattgaacaaccataggaaaaaacgattatcatcttcatttcttctctctttgttcttttccatcctctctttgttcatttccatcttcatcattctaacttcctctttgtaacgcccgtgaaccggaaaatcagttagagtttgtttttaaatcatccggtttaattgattgggttaattggaaaccttagagtatgcctataaaagaagtaaactcgaaattagggctttggttagccacttttcgttttataaaggagaaaaagagagaaaaggagaacgagcagaatcgttagggtttgggagaaatcagtttcgtcatatcaaatcgtggtaaaaggtaacgaaatttggcagagttattcccaagtcctttatcgttattctccaatttacagaattggatttggattcaaattggttgagttattcgcagtttcgtgagacacgttttctcagacgcgaattaggaccagcggagattgaaactgagatcgtggtctcgtctgttttccgatcggcacgagattttgtggtcagctttgtgacgtctgcagctaggatttcaccggagagattgaatagttaacggttagtttgtatttgagggtttcgtctttgagactgcttgtttctggtttttcctgtccagtttgcttcaaggttgcttttggttgtggactttttgtaggacgtttctggactgtttcagacgcaaggagagtctctcctgggtttaattgctattagaatcaatttgttaaggtgagtgcgtgaccatgagcttatctgagcgatagggttgtgtgatttgttttgtgtgatgatatgtaggtgtggtgaatgtgttttggatgaattgttcaatgactggtttgtttgtattgtattcgtgattatacctttttatttgcttgtgtgtatagctcgtagatgggaggatcgcctcactaagtatttatgataatacttacgcatctcattgtgttgttgatacaggtaaagataaagtgtgatcgtggaatcatggcaaggaagagaggatgatctaggaactcgtttgttttatttttggtgtttttggttattggaacccggttaggattgttagttattcttggttttgttggtcgaattatttatttattcattaaatagtatttttgacttgtggtttaattgttattctattggttggtttaattagatatttatggaaatatttaattattttttttaaaaaaaatg

SEQ ID NO: 35571 - DNA, 3000 bp, Unknown
  misc_feature (1)..( 3000): 2750-1469P.txt file - cDNA_ID_3089007; gDNA_ID_2926142; Annot_ID_197508
ggttgacggcggacgaattagacccattccgcctagggttaaggcgcgtctctgtactcgcggcggtgacgccgccgaccttgtctcggatgaactcgaatcatcgctgtaacagtggttgctcttgttctgagaatcttcgaagtcgctcatctttgggtttcgacggagaagggcgagagagatgaaagaaaaaagcaaaggaggcagatcgggaaggagggaatagcagagaaacgaaggagatagcaaaaaaataaaaacgagatttttctacttctacaaaacaaagcgcagtaaataataaaggaggagagaagttaccttgagagttgtgtgagttgacgtgacgtcaagtggagaggtggaaagttatttaaagccatcatcaccacgattttcgagattgcagaaatctattatccgcgcctgatctggaccgtcagatgcggtgcgctgaagagacgctccagctcggccgtccacatcagcagcgacttatctcgcgtatcttctcgaaagtttttggttaaaggaatctgaaatgaaaacgaaattgttgagtttatcctcaaaaccgactgatctaaccacatttatcctctcgtcaagaatattttcgcaatcttacttgacctatatgtccgctcatcgagttcgcctactcactcaatgggctggggggcaaatgttggagctggattcccctccaggaatccacgtgcgaaaatacaaagtcagcccacaaaagcccaccaagcccactaagtagaggacctacgcagctgacgagcccacatacgcgaatgggtatttgggccaaataagcccagtcacctgatgaagggagataagcgaataatgacctaggaactgacgaggagatactcgcggagaggacctgatatctcggaactgacctgccgaatattcaggaggatctccgcagatcccggacaaggctaccacgtgcgtagacctatataagggagcaaggacgacttagaagagacattcaatctagcttacattcacacccacacttttacacttgtaatctcttttctcattgtaaaagctttgtcaaaatcaatacaaaagtccattcgttcttagcaatataactctcaaggtttcagtgaagatctagccctcctttctcataatcttaaatacaaatctctagtgtggatttcagaacccacaatagtgttttaggattaatggactaaaatcctattatcaatttggcgccgttgccagtttggtgtttgtttgctatatttgagatcattagaaacgttaagatcaagttcatttttgttacacaagttactaacattgtgcttcttctgtctttgtgtttcaggtaccttgcaacctgctttacagacgcatctctatttcgtctgttatagcccagctgctatctgttgcatgcatacacggtcacaaggaaattagaacctcctattcaacgataacatcgaccgtattgctcgccaacttagagaacagacagaaacagacacaatggctgacattgtagatgagcaagagcaacctaccaacattggtgctggtgacttccctcacaaccacaaccggcgtcatggaattgttccacctccagtacagaacaacaactttgagatcaaaagtggtttcattgcaatggttcaggggaacaagtttcatggcctgccaatggaggatccgctagatcatcttgatgagtttgaaatgctatgtggccttactaaaatcaatggagttagtaaagatggtttcaagcttcgcttgtttccattctcacttcgagataaagcccatctttgggaaaagacggtaccccagaattcaatcacgacctgggatgactgcaaaaaggctttcttaacaaaattcttctccaactccagaactgcaagactccggaatgagatattcggatttattcagaagcaaaatgaaagcttctgtgaagcttgagagcgatttaagggttatcaaaccaaatgccctcatcacggatttaagcaagcttctcttctcagcacactctacagaggcgtcttgcctaagataaggatgttgcttgacatcgctttaaatgggaatttcctgaagaaggatgttgaacacgggtgggagctagttgaaaactttactcagtcagatggcaattacaatgaagactatgacagaagcatccacaccagttctgactttgattacaagcaccatagagagatgagagctctcaatgacaaactagacaaaattgtccaaatgtagcagaaacatgttcacttcatctctgaagatgaatcattccaagtacaagagggggagaatgatcagtgtgctgaaatcagctatgttcagaataaaggtggctacaacaagggtacaataattacagacccaaccctaatctgtcatatagaagcaccagtgtcgccaaccctcaggaccaagtctaccctcatcagcagcagcagcagaaccaacccaaaccgtttgttacttacaaccaaagccaagggttcattccaaagcagcagtttcagggaggatatcaacaacaacagccaccacctggtttcacaccacaacaacaacaagcaccttggcctcagaatttagacataatgactatgctccagcaactcattcaaggacaagccacatgagcaatggaaatcgctaagaacctggctgaattaaacaacaaagtcgaccgacaaggtgtcaaactgaacagtaagtttgaatcactaggcactaggatgagatatgtggaaggcatcctcgcttcaccatctgttaacaacaacccatgccagcttccagggaaagcaatccggaatccaaaggagtatgccactgcccatgccatcactatcagaaatgatcgagagctgccaactcgacatgtccctacattaaacactgaggacagtgtgattctagagggggaggatttttatcaagatg

SEQ ID NO: 35572 - DNA, 3000 bp, Unknown
  misc_feature (1)..( 3000): 2750-1469P.txt file - cDNA_ID_3089011; gDNA_ID_2926142; Annot_ID_197507
gttttggttttgattctcaggaaatgaataacagctggagtaacagcagggatgcaaccggtgttcaaataaaaaaaatcaattttttttatgaattactcgatcgcatgatgagagtaaaagctcgagagtgcgatctactggttttgggacaacatctttctcaacaaaaatgtcaaactactcgatcgcaacatggaagtggtgtgatcgagtggtctcttagtggaattgcccaaaccactcaatcgcaaggagaagtgaaaatgcccgacaggacttcaatgacaacccgcctgaagacatgccatccagctgccacgactttctcccaccaaggcaatccacctatcaacaaagggaccacaccgttccacaagtttccgcaaggcactcgtctcatgagccaatggaacacaagaggaggaagagtgctagaactgtacattcatcaattaagggtcgaataatgtcgggtcgtagaacacatgagcgacgtgcttcacaacctgctggggttgcgatcgagcataatgacgaggagatggcggagccacatcaagaaccggtcatgcttgctgagtacactcaagcagatatggatgactacatctccagaacattctactgaggtaacacaccaaaaccctttgtaaataccgcttttgtttttgtttctctgtttatcttgaattctttcacaaattttgattacacaagggactgtgtaatttaagtttggaggagggttcaagacgtatttgacttgttttttgtgaatattatttgagtctgcatatcatctaagtcatagaaaaaaacaaaaaaaattgaaaacaattttgaaaatgaattccacaaaaacagagttatcatttagttgcattacatttaggatcgagtctagagtgtttcatataggattgttgcatatccataggggataatcaggaaatagccttgtaagcatgatgattcactaaaatgagttattagttctctgaggcatttgaatgactttgaagtaaaaccgcaccatgttctatagaaaccactcgatgcatgtcatgacacctttccctgtcaatttgaacttgaatctgacttataattatcatgtttgcatcgtttttgaactcatggatagaatacttattttgattttatttaacttattcaccactcttgttaatccaagttgctgcttctattattggagtagttcccccacctttaaccaacccttctttcaagacatgttattttgtgagagcatgtgaggcctatttttaggattgagcttggtataacgtgttaaggttgagccgacaagagtagtatcccatgtagttccaaagaagagaagagaagccgaagaaaccactcgaacaccacctcatgacattcactcaatcgcactcgatcacatggtcgctagaccattcaatcttgacttcactgcatctcactcgattgcaaggcggagcccctgaagcctagtttgatcaaagagatactcgatcacagggaagctcatttcagcccatcagatgccaatgacacattcgatcgcagggtcatgacgtgaagattcgttatatatctagtttccttatttgtttcatttctcgcttatataaactgcctcttagggttttccctagggcatcctttgttattccgtttttcattcacttttacattttcgcaactttcatagccgcagtgtttctcctgcgactttgtattttcactttcaagtatttgatatttggttttcgtataagtcttacgtcatttatgttatcatgttttcaatcgttgctttgctattgtctttgattatgtctgagtagtgaaccgtatttctgaggatgggatagattagttgtggtttacttggtcgttttaggtggttgagtttagaatactagaatcccttctagattagttgcgcttattgctttcattggttaatgtggaatatgagtccagacgtccagcgctcagaaggcgtttaatgggcgttggatcctattaattccagagatatctgactctaccccaaggtattcgctgtagagagggtattggctttaacatgttgattcgataatgcctgcttagttagagatcgctaatgggaattaggtcagtgtctagctttgtttgaggatttctatcacgggagtgaattaatctgttgttgaacttgttgtctagggatagcttctttcaagttttgtcaaccacctgaatagattaaggagaccacactattcgattaccccatccttaggaatcgtttatccatttgattgccagttatcatttctgctttgttattcacctgcctgttactcccatttctgcttttagtttcatttcatttctgttattgcatactaggactgctagaaccaaccaactctctacttggcttgacatagagctttctaatcatatctcatctgtttgcatcacaccggattggattgacacctaaaatactacaatgacaggatagtcgtaacgcccgtgtcccaagttagggagtaaacaagatctctcatccgccgaattcgaggacgaattcagtgtaaggggggtagacttgtaacgaccgcatctcgcgttcataaagaggcaggtttgttttaggagaaaactagatcatggtcgaggaacggaataaaatactacgtaggaagaacgagaaagtataagctaaaccagctaggtgagctggacaagctgtatgaactagctaggtaagctatgtgagctaaaccagctggaagactagctagctcagctaggtgagctgaccgacagctcgactgagcttggtgagctgatcaagtactgacccagctgggtggtccggtcagctgacactcgagctggtggactgtggtagctcacgggtgaagaggtgtctcggccaaaaggtgtaaggtcgagcgggtaccaacgaacgtttgcatcgcccaaaggatg

SEQ ID NO: 35573 - DNA, 3000 bp, Unknown; identical to SEQ ID NO: 17481
  misc_feature (1)..( 3000): 2750-1469P.txt file - cDNA_ID_3089047; gDNA_ID_2926143; Annot_ID_197587

SEQ ID NO: 35574 - DNA, 3003 bp, Unknown; identical to SEQ ID NO: 17480
  misc_feature (1)..( 3003): 2750-1469P.txt file - cDNA_ID_3089047; gDNA_ID_1621164; Annot_ID_173805

SEQ ID NO: 35575 - DNA, 3000 bp, Unknown
  misc_feature (1)..( 3000): 2750-1469P.txt file - cDNA_ID_3089051; gDNA_ID_2926143; Annot_ID_197585
tctaaccaaagttttttggaatctaatagcaataacaatctcaataaatgtttttgcatttctaaacggttgcattttttatcataacttttcgttaaaatatttaatgtttgttttacagtcgtgtttttttgtcgtatcttttcgttaatatatttatggttatttttggtggacagttatacttattcaactttagtcgtatcttttcgattctgaacggttacgtctttttatcgtaacttttcattaatattatttacgattacttttgcggttgtgtcttcttgtcgcatatttttgttaaaatattgcatattttgggaaaatttatgtaataattcaaatatttgaatatatttatataataattaaatacataaatactaggcctgggcattcggttcttctgttctatagcctcttaagatctacgagggaaccgaaaaagtttcggtttggttcagatacttagaaagaaagccgagaaattaccgaactctaatagataccggtttggttccggttattttacccaaaataccaaaaagaaaaaaaacgaaataaccaaatattcgattaacaaaattgtaaaatattaaaaaattaacaaaactctattgggttataggtttgttaaaaatgtagtgggcttagatgtagttttgtatagggttgaccaaatattttttggttagattttggatttccatagatattcggtttgttcagttatacataatattcaatggatagtgtgactgaaatccgttcgaggatatttagtattatctagaaccgaaccggattcctttttcggtttggcttggttcggttcttcggttccggtttttatgcctaagccgttctaacttctatggttaattgaagaatgtgaaatggtggttaatattcaagaaattttaggaagccgaagtactaaatttagatactgaagaaaagaagaagaagcataagaagaggcctaaatgcccagagaattaaacaaatgggcctttaacaatatttttaacaatcagatctcaaaaagctaaagccttaatatataaacaaacatcaatctctggccgtcaaaggttacatctatcgccgccgctgagaccgccacttaaggccgtctcctccgcaatctccgtaaccaaaaccaccggcatcgcctggtaagctcgattttgtaatcatttcgatctcatatgatgtcgatctgttaaatcttgcgaaatcgatctttgttttgttctgagatttagggtttcacgaatttgtgttctaggttttctggcttaatcatttctattgttttttgttcttattggttcttatgcttttggtgacacaaagatctcgactttttcttgactctctatgcgaatttgtcaaaagtcaaaactttgtaacagtttactctctttcgtgcttgtgtttatgtatgaacaatagcttcgctattgggattgtttatttcaccacacttgattaattatacatactattgaaaatgttatcaatcttggcgataaaaaccgtcattttcatgtgtcttagctctagtagcaccttttgtttagagatcctgagtttaaagaagcagtagctagcatctttggtatagtaaattgtttcactgacaaattgtatatcatttggttataactagattagtgaaatttaatggatgagattatgtagcattgttttaattttgtatggagagaactggtggtgggcttatttccaaaattttcctttgattaagtcaagaccctttattttgagaagtgagagagaggattgtctgagtattgtcgctttctcaaaatctttccggggctaagcagagaaaagctgatagttaagcttaggaatgtgatcttggtcttttaagaatcttgaaactagtgggtaacttggatccatcgaatttgttttccgtaggtgagtgttctttagcctatttctgagtctgaattatacagtgtagacatgaaaataggtttttatgtgatggactcttttgttttatggtttaatggatatgttgagttttgtttttcccatgagtctcttataaagttggaatttgattcatggaatcttggatccagattacttcgaatatataaatgaaagaacacttagatgtatcaaagggaacttaagcgtgtgtactgtttagtgtctcacaacttggaatttggattagcgctttcatgttttggagtttgatttatattcgtgatgtttggatttggatagtaccttggtccattgaactatgtatcataataatgctttggatatggatatcgttttgatgacttacttgataactgctcatacttaaaaaacatttgttctagaaatctagattctcgtctatgagtgtttatatgttgaattcatgtcgaagtcatagtttagagatctcattgagcatttccccttcggaagagtgaggagtcttgttttggggattctttttagggctagacctgtgaggaccttcattaattgagttcgttttattttgtacccaaatatgttttttcggcttatcccattggcattgaaaaagttattgtttacattaaaatgttatttttttctttcattgagattaccttgctagtcattggattttatcggttttaaacttttaatagctgaacaaaaggggttttattctaatgtttacttaacactagtctggtcataaacaagtataaattttgggtttaagttatacttcttttattggaaatacatatcaaattagggcgtttcatagatagttgatatattttcttcacttgcatgtagttatgttcggtattatcgagaacttactgtgtttgaagttcctcggcaggaaaatcctgtagagtttgagccaatgttgtcggtgtgaacctcaaaagttgtgggtgtttttcccgccgataaagctgctggcaagatgggttggggttgggtagaatg

SEQ ID NO: 35576 - DNA, 3003 bp, Unknown
  misc_feature (1)..( 3003): 2750-1469P.txt file - cDNA_ID_3089051; gDNA_ID_1621164; Annot_ID_173808
tgatctaaccaaagttttttggaatctaatagcaataacaatctcaataaatgtttttgcatttctaaacggttgcattttttatcataacttttcgttaaaatatttaatgtttgttttacagtcgtgtttttttgtcgtatcttttcgttaatatatttatggttatttttggtggacagttatacttattcaactttagtcgtatcttttcgattctgaacggttacgtctttttatcgtaacttttcattaatattatttacgattacttttgcggttgtgtcttcttgtcgcatatttttgttaaaatattgcatattttgggaaaatttatgtaataattcaaatatttgaatatatttatataataattaaatacataaatactaggcctgggcattcggttcttctgttctatagcctcttaagatctacgagggaaccgaaaaagtttcggtttggttcagatacttagaaagaaagccgagaaattaccgaactctaatagataccggtttggttccggttattttacccaaaataccaaaaagaaaaaaaacgaaataaccaaatattcgattaacaaaattgtaaaatattaaaaaattaacaaaactctattgggttataggtttgttaaaaatgtagtgggcttagatgtagttttgtatagggttgaccaaatattttttggttagattttggatttccatagatattcggtttgttcagttatacataatattcaatggatagtgtgactgaaatccgttcgaggatatttagtattatctagaaccgaaccggattcctttttcggtttggcttggttcggttcttcggttccggtttttatgcctaagccgttctaacttctatggttaattgaagaatgtgaaatggtggttaatattcaagaaattttaggaagccgaagtactaaatttagatactgaagaaaagaagaagaagcataagaagaggcctaaatgcccagagaattaaacaaatgggcctttaacaatatttttaacaatcagatctcaaaaagctaaagccttaatatataaacaaacatcaatctctggccgtcaaaggttacatctatcgccgccgctgagaccgccacttaaggccgtctcctccgcaatctccgtaaccaaaaccaccggcatcgcctggtaagctcgattttgtaatcatttcgatctcatatgatgtcgatctgttaaatcttgcgaaatcgatctttgttttgttctgagatttagggtttcacgaatttgtgttctaggttttctggcttaatcatttctattgttttttgttcttattggttcttatgcttttggtgacacaaagatctcgactttttcttgactctctatgcgaatttgtcaaaagtcaaaactttgtaacagtttactctctttcgtgcttgtgtttatgtatgaacaatagcttcgctattgggattgtttatttcaccacacttgattaattatacatactattgaaaatgttatcaatcttggcgataaaaaccgtcattttcatgtgtcttagctctagtagcaccttttgtttagagatcctgagtttaaagaagcagtagctagcatctttggtatagtaaattgtttcactgacaaattgtatatcatttggttataactagattagtgaaatttaatggatgagattatgtagcattgttttaattttgtatggagagaactggtggtgggcttatttccaaaattttcctttgattaagtcaagaccctttattttgagaagtgagagagaggattgtctgagtattgtcgctttctcaaaatctttccggggctaagcagagaaaagctgatagttaagcttaggaatgtgatcttggtcttttaagaatcttgaaactagtgggtaacttggatccatcgaatttgttttccgtaggtgagtgttctttagcctatttctgagtctgaattatacagtgtagacatgaaaataggtttttatgtgatggactcttttgttttatggtttaatggatatgttgagttttgtttttcccatgagtctcttataaagttggaatttgattcatggaatcttggatccagattacttcgaatatataaatgaaagaacacttagatgtatcaaagggaacttaagcgtgtgtactgtttagtgtctcacaacttggaatttggattagcgctttcatgttttggagtttgatttatattcgtgatgtttggatttggatagtaccttggtccattgaactatgtatcataataatgctttggatatggatatcgttttgatgacttacttgataactgctcatacttaaaaaacatttgttctagaaatctagattctcgtctatgagtgtttatatgttgaattcatgtcgaagtcatagtttagagatctcattgagcatttccccttcggaagagtgaggagtcttgttttggggattctttttagggctagacctgtgaggaccttcattaattgagttcgttttattttgtacccaaatatgttttttcggcttatcccattggcattgaaaaagttattgtttacattaaaatgttatttttttctttcattgagattaccttgctagtcattggattttatcggttttaaacttttaatagctgaacaaaaggggttttattctaatgtttacttaacactagtctggtcataaacaagtataaattttgggtttaagttatacttcttttattggaaatacatatcaaattagggcgtttcatagatagttgatatattttcttcacttgcatgtagttatgttcggtattatcgagaacttactgtgtttgaagttcctcggcaggaaaatcctgtagagtttgagccaatgttgtcggtgtgaacctcaaaagttgtgggtgtttttcccgccgataaagctgctggcaagatgggttggggttgggtagaatg

SEQ ID NO: 35577 - DNA, 3003 bp, Unknown; identical to SEQ ID NO: 31724
  misc_feature (1)..( 3003): 2750-1469P.txt file - cDNA_ID_3089077; gDNA_ID_2926143; Annot_ID_197571

SEQ ID NO: 35578 - DNA, 3003 bp, Unknown; identical to SEQ ID NO: 31724
  misc_feature (1)..( 3003): 2750-1469P.txt file - cDNA_ID_3089077; gDNA_ID_1971793; Annot_ID_175600

SEQ ID NO: 35579 - DNA, 3003 bp, Unknown; identical to SEQ ID NO: 21569
  misc_feature (1)..( 3003): 2750-1469P.txt file - cDNA_ID_3089091; gDNA_ID_2926143; Annot_ID_197565

SEQ ID NO: 35580 - DNA, 3003 bp, Unknown; identical to SEQ ID NO: 21569
  misc_feature (1)..( 3003): 2750-1469P.txt file - cDNA_ID_3089091; gDNA_ID_1971781; Annot_ID_175410

SEQ ID NO: 35581 - DNA, 3003 bp, Unknown; identical to SEQ ID NO: 21569
  misc_feature (1)..( 3003): 2750-1469P.txt file - cDNA_ID_3089091; gDNA_ID_1971793; Annot_ID_175593

SEQ ID NO: 35582 - DNA, 3000 bp, Unknown
  misc_feature (1)..( 3000): 2750-1469P.txt file - cDNA_ID_3089104; gDNA_ID_2926144; Annot_ID_197651
attcgaggtaatgctttaattaatggtatatgtgggtaaatttaattttagtataattttttgtttttgtttttttttctttgtttttattttttgttttttttttatcgacaattttattagttaccattttcactagatctgagtaatttgtatagaacgtcatttttcgtttgttttggccaatcatacatcttattacctagacaaatgcttccacttttgtgtgtagacatgtgaaacttctacgtaggttggcaacacccatggttggatgtccgtatttgataatgtataaaaccatcccatgcgcaaaaacttatcagtttctttacaggagtaatcaatgaaacaatgatatcctgaaggatttatattaaccgatttaactgccattggctccaattgagctaacgtctaaacattggcttcgttttccgttaatgggagaatgttccttggatctcgattaatattctcgtgaagtttttcattccgtgatttctaaatataccgtacgatccaagaaaaattagaactaaagaacccaaaaaaagtgttctccaaagtcaataatttatctttacatagacccaagaaaatagaaaaacttccggaactattagtattggtgataatgccaaggtctgaaatgctggtagacactcacaattttttgattaatagttagtataaatttttaaattgaaaaaatgtatgagatttaacgttttgttaatgtctttcaactgtttggcgtattattctgaaagtgcaagaaaaaagattgtgtattttaaagataatagttagtatagttttcatggatttttcttttcgatacaagggtatatatatcatggaattccaaatttattgtttatatatacgttgtagttggattctatgttaaatattgttgataaaaaaaacggaacaaaaaaatgcacactgtaatagggtaaaagttagattattctaattagtttaattagaattaccagaaaacactctattaacataaatcatttaccaaaacaaagaaaaaatgttattttttcttctctttagtttacgaataatgtttttgtagtgaaagtttcttgtaagtactttcaattaattaatatatctatgattcaactactaagtaccaaatctcacatattacagcagcccccttggtttgacgaatgatatcactagcagcctctttggtttgactagcacccggcttgcttttgtcaaaccatgaaactttctttcatttcattattagtctcgtgggtctctcaaccactccattgtcctctttttttggttcgaatctaggactttttgtgtcatacgacgaaggacttgccactaggtcatcaacttcagtcgtcttttaataatcaatatagatgagtttatgtggaaaatgcaaaaagttcttagaaaatggggaattaaaaaaaacttagtgctagcacatgttttgtttttgtattgatatgtgctagcactaagttttttttaattccccattttctaagaactttttgcattttcatctttacaatttcaattcatatttatattcttgcctaacaaaaccaatataagtaaagacatgcactttgcttctttctatgtgttttcttcacttttagacacatgattcaatttttttaatagttaggatgctcagaaaccgttactcgtatatctctccaagactaaataaaattaacgttcttttggagagcagatcctttctaacgcagatcagtatcctctaaaatctctatattttcagtaaccaaatggtttaactactaaatatcaaatattcgtcgtgtgttacatgactaatttttaatataccatacataattttacaagtttatccactcttttccttattttctacaattcttttccttatttttttggacaaaagacaattattttccttcttttttcccaacaattactgttaaaacaaatcacaaaagacaagtatacagtaaaacctccatatattaatactctataaattaatatatttttccgattccaaattgggaccaatgtaaaaagagatacaatcgataaatttaatgataatattttttttgaaaaatgctatgtatacatatagtaccataatattataaaataatataaaaaaatcaaatgaaatataatttttagtaatgtttcttttgcttaaattcatattagcttttgtttaaatttaattctaatatgtttactgtatcaagtattttggtgttgtttactagacatgaaaattattttgtacatgtaaatggttctagaaagatattttatttagtaaaaaaatcttatattttcattgaaaattaaaaaagttatgaaattaagaaactctctctataaattaataaattataacattattaatttatcgataaattaatagctttttaaattaatagaattttgcagtcctaatactattaatttatagaagttttactgtatatgcacaaaaaataataaacatacagtattggtatagccaaaaaaaaaaatggatacataatcttacgtgaatggctagataaaaacgtctaatttcaatagaaaacactgataaataaccctatttacagaagagaaagtttaaatgtatttaaagtgtgaaataaagagattctgaataagaatacgctataattaaagtatttttagactttaaaacctagtagccgaaagaaaacagatgcttttaaaccactttgtacagagtcattcaacaaataacaatgtcttattcaaagtataacattccatatgtaatatactattcacggatacacaacttgaataaaagtatgtcaaataatccacaaaagtaaaagccgccaagctagaaccttggcctataaaaagaatcgttaagacaaacctacattcactcaaattaaaccataaccaaataattctcttaaaagagctaagaaaatg

SEQ ID NO: 35583 - DNA, 3000 bp, Unknown; identical to SEQ ID NO: 35582
  misc_feature (1)..( 3000): 2750-1469P.txt file - cDNA_ID_3089104; gDNA_ID_2926271; Annot_ID_143427

SEQ ID NO: 35584 - DNA, 3000 bp, Unknown; identical to SEQ ID NO: 35582
  misc_feature (1)..( 3000): 2750-1469P.txt file - cDNA_ID_3089104; gDNA_ID_2926144; Annot_ID_139060

SEQ ID NO: 35585 - DNA, 3000 bp, Unknown; identical to SEQ ID NO: 35582
  misc_feature (1)..( 3000): 2750-1469P.txt file - cDNA_ID_3089104; gDNA_ID_2926271; Annot_ID_205135

SEQ ID NO: 35586 - DNA, 3000 bp, Unknown; identical to SEQ ID NO: 35258
  misc_feature (1)..( 3000): 2750-1469P.txt file - cDNA_ID_3089112; gDNA_ID_2926144; Annot_ID_197635

SEQ ID NO: 35587 - DNA, 3003 bp, Unknown; identical to SEQ ID NO: 28508
  misc_feature (1)..( 3003): 2750-1469P.txt file - cDNA_ID_3089152; gDNA_ID_2926144; Annot_ID_197608

SEQ ID NO: 35588 - DNA, 3003 bp, Unknown; identical to SEQ ID NO: 23416
  misc_feature (1)..( 3003): 2750-1469P.txt file - cDNA_ID_3089168; gDNA_ID_2926145; Annot_ID_197705

SEQ ID NO: 35589 - DNA, 3003 bp, Unknown; identical to SEQ ID NO: 23416
  misc_feature (1)..( 3003): 2750-1469P.txt file - cDNA_ID_3089168; gDNA_ID_2926145; Annot_ID_139084

SEQ ID NO: 35590 - DNA, 3000 bp, Unknown; identical to SEQ ID NO: 8052
  misc_feature (1)..( 3000): 2750-1469P.txt file - cDNA_ID_3089189; gDNA_ID_2926145; Annot_ID_197685

SEQ ID NO: 35591 - DNA, 3000 bp, Unknown
  misc_feature (1)..( 3000): 2750-1469P.txt file - cDNA_ID_3089199; gDNA_ID_2926145; Annot_ID_197666
ttcggaaactccaacctcaccctctcacgtacaaacgcatcgtcaatcacattctccggtttcagaatacctccaccaacactccctttattactaacactcatataacgaaggaaaagtcttacaggtcattttatttcagtgcataatcgtacgagcatttgccttttttggttacaatattttcaattacctaataataataataaatattatagtgtacaggtaaaaattgacttgagcatcagagagttctcgaaattaacaaatcaagtggtagaatacaaacgtcgtatttatattcatataatcactaacatctccttaagatttagtttgatcatagcacctataaatatcaaatcaatttcttgaataaattctaaaccaccttgataagtcaaatactctatttgtgtctttaagcatacaaatattagattaagaaaaaaaaaatatttctctattttgtatatatctatttatatatgtgaatttaaaatttaacgattttattgattttataacatctgttaacggctgataaatcacggatttgaatatactaataattaaaagataaagtatttttagagaaatatctttttctaactaaaaagttaaggtattaaacgttcaaaaatgaatacatatgctttttgttattatttaacgatgttcattgattccataatgttcgttaagtcaagggtttaaatataccaacaattcaaaaaagatgtatttcggaccaaatataattcaatgaaatacttttctttaaactaaaaaataaaagtattaaatattcaaataaaatagatgggataatttttgggttttgtcgtgtacaattatagtttaaattatgaatgaagttatattttacacatttgtagaattcgtttatattttattattattactttttttgaacaaggaattggtttattttattgggtgaattaaatttctatgcttagacgaatgcgaaattaggaaagtatgagtgatgattttatatttagttctttctcctcccgacaacaaattctgacatatttatccctactgagcagagatattgttggatacgtaatgattatgcaacatttaattctaacacaagtatgaagataattaggttagtcgataatacgttatttgatatggtatcataggttatattagaagattcttgatagaaaataagaataaataaaactatgcccaatagtagaagacgataaccagatagcagataataaagttaatatagttgtagggcttcaccactcgcaatgaaatgtcgagttattacacgtgtagtgagagtaccgcaaaaattcgtatatggtaataaagtatccgataatcaatctgttaggggttaaaacttcaacacacgcaataaaatgtcgagatattacacagagtaaaacaatatgaaatgtcgagataatgagatagcagataataaagttaatatattcataatagagttaatatattcactactcgcaacacgtgagacgaattctgaaccgcaaaaacttgtgtacggtaacaaattatctgatagcaaaccaattaggagttaaaacttcaaaacacgcaatgaaatgtcaagataacgagatagcatataatagagttaacatagatataggtcctctcgcaatgaaatgtcgatttattacacatagggagagtaaataaaatgtagaattctgaaccgcaatgtcgataataaagtatctgataataaatatgttagaggttaaaacttcaacacgcgcaataaaatgtcgagatattacacagagtaaaacaatatgaaatatcgagataatgagataacaaataataaagttagtatattcataatagagttaatatattcaccactcgcaacacgtgagacgaattctgaaccgcaaaaactcgtgtacggtaataaattatctgataacaaaccagttaggagttaaaatttcaaaacacgcaatgaaatgtcgagataacgagatagcatataatagagttaatatagatataggtcctctcgcaatgaaatgtcgagataatgagataacagataataaagttaatatattcataatagagttaatatattcaccactcgcaacacgtgagacgaattctgaaccacaaaaactcgtgtacggtaacaaattatccgataacaaaccaattagaatgaaagagacgaagaaaaaacatgaggtaaatatagattggaccgaaacgacgcctcgattgaaaactatcaaaataatataaaaatttaattcacccaccaaaatatccaaagcaagatcttctactattcgccttacacaaagagatataagagctacatttagatttctactagacatagggatacacgcgtttttatttttgcaacagtagcgctgaaacttttgggaaattagaatctaaatactgaatccactgagcatacgtgcaattttcctattttattttactatttcatgaactaaaatttctaaaagtttttattcgttcaacttcgaaatatttatactgaaacctcctaaaatcattaatccaaatatcctcttttagaacacataagtaaaacgttcaaatcaaaccggctcaaacgtcccagtccatttactttacttctaaaccaaaccaattcaaaatcactctcatttattttcgttcctaaattaaatagtaaattaaaaagggaaaaatgtcaaaaaaaagcgtcaacttttaaatttgggacgaaaaaagcctgaactttcgaaatgtcatttaaatcttaaagttttgtttaactttataaaaaaatagttaagttttgttgactgggacattttaagcataccgtaaaatttccgtcaacagaaagataacggagttaattttccgttaataatctaaaacgacgtcgtttttcaaaataaaaataaagacgaaaaatgctaccaactagagatg

SEQ ID NO: 35592 - DNA, 3000 bp, Unknown; identical to SEQ ID NO: 35591
  misc_feature (1)..( 3000): 2750-1469P.txt file - cDNA_ID_3089199; gDNA_ID_2926271; Annot_ID_205139

SEQ ID NO: 35593 - DNA, 3000 bp, Unknown; identical to SEQ ID NO: 28520
  misc_feature (1)..( 3000): 2750-1469P.txt file - cDNA_ID_3089242; gDNA_ID_2926146; Annot_ID_197760

SEQ ID NO: 35594 - DNA, 3000 bp, Unknown
  misc_feature (1)..( 3000): 2750-1469P.txt file - cDNA_ID_3089254; gDNA_ID_2926146; Annot_ID_197755
tataagcctttcactggaaacccaaattgagacgtcaacggttaagtactaaatgtcgtcgatcacattttgatttggaacatggcttgtgttgtcattgtctcaatgaactgttttagcgaggcttcaatgtgagcaaatttctcattgacttctacttctacatgcatcttcacgagcttctcttggacgtcgtcaaagcttactttaagttgatcaagtgtgtccttgttattcgtagtcattgtacgaatttttgttctgatacaaaatgaaaaacaaggatatggaaattgataagaacaatagtcttttggtagaaaaattatgtgattatcttcttatttttatacttaaatagggtatacaacatggacgtgaatatggaatcatggattcatacaaaaatggagataggggaaagtggttcctacttctatgaccactagtatttatttagggggtgattgacattggactgttaagactttaaaagcatttgacagtccttacaagattaataatatttttagacttcaagtttcttttgtaaaattcaagattaataatatttttaaatattttttttctcaaaaatccatcaaaactaaaaattatttatgattcgatgatttatttttggtttagaccctgaatggatgctgattttcgattcagtttttggatttagattttagtttctagattttagattttagttttagatttttgttattatatttttgttttaaaaaccccaaaaaattggtttttagtttttgagaaaaataacgttgatggagtaaaaactagattccctaagttttaggaaaactataaaattaaaatcatgaatcaaaaactacaacaaaatagtttttctaaattgtagggaaaccaaaattttataatcttgattggtataaaaataagtttttgaaaaacaaaatctaaaaactcttacaaaatctacaaaacattcaaggccttagtctattgtattctattttggtttcaatggatgcaatgaaaaaagcacactaaatcgctaacagacaaaaccactttatttttagagcggacgataaatcgcatgcggataaaaaaaattctacgtaaaagttatctgtagttagtacaccgcaaactttttttttttttaattcgcactactgcggattatagtttatgaatgataaacaaaagggtgaatgaaatatctatacatggaagaatatataattaaggatctacacatatcatttagttatttaggtggaaattttcttgtaaattaaatatgacataattgcccctatacaaacaaagaatcagtagccttcttccgcgagatatattgtacctataagaaagagacacaaagcatttaagtcttaggtgtgtacctatatatatatatatatatatatatatagctccttatcatttttttgaaaaaaacagtcgataacaaaacttttaccatggttttgaaaacaggaaagaagatgtcgctgataactttggattatcgataattttgaaaatatcatgataatatacgaattagcagggtaaaaaaatgtttacatattacatttgttgatggtgtatgaagaaagtagagtcgataaagtaaatgttatctgataaaaaaggaaaatgactgctaatcaaaaaattaatgtgttgcagggcggtaagtaagcgacgaggaaaagtttttttgacggttcaagatggaaggatgagactgtttttggactaggagggtttgaacagatggtttcacttttgttatgaattagagttagcacctaatataaatgttacgttaactttttgttaacggctaatatttgtttacatatagtgataataccctcataagttttgcatcagagttactaccttatacaaactgatatgttaatacttgggttatcggctaatatcataagttccttgtgattacagatagtttcacttttgttatgaattagagttagcacctaatacaactgttacgttaacattttgttaacggctaatacctgtttacatatagtgataatacccttagaggtattaaaaatttgaattcataagttttgcatcaaagttaccacctaatacaaactggtatgttaatacttggattaccggctaatatcataagtttatggtgatttgagatagtttcacttttgttatgaattagagttagcacctaatacaaatgttacattaacttttatcttttggactgtgttttaataagggaaagaagggatacaactttccatttagaaagagaaatgacgatgacgactggtttccctaaaaatcaataaataaatagcaaaaaagaaaaaagactacatgcaaagaataataataatctgacacaatatattcatacagtataaaaagattttcctaggggtacatacgcaatttccacatgtacaatattagtcaaacagtgatttttttggacacttaaataacaactcttccaagtatagattgtgcaattttcctaaacaaaaagcagtctaaaccgttgatagatttgtccgtcctaaccgcgtaaccatttgaactcttagctttttttaatgttaagttgttgccaataaaccgaccgtaaatgaatcgagatacttgatttgaaaagtcgatccaaaatcaaatcaaacaaagaaaaatggtttaaaaccgaaatttctttaaaaattaaggatattgtagataaacattcaataccgaaccaaaataaaaccatactaaaccatccataatttggataccagtactaagaaaccaaatttttaaaaaccgaataattcaaataaaaaccgaaccgaaatcacatggttttgtaagagatcatttgaaaaaaataaaaaatattcgctcaacaattttgtttctctataatcaatcaccaatcagcaaaattctagggtttcaattatcttctctgcgatttgaatg

SEQ ID NO: 35595 - DNA, 3000 bp, Unknown; identical to SEQ ID NO: 35594
  misc_feature (1)..( 3000): 2750-1469P.txt file - cDNA_ID_3089254; gDNA_ID_1971905; Annot_ID_176969

SEQ ID NO: 35596 - DNA, 3000 bp, Unknown; identical to SEQ ID NO: 28514
  misc_feature (1)..( 3000): 2750-1469P.txt file - cDNA_ID_3089284; gDNA_ID_2926146; Annot_ID_197721

SEQ ID NO: 35597 - DNA, 15 bp, Unknown
  misc_feature (1)..( 15): 2750-1469P.txt file - cDNA_ID_3089288; gDNA_ID_2926146; Annot_ID_197719
tgattttaaaacatg

SEQ ID NO: 35598 - DNA, 3003 bp, Unknown; identical to SEQ ID NO: 21052
  misc_feature (1)..( 3003): 2750-1469P.txt file - cDNA_ID_3089318; gDNA_ID_2926147; Annot_ID_197821

SEQ ID NO: 35599 - DNA, 3003 bp, Unknown; identical to SEQ ID NO: 21052
  misc_feature (1)..( 3003): 2750-1469P.txt file - cDNA_ID_3089318; gDNA_ID_1620633; Annot_ID_162761

SEQ ID NO: 35600 - DNA, 3003 bp, Unknown; identical to SEQ ID NO: 18935
  misc_feature (1)..( 3003): 2750-1469P.txt file - cDNA_ID_3089325; gDNA_ID_2926147; Annot_ID_197818

SEQ ID NO: 35601 - DNA, 3003 bp, Unknown; identical to SEQ ID NO: 18935
  misc_feature (1)..( 3003): 2750-1469P.txt file - cDNA_ID_3089325; gDNA_ID_1620633; Annot_ID_162758

SEQ ID NO: 35602 - DNA, 3000 bp, Unknown; identical to SEQ ID NO: 28522
  misc_feature (1)..( 3000): 2750-1469P.txt file - cDNA_ID_3089333; gDNA_ID_2926147; Annot_ID_197791

SEQ ID NO: 35603 - DNA, 3000 bp, Unknown
  misc_feature (1)..( 3000): 2750-1469P.txt file - cDNA_ID_3089354; gDNA_ID_2926148; Annot_ID_197878
tttcttttgtggagatagagaataatgagtggcacaaggcctttttcttcatttgttcccattagacttgtttctatagcctcatgttttctcgagtctgccttctcaatctctcactgaacttcaacgtctttgttcgggaccaaaacctctaaataactaactcgattaaaccctgttttcgacacggtgaccaagtttgttttctgtgaatatgattgaggttgagaaagatgagtgtaatatgatgatgtgtattattgcaggtagagacgtgaagaaaagggatttaaagtcgtataagtatgtagttagctctgtttttggcatgtggaggtaatggaacagagcatattccaggctttcacaaattggatacctttaagccacttcaaacccgaaaactaatgtgaatggtttctatagttgaagaagaatctgagtaggagatggtaaaggttaactgaaatagtatggactttaaagtctatataaatcatgttgatgctcatttgcacaataatatatcttgagtgtaaatgggatcatgagattggaacgagtgacatggaaaaagagacaacaaagatgttatatgttcttttctttcataggggaaatatccaaactcaaaattgtaatatagcaataaatatgaaatttattattcgagtgaacaacaaatgacaaattcatggatattgttttttttcatctacccaaaatatgtagtttttcttttattatagtttagccaattatttatcattttcattttattaagaaaaatatgaatgaaacgaaaactaaactgtgatccctcttaattcatttcttttaatgtgtaataatttgtttataatagtatttttttataatatttgggaatttgatattgacataaattttagggtcattgttttctaagattataaccaaaacctaaaattccaaactaccagttatattataaaataagcaaattatagttataatcttgtgtctatattggactttgatataatatttaaaagataaaatgaaatgcattactacacaagccccataatgaatatgtcaaggaatatccaaaaacgggtaaggagctttgtgaccattcgactctttctacgattctagttcttaagtaaagctttcacacccattattcacagatttaggataacgtccacttgcccaccgaaagagactcttagacttattgtgacaacttcaaagtattcttcaatccagtagagatttttcagatatttattagagtaaatctgttaattatatagggctcattgtttgtcagtttattgatggatgatacactgaattttttttgcggtgaaacttatgtattggtgttttttttttctttctttctacatcaatctttttcttttaagagtgtaaagctcagcccaaattcccaacagtcaaaaagttaattgttgctttcattggtaatcatattaaagacagttaaagatataacccttatttagttactatttaccaatcatacaagcagataaaataggcaattgaaaataaaagttcaaatattaactaaccacatatttccgatgcagtcaaatatttttcttaaccacatactaatatactatcaatgaaaagaaaatctcattattttttccaaccacaactatttcttttttttttctacctttctcgatatctaaccgtatcatatcacatatgcaaacaacatttcttagagttgactcttttgagctctaaataaagatagattgacaaaaaacaattttttaatttttattgacgcattcaactttaattttctaaatatcaatcaattcttacaacacactaattttttttctagctggttgaccttctctggtatatctgctttctatttttagtttttgaataaaataaaaatctatttttagtatgtgttaagtatatttattaagaaaaaaacaacgttccaagtaagatacaaaacgtttttacaaatctgaatcatgaaaaatgctacttcacttataatttattgttttctcatgttcctccttatgaacaatgttaaaggtaatatcttagtctcgttaagatttaactaataccttattcacaagatcgaaaacattgattatatctataaaacaaatatgcattaaaaatagagctttcatttttttgtattatcaactaaattctatatattttatacttttttattgattgaaaatagggcagggaaaaaaaaaaccaccatgcccgcttggactgtcggcaaacggaaaatgtgggcatgacggacctaagttatgttttagtgaaatggaacgaaaatttaataaagatgtggttaaaactattacccactgcaagtgctgggatgatcgacgcaacaatgtggacaagcatcggtgcacatgttatttaaaacatggttttccttgcaccaatggctaagtttgaagttataagatagttttgtttatggcaaatgttactggaaaatcttcaaaaaacagctccatttatttttcatttgtatgtttactatccaatactttttggttagaaataaaaatacctcatttaattttttttggcctaaaaataaattatctttaaaaagttaattacaaaatagacatttgtcttaagaatttatttattttaaaacatttctgatatgtctttacgaaaacaagtatttctctcatgtgaaaaatcatctctaacctcatttcatttgagtcatcttctcaaatcgagaaagtttaattagtgttgtagtgttgtgtcgttgtgtctatgtatgcatcgcagactgtcgactaaacggtttgggtttacaagtccaattctagagtatagtgttttgtgaaaaacaaaaaattatgttgcgaaggaccttctctgtcgttgctttgagacaccaagaagcgctgcaccaccactgaagctgtttgccaccatccaccattgatg

SEQ ID NO: 35604 - DNA, 3000 bp, Unknown; identical to SEQ ID NO: 3859
  misc_feature (1)..( 3000): 2750-1469P.txt file - cDNA_ID_3089354; gDNA_ID_2926148; Annot_ID_139192

SEQ ID NO: 35605 - DNA, 3000 bp, Unknown; identical to SEQ ID NO: 3859
  misc_feature (1)..( 3000): 2750-1469P.txt file - cDNA_ID_3089354; gDNA_ID_1620670; Annot_ID_48137

SEQ ID NO: 35606 - DNA, 3000 bp, Unknown; identical to SEQ ID NO: 3854
  misc_feature (1)..( 3000): 2750-1469P.txt file - cDNA_ID_3089354; gDNA_ID_1620670; Annot_ID_164074

SEQ ID NO: 35607 - DNA, 3003 bp, Unknown; identical to SEQ ID NO: 19515
  misc_feature (1)..( 3003): 2750-1469P.txt file - cDNA_ID_3089358; gDNA_ID_2926148; Annot_ID_197876

SEQ ID NO: 35608 - DNA, 3003 bp, Unknown; identical to SEQ ID NO: 15603
  misc_feature (1)..( 3003): 2750-1469P.txt file - cDNA_ID_3089358; gDNA_ID_1620670; Annot_ID_164071

SEQ ID NO: 35609 - DNA, 3000 bp, Unknown; identical to SEQ ID NO: 3861
  misc_feature (1)..( 3000): 2750-1469P.txt file - cDNA_ID_3089366; gDNA_ID_2926148; Annot_ID_197872

SEQ ID NO: 35610 - DNA, 3000 bp, Unknown; identical to SEQ ID NO: 3861
  misc_feature (1)..( 3000): 2750-1469P.txt file - cDNA_ID_3089366; gDNA_ID_1620729; Annot_ID_166051

SEQ ID NO: 35611 - DNA, 3000 bp, Unknown; identical to SEQ ID NO: 3861
  misc_feature (1)..( 3000): 2750-1469P.txt file - cDNA_ID_3089366; gDNA_ID_1620670; Annot_ID_164065

SEQ ID NO: 35612 - DNA, 3003 bp, Unknown; identical to SEQ ID NO: 18927
  misc_feature (1)..( 3003): 2750-1469P.txt file - cDNA_ID_3089381; gDNA_ID_2926148; Annot_ID_197846

SEQ ID NO: 35613 - DNA, 3003 bp, Unknown; identical to SEQ ID NO: 18927
  misc_feature (1)..( 3003): 2750-1469P.txt file - cDNA_ID_3089381; gDNA_ID_1620633; Annot_ID_162775

SEQ ID NO: 35614 - DNA, 3003 bp, Unknown; identical to SEQ ID NO: 19385
  misc_feature (1)..( 3003): 2750-1469P.txt file - cDNA_ID_3089400; gDNA_ID_2926149; Annot_ID_197920

SEQ ID NO: 35615 - DNA, 3003 bp, Unknown; identical to SEQ ID NO: 19385
  misc_feature (1)..( 3003): 2750-1469P.txt file - cDNA_ID_3089400; gDNA_ID_1620659; Annot_ID_163757

SEQ ID NO: 35616 - DNA, 3000 bp, Unknown; identical to SEQ ID NO: 3723
  misc_feature (1)..( 3000): 2750-1469P.txt file - cDNA_ID_3089404; gDNA_ID_2926149; Annot_ID_197916

SEQ ID NO: 35617 - DNA, 3000 bp, Unknown; identical to SEQ ID NO: 3723
  misc_feature (1)..( 3000): 2750-1469P.txt file - cDNA_ID_3089404; gDNA_ID_1620659; Annot_ID_163751

SEQ ID NO: 35618 - DNA, 3000 bp, Unknown
  misc_feature (1)..( 3000): 2750-1469P.txt file - cDNA_ID_3089431; gDNA_ID_2926150; Annot_ID_198033
ctgatcacttgtttaaaattaaacagttgcatttagattatacgatactcgtgagactggattcattgaaccggaggaggtacgtatgtaaactttgtctcaaaaaaaagaaaaagtcatgattaattatatttgacggttttcctcgacttggagaaatctataggtgaaagagatgataatagacgttctagaggaatcagaacttatgctatccgagagtatcattgattctatcgtgtctaaggtgtgtataacgcttaagtttatgagcttgatttaacattatagtgattttacttactatttttgtttacttatatttggcaaagacatttgaagaggccgattggaaaaaagatgggataatagatttggaagaatgggagaattttgttgccacctatcctttgacactaaagaacatgactatccctttcttgaagtaattcgtttgtttgtttttcctaaccattttcttaatattcgctgataaattgcatgttttagatacatctttcgttttacaaaaaaagtaatatatatacatctttcaaaaacagcttttatatatgtgtgtttatgcatatattactattatcttcttttattttatttttcttgttttataaatcgagataattattctaaaattaacttttattgtacagggacattccgaggattttcccaacctttctccggtaaaatcagatgaggtgtttgctagaggtttttgtttaaaaatatttttatccgaaaatcacataggtaatttgttataagaaatatagaaggttaattattatataaacatattaactatcgaaagaaatctttaatatttaacgaggatagaaagtaattgtttttaaccacaaagctaaagctgtgatatgaaaacttaaaagcaaagatcggttcgtgaagacaaaatggggttttggaaaaggaaaagaggaaaaagaaaaagaacaaacgtgtgaaaattcgagaaaaatggtaacacaaaaagaaattggacatgatataagttgccaaaaccaaagagaaaaaattgacatgatataccaatcaaatttttgaatcaggtcaactaatcaaattcacaacaatcatccacaatattatttagatttgacgctttcactgtttcacatgaaaattttacatttgacgcgatgacttgtggagtcacgatcattttagtcactcgttttaaacggatgcttcattcaaaaaatgtaacttatattcagaagactcctaacgtccgattcagatttacaaaaaaacaatatcattgaatcggaaaacagaaaagcatagtaatattctaagtatttaattataatcgtgaggaaatagttccgtaataatgggggaaaaatatatatatgataaaaccaaaatgagatttgcctgaagatgccatatgtctgatcaaacactctgagctgttgtgtcgatgaactcaccatatgccaagatacgctattagcgacaacacatttgtattgtcaaatgtcattaattaacatccacaggtccaacaacagagaaacaaaataattatcacaagtaaaatataaaattagtaatatacttgtacttataatttttggcttatgccttttaatttattttaacactagactcgacgaaactcatcactaacatgaccacaaaaaaaaaagattacaattctaaaacacaaagattaaaaaagaaaacataacgaagtaaaattaagactagacatcaactttacaagttgaaggagcgagaagaggaacttgtccgttagaagatggattaaatctcaaccacacatcacatctggcgtaaaatccataccgtccagtcttaatcgcaccagctttccaacgtagcctcccaaaaatcaccactctcatcaaaacgacgccgtaagcttcatcattttttaaaccattagctacttccggcgagactggtataccgttgcctcccatcaccggagctatcacaaccgtagatttatgtcctaaacgaagcggtggtagtggaagcggcggtgttatgatctgatctttgtacgttacgtacatagagagcttgtcgtagtgaatggagactctccggttagggtttcttgctaaaacgctgaactgaacggaggttgagattaacggcggcgctgtgaaattcaggtcgtagatggcggctccgacgacggtgagacgtggtttatgtggacggtagacgagccaaaggattaaggctatgatacctagtatgacaaggatggtgaagatcgcgccgcagattgcgcggcgagcatctccaccgcctcctccgccttctttagagtaagattctggcgttgaagaagcggagggagcgttcttgtgatctgctttggctgcgtgctctgcttttgcttctccttctcccatggctatactctacagatataagtgttaaagtgtgtatgtataggtatgtgtgtgtctatacgagaatcagagggttcggtgaagagtgaagactctaaagaaggaggaggagaagaaagaagataagtagatgcaaggttttgtctcttttctagttaataagagtaaacagtcttctagagtacagttttattaattgtttattaacttagaaagcttgtagttgtaattatgtgttaaagctaatctttttataaagtagccgtaaattactactgtttttacattgtgattttattttgttataatacttaatgtaataatataagatagagaagtactttcgaaagactccaaatctcggtgcaaccgttcacgtgacggatctgatgagtgatgaattttttaaaaatgaaaaatccaatgtaacgtgtatacatatggctatacataatcaaatactttgttgtcaatgattgacttatttggtgacaactatggtttcgtgcaacgtgataactatcactttttggccgtgttaatttttaaaaaaattagaatg

SEQ ID NO: 35619 - DNA, 3000 bp, Unknown
  misc_feature (1)..( 3000): 2750-1469P.txt file - cDNA_ID_3089431; gDNA_ID_2926150; Annot_ID_139292
tttagatacatctttcgttttacaaaaaaagtaatatatatacatctttcaaaaacagcttttatatatgtgtgtttatgcatatattactattatcttcttttattttatttttcttgttttataaatcgagataattattctaaaattaacttttattgtacagggacattccgaggattttcccaacctttctccggtaaaatcagatgaggtgtttgctagaggtttttgtttaaaaatatttttatccgaaaatcacataggtaatttgttataagaaatatagaaggttaattattatataaacatattaactatcgaaagaaatctttaatatttaacgaggatagaaagtaattgtttttaaccacaaagctaaagctgtgatatgaaaacttaaaagcaaagatcggttcgtgaagacaaaatggggttttggaaaaggaaaagaggaaaaagaaaaagaacaaacgtgtgaaaattcgagaaaaatggtaacacaaaaagaaattggacatgatataagttgccaaaaccaaagagaaaaaattgacatgatataccaatcaaatttttgaatcaggtcaactaatcaaattcacaacaatcatccacaatattatttagatttgacgctttcactgtttcacatgaaaattttacatttgacgcgatgacttgtggagtcacgatcattttagtcactcgttttaaacggatgcttcattcaaaaaatgtaacttatattcagaagactcctaacgtccgattcagatttacaaaaaaacaatatcattgaatcggaaaacagaaaagcatagtaatattctaagtatttaattataatcgtgaggaaatagttccgtaataatgggggaaaaatatatatatgataaaaccaaaatgagatttgcctgaagatgccatatgtctgatcaaacactctgagctgttgtgtcgatgaactcaccatatgccaagatacgctattagcgacaacacatttgtattgtcaaatgtcattaattaacatccacaggtccaacaacagagaaacaaaataattatcacaagtaaaatataaaattagtaatatacttgtacttataatttttggcttatgccttttaatttattttaacactagactcgacgaaactcatcactaacatgaccacaaaaaaaaaagattacaattctaaaacacaaagattaaaaaagaaaacataacgaagtaaaattaagactagacatcaactttacaagttgaaggagcgagaagaggaacttgtccgttagaagatggattaaatctcaaccacacatcacatctggcgtaaaatccataccgtccagtcttaatcgcaccagctttccaacgtagcctcccaaaaatcaccactctcatcaaaacgacgccgtaagcttcatcattttttaaaccattagctacttccggcgagactggtataccgttgcctcccatcaccggagctatcacaaccgtagatttatgtcctaaacgaagcggtggtagtggaagcggcggtgttatgatctgatctttgtacgttacgtacatagagagcttgtcgtagtgaatggagactctccggttagggtttcttgctaaaacgctgaactgaacggaggttgagattaacggcggcgctgtgaaattcaggtcgtagatggcggctccgacgacggtgagacgtggtttatgtggacggtagacgagccaaaggattaaggctatgatacctagtatgacaaggatggtgaagatcgcgccgcagattgcgcggcgagcatctccaccgcctcctccgccttctttagagtaagattctggcgttgaagaagcggagggagcgttcttgtgatctgctttggctgcgtgctctgcttttgcttctccttctcccatggctatactctacagatataagtgttaaagtgtgtatgtataggtatgtgtgtgtctatacgagaatcagagggttcggtgaagagtgaagactctaaagaaggaggaggagaagaaagaagataagtagatgcaaggttttgtctcttttctagttaataagagtaaacagtcttctagagtacagttttattaattgtttattaacttagaaagcttgtagttgtaattatgtgttaaagctaatctttttataaagtagccgtaaattactactgtttttacattgtgattttattttgttataatacttaatgtaataatataagatagagaagtactttcgaaagactccaaatctcggtgcaaccgttcacgtgacggatctgatgagtgatgaattttttaaaaatgaaaaatccaatgtaacgtgtatacatatggctatacataatcaaatactttgttgtcaatgattgacttatttggtgacaactatggtttcgtgcaacgtgataactatcactttttggccgtgttaatttttaaaaaaattagaatgaaatttatcaggttacggcctgtcaaagttagcaataacctaatatctgtttgcatgccagaatacggttatgtagaaagaaaattaaattatcatatttcacaattctttatcaactgtataaagcaattaataataaattaattagataccacatgtgtcatatttgttctaatgtttagaaaataaaagtacaagtcttttatgtccacatctccaacaatacttctgaccaaattccatatattattagtaagcttccaaaataaataataatcacatttaagaagaatctgttatttaatcacactaactgagataccgcaccaccgacactgtagtcaccgacaatgctgtggatgctacctgggcctcaattataagcccattataaaattgggcctacactaaaactattgtgtacagagagatatttgataatttgctgactgatacaagtctcacttccaacggccgatttattaaaaaaaaactccgacaaatg

SEQ ID NO: 35620 - DNA, 3003 bp, Unknown
  misc_feature (1)..( 3003): 2750-1469P.txt file - cDNA_ID_3089439; gDNA_ID_2926150; Annot_ID_198029
ttttattgcaaatacttaagaaaaacactcatgtttatcatacacttggatgagtactccaatctcaaaagcagagtaaatatcaagggaagaggcctttgaggtcctcacagctgtcagcttgtcgttcttcttgaaacggataagacttaaagttcataaacacattgaattacacaaagaagacacaaaaagttcctatatattgcaagacaaactctacttgcactctagctctcgttgctttggctttggctttagctttatttgcttcacgtttagccttgtaaggtatgatactgaagcttggaagtaatctgtgagaaatgtctgccaaattctacatgtttcggcataatcatccacaatctgataaattgttatgtagaatgaagacaatctccttggaaaactctgaaccatccctaaaccacttcaatcacaattcccaaattactgtatttattgggcaaaccaaaaacacaacttctcgagcattagttatagatgagagttgtaaaagcaattgcgatcaatatatcatcagctgattttcaacggttcagattaaaatttacaaaatttccttcttcttctttttttcttttttttttgagattcaagcccaaccaaattattaaacccgtttatggtttaagaaggcccatatggaagataatatcatataactaaggatacttagttttgttaactatattgatttttctcagtgcttcaaaagttgttacaaatccaatgctaattttgggcatgtctcttgagtcttgactaatcaattttttcttttaaaaaagaaaacagtaaactaattataggttgttgtgtcctgacaactctcagccttaataacttaagattcgcatcatcaaattattaagaattactcgaagagtagacttttagctgttttgaatttcaagatttgaaggatgattcaaatcgataaatgaggacacctacatttatgtaacgttgtccacgtctatgacaaataattttggactatgtgcaatgcatgattgttgggctgtatgtctaatttacagcattaatttttcgtaagactaaagtcttgattacttgtcaatcatgctgtaactttattgtaaaatttacagtctaaattttttttctttttaaggttatagtcgagtaaattctcaaagctctaatttttttactgtaaaaattttaattcaataaataaattctagaaattaaaattatcaacaaaaatatataataaaaacaaagatatgttctaaaaaaatgataattatcaaacctaaaaaaaaaagattataaataaatatcatatgaagaggtcaaagtacaagacgatgaccaaatgattgattctaggcaatatatggaaggaattcgagatgatattacaataaatttatgaaataattataggtaaaattatatttattttatcaataattcataaggttttattttatttttatatcatcataatatatttatttaaattagtaatacaaggtattttatttactataaaaatatattttattacaagtattatatttacaaatctatttttataaatatttaaaatcaaaaacttacagtaataaaagttacaggtatagccaacacaggtacatcaaaaattttacagcaaaaattctatagttacaacccaaccaatcatccacttaacttgtggaaaatttgtataaatttaaataacatctgagtaattagttttttatttgtttgatcaaatattattacggcactaaaatacctctaaacttttctagtccgaataaattctcatccacatccaccttttattctcatttttacattcattccgaaaaatcattactttctaaaaagaaaaaacgttcataaattctctaaacactcgtgcatcaacataaatccaccattttcttctatgaatatttccaaattcgaatttgaattatcgagctaataaaagctagcatgttagtatgttacaatctccggttatttgtaaagaagtaaaaagttccgagtcatatattaaatcgtgacatcctttatatatatatatatatatatatatatatatatatatatatatatatatatataagtcgtttaattcatgataattcgtgattcgcatcaaattagtagaatatgtattagaagtctaaatctcttagctgtttgcatgggaccatttttaaaaatatattatcaatttagaaaatttcaaaggcaaaggcgccgacgaccacgtctactacaactaaattatataagaattagcttgtgggacatttgtttaagttcaactactgtatttgaatcgttataaaaaaagtctcgagatcatccaatccataattaattattatattctgaatctgactctgattaatcttattatggtaaattgcaataatgtctccgaattctctttaatattcttttagcccaagcttctgaatgagacaagattgaccttacgttaaactgaggctaacacaaccgtaacaaatagttttttttttttttttgttgttgtttaattcgtattcttttagattatagtcgaaatgaaagtataatcgccggatccagttccaagccagtagaattcagcgcaacgattaaacaaattcatccactaggaaactaattcgtccacaaatctctagatgcgtaggctattaggtcggtttatatgtgttttggtttggagttatggaaaaaaagaataggtgatatttacaaagtttaattgacgtgtgtttatgtaagaaagaagggtgtcctttgttatttaagataggtgatggttcattttgcaaataactcttaacactggctattatattgggattacagaggcatatatcaacgtcttccatcttcacttggagtcttggagatctcatcaaacaaattagcaaacccttttgattcattgacttgtacacgatcaaaaaaatg

SEQ ID NO: 35621 - DNA, 3000 bp, Unknown; identical to SEQ ID NO: 7639
  misc_feature (1)..( 3000): 2750-1469P.txt file - cDNA_ID_3089439; gDNA_ID_1621155; Annot_ID_173451

SEQ ID NO: 35622 - DNA, 3000 bp, Unknown
  misc_feature (1)..( 3000): 2750-1469P.txt file - cDNA_ID_3089447; gDNA_ID_2926150; Annot_ID_198023
gattttggttaacagagaagctccgtacattctaaaaccgaggaagagatgatgaaatcacataagctcaaatcaaatcaaacgcacgagtaagacaagaaactagtaggagtaataaaacctcagatcaaggtacgcactattagaaaagaacaaaatttagaaacgagaagcagagacgatggtatatgaaacaaacgagtcatggaatctcaacacacacaacacagaaagcaaaacccaaacaaaaacgaaatacgatgagtgaaacaggatagtaaaatgtctcagaaaaaggttttgaagcttacccacgacggtttccatgaaaggaatcgccatggctgagaaaagagtgacctgaaccgcgatgaaagcagaagcaaatcgaagaaagcagaagcaaatcgaagaaagcagaggaacgacaaaagagaggtttttcgtttttgactcttctcaggtcggtgtggatatgtaaaacaacaaaaacacgggtacgggttataccttagaagcccaaatagtaaacgggctgagatttaggcccatatgaaacaacccctatattttatctaaaatctctaagtataatagtatattatcaaatattggggccttagttgaaatattatgttttaaaggggctaaacggaaaactccttatcctcaaactgtcaacaaattacgaaggtgccattgggtttaatcaacaacgaacgccgagagctctcacttcacactttatccacttggagcttcgacaatggcgtctccttcgcttctgcagtcttccgcttcttcgtttcacggacgtttctcaccattagcggctccatcctccgcacgaatgctctctccgccgctcagaaacgtggtgaaagtctcggcgtctggaactgtactggtcgagaaatctgaagccgagaaaactcaacgcctcaaaaccgcttacctcgagaggattatccctgcgctcaaagaagagttcaagtacgttaatattcaccaggtaaccccaaatccttcccctctgagctcaaacctagtttttgttctgttgcgattgattgaagtctaattctcagtgaattcgaattttttgagcgaatgttaaacctaatttgcttttaatgataagtttgaattgatttcttctagaaaatgtagtgaagaagcctagatttaagattgttgtgttgataaaatcgtgctgttgggatgtgccatttacaaatgtgaatgtgaatttgtcaatctcatcattgttgtatatctgcttggacatcttctctaccaggttccaaaggtacagaagattgtagtgaattgtggtattggagatgcggcgcagaacgacaagggtttggaggctgcgatgaaggatatcgcgcttatcacagggcagaaacctattaagacacgagctagagcttccattgctactttcaagatcagggaagatcaacctcttgggattgctgtcactctcagaggagatgtgagctatatttctcttgactaatcaaactttccttttgagttatttatgtattaacattttgtgattttgactgttgtgacaggtaatgtactccttcttggatcgtcttatcaacttagcccttccgagaactcgagatttccaaggtgtgagtcccagtagctttgatgggaacggaaactacagtattggtgtgaaagaccaaggtgtattccctgaaatcaggttagttctattgtatctaccctcaaaatcaaaactactaacttgttatccgctggttcaacaagatcaagcatggtttctctttagtcccactctttgtttacaaccgagcaactaaactctatgttggttggttggtttattacactctaggtttgatgccgttggaaaaacgagaggaatggatgtatgcatcagcacaacggctaaaagcgatcaagaaggacagaaactattggctctaatgggaatgcctttcagggaaggaggtggtggcagcacaggcgcgatagtgcggaagaagaaactaaagtctcatcactttgatgctaaaggaaaaggaaagagatgatgaacatagctgcctattgtatgtatcgtcttctgtaaccaaccatttcatgtttcagaaaaaccatctccttttgtaatgctttatgagtcaatttgaaaataatatcagggatcttgttgttatggtaaaaatttatcaaggtttttctgtaatttattgaaagttttgtggattatacaaaatgtagcgcgtgagtgaacgtgaaaagctagcgcgtggatttgtcaattttaccttcccctttgagagaaatcgctcttctttgtaagacttggtttcgatcttctctttttcatcatcaatcgatcaaaacaaacagcaacagcaaaattatctttctgcagatcgaaaccctaattggtttctccgttctccttttgttcttctagaatcggcgactcttacttttttttctttctaattatccttttctgatggattctggaatccatgtaattccccattagcgctaaaaaccctagctgtcgaagaccttagattactgcagaaatgttataatctgttttcatcttttcccgatttgaggtttttatttattttggttgggtgagagaatccgatacgagagattaaagccttgtgagtttaggatgagctagttttctttggctttgagctgtaatttctcttctctgaaatctttcactgtacatatagctagatcctgatgaagttgcgtggtggtgaatcgtggtttaagttttgctagttgagatattattggtggttactgtaatatcgaagaatcatatttcacggtatttactatagacaactactgtagagttacttgattaaggcgttaagaagagatactggtgttttttggcctcaatcagctaagatttttgtgcattgtatgatgagtatagcaaatgaacaacaatttgccatg

SEQ ID NO: 35623 - DNA, 3000 bp, Unknown
  misc_feature (1)..( 3000): 2750-1469P.txt file - cDNA_ID_3089453; gDNA_ID_2926150; Annot_ID_198020
ttggggtttagatctcagcactttgattctaccacctttaccatcaggtccaatagagatgagatcatcttttcttggaacagaacctcctagtgatggagttgcttcgtttctctctccatgtttgctccatctaccaaggtttctatttgttccacttgactgccaaatgtttccactacctgcattggacaatcttcaatctactactacactcaagaacttgaattcatgatgtacaacaaaagtaccattgctgtaaggtgacactgatgatgtcgggtcttttctgatgttgaactttatatccttcaccatggaattatcacctttctcttcaatattagtattccaatctctaatgccagaagtgttggtttcaggaacataatcatcatctacatctataaccgagtctgttctgctaacgaaggagtcttctcttccccttaagcatgatccttgaatggtaaagccatccttttcttctaatttaccaggtggtgtggagattttctccactttgttgtctgatgaaagcattctgaaagaagacatgctctcgattgcaggctcggaaacttctgtgtaactgcatttctttgaaacgtttatgtcccgtagagctctgttctctctctcttcagttatcaactcaagttccctcattcgtttctggtcatagaataaacataataagagccagatatagaagacacaaagaagatcgagataaacaccaaaacacacacctttagtttttctatcttttccaaagctttttcaagtttctcagaagatcgtgcttcgcctcttcccagctgattgcacttggctagcaattccttataactcctgtcagagtaagaaagattgttttttattagagacttcataaaagaaaattcaaagacctaagagaaaagaaacgcaatgttcaatcctcctttcctcaaattcttgaccatacctacttatgaaatttcgtaatttcagtttaacaagttgttgttacgaatgaactaaggtaaatcaccatttcataagtcactgaaggtcaaattaatcttttttaatcggattacactgctgtagacatgacaaatgggaaataatgaaccaagttcactaagtcaatgaccaaaatgagagcagggaaggagtgacaactaagtgctaagcacctacctatatcaaataaccaaaactaagtgaagccatgtgaactgagtggaactaatctatgtgacaaacctattccgaataaccaaggacttgactagtgtgtctattgtatctttcgtcttcgcgttattccccaacaaggccaacttcagtacatcatcttcctccaagcttaaatcagaaaccctggatgcaaaacaagatattagactcagaaaaggtttaaccatacgagtgaatgattaaattagaacctgaagacactaaaagagcaatatgaaagatgttatcttacaatttaagcgatgcgagctccttggcaagagccacagttctctcctgtagcttaacacactgtgagttaagctggatacattcctgtaacaaacaaacacactaagaaactcaacacaaaattctgcctgtgaagcaaaaaggatctaaaatctaaggatgttgtatagtttaaacaaacctcagattttaacttaagcaaatgctgagtcgttgatatttcttgaagagcctcccaccttttcactttatcctccttcaattgctcattgcattgatgcaactgagacacacacaaacaaaaacaaaaaaaaaaaaaatcacataaccttatcttatcttataaaccattctaatcaaacgaaatgaacaaaattaaccttatcagagacttcaacattctcctttttcttcgcctccagagccgaagtaagattctgtaccttcccttcaagccgcttcacttctcctctcaacaaaaccggatcttcttcgattccaacaaccttatccgaggcaatcgaatcggtttgattcccagaagactgaaagtaaagtcgacaaggatcctttagagagcacttctgcttacaaatcggacaatttcgcttgttcgtactcgggcaatactcaaaccattgctgcaaactagggtttccgaaagaaatcgattaaacacataaatctataaaatttcggagataataaacttcattagagaattgattttgccgtactaaccaaagttcgtgaaagacatggccacaagcggagattgattgcagattctcaaccaccggtttaagatcttcgtagcagattgaacaaattgcattccccgccgcgttttcttcggccatagctatctctccggcaatcaccgactagtcagtttccgacacagtcaccattttcttctcgagaaaatcaaaaggcaaatatcagagagcaaacacatggcgcggataaaaagttgaaatttcaatggtaagcgcgaaaatctggggaaggatagcacgtgtaagtcacgtgagataaaaacataaacaaccagtggcttgtattaggcccaacgtttttaccctataggtccattaaagcccaaatcagctattgatcagtggtcaaacacaatgtttaaattaatgttgacttaactcgtttttagtaatactagtacatcttttcgcatgcactaattaactcactctcgagagtagcgttcgtgagtctcgaggtttctcactattttttcttccgcagcgtcaccgactcagatttggtggtgctaggtcaccgtgttcttcacggcgttcgggagaatgtcttagttaccccagcttctccctaaggaaactccactactgttcaaaatccctttcctacacatctgtagttaaatgtcacataatctgttgaattacttgaggcttaaggtgtaaatgttatttttccttggcagagacctaaggtttatgtgtgtcttccagtttaaattatgtgtgggtgactcagagaatg

SEQ ID NO: 35624 - DNA, 3000 bp, Unknown
  misc_feature (1)..( 3000): 2750-1469P.txt file - cDNA_ID_3089465; gDNA_ID_2926150; Annot_ID_198005
ttggtttaggttgcgtgcatctgaagcaatcatgaaattcaacaattccatataatgtaaaatatttttcatgcatgttttgatcatctttgtcttttattaagttcattttgaagtatgtgcctcctgaaactaagtgtggatccaagataatagtttcagatgcaacagatacaatgttgaaacagagacattgtataatataacacgatattacaggaaaacatacagagagaaagctggttttatttgaaaatgaatctattcgcttcctgcgatcttcttcttcaaggattcaatatcctcagccaattcctttctgcttgactgtaacaagatgatcatttcatgtcagatcattgatgctttatagattcacaagaatccaaaaatagtatagttttgttaccttgaagagaaggtatctgtagacaaaccatccagtgtacccgagaccgacaagttccataactttcggaagctacaaacacaagaaatggaaacatcactttaactcaaactcattacacattttctaatctcaaaagaattatatagagagtgttgttaccagaggaacagagttgatggcaccaacaacaatggaagataaccaaacagcaacaatggctcctcctccatatataagtacagtagatttgttctcaagaccatcccactgcaccggaaaaaaaaaccaacaatcaaaacagaacacacaaagccaaaccaaaccaactcggttttttcttcgataaatggttcaccttttccttcaaatctgtgatgagttcgttggtatcaatggacgaggtctcttctgaagaagctcttgtcttcaacaattcaactttttgcaatccattccctgcaatttgaaccggagaatcaaatgttttggtttagattccgtctcaatcaaccgaaatttgtaaattttaccactaaccgaaccggtacatcgctaaaatttcgatttcggaccggaatattctaatttgaggcaatttgtgacaattcagacaatttctcgggaatgtatagattccattgaacccagaaagagagattatgtaaataaatccgtcacctgaaacaagcttcaacggaacggtgaaagaggatcggccaaaggagcgaggaggaagataagggacggcggagcaacgggtggatacggcgggaacacgtggaaccatcacggccatagaggacgaagctgctactgatatcgccattgaagcacgccgagaacttcttcttcttcttctttgtctgcctacttcttctctactcgattttttttgcagctgcgctttttactaaacaagattcgtgtagtaacacgtggaagctcctcgcgctcttattggtcgctcctcttatctttagaaatccaactcagtggtgtttatagaatgctcgcattctgtggggttttaggcccatctattatatgggtcactaaaagcccatcttgtttttttgataactcttgtctttttctaggtgaggaaaaaatggcaaatgaatgcaaacctttgatttttgtttctaaccaaactataagacagttacgaggacaatacgagattaactaaaaagagaaattcgaacaatgaactttaaatatctaactctaaattatgttttgtataagtgaatgaaaaaacgaaacttctttttgataaaagaaatgtggcaaaaagagagaaataaataacaaacccactaaaattgagtgatggtacagctcttccaccctaatacttcgctggcgctttcaactactaaccaaaactccatttctcttgttaatataacaaaatagttgatattataaaagttttatttaatcttatttggtagtttttgtatgattaatataatcaacatacgtattcatctaggatgagttggcatgaaaaaacaaagagttcgctatctaatttttccaccagaatttaaaattatttgagtccatagatgtgagatacaataatcacaagtttacaacataatagtataatggtttatattaatgttgttggtgcattaacatttcaattcaaaataaatatacatacattttttatagtaaaactgatagtttactcatttgcaatgacaatctaattttcgactgtatttaaagaaaaaatgaatggttttatgtacgatttcataaaaaatattgttcatttttacccgaaaaaaaaaaaaaaaatgttcgcacatcaaaatagtccacgatgagatattaaagatgagaattttaaaatatgaagaaaaaaataaattttcaatgtggtaatagtattattattttacagctattttaattttatcactaaattgacagaatggttgaacaaaaattcaatattttcttataatcatattacatgtgaatcgtaagaatactaaaaccaaagaaattgcatgatcgttacgtcatcggcatataatcatagccgacatcttcttttttcttatcacctccattacaaaattttgattagaaaaaaaaataaactccaacttcaatataattttgggtcaaaaaaaaagcatccaccattaatacagctcaaacccaactttctctccccttttttcttacaagtttgaatatcaaagtacggtctcttttttttctatataatagttatttaatcaaccatacacattcatcaaatccatatttcatgcagctgttacatttttattatatgtcctcttacttccttttgagtgtgtatatgtgcttaattatattccctcatcacaacctcaatctcaatctcaatcatgtctccaaatctcaatcatgcttcttccactttgattcttatctatctggatcacaattctattcatatcctttaatcaaaatcatatcatagcttcttttttttatattactaatcttgatgaagatcaccaaaactcattttggtcttcttcatcatcgtcgttcttgattttctcttggcaatg

SEQ ID NO: 35625 - DNA, 3003 bp, Unknown; identical to SEQ ID NO: 19529
  misc_feature (1)..( 3003): 2750-1469P.txt file - cDNA_ID_3089474; gDNA_ID_2926150; Annot_ID_197990

SEQ ID NO: 35626 - DNA, 3003 bp, Unknown
  misc_feature (1)..( 3003): 2750-1469P.txt file - cDNA_ID_3089482; gDNA_ID_2926150; Annot_ID_197985
aaaaacaattggtctccggaagaacaaagctcattattcctccttagctatgtaagtgaaaaatattattgtttaattttgatttttatgcaaataaactctcaaagtcttctatttttacaattttactctctacgtccaaaataaaaaaatatacaaaataatcatatgaagtcaaaactaatacgcaatatagccgatttttgcaactttacatatattgtaaacgttttcagatatagttgaaatcttcatctcaagggcttcaatttgatatattatttatcgaaattttaaaatttggtaatagcgaaaaaagctatattgtgtattatttttatttcatatgattattctgcatttttggacgtgaatgataaagttgcaaaaatggacgactttgacatatattcaactcatgtataggtgtggaaatgctggagagaaggagaagtgttgaacattgtggatccaagtttgattgaaacaagaggtctaagtgatgagatcaggaaatgcattcacattggtttgttgtgtgttcaggagaatccagggagtagaccaacaatggcttctattgttagaatgctcaatgcaaattctttcactttaccgagacccttgcaacccgctttttactcaggagttgtagactcatcgtcaagagacaacaatcatacaagaaacccgcgtattgcgtctttgaatgatgttacaattacggagttagatcctcgttgattaactttgtaagagacaaaaatgattttttctattgctttaaagtttacttcagaatgtatcagtatgatttttggttatgttgtaaaagacttgttaagcatgagatctcaattggtgttgttttcttgagtaatcaagaactgaatttgtgatgataaacagattttgaagagttcttttaggtttctgtttttgaataatttaacaaaagaaaattaaggcagcacaaaggcccaaacgacagttgtgcaatgtgatggagtcgatttgaacgagcacatagacaagaaacaaaagatgaaagaagtgaaaatgaaggttccaaataaacttaattaaagagtttatcctcagagtcagagtgtaagctactttattttggaaactttcttccatgtccagagtctcgttatcatccctccacttatcaatttcagaaaaccaaagaaccatggagggaatcaagagagatcataaaagagaaatcaaatgtgaattatagggaaaaagaatgatggacgacataaaaggggaaaaaagaacttgagcaatcaagaatatggctcaaagagaatcatttcaaatcagagaacaaaaaaaggtcagcaataaaaccattaattgatcaaatctacagattctaagtttccatggtagactatgtagtacggtttaaggacaaggatactgcaaaatggtttacacttccatgtgttttttcaagaaaataactttgatgcacatatagcaagaatacacattcactttcgagatataatgatccgcaagtactaaaagaaagataagaaacaacatacattaagttgtatacaattttacgagatcaaaggaaataaaggatatttaagcaagacatatggatgaaaataatatgtttagcaaatgagtaaagcaattaacaaattcaaatcaaataaatctatcccaaatcgtaaatctaagttaagcctataaaaaactaaaagctagatggaatatttagaagtgagaagatgaaacacaatgagaaaaataaggaggcaaagtcaaagactaaacgcaatgagaaaaaaaggaacgttggtattatgttgggccttaaacgtacattagcccatagctctttattgtataatgttttattattattatactgttgggccttaaacgaacaatttggtttatacaattcggagaaacgtttggataacgttcaacgtctagaatcaatatcatgatacttttatatttaatgcagggaattataactatactagatagacggctgtaagatgtaaatataattttttatcgataatatttaaattttaaatagtaaaataataatatatacattattcttatatataattttgaatagtaaaatagtagttttatgcattttattttattatacacattcaattttattgatgatatttgaagtctaaatagtaatctacacactttttctttattataatttagtatttagaagaaaaaaaacaaaattttatcttacacattcaattttgtaatacaatttaactatctatttcataaaaaactcgattttaattctacacacttcatcttacttgataatgatttcatgtcaaaataatatttatatgagatcaaatctatattttagttaatattaaaaattattaacaattaacaaaacataattaataataataaattttttgttaataccatatatattaaaaatttgaccaataacatatataaaattgttttgttaatttgcttttggttaagaaaaataaaatgtaatattttttagatatagacatatgaattagtatatgttaataatgatttattttttagttttctatttctttaagaaaaaaaagttaattattttcttacacgtgtcaacatctgatcgatagacttgacacgtggcataatcctatgaattagtaattctaataagatattattctggtcttacgattggtagacgagttatatttaatacgctttacatcaacactcaaatctactttgaatgaaaggttctaatgctgctacacagctaacctactttgacgtagtcaaaaacacgtcacgtctaattttcaaagaacagaaaatttcaaagtgacgaagacttattaaatttggtttcgttgataaaatacatataaattatgtaaaagtttaaaaccatgaacaaactacaacattcataatcataatcagcaagtccactttagagtcatg

SEQ ID NO: 35627 - DNA, 3000 bp, Unknown
  misc_feature (1)..( 3000): 2750-1469P.txt file - cDNA_ID_3089491; gDNA_ID_2926150; Annot_ID_197979
tctctattagtggagtttcgtgagtgagtgatcttgtgccatcgggattttgatcgttcctacttaaatttgagccggtatcgatctaaaatttcaagtaaacctagatttgaaaatcggatgctttaatctggatcactcaaatgtcgttgatgtagacatattatcacaacttgacgtttataaatagccagaatgaaataagaagatcgcttgaactttaagaactaatcgggggtgataattgagcagctaggatccattgtccttaaaacgttgtttatttagttgaatatgtaacggctatggagatctataatccggttttacatttcacatactctagattagtttcatataacggctatggaaatctttaaccatctatctaccagtatgcataagctaatttaaccttttaccaaaaaaaaagtatgcataagctattagatcatagcgtagtgttcattttgcagtagtcttgtccttgaaccgtactacatgagtccaccatatgattttttttttctcggctatggagttctagttcctttagtctattcttaatttgcagaatatctaggaagagttgctaattaattcccatgtttttggtattcaacagaaacattgttcaacagagatattaggaacaatcattcacaaaatgagaaggtaatttccgtatcaacagttactggatgaatctttatcttttctacttccactgaatagctttttctcccaattcagtgtactctctgattaaaatcgtgagtcattttgaactatatcattctcctttccagattttaatttattctaaaaacggtagaaactcagaatatgtagatcttcttttttttgtacaccaaatagataccttaaagtcagagtatgttttgcgcatatacatagattgtgagtgcttcgctaaagaatcagccgagacatttgctgatctgggaataaaactacaagagaagctagaaagcctattaatgcagataaatatgtcactcagaatatgtagataaatagtttaatttgctgacctttttggttctatgatttgaaattattctctgagacatattcttgattgatcaagttctttttcaccttttatgtccctctttttcccctataattcaaatcagattcttcttttatgatattacatctagttctttgttttttgaaattgataagtggagggataacaacgagactggacatggaagaaagttccaaaataaagtagctcatagtctgaggataataatctttaaatgtttctttggaaccttcattttcatttctttattacttttgtttcttgtctgtgctcgtttcaaatcgagtccattgcattacaaaactctctttcgggcctttgtgctctgccttaattttcttttgttatttactcttttctttgtcagaacaacaacaatatctaggcaaataaaagaggtttttaaattctataatcgttatcatagtttcattatttctatatgtttagacagaaatgttgtcttgattgaatcaaggttcctttcttagaaaaaaaagaaatgcatgtcggctttcatcttacttttaattggaataagtaaactaaaatctttattcatcacatgcatttgcatgtatatatatatgtatacgttatccattgcttttgctaggttcatgttcttttttttgtgcaataatggcttaatttgttaatccagcttgcagattgcaatttgactgcaaagtttccccacttccataactatatgtatgtgatatcaaatcaattcattatgacgagcgaactcttgacaactatctttgtcagtactctgctttatttggtcgtttttattttgcatgaaaaaggtcaaaaaaagctttactcatttggatattgattagtattacacaaagtcttagtttggatatattttctcaaatgtttccactgctttcaacattcatttgctttggggataagtcaaataccttgacaattaactaattccctaactaaatatctcacctttgtttattagtgcttttttggtgaattaagtgtttttaatttatcccgaccccattgtgatcttgttctgtcacatttaattacgtatatttagtagttttattactaccattttgatagacatatattcatgcatgttaagtaccaaacaatttgttgacagtttaggtatggcgtgtttggaggatttgaaaagttgatggagctccaagagaagatccaagtggctcatgtttcttcaggttactttgctttcatgttctattaacataaataatctctttggttggttccttatttttttcttctttatcggaaagttacatattacgttgtttcttagccacgcctgatttgaattaaaggctcactgaccaaaacatccaagcccaacttttgctaaagcatataagcatatacctatgtcagtttccggcgacttttcttttttgctcttttttgaaccaaaacaaatttctagctaatgtagaaatttatactttttaagaaaattactggacttgtaacaccattagtaataagataagatgagacatttgttttgtttatatgaaaatatagtcagtaataactgttttttatgttctcttttcaacttatttttaattctttttggctttcaactttgcttctttttgataaaagacacatatattgttcctaatctttattgtctttaattttgaaaaatgccacaattaaattttgaattaaaacttcttttaattgcccctttaatgttctccctgactcccaaatctacacgaaacactaggaatagagaaaaaacaaccctcgggtaaagacagagcataaaacacttgtagtgtagatataaaagacacacctcagagaagagaagagcagagagagagagagagagagagagagaaagaaagatccaacttccacaaagaaccatg

SEQ ID NO: 35628 - DNA, 3000 bp, Unknown; identical to SEQ ID NO: 35627
  misc_feature (1)..( 3000): 2750-1469P.txt file - cDNA_ID_3089491; gDNA_ID_2926150; Annot_ID_139248

SEQ ID NO: 35629 - DNA, 3003 bp, Unknown
  misc_feature (1)..( 3003): 2750-1469P.txt file - cDNA_ID_3089509; gDNA_ID_1621151; Annot_ID_173243
ataatctcgataattcctccgccgtctctcttcaacgtgtgaagaaactcgcggctgaacacggagaacgcctctccttccaccaggttcggtgaaatttcgctttcttagggctaggaaacgtgtgattgaaggatttgtgtttgtgtagttgatgatttcaacgaatttgggattatgatttgacttgttaatcattgatttgactacgaggctcttttttttgtgtttatttatttatttaattttgggcataaattctcgtaataaaatatcagtttttctaaaagattgtttgattccaaaatcatgggtatctttctttggtattattgctttgattggtaactactacaatggtactgggtatttaccgttttaacaatcataaaaacgataccaaaagcgttatttaccgttattttgtaccattttaactattcgcattttcggcttaaaaacttgtatagcgttgtgtcaatgtaattttatatgttaatgttaattattacaatttctttttctctaagttttataacccaaaaataattatttatgtattaaatattagtttaggcctaatgagtaccatgtgaaagagtaattgttctactttctatttttgtatttcatataaagtttaatcttgttcttctgaattagtttgtattatgtttacttacggtcaaaagaatctgttagttactgtcaaaagttaaaacttgattgttctgtcttaatttgcaggtggatcttcgagacaggtctgctcttgagaagatattctcagaaacaaagtatgattgagaaaaaaacaaacattcttttagcttcttcactttatcactaacaatgagtgataatgcatattattgggtttattctttattgattgatgaacgtggaattattattattttacaggtttgatgcagtgatacattttgctggacttaaagcagttggtgagagtgtagagaagcctttgctttattataataataatcttgttggtactattactcttttggaagttatggctcaacatggctgcaaaaatgtatgtataatttgccactacacaacaagttcgaatccatttttactttgcttgatcaattctcatgattagctacttttactctgtttccagcttgtgttttcatcatcagcaactgtgtatggctctccaaaagaagttccttgtacagaggagtttccaatttctgctttgaacccatatggacgaacaaaggttgttttcttgacaaaacccacttgagtattgtggttaattatgaagtgtgaatctgacttattatggatgtttttgtagctattcattgaggaaatctgccgcgatgtatacggttctgacccggaatggaagattatattgcttaggtatttcaatcctgttggtgcacatcctagtggtgacattggtgaagaccctcgtggtattccaaacaatctcatgccctttgtacaacaagtggctgttggtaggagacctcatctcactgtctttggaaatgattacaatacaaaagatggaacaggggtatgtacttgtcttttatgttttcataaaacaagaagaggttttcaacattttgatctcatgttttgttttaggttcgagattacattcatgttattgatttagctgatggacacatagcggctctacgtaagctagaagattgcaagatcggtatattatgatttccattcgtttctcttatctactacaatcattctcaagtctcttaactttgtttgtgtgttgtttatattcaggttgtgaagtgtacaatctcggaacaggaaatggaacatcagttcttgaaatggttgatgcttttgaaaaagcatccggaaaggtaaaaagtgacactttctttcatctttagatacttggattctaagtcatgttttgttaaacctttgaactcttttgtggatcagaaaatccctctggtgatcgcgggacgtcgaccgggagatgctgaagttgtatacgcctcgacggaaagagcagaaagtgaattgaattggaagtaagttcatacatacataaagctataactttgaagatattacttgcacaaaattgtatgttagacactaaaaagttgggaatatgtaaatgagataagtctaaatttgggttggtaacaaatgcagggccaaatatgggattgaggagatgtgtagagatttgtggaactgggctagtaataatccttatggatatgattcctcttctgaagacaactctcattaacttttcttaatcgttttcttcttttgctaaaacatatttctccacactaaattattatagtatccgcaagaaaaaacaacaacaataaagagtcagattttagggaaatatagggacattatgtattattattacaatcaatacttagtctgtaattgatttggatatgttcttgtataatcaaaaaagatttgttatgaatagctacaacgcaaatgtttagctctatacggcaaaaagtaccttgaggttgacacgacgtcgttttcagctcggtgatagttgaaatgtatctttctgaagcttttaagttcaagagcccacacacttcttctcattctttataaacataacactggacagtaaccaaacttcagatctgaatcaacctcttaaggttcgtttatactcattctgtttttcactgatagtttatgcacaatccgaatctttcttctatgtgattgttttggatttgattataaatttgacattatcattaatttagaatgattttgtgtgtgttgggttgtttacaaaatcatttctttgaatgagtttgttttaattttgtgttagggttataacgcgattgggaatttagttgaatttagaactaaatttgtgctagcttgtgatttattgtctctaattttgaactactaatatttgattaccatatgtttagtggtacagaagaagagaaaggaatg

SEQ ID NO: 35630 - DNA, 3000 bp, Unknown; identical to SEQ ID NO: 3757
  misc_feature (1)..( 3000): 2750-1469P.txt file - cDNA_ID_3089509; gDNA_ID_1620662; Annot_ID_163839

SEQ ID NO: 35631 - DNA, 3000 bp, Unknown; identical to SEQ ID NO: 3757
  misc_feature (1)..( 3000): 2750-1469P.txt file - cDNA_ID_3089509; gDNA_ID_2926151; Annot_ID_198099

SEQ ID NO: 35632 - DNA, 3000 bp, Unknown; identical to SEQ ID NO: 3752
  misc_feature (1)..( 3000): 2750-1469P.txt file - cDNA_ID_3089513; gDNA_ID_2926151; Annot_ID_198097

SEQ ID NO: 35633 - DNA, 3000 bp, Unknown; identical to SEQ ID NO: 23551
  misc_feature (1)..( 3000): 2750-1469P.txt file - cDNA_ID_3089517; gDNA_ID_2926151; Annot_ID_198072

SEQ ID NO: 35634 - DNA, 3000 bp, Unknown; identical to SEQ ID NO: 8317
  misc_feature (1)..( 3000): 2750-1469P.txt file - cDNA_ID_3089546; gDNA_ID_1971724; Annot_ID_175190

SEQ ID NO: 35635 - DNA, 2011 bp, Unknown
  misc_feature (1)..( 2011): 2750-1469P.txt file - cDNA_ID_3089546; gDNA_ID_2926152; Annot_ID_139373
ggtggtggtggtggtggtggtggtggtggtgaccggcggtggtggtggtggccggcggtggtggtggtgaccggcggggtgatggtcggcggtggtggtggtggtggtggtggtggtggtggtgaccggcggtggtggtggtggccggtggtggtgatggccgacagtggtggtggcggtggtggtggtggccgaagttggtggtggccggagttggtggtggccggatttgatggtggccgacagtgacggtgaccggtgttggtggtgaccggaatagatggtggccgaagttggcggtgatggccggcggtggtggcaggcagtggtggccggcggtggtggcaggcagtgatggccggcggtggtgaccggtggtggtgaccggtggtggccggcggtggtgaccggcggtggtggccggcggtggtggccagcggtggtggttgctactgaaggtattgaggcaacaagggcaaattgagtaatattacatataatacagagaatattataattacatagttaggatggttagttagtgaattatagtttttttgttagttatttctgcaaatttcccaaaaaaatatatcaatttccactaattttttttatgtacatgttggattctagaaaatcaatgaatttaacaaaacaaattcatgatcatcgcacaaattggctaaaatattgttgattttggaattggatggaaggttaattgtagattataacggaatttaaattgtttgaatcttggagtaactcaaaaatatagatcaaaatgattacatatggctatgttctattgcaaatcgtgagcgacagttccgacaaaaaaaatacgtcgatagtaaaataattcaaaaataatctgttatattaattttccatcacatatttccaatgccttgcttaaatatatattttgaactgtataatgttcttatactcttgttacttacctagtataattaagaaaaaaacagttaaaagtaagctaacaatccctatttgtaatagaaaaaatcatattcaaattttcaatttttttatataaatgcaataatcataattaattttttttatatgaatttataattgcccaattataaatattaaagcgggttaacacaattatactttaaaaaaaatttaattgaataacatcagattctatattacactttaagtcattaaaactcttttgaaatcataaaccaataacacccttttacagttgaattttttacctttcatgattttatgtaaatcaattgtttttttgaaatgaatttttgtagtggcattttatgtaatatttaatatgttgttggctatttacttaaatgtatgtttagttaataatatagaaatatcaaagttaattgctaaaaatattattaaacaaaatatagagagtatattgtaaatgataattcgaaaatgaaatccataaattttgttgatctcaattgaatcacatcccagtattagacaaattgggttttataaacactaagaagataaaacggggtcatttcgaaaccgtaagaaaataggatgatttctgcaaatatgggtaatatatatgtagaacgataatattaataccagaaaccctagagttgcttccgcttcgcttctcgtctctcttatcagtcttctcttttcacggctacaaggttagtcctaagtttcggctctgttcttgcatcagtgattggatctctactgccttttaatcaaatctcattgaattgatctgggttagggtttgggtcaggttatcgaatctttctgtgttattttgattctatgaaatgaatttagggtttgggcaagttttttctggtctatgtagcttccatccttttctgagatatctgattgggtttttcggattctggtgatctctgtaacaaaatcgcttctctgtgtttttcaggctaattgagagtgtcccttgcgttagagtttgttactagcttttttcgtctgaaacatg

SEQ ID NO: 35636 - DNA, 2011 bp, Unknown; identical to SEQ ID NO: 35635
  misc_feature (1)..( 2011): 2750-1469P.txt file - cDNA_ID_3089546; gDNA_ID_2926152; Annot_ID_198173

SEQ ID NO: 35637 - DNA, 3000 bp, Unknown; identical to SEQ ID NO: 8317
  misc_feature (1)..( 3000): 2750-1469P.txt file - cDNA_ID_3089546; gDNA_ID_2926153; Annot_ID_198189

SEQ ID NO: 35638 - DNA, 3003 bp, Unknown
  misc_feature (1)..( 3003): 2750-1469P.txt file - cDNA_ID_3089567; gDNA_ID_1971823; Annot_ID_58367
tattttattctagccgttgatacaacaaactaacactagccaaagttttgttttctggatcatagtatttaaaaacgttattgttttgtttttgttggatttacaccaagaatagacactaactagtaaggagtatcgttttttaatctacaaacttttgatgcatgttttgttatggtgtgaagggagttgttgggctttctcgactgtgggagcagtggaaggcttaaacaagatcgtgacgggagagttagtcactttgtctgagcaagatttgatcaattgtaacaaagaaaacaatggttgcggaggaggcaaactcgagactgcctatgagttcatcatgaaaaatggtggtcttggtaccgacaacgattatccttacaaagctgttaacggagtctgtgatggccgcctcaaggtcagtatagttacgatttatatataacaatattaaaagaaagaatcaattttgaacttattttccaaaaatatttgtgtaggaaaacaacaagaatgttatgattgatgggtatgaaaatttgcccgcaaacgacgaatctgctctcatgaaagcggttgctcaccagcctgtgactgccgttatcgattccagtagccgagagtttcagctttatgaatcggtaaaagattaattttttgttaaattttcatgtagaaaccttctctaattggaaaaagatttcatcaaattttttaatattttttttatgtcaaagggagtgtttgatggctcgtgtggaacaaacctaaaccatggagttgttgtggtcgggtatggaactgagaatggtcgtgactactggctcgtgaaaaactctaggggcattacatggggagaagctggctacatgaagatggctcgaaacattgccaatccaagaggcttatgtggcattgcaatgcgagcttcataccctctaaagaactccttttctaccgataaaagctccatcgcctaataaaatgagctaaatgtatgttatgcaaaggatccagtgagccagcaacctattcgattgtgaaatgaaaaataatgtagtcgatgggttttgttttgtaatatattttggatttgtatggagggcaatgtttgaagtttgtataatatttatggatatttcgttaggctctaattatgaatgccttctttttaggaagaaatgccaaaaatgataattgaactacatttttgcccctaataaaaatattacatttgagacggacgagattgattagcgattctaccatatttgcaacacccgatttttatcaaaaaatgttacatgcagaaaggtttaaaatagtaataattatgtttttataaaaagaagtaaaataataccaaaaaaaaagttatgcattttttttcatagaaaaattcataattaagtgtattgaaattaaataattttatgaaaaattgtgttattgaagactacaaaagaattgtaaggatatagaggatacacaacacaatgattttgtctagaacgcgccaaacaaacttttttacttattcttattgataataaatcttttacaaaaatcaattatcttagaaataatttgacctattctacatgaatgatcaactccgactaagaagaaatgtatgcctaattctctcttctgtattttctaccacacatctgtgaaaaccaagagaattacaaacactcacattttaggcttttgctaggctttgaagataacacacgtataccaatattctagaatgcttaggtggctcaatgcaaactccataatatttatactatttccagaaccctaacccttaggatctccgagaatcaataagcgggatcttctttgatcttcaagcttatctctttccttatttgttgagaaaaatattcaccaacttaatcgactttcgtctttgatctccacgctaagtcagcaaagctcttcggctcgtcacatcaaccaattcatctctgccatgtcagcttatgcgtctatgtcagcaactcaaccgtctgatgtgatctgatgcagtttcctgatatacaacaatttcctaaaatacaacaggtctctgatgtccatcaactcgttattgttagaatctacatcttcaaaaattccttgtgaactgtagagtcattcgtcgcgtatgaaatttggcgtaaaaagggagactaataggcagaatgtgagtatgggaggaaaaagatggaggtcgccagtacattacaagtgttcataaggtcacactattgggagtaacgggttttggtgcaacaaagataactatttaaaactgattttttaatattgagcatgtacaaaaaaacacggaaaaagattttgtggtgttctagcggatcacttgacaagtatatatgcaagcttttgcgccataatggttttagatgtactttaaaattctgccatattatgttatatatatgagtgttttttgttccatgatctaaatgatgacatttttttttttttttatctaatgcctatctttaaaatattttctggatccaccactaacctcaattgcattcaaaaacgaccaaattggtgtatcatcttcggaaaacacctaaaatatatagaatatcggttcaaaagaatgacctggacctcttttttactcattcacccaagcgaactttgggcatgtttctatacccaatcgaaaatatatcgaacagccaaaaaaacgaatttttagatacaacatatatttgaaaaagttcttatttacaaatcattggtgaaaaatttagacactactcgacacaaatgcatgagtaggtttacccatttgttcacaccaatggacacgttataaataacaattttaatatatctgagcgctgagtactataaatactgtcatgtgttagccaaaaagaacataacacaaaatcctcttctcttctttaataacttttagaaacacaaataaaagtttaattacttttaagcccaacaaaaatg

SEQ ID NO: 35639 - DNA, 3003 bp, Unknown; identical to SEQ ID NO: 35638
  misc_feature (1)..( 3003): 2750-1469P.txt file - cDNA_ID_3089567; gDNA_ID_1971823; Annot_ID_176263

SEQ ID NO: 35640 - DNA, 3003 bp, Unknown; identical to SEQ ID NO: 35638
  misc_feature (1)..( 3003): 2750-1469P.txt file - cDNA_ID_3089567; gDNA_ID_2926152; Annot_ID_139363

SEQ ID NO: 35641 - DNA, 3003 bp, Unknown; identical to SEQ ID NO: 35638
  misc_feature (1)..( 3003): 2750-1469P.txt file - cDNA_ID_3089567; gDNA_ID_2926152; Annot_ID_198159

SEQ ID NO: 35642 - DNA, 3000 bp, Unknown
  misc_feature (1)..( 3000): 2750-1469P.txt file - cDNA_ID_3089578; gDNA_ID_1621138; Annot_ID_56589
attggagtttccggtcaccgacacttgaactggggaaaattggccgaagcggaagacgaagaaacgaaaagcgagacaagttataagtgttgcagcgacgagttttatgagatatgtgttttgttgaagattagagattgattcccattttagcttcatcttcttcttcttccctcgcgctgagagatatacgattttttttttttggtcagaaagtggaatgtttttgattccgtacttattgcctaagcgataaaccaatgaataatagaatccaaaaagattagtgagtaatttaatgcttgtggggttaatgatatacagaaagttaataaatgaaacagagaatgattaatgaggattctaaacaaccgtaattattctctctctgattttaagtaatgtttaaggttttttacacatattacaaaagtttagtttaatttacctttttttgcataagtaactatatctaagtcaaccaataaaaaatatactatagaatattattggtcaaaaaatattaaatacatttaacttttatattgaaagttgaaagcatcatttaaaatcggaaaaaacattctctaaattatcatttttaatgatatgaaaccgtcatcaattgtgtcaatatcaataaaaacgatctcttcagtagagatgaaaaaaaattgtatcgcatatgtcacaactaatctaatcgtttatattatttaaagttttaatttctaaactcataatttttaccaattgtttcaaaattttcacatctgcaattttaactgcaaaagtctctatattttctacggtcaaattccttacaccaaaattttctacaaccaaaattgatatagttagaaataacacttgttaccaatcggtcctaacactttcagattatagatattgcggttaattagataaaaaagattcaaaaatatatttgatttctaaggacaaactaaaaaaatttaggagctttagaaaaattatgtttgatttccaattattctacgtggttttagtaaaagatgtgtttactataaaaaccttgattgtaattgtttataactcattactaaaagttgtgactgcagaaattacgaaactaaactactacaaaaaaatgtggagaaatgggttaaaaaaaacaaggaaaaaaattcaatgttaaatcaactgaaatttttttcatttaattattcagctaattttagggaagttatcatatcactatatatatatatatatataaataatacaaacaaacgatgcgtagaagaaaaaaaactgttgtccggttcactgtccagatcgggtttaaaaacattgattttcatattatattccgaattttgttttgccaaaaatccaattacttaaatttcaggtcaatttatgttaattttttaacataacccgatccaattcaaattgaaacaaatttatatttctcttttaatagtataggaatttgcacaaatgttatgtaaaaaacggaaaattggttttttcatatctttagtttgaactatgctgcatttatacacgtattataccacagttgatttaacctaaacttcaatttgatatttaaactttcatttttatacgaaaacatacattaatgttacaatgttagaatacctttaatttctgttgttaacctgaatgttagggctgggcaaaatattcgttcgatccgctttgattcggtatatgatttggtttgattcgaaaaatccgaatatccgtaagattttggaccaaagcaaataggaaaatgtagtattcgtaaaaaccgaatcaaataacaaattttaaaaaaaaaaaaccgaatatccgcttcgatccgtatctttttatatatatattagaaaatatagttatatctatatatatatcataatagtttgtgtattgttgctattttacgtttttatgttaaaatgtttgtttgatcatttttctcatgttatgttttgatcaacgacatcaaaaactatcgggttttagttttcggaattagtttgataacattttgtagactggtggtaccaacaagtatttagtttttattttgaaagcatgttaaataaaaactttgaatatctgatatagttatatagtatatagattttttttaatatttaaatatatcaaagcggatatccgcaaatatcacaaaaaattctggatattcgaaattccggatatccggaaattttcgaagcaaagcaaagcaaatcacaaaatcaagtattcgtttaaaacgaatcgaataacaaatatcacaatttttccggatatccgtttcgtacccagacctactgaatgccatatataaaacggtaaaaacagaaaattaaagttctagtaaaaaaaacatcgcatcagttacaaggtttggattaaattaaaaaaaggtttgggttaaattagcttaagaatgaacaatttattaattatttttttggtcacatggaataaacaattaattaatttgaataatattacttaaatacatacaaacattatctgtcatcttcgattacgttatcattaaccaacgtttaggaggactttgcttcttcgtcttcttctctctttaggttcttcaagttcgcaatcctggtaagattttctcgagaaaattccatttctttctatctgattctgtttacattgttgaatgcttgaaagaatctgagttttaaccacactctctcttccctgttactcaccattttctctctgaatcctccgaaacccatttcgatttccacaatctgagctcataaatctggtttaattctcatcttcgttgcatttcagtcataaagagaacataaagcttggatatttagggtttttgcagaatttttgattaagcttatgagtttggtaataatctgtagaaattggttgatgttgtttcaggtttgggtttaggacaaatcagagaagaagatgatgtttggtttagagaaaacgatg

SEQ ID NO: 35643 - DNA, 3000 bp, Unknown
  misc_feature (1)..( 3000): 2750-1469P.txt file - cDNA_ID_3089578; gDNA_ID_1621138; Annot_ID_172747
aataaatgaaacagagaatgattaatgaggattctaaacaaccgtaattattctctctctgattttaagtaatgtttaaggttttttacacatattacaaaagtttagtttaatttacctttttttgcataagtaactatatctaagtcaaccaataaaaaatatactatagaatattattggtcaaaaaatattaaatacatttaacttttatattgaaagttgaaagcatcatttaaaatcggaaaaaacattctctaaattatcatttttaatgatatgaaaccgtcatcaattgtgtcaatatcaataaaaacgatctcttcagtagagatgaaaaaaaattgtatcgcatatgtcacaactaatctaatcgtttatattatttaaagttttaatttctaaactcataatttttaccaattgtttcaaaattttcacatctgcaattttaactgcaaaagtctctatattttctacggtcaaattccttacaccaaaattttctacaaccaaaattgatatagttagaaataacacttgttaccaatcggtcctaacactttcagattatagatattgcggttaattagataaaaaagattcaaaaatatatttgatttctaaggacaaactaaaaaaatttaggagctttagaaaaattatgtttgatttccaattattctacgtggttttagtaaaagatgtgtttactataaaaaccttgattgtaattgtttataactcattactaaaagttgtgactgcagaaattacgaaactaaactactacaaaaaaatgtggagaaatgggttaaaaaaaacaaggaaaaaaattcaatgttaaatcaactgaaatttttttcatttaattattcagctaattttagggaagttatcatatcactatatatatatatatatataaataatacaaacaaacgatgcgtagaagaaaaaaaactgttgtccggttcactgtccagatcgggtttaaaaacattgattttcatattatattccgaattttgttttgccaaaaatccaattacttaaatttcaggtcaatttatgttaattttttaacataacccgatccaattcaaattgaaacaaatttatatttctcttttaatagtataggaatttgcacaaatgttatgtaaaaaacggaaaattggttttttcatatctttagtttgaactatgctgcatttatacacgtattataccacagttgatttaacctaaacttcaatttgatatttaaactttcatttttatacgaaaacatacattaatgttacaatgttagaatacctttaatttctgttgttaacctgaatgttagggctgggcaaaatattcgttcgatccgctttgattcggtatatgatttggtttgattcgaaaaatccgaatatccgtaagattttggaccaaagcaaataggaaaatgtagtattcgtaaaaaccgaatcaaataacaaattttaaaaaaaaaaaaccgaatatccgcttcgatccgtatctttttatatatatattagaaaatatagttatatctatatatatatcataatagtttgtgtattgttgctattttacgtttttatgttaaaatgtttgtttgatcatttttctcatgttatgttttgatcaacgacatcaaaaactatcgggttttagttttcggaattagtttgataacattttgtagactggtggtaccaacaagtatttagtttttattttgaaagcatgttaaataaaaactttgaatatctgatatagttatatagtatatagattttttttaatatttaaatatatcaaagcggatatccgcaaatatcacaaaaaattctggatattcgaaattccggatatccggaaattttcgaagcaaagcaaagcaaatcacaaaatcaagtattcgtttaaaacgaatcgaataacaaatatcacaatttttccggatatccgtttcgtacccagacctactgaatgccatatataaaacggtaaaaacagaaaattaaagttctagtaaaaaaaacatcgcatcagttacaaggtttggattaaattaaaaaaaggtttgggttaaattagcttaagaatgaacaatttattaattatttttttggtcacatggaataaacaattaattaatttgaataatattacttaaatacatacaaacattatctgtcatcttcgattacgttatcattaaccaacgtttaggaggactttgcttcttcgtcttcttctctctttaggttcttcaagttcgcaatcctggtaagattttctcgagaaaattccatttctttctatctgattctgtttacattgttgaatgcttgaaagaatctgagttttaaccacactctctcttccctgttactcaccattttctctctgaatcctccgaaacccatttcgatttccacaatctgagctcataaatctggtttaattctcatcttcgttgcatttcagtcataaagagaacataaagcttggatatttagggtttttgcagaatttttgattaagcttatgagtttggtaataatctgtagaaattggttgatgttgtttcaggtttgggtttaggacaaatcagagaagaagatgatgtttggtttagagaaaacgatgactttggagcatgaaattctgaaggagaatcatgagactctgttgaaagattatgagagtcttcaggagaggattaagcatgctgaggaagcttatgaggctattaagttgcatcatgagaacaaagctaaggagcttgaagtgagtaacaaacgcttgcttgaggaatgtatgaaagagagaagggagaaggctaaggttaggaagacttttgaggagatgaagaagacaatggagagtgagagaactgctattgttgatgagttgaagtcgaagaatcaggagcttttgttggggaagaagaaagaggaagaagagttagtgaagatg

SEQ ID NO: 35644 - DNA, 3003 bp, Unknown
  misc_feature (1)..( 3003): 2750-1469P.txt file - cDNA_ID_3089578; gDNA_ID_1620713; Annot_ID_165527
gttaataaatgaaacagagaatgattaatgaggattctaaacaaccgtaattattctctctctgattttaagtaatgtttaaggttttttacacatattacaaaagtttagtttaatttacctttttttgcataagtaactatatctaagtcaaccaataaaaaatatactatagaatattattggtcaaaaaatattaaatacatttaacttttatattgaaagttgaaagcatcatttaaaatcggaaaaaacattctctaaattatcatttttaatgatatgaaaccgtcatcaattgtgtcaatatcaataaaaacgatctcttcagtagagatgaaaaaaaattgtatcgcatatgtcacaactaatctaatcgtttatattatttaaagttttaatttctaaactcataatttttaccaattgtttcaaaattttcacatctgcaattttaactgcaaaagtctctatattttctacggtcaaattccttacaccaaaattttctacaaccaaaattgatatagttagaaataacacttgttaccaatcggtcctaacactttcagattatagatattgcggttaattagataaaaaagattcaaaaatatatttgatttctaaggacaaactaaaaaaatttaggagctttagaaaaattatgtttgatttccaattattctacgtggttttagtaaaagatgtgtttactataaaaaccttgattgtaattgtttataactcattactaaaagttgtgactgcagaaattacgaaactaaactactacaaaaaaatgtggagaaatgggttaaaaaaaacaaggaaaaaaattcaatgttaaatcaactgaaatttttttcatttaattattcagctaattttagggaagttatcatatcactatatatatatatatatataaataatacaaacaaacgatgcgtagaagaaaaaaaactgttgtccggttcactgtccagatcgggtttaaaaacattgattttcatattatattccgaattttgttttgccaaaaatccaattacttaaatttcaggtcaatttatgttaattttttaacataacccgatccaattcaaattgaaacaaatttatatttctcttttaatagtataggaatttgcacaaatgttatgtaaaaaacggaaaattggttttttcatatctttagtttgaactatgctgcatttatacacgtattataccacagttgatttaacctaaacttcaatttgatatttaaactttcatttttatacgaaaacatacattaatgttacaatgttagaatacctttaatttctgttgttaacctgaatgttagggctgggcaaaatattcgttcgatccgctttgattcggtatatgatttggtttgattcgaaaaatccgaatatccgtaagattttggaccaaagcaaataggaaaatgtagtattcgtaaaaaccgaatcaaataacaaattttaaaaaaaaaaaaccgaatatccgcttcgatccgtatctttttatatatatattagaaaatatagttatatctatatatatatcataatagtttgtgtattgttgctattttacgtttttatgttaaaatgtttgtttgatcatttttctcatgttatgttttgatcaacgacatcaaaaactatcgggttttagttttcggaattagtttgataacattttgtagactggtggtaccaacaagtatttagtttttattttgaaagcatgttaaataaaaactttgaatatctgatatagttatatagtatatagattttttttaatatttaaatatatcaaagcggatatccgcaaatatcacaaaaaattctggatattcgaaattccggatatccggaaattttcgaagcaaagcaaagcaaatcacaaaatcaagtattcgtttaaaacgaatcgaataacaaatatcacaatttttccggatatccgtttcgtacccagacctactgaatgccatatataaaacggtaaaaacagaaaattaaagttctagtaaaaaaaacatcgcatcagttacaaggtttggattaaattaaaaaaaggtttgggttaaattagcttaagaatgaacaatttattaattatttttttggtcacatggaataaacaattaattaatttgaataatattacttaaatacatacaaacattatctgtcatcttcgattacgttatcattaaccaacgtttaggaggactttgcttcttcgtcttcttctctctttaggttcttcaagttcgcaatcctggtaagattttctcgagaaaattccatttctttctatctgattctgtttacattgttgaatgcttgaaagaatctgagttttaaccacactctctcttccctgttactcaccattttctctctgaatcctccgaaacccatttcgatttccacaatctgagctcataaatctggtttaattctcatcttcgttgcatttcagtcataaagagaacataaagcttggatatttagggtttttgcagaatttttgattaagcttatgagtttggtaataatctgtagaaattggttgatgttgtttcaggtttgggtttaggacaaatcagagaagaagatgatgtttggtttagagaaaacgatgactttggagcatgaaattctgaaggagaatcatgagactctgttgaaagattatgagagtcttcaggagaggattaagcatgctgaggaagcttatgaggctattaagttgcatcatgagaacaaagctaaggagcttgaagtgagtaacaaacgcttgcttgaggaatgtatgaaagagagaagggagaaggctaaggttaggaagacttttgaggagatgaagaagacaatggagagtgagagaactgctattgttgatgagttgaagtcgaagaatcaggagcttttgttggggaagaagaaagaggaagaagagttagtgaagatg

SEQ ID NO: 35645 - DNA, 3003 bp, Unknown; identical to SEQ ID NO: 35644
  misc_feature (1)..( 3003): 2750-1469P.txt file - cDNA_ID_3089578; gDNA_ID_2926152; Annot_ID_198131

SEQ ID NO: 35646 - DNA, 3000 bp, Unknown; identical to SEQ ID NO: 4740
  misc_feature (1)..( 3000): 2750-1469P.txt file - cDNA_ID_3089590; gDNA_ID_1620726; Annot_ID_49285

SEQ ID NO: 35647 - DNA, 3000 bp, Unknown; identical to SEQ ID NO: 4740
  misc_feature (1)..( 3000): 2750-1469P.txt file - cDNA_ID_3089590; gDNA_ID_2926153; Annot_ID_139393

SEQ ID NO: 35648 - DNA, 3000 bp, Unknown; identical to SEQ ID NO: 4627
  misc_feature (1)..( 3000): 2750-1469P.txt file - cDNA_ID_3089597; gDNA_ID_1620718; Annot_ID_165713

SEQ ID NO: 35649 - DNA, 3000 bp, Unknown; identical to SEQ ID NO: 4627
  misc_feature (1)..( 3000): 2750-1469P.txt file - cDNA_ID_3089597; gDNA_ID_2926153; Annot_ID_198231

SEQ ID NO: 35650 - DNA, 3000 bp, Unknown; identical to SEQ ID NO: 4743
  misc_feature (1)..( 3000): 2750-1469P.txt file - cDNA_ID_3089599; gDNA_ID_2926153; Annot_ID_198215

SEQ ID NO: 35651 - DNA, 3000 bp, Unknown; identical to SEQ ID NO: 8320
  misc_feature (1)..( 3000): 2750-1469P.txt file - cDNA_ID_3089615; gDNA_ID_1971724; Annot_ID_175201

SEQ ID NO: 35652 - DNA, 3000 bp, Unknown; identical to SEQ ID NO: 8320
  misc_feature (1)..( 3000): 2750-1469P.txt file - cDNA_ID_3089615; gDNA_ID_2926153; Annot_ID_198200

SEQ ID NO: 35653 - DNA, 3003 bp, Unknown
  misc_feature (1)..( 3003): 2750-1469P.txt file - cDNA_ID_3089622; gDNA_ID_1971724; Annot_ID_175199
tagacatggccagattgttgtatggtacgttattccaacatttctttctctggattttgtttggaaggacaagaaaaaataaacgtttacgagttaatttgtacctaacaaaagccttgactatttcctctttggtatgttatgagcttagatacttttaagttccaagatgtccttattgttgctaatgagtcatatacttgcaaatgtacagaccctgcaaaacaaggtgaactagattggacaagacggtacaatatcattggggggattgctcgaggaattctatatcttcatcaagatttacggcttacaatcatacaccgtgatctcaaagcgagtaatattctcttagatgtcgacatgaaacccaaaattgcagattttggcatggctaggatttacagaattgatcaaagtcatgccaattacacaattagaatcgttggaacatagtgattttttttttctcttaacttataaccttacaaatacaaactatatttggtggttacttctaggctaaaaagtctaatccttatttgcagtggttatatgtctccagaatatgcaatgcgtagtcatttctccatgaaatctgatgtctatagctttggtgtaatgattctagagattataagtggtaaaacgaatcgcagcttctactacattgatggttctcctagcaatttggtcactcatgtgagtatatgatcgttcaagttatatgagtgtatatgattaagccaaaggatattaatttatttgatcacttttgttaggcttggaagctttggagaacagggtcaccttttgaacttgtggatccgacaatgggagagagttctcggagtaacgaggctattattagatgcatccatatcgcacttttatgcgttcaagaagatcctgtagatcgaccaatgttgcctgcagcaatagtcgtgatgctcactagtaacatagacaattaccgtttgcctctcaaacatgaatgaccaatccacaagcaggtctattccttgttctaattaacaatgatgtatcaacacagttctagatcctcgttgaagaatggtttttttcttgatattggaactgtattgaatatatggaagtatctacatcatctcttgttcttctcattactctactttatgagacatttaaacaagtatatcagatagtaacattgtacaacaagattcacgttttaaacatattttcagtaaccagaattggttcagacataattaggcattggtgtttcatgtttgtgaagccaataactgaattcatagtttgtataatttaggaaatagacataagaaaatagtttgaactaaacgaacgcaaaacattagttttttttatccatggggcttggttacattgttataattgaaactgttttttagtttttgttgtattatatcatctttcgaggaagagctggtggatctggaccacgacatctctttgatttttcacatcctcgatggtacggattcgccggttgatcgggtggacagttgccatgatcacatcctggttggcgatcgccgcgtcccattcctggatagccaatctcatttgcaactgctacgttcatgttgttgcttatgaacacacatgctatgaacattgccacgaccataaacctttttgtttctttcaaaatgctcatgatgattgatgcctttttcttatgtcaaatatgagtttagatagttcaagagtgttttatgagtgtaatagaaggtttcactttgtgatatttatagagaatgaaaattctgaaagacaatgatccatacatatcaaaacagtgatatttgttgtataatatggaaggaatctcggggagtttgatttgtcttaatctttagaagcattgtgtcatgaaactatttgttggtaatactaaaaatattatgatgatatcttttcgttttagttttacttaaacagagatttgaataggataactgaaattggcagtagaaataaactactaaatatatagatgccataatagttaatagtaaaatttttacttttatattatataaagcttgatttggttttcaaagttgttaattcacgtgatcgtgacacgtctcacatctgtcagttagattatgacacatgttgaaagattttaacattttttaactaaatagaaaaattaaaaagaaaaaagtacatatctacaaatactatttctaaaccaactgagctctattatcttaatccaaaaagtatactagaagaaattaacatatactaatttacatgtgtgttatagagaactcttaaaattgtgttccttaacccaaaaaacaaaaacgaacaaaaattaacatacatactaatttatgtgtgtatagaaaactcttaaaactgttttttcttaacccaacaaaacaaaaactgaaaaaaatgtttttactaatgtttctaatttttattatcggtttacacgtggaaggagttatatgactagaaaccgtgtgtaaaccgataatagataaagagtcatattttcccaaagatattagagaaggagtcatattttgcagttcttttttgtgctagttttactcatttcataatcaaattcaagatgttcaggtatcaatatttgatcaaattaccagtcatgattctataacttgtgtactgaatgcaaatggcaaattctgactagtataaatgggtttgattaaaatgtgttatccggttgggttttgttggttttgtgtggtctaagtttgtttgttgacttccattagagctattgactcagtcaactttaatttttcaaaggcatttgcataattttccttagaccatctctttcaattaagaatgtatgacaaattcagtgaaccagtcaaatctgccaagagaacctacatagtttgagttattgatgcccaaacaaaacttcttgattctaatatctaaacacaatcttttttttctgatcttgagagaatg

SEQ ID NO: 35654 - DNA, 3003 bp, Unknown; identical to SEQ ID NO: 35653
  misc_feature (1)..( 3003): 2750-1469P.txt file - cDNA_ID_3089622; gDNA_ID_2926153; Annot_ID_198198

SEQ ID NO: 35655 - DNA, 3003 bp, Unknown; identical to SEQ ID NO: 31844
  misc_feature (1)..( 3003): 2750-1469P.txt file - cDNA_ID_3089636; gDNA_ID_2926153; Annot_ID_139378

SEQ ID NO: 35656 - DNA, 3003 bp, Unknown; identical to SEQ ID NO: 31844
  misc_feature (1)..( 3003): 2750-1469P.txt file - cDNA_ID_3089636; gDNA_ID_2926153; Annot_ID_198194

SEQ ID NO: 35657 - DNA, 3003 bp, Unknown; identical to SEQ ID NO: 31845
  misc_feature (1)..( 3003): 2750-1469P.txt file - cDNA_ID_3089640; gDNA_ID_2926153; Annot_ID_198193

SEQ ID NO: 35658 - DNA, 3003 bp, Unknown
  misc_feature (1)..( 3003): 2750-1469P.txt file - cDNA_ID_3089690; gDNA_ID_2926154; Annot_ID_198301
ttggcacaaacgtaccaggaaagccagtggatgcgtatcccttatccctgactgtagaaacccgaccaccaacttcgactcaacctccaacaccacccgccgtacccctctctcccaagcagtcaccagcccataatatactccccacagttcagctaagggagctgaacacactccgatgttaagcgcaaaccctcccagccaactgccctccccatccctaaccacaccccttgccgtcgcgaaccccggatttccgtgtgaggccccgtccgtgttcaccgttgcccatcgttcgctcggcttcttccaaacgatctgcctctccactctttctcccaaattcctgcccgcattgactttcaagtacgccgccccaacctccgcagccatgtcccgtacaaaccgaacccgatccctacatggtctcaactcgccaaacacattcatgcatctccatttccatccccaccatatcgacatagcaaacaacgtaggccaccctcccctactcggatcctctttctggtgtagattctcataaagccattccaagagagatcttgtgaagaacctctcacgttcccgggcaggcactaaccgtaaccaaataccactcattgctggacaatcccgaaggacatgtataattgtctccttcgctcctctacacacttggcaaacgtcggtatcccccatgtgtctccgagctctctccacattcgttaatatagcctggttccctacaagccataaaaaaactcgtaccctttccggagccaatactctccatatcctggaaaagaaacgctccatgtcctgagtctgcgatccctcctccatgagtagagaataagccgaccccactgtaaactctccattctccgtaccagaccatgacagagtatccgctactccgggaccgcctcccaacacgaccgcagtcaatcgtaacagcagcttctccggtaagaaacacgaaattctgcccatgtcccaaccaacacgaaattcttaattagttatttataagattgagatttcaccggggcagaaaaatgattaattgtcatgatttatgaataaaagaaaaaagaaatctacttacacttaaaatggaaacagtttatactgtgagataaagagattgattaattacgatttaagtaaaagaaagaaaaataactttgaattgtgaattgaatacaacaaaaacaatatgcacgcattacaaatatttagtcttgttttttattagccgttaagggaagtgagaccaaaggtgacacttgtggtacgaatggtagcttcagtgggtaactacgattacatcattgattatgagttccaaactgatggggttatgagagcaaaggtactttcaatatttgacttttatctcattttgacaaaaacaaatcataaaaggttccgtattgaaaatattttacttttggtaatatcaacgacaggttgggcttagtggaatgttgatggtgaaagggacaacgtacgagaacaagaaccaagtgaagaaagacaaagaaggtaatgaagaagagctttatggcacgattctgtccgaaaatgtaattggagttattcacgaccactacgtcactttttaccttgacctcgatgtcgatggcccggacaattcctttgttaaagtgaacctcaagaggcaagagacggcgccaggtgagtcacctaggaaaagttacatgaaagcagttaggaacattgtgaaaaccgaaaaagacggtcagatcaagcttagcttgtacgatccatcagaataccacgtcattaatcctggtaaaacaactcgagttggtaacccgacgggttacaaggttgtccctagagccacagcagctagtctacttgaccatgatgatccaccgcagaagagaggagcttttactaataaccaaatttgggttactccctacaataagtccgagcaatgggctagtggtttattcacttaccaaagccatggtgatgatactcttgcggtttggtccgacaggtgattagttgcaaagaattaccctttttattagttatattatagttaatattgttacgattgatttagtgtctttatttggtgtgatgcagagatagagatatagagaataaggacattgtggtgtggtacacgcttgggttccatcacattccatgtcaagaagattttccgataatgcccactgtttcttcaagtttcgatttgaagcccgtaaattttttcgagcgcaatccaatccttaaggccgctccaaactttgaatatgaccttccggtttgcggagccaaatctgattctgcttgagaagaataaagaaccaacaaaagaaattatccaactttttggatcttattggcaaaactacaaatcaagttacatgatattcactttcctatgtgttattggcgaaatcccaactcctacaaaacttataagcgcaaaaatagtatataacatgtccaattcacaccggaatgttaatctcaaggaattgtattttctcctagaatcactacttttgtgatagaagactttttttttgtcaaccttgatagaagatcttgataagattttttgtttttgtttttggcattgataacacattattctttcctaaaagaaattagtactcccctatatctcagtcaatttactaatgtttgatcttatgtttgtatatcttctcaaagcttgatcgtatctttctcttaatttgtatctcagtgtcattttatcaattaatgcttgattgtatacggagtattggtatttaacataattttaatgttcactgtgtgaatctaagtaaatcaacagtccagagactcagattgataatgctactacctaattccttgacgtaacaaatgcttatatctcatctaagaaatattcagtcgaaaataaagcatttccatcactctctgctcataaaactatcacaatagatattgacaaaaaaaatg

SEQ ID NO: 35659 - DNA, 3003 bp, Unknown; identical to SEQ ID NO: 21300
  misc_feature (1)..( 3003): 2750-1469P.txt file - cDNA_ID_3089710; gDNA_ID_1620632; Annot_ID_162732

SEQ ID NO: 35660 - DNA, 3003 bp, Unknown; identical to SEQ ID NO: 21300
  misc_feature (1)..( 3003): 2750-1469P.txt file - cDNA_ID_3089710; gDNA_ID_2926154; Annot_ID_198276

SEQ ID NO: 35661 - DNA, 3003 bp, Unknown; identical to SEQ ID NO: 18917
  misc_feature (1)..( 3003): 2750-1469P.txt file - cDNA_ID_3089720; gDNA_ID_1620632; Annot_ID_162722

SEQ ID NO: 35662 - DNA, 3003 bp, Unknown; identical to SEQ ID NO: 18917
  misc_feature (1)..( 3003): 2750-1469P.txt file - cDNA_ID_3089720; gDNA_ID_2926154; Annot_ID_198268

SEQ ID NO: 35663 - DNA, 3000 bp, Unknown; identical to SEQ ID NO: 4505
  misc_feature (1)..( 3000): 2750-1469P.txt file - cDNA_ID_3089733; gDNA_ID_2926155; Annot_ID_198372

SEQ ID NO: 35664 - DNA, 3003 bp, Unknown; identical to SEQ ID NO: 29185
  misc_feature (1)..( 3003): 2750-1469P.txt file - cDNA_ID_3089737; gDNA_ID_1620711; Annot_ID_165410

SEQ ID NO: 35665 - DNA, 3003 bp, Unknown; identical to SEQ ID NO: 29185
  misc_feature (1)..( 3003): 2750-1469P.txt file - cDNA_ID_3089737; gDNA_ID_2926155; Annot_ID_198361

SEQ ID NO: 35666 - DNA, 3000 bp, Unknown; identical to SEQ ID NO: 4491
  misc_feature (1)..( 3000): 2750-1469P.txt file - cDNA_ID_3089741; gDNA_ID_2926155; Annot_ID_198359

SEQ ID NO: 35667 - DNA, 3003 bp, Unknown
  misc_feature (1)..( 3003): 2750-1469P.txt file - cDNA_ID_3089745; gDNA_ID_2926155; Annot_ID_198358
tgttgtataaaacagactggtttctagttactagaagatcaagttcgtcgatgagaagtatgcaaggcttctcatcctctttaccaatcctttttccttctgcaaacctctcatttagacactgtagagctttcttccaaccgactcgatgaccactcaatgcttcatagattacactgtaaatgttctcaggtgaagccaatttgagaccattgatctccacaaagcaataagggcttacgcttccctcttcaacctcagccttcagattcttcataaccgataacacactaatagtcttcccagtcccgggaacaccatgaatatacatacatcttcctaaacactgatcatccgagattgaaccttttataaacgaagtgatctcttccatttctttgcttctacaaggaagagacttaggacgtgtagccaacaacaaagtagctttcgccttttctaactcactctgcttatgacatctcacatgttcaggaatcagcttcatccccaccttctcaaccccaaagaatctccctttacgagagttcgcacctcctcttgcactagtcaaacctcctcgcttactcttcaaaacttcatcatcaagctccatctcttcatcactatcatcaacctcctcctccttcctaccattccactcttgatcactatcagaatctccatcagccaattcagccaaacgcttaaagctacgccaatgaacatcatactcatactcacacaagaacacatcatcaccatcattactagctttcgaaaactccttaggacacttgacagaacaatgcctaagaatacattccatctctatatcagcaaaatcattcgtcaaataaagctctcgtttcagattatgcggttgacgccccgaaacggtctcttcaggtatcatataccaacgagcacgaatccaatacacaccatcatcaacttctttccataacttgtcgattcgagcagcccatagatcaccggaaagtagcttctccctcatagttctcgctaacttcttcccttccggtggcttaggaaggtcaagtgtttgactttgaccagactttttaacctcacagaattgacagatccaatcaccttcaggaacttccttcaatggcggtttcaagcatttcaaatgaaatccacctaaacaatcatcacactcaatcattatgttagtatctgatttgaaacaaatctgacaatcttcaatttctggatcttcttcttcatctgaattcgaatcttctcttctcttaacgtaaacatcatcaccgatttcgaattcggtttcgtcgaattcgactttattgtaataaactctcttcttcttcttcgtcttcttaatcgtctcagatctaattggtgaaacaggagtgaaggaatctatcttcttcttcttcttcggagtttctgttttcttcgacttcgatggaacgacatcagtggttggttttctgggggcacgttctcgttttcgaattagattcattccttcgattgggtcatttcctggagcatcaattgggtcatttcccagatcgattttacgagaaacatgacgagcagatctacggagaggagtgtgagtttctggggtttgaggagtgtgtgaggttgaagatggagatagatacgatttgcgatagatgttagacggagttttggttggggatttgaaggtttttgctcttggagttgaagccattgatggtgtaagctagggtttttctgggtgaagaatgaagagtgaatgaagaggaagaagaagacgatgatgatgatgaagaaggaggtagagagagaaagttggcgggaaaaggtggcggacacttcttcttcttcgcatcagacaagagtttgcgagaaaagggtttaactttgggccgaatattgggcttattaacccaactcatcactttaggtttatccaaattaatcataacattttgggccgatttgataagaaatcaataatataggtccttttgtgaaagaaaaaaaaaaaaacgaagagcacaaagtgaaatggggaattgttttttgtagagccctaaatagaaaatctccaactgtagtgaaagtgaagaagaagaagaagatggtggagatctgaaaatatgcgatagatctgacgaatgcagatctaaaatggtctaattctataccaatctcctctctcattgtttctactaagttcaagttggtgtactgatcttattttgtggcggtgtatatacagtcatctagaggaagggagaggatgatgatgaaggaagacggtagaggaaggaatccaccgtcgcgacatctttgggttggtaaccttcctcatgggatacttgaacgagaattagccgatcggttcttaagatttggtgaattggaaagcttagcgtttcagcctggacgaagctacgcatttgttaattttaatcacgatgaggatgcgttcgctgcgattgagtcgcttcaaggcttcccactctctggaaacccacttaggatcgagtttgctaaggcggttagtgttgaaaactcctttttttttttttttttttccaatgcttgcttaatttggcttggtttttgagtcttgaggttgattagagatgacatgaactaacttattaggagtgattgaaagttatcagttagtgtgtcttcaatagatgactagttatgtgattacttacacgtaaattagttccagtcagtaccattctagaaattaatgattgttgactacgcaaaggtaacaagtctcttaccttgttctggataagttgttactcggatgatacttaatcattgtctaagtttatagaacttagcaatcagtaccattctagaaattaatgattgttgactacgcaaaggtaacaagtctcttaccttgttctggataagttgttactcggatgatacttaatcattgtctaagtttatagaacttagcaatgagcaaaacaaacgaagatg

SEQ ID NO: 35668 - DNA, 3003 bp, Unknown
  misc_feature (1)..( 3003): 2750-1469P.txt file - cDNA_ID_3089775; gDNA_ID_1620711; Annot_ID_49004
aaggatactccatgcaatacataagggcaccattaggaccaagctttagatcctccatcacatcttccaaagaaataagttctctgatatctgcattcaacgatgtcaaaaaagtgagaagcactcaaaactccccccaaaggtaattgaacaagaagaaacttcttcactcacccatagccacaggatagttgaagatctccgcagcaggatcaaggttaacaacatgcattgttcgaccgatagtttcacaatgttcatacaaagacgagcaataagttgactgatagatccaaaacacacaaaaaaacacagttagtcaaatctcactgatgaaactagttaacagaaattaacttaacatagactatagcataacctttccactgcctgctggaccaataactagctgggcgtaacccattgtagcaagcaagcagaacctctccacaaaagctcttgaaattaacaaatacagtgaaagattctaaaagacgcaaagattgcaacagttatataagcaatacaccagacacctaaaccaaacaacactctcaaaatgtcgcagggacccataaaccagaagcaagaagcaatagacacatttcagtacctgaaaggcaaaaaagatcaaaactttaacactcacatacatgatttagctagggttttaaagacccacataaacccatgaaatagataacctaaaaaagacgaaatttgggagagaaattgaagaaattagaagcagccgacaaaaatttcacaaggttgaaacgaaacccagaaggaataaataatcagaagcatcaatggagaagaaaatcggaatcagagaaatgattattgactttcacctttgacgcgtcttcgtttttctttgctctcaaaacctaaagctcaagcaaaagaagaagagaggaaatttcaagagcttcagttttttggtttgttgcgttttattaaagaccttttttagggttctttatggtttttcattcattacttttttaatagtggtcgtaatatataaatcaaaaagacttttttacttaattattttttaattctttgaaacagctaaacgatttgaccatgcaaaagaactagtctccaccaacgtgtctcacgtggatcaaaaacaatgggttttatgcaaaaaaaaaaaaaaaaaaaaacacattcaaaatcgatatttttacaattttagtttttagatttaaaaaatagaaaataatttgattgaatctaaaataatatgtaatatatctaattttagtttgcaactttacagtaaacgttttcacgatcacatatatttgtgtttaaatattttaaagatatagttgaattcatcatctcgagagattccatttgatatattatttatcaaaattttaacatttgacgataatgaaaaaaattgaattgcgtattattttatattttataggtttattttgcatttctgacataaataaaattgtaaaaatagacgacttcgaagtttgagcttgagatcactaaaagaagttaatgaggtatgttgtttgaaataaatttggggacttgtctcccacaaaaactccttatggattaaatagatcaaggcacacctactcaaaagagtcactatttggtaaataaaagaaaatactactttgggctcttagatgtggaagaaattactcaaatacaaaggagtggccaaacaattttgcaaagttgaggtaaacaactggaaaaaagtttcattctggtatgataactggtttacaatgggctgtttgatggatatcataggagagaggggacgaattgagtttgacatcttaaagcaaatgtcgatggcggaagcatggacataactgcaaccctaaaacaaattgaaacagatctcaccatgaagagacaaaatcaaaccgatgaagaggatgtggtattatggaaaggaaaaacgatgtgtatcaatcaatctttagaaccaaagacacttggaatcacactcgtaccgatacaaataaggtagtttggcataaagaggtatggtttactcacacaacaccaaagtattctttttgcacatggttggcgatccagaacagactctcaatgacaaacttctttctctacagcaactgcattgaatcagaggatcatttattcttctattgtagctatgcagctgaagtatgggaggctctaactataaatatctacaaagcaaactactcgacgaactggacatctctaatcacaagcatatatagcccatggcaggagcgtatggaaggttttattgcgcgatatatattccaagccacagtgtcacacaatttggtgcaagagaaacatacgtagagataaagaaacaccaaaccctctggctcggctcatcaagtggatagacaagcatagcaaaatgttccaattttaagtaagaaaaacaaaattctactgacaatttcaaaaacaagataagtaaaagtttaaatttaaaaaaaatgaactaaaaagctttgtcctattgatcacctaatgagcctttaaatttctaaccgtcttaaatcctattactagttaaaatctttaaattattttaaattaaagatataggttacattatttaaaatatagatataatcaattaaaagtttaaaactcatgttaaaagcatcttaaagggaaatgaaatattaatacaagaaacaaatatatatatgtaaagacatattttcaccagcggtccaaaaaaaaggatatattcacatattaaaagaaaatattggggcaaagtggataagataacatccaatgagaataagacatatcaaaattcatatccctgagagccacaacaatcttaagaaacagatcctctgtcttgccacatcagcaaacgcaatctcaagtttcgtagattgcttatttcttcatcacacacttcaaactcgattttattttaattttcataagagaacaaccaagacaaaaagaacaatg

SEQ ID NO: 35669 - DNA, 3003 bp, Unknown; identical to SEQ ID NO: 35668
  misc_feature (1)..( 3003): 2750-1469P.txt file - cDNA_ID_3089775; gDNA_ID_1620711; Annot_ID_165428

SEQ ID NO: 35670 - DNA, 3003 bp, Unknown; identical to SEQ ID NO: 35668
  misc_feature (1)..( 3003): 2750-1469P.txt file - cDNA_ID_3089775; gDNA_ID_2926155; Annot_ID_139506

SEQ ID NO: 35671 - DNA, 3003 bp, Unknown; identical to SEQ ID NO: 35668
  misc_feature (1)..( 3003): 2750-1469P.txt file - cDNA_ID_3089775; gDNA_ID_2926155; Annot_ID_198376

SEQ ID NO: 35672 - DNA, 2492 bp, Unknown
  misc_feature (1)..( 2492): 2750-1469P.txt file - cDNA_ID_3089775; gDNA_ID_2926156; Annot_ID_198400
gttatataagcaatacaccagacacctaaaccaaacaacactctcaaaatgtcgcagggacccataaaccagaagcaagaagcaatagacacatttcagtacctgaaaggcaaaaaagatcaaaactttaacactcacatacatgatttagctagggttttaaagacccacataaacccatgaaatagataacctaaaaaagacgaaatttgggagagaaattgaagaaattagaagcagccgacaaaaatttcacaaggttgaaacgaaacccagaaggaataaataatcagaagcatcaatggagaagaaaatcggaatcagagaaatgattattgactttcacctttgacgcgtcttcgtttttctttgctctcaaaacctaaagctcaagcaaaagaagaagagaggaaatttcaagagcttcagttttttggtttgttgcgttttattaaagaccttttttagggttctttatggtttttcattcattacttttttaatagtggtcgtaatatataaatcaaaaagacttttttacttaattattttttaattctttgaaacagctaaacgatttgaccatgcaaaagaactagtctccaccaacgtgtctcacgtggatcaaaaacaatgggttttatgcaaaaaaaaaaaaaaaaaaaaacacattcaaaatcgatatttttacaattttagtttttagatttaaaaaatagaaaataatttgattgaatctaaaataatatgtaatatatctaattttagtttgcaactttacagtaaacgttttcacgatcacatatatttgtgtttaaatattttaaagatatagttgaattcatcatctcgagagattccatttgatatattatttatcaaaattttaacatttgacgataatgaaaaaaattgaattgcgtattattttatattttataggtttattttgcatttctgacataaataaaattgtaaaaatagacgacttcgaagtttgagcttgagatcactaaaagaagttaatgaggtatgttgtttgaaataaatttggggacttgtctcccacaaaaactccttatggattaaatagatcaaggcacacctactcaaaagagtcactatttggtaaataaaagaaaatactactttgggctcttagatgtggaagaaattactcaaatacaaaggagtggccaaacaattttgcaaagttgaggtaaacaactggaaaaaagtttcattctggtatgataactggtttacaatgggctgtttgatggatatcataggagagaggggacgaattgagtttgacatcttaaagcaaatgtcgatggcggaagcatggacataactgcaaccctaaaacaaattgaaacagatctcaccatgaagagacaaaatcaaaccgatgaagaggatgtggtattatggaaaggaaaaacgatgtgtatcaatcaatctttagaaccaaagacacttggaatcacactcgtaccgatacaaataaggtagtttggcataaagaggtatggtttactcacacaacaccaaagtattctttttgcacatggttggcgatccagaacagactctcaatgacaaacttctttctctacagcaactgcattgaatcagaggatcatttattcttctattgtagctatgcagctgaagtatgggaggctctaactataaatatctacaaagcaaactactcgacgaactggacatctctaatcacaagcatatatagcccatggcaggagcgtatggaaggttttattgcgcgatatatattccaagccacagtgtcacacaatttggtgcaagagaaacatacgtagagataaagaaacaccaaaccctctggctcggctcatcaagtggatagacaagcatagcaaaatgttccaattttaagtaagaaaaacaaaattctactgacaatttcaaaaacaagataagtaaaagtttaaatttaaaaaaaatgaactaaaaagctttgtcctattgatcacctaatgagcctttaaatttctaaccgtcttaaatcctattactagttaaaatctttaaattattttaaattaaagatataggttacattatttaaaatatagatataatcaattaaaagtttaaaactcatgttaaaagcatcttaaagggaaatgaaatattaatacaagaaacaaatatatatatgtaaagacatattttcaccagcggtccaaaaaaaaggatatattcacatattaaaagaaaatattggggcaaagtggataagataacatccaatgagaataagacatatcaaaattcatatccctgagagccacaacaatcttaagaaacagatcctctgtcttgccacatcagcaaacgcaatctcaagtttcgtagattgcttatttcttcatcacacacttcaaactcgattttattttaattttcataagagaacaaccaagacaaaaagaacaatg

SEQ ID NO: 35673 - DNA, 3000 bp, Unknown; identical to SEQ ID NO: 3308
  misc_feature (1)..( 3000): 2750-1469P.txt file - cDNA_ID_3089786; gDNA_ID_1620637; Annot_ID_162953

SEQ ID NO: 35674 - DNA, 3000 bp, Unknown; identical to SEQ ID NO: 3308
  misc_feature (1)..( 3000): 2750-1469P.txt file - cDNA_ID_3089786; gDNA_ID_2926156; Annot_ID_198456

SEQ ID NO: 35675 - DNA, 3000 bp, Unknown
  misc_feature (1)..( 3000): 2750-1469P.txt file - cDNA_ID_3089811; gDNA_ID_1971822; Annot_ID_176232
taacacctttgttcccattaatcaactcaacaatctcattccttttctcctctaacttcaaccctaaactccaattctcaaaatcacttaaatcatcaggttctctaacaaacgtgcctttatcagattgtaacgcaagtaacatcatctcaaaacgacgataaggtttcaacgacaaaacctgatttgtacggtcacgattcggttctaaagattccttaccacgagaaataatcttagccgttgatttccacacggtggcgccgatatcgtcgataacttgacctaccgattcgagagattccgaagcgacggaggcgccaatttcgagagaatcaggtaatcttgaagctactcgtcggattattgaggtttctttcttcaattcggatccgaattcgaccaaatcgcgacggtaggatccgattacagattcggattttgtcgatagggttttgattagattgccgaaactccatgaagaagaagaagaagaagttgtggattcatgcataggtgaatcggagctatgttgatgatccatgaagaagaagcacaaggaaactaggttttttttaaggaagtttaatttcgtacggaaactataataaataataatgaatcgatgattactggttctgttttaaaagtcagatgtcggtggcatgtgttttgtatgaacaataaaatatattaaacggttcacttaaccgagtaataattggaaatttgtaccaaaccggttgaattattttagaacttttgccttttttttcttttatacttgcgtcgcttatttgccatcgaagaaaacggttggtggagattattctcgttgcaggctggtccaaggctaaagcccgtaaaacatgagttttatgcagcaaatgactataacaaagtttaggagtatcattttacagaaatttattgtggtagattggttaatagctggattctctctacaaagatgatgtgtttgaaccttcattattacattatgaatatatatttttttaaactatatttaatgatggaataaaattgtttttgcttcaggtttactttgggtcggccctgtcattgcctcaacgtctaatgagtctagaagagaagtcgttgtcatcgccgtctcttgtaataaatgcctactttcatatggatttccctccggatcctaatatggacatttatcctagtagtgacaaacatttttcatgtggttatgcatcaggtttgatctatttctatagtttgtcgatcaaattagacgagtttcattacgatcatgggcctgtgatatataaccttccgatcaagaaatccttatgtcgcttcttcagatgtggtttgctactgccactacaagatacagaatcatctttgttgttctctgttgcatcatggaagaaatattcttctctcatcgtacaagatgagcatcgtagaatctcatcgtacaagatgagcatcgttttctacatgtctacgaaagagtgtgctggttcaactcccttaattgagcttatttcatcttaatgtgataatgtcattgttatgggctgttcaagatatgggcctcgtgaattaacagggccacaaaggcggtaaaataagcactatcgcgtgcacaattttaatctttaaattgccgttgactcaacaaatttgacccaaaatttagtcaatgtttactaattcatagaaaaacgttaaacaactcgattaaaacctaataagctcataaaatcctcaaaatttctctcaaactaagaagtctatgtgattttttctcaaaatcgattgataaacacatagaaattaaaatcaaattcgcatattttgatgagagtatgatgaatagatgaataaagaagcttctaattcgaatgaatgaattagatttacagagatcttagattttaatttgagacaaattttatgattttctgagtttattaggttttaatcgagtaagttatttggtatttctttcctgcaccgctacccatatttttttatttgtttcctgtttactttttacttgcctatcacgatatttattcgcatatcttaataatctcctttccttgctcaacaagatattaaatttgtgtccactcatgtttccgtatcgaatgccaatcaacattttctttgaaaatgtttgatacttaaacctttgtgaccaagattgtgtcatggttggttgggaacatgtttttcaatgatccttttgtccactgagtttctccttcatctttgaatcgtaagcattgtaacatggtttcggagggatatctccttggtttaagctgatttgtgatgttaaatctagattgacatacgtttccttggtttgatgttgtatataaaagaagttgagtattatagtttattattatcaatacaaaaaacggcttatcacgatattttgtaaaacacgttcatcttagattcatttcgatatttgtattggtagactgaatggataaaccacgacataagccttggaagctctttaaatttgttgatttttgttgataatttaggtttatttgtgtttgttagttttagatgagctaattatattttgtttcgtattgttgattaaggatgtgaaattggtaatgttggtagatagattggacgattgttggtttcttgttatggaccaaagtttttaagcaaaagtttccttttaacccaactctctcttagagaattaggctaactgttggagtttggttctttcattaagaagaagagaccttatataggccacaatacattgtgtaaaaagaaacctcaaacctaattctaaaagtaaaacttccaaaacccatgattaaaagaaacccataacaccaaaactaattaattaaaacgtcctaaccgtggcctaatcaatctaaccatagtctcgtatcatttttcttgtggtgtagagacgcgagggcattgcaagagaaggcagctagataggcaggacaatcaatg

SEQ ID NO: 35676 - DNA, 3000 bp, Unknown; identical to SEQ ID NO: 35675
  misc_feature (1)..( 3000): 2750-1469P.txt file - cDNA_ID_3089811; gDNA_ID_2926156; Annot_ID_198435

SEQ ID NO: 35677 - DNA, 3003 bp, Unknown; identical to SEQ ID NO: 31800
  misc_feature (1)..( 3003): 2750-1469P.txt file - cDNA_ID_3089823; gDNA_ID_2926156; Annot_ID_198425

SEQ ID NO: 35678 - DNA, 3003 bp, Unknown
  misc_feature (1)..( 3003): 2750-1469P.txt file - cDNA_ID_3089827; gDNA_ID_1971822; Annot_ID_176219
aggctactagattacatgataaaacacaatcatgattgtaaatgattttcttcatttctgatgcttacgtagtcactagcggtttctatatggatctcgttgctctgggaatctatggaaaatttgagtacagagaacacgccttttaagctagataatgtgattgagattatgtacgaaatgagagaatgaagaaaagagacgatggtggtgagagtagctcacaaaagaggaattattagtgatagttttaaattatttctctgtttttgtcgattggattggattgcagagtccactagattgcatgatgcatctcatatgtgaagtgtctctgattaagtgattattttgtgaagttagtgttctcatgtgtgtattttttttctgattaaaaggtaacattatctgtttttgtagtgtttttttcttttttttttcttttgtgatgcattcctgtatgtgtattctgtactcttttgatgataaatacgtggttatctgaatatgttctcagcatgttcaagttccggttccaacaccaaagagtaatgaggtttgcctgaaattagaagctactagtctaaaccctgttgattggaaaattcagaaaggaatgatccgcccatttctgccccgcaagttcccctgcattccaggtattctaatagctttgaagattttagtttctgtatagaagaaagaggttactttgcttagaggtcgttgagtttggaacctttgatatttgttttgaacagctactgatgttgctggagaggtcgttgaggttggatcaggagtaaaaaattttaaggctggtgacaaagttgtagcggttcttagccatctagtaagttttttcagacagacaagtagaaactttaattaccttgaaacatgttaagggaaactgattttgttctttcagggtggaggtggacttgctgagttcgctgttgcaaccgagaagctgactgtcaaaagacctcaagaagtgggagcagctgaagcagcagctttacctgtggcgggtctaaccgctctccaagctcttactaatcctgcggggttgaagctggatggtacaggcaagaaggcgaacatcctggtcacagcagcatctggtggggttggtcactatgcagtccagctggcaaaacttgcaaatgctcacgtaaccgctacatgtggtgcccggaacatagagtttgtcaaatcgttgggagcggatgaggttctcgactacaagactcccgagggagccgccctcaagagtccgtcgggtaaaaaatatgacgctgtggtccattgtgcaaacgggattccattttcggtattcgaaccaaatttgtcggaaaacgggaaggtgatagacatcacaccggggcctaatgcaatgtggacttatgcggttaagaaaataaccatgtcaaagaagcagttagtgccactcttgttgatcccaaaagctgagaatttggagtttatggtgaatctagtgaaagaagggaaagtgaagacagtgattgactcaaagcatcctttgagcaaagcggaggatgcttgggccaaaagtatcgatggtcatgctactgggaagatcattgtcgagccataagagcgttgtagccatctttgactgtctgtgaatgtgataatagatgttaaaagtttgcgtaccgtttacagaatgttttatgttgttttgtttaatatacccgagtatgtcgaaagttacatgaaaagaaaatttggatgaaataaataatacttgttaggtattttagttttaccataccgctgaagttgaaccgaaactgagcatggaatcgaataaaacagacccaacaacatcataaagcccaatagcccattaacgacttcgtcaattcccctatcttaaaaagactttctccagtagaatcttccggtaaataaaacaatagtcgaaggagatttccgtcatttcaaatggtaagaaaaccagaattatttaatatcactctcttaagggaccaccgttgccttccccaccacaaccaaccattttcctccatttttttctttttccttattaatattttaataataatacaaaaatcaataattatcttcttaaatatttaatttaattaattaattatgtatttcgttcttcttcttcttcttcaatttcttctttcttctcccatggcttcctaaacaatctgctattcctctctctcttcttcacctatagtttatctctttttttttgttttggcttctcttaaattcactttctctaaaacataaacgacattgatgtttcttcatcagatcctttaattcttctccaattctcattctccttacatcaatggtgagaatttttttttatagattatgtttttaattcttgtgttcatgtaagatttttttttttttttttttttgtgttttattgttttcttaattccgattggatttgttttttgtttatttttctcaattttatctcaatttcttggacaaattgatctttttttactctacaaataaataaagtttgagactttatagcagaatcttcatatgtagcaattgaagatttttttttcttttctaaaccgatctaaatagattaaatcatcattattgaaaacaaaagattttgtttttattttgattaaatcctttttttttttttttttttttgcagataaactttgtagttggagatttgttgtggatgaagattattgattgcagcttataggaagctgctctttttgttttgaacaatgttgctaacttttcagattcttataattaatcagtcttatgatgagaagttggttcttgattacatactacaatcaagaagtaaacagtttatgcaatcttgtgacggttcttgtgttcaaagagtagatacttgttcttcaaggtggaggttaacagaggacaattgacggggtttttaatcgttgttgtattgctcgaataaacggaatcatg

SEQ ID NO: 35679 - DNA, 3003 bp, Unknown; identical to SEQ ID NO: 35678
  misc_feature (1)..( 3003): 2750-1469P.txt file - cDNA_ID_3089827; gDNA_ID_2926156; Annot_ID_198424

SEQ ID NO: 35680 - DNA, 3000 bp, Unknown
  misc_feature (1)..( 3000): 2750-1469P.txt file - cDNA_ID_3089831; gDNA_ID_1971822; Annot_ID_176214
gagacttggtaagaaaactgttggagaaagatcctagccgtaggattaatgttgaaggaatcaagggacatgatttctttaaagggttggattgggatttggtgcttaaggtatcacgaccaccgtatattccggcgccggaaaattatgagatttcgaaaatcgacgtggagaaattcgtccatgaaatatttactaaatgtgaacataatggtaattttattgtcttttagtttaaatttattttaaaaatttgtagaattatttatgtctatcatatgattttaggtaattgtcaaactggccatttacatatatagaatattcgataactcagagaatattatgccaactagcttcaagagatatatttgatatgctttgcttttttagttttcacaatgattttttttttgtatctagtcctaattttgtgacattattatatattcgatttaagaggaatttccaaaaagagaaactcaaatccaaatcttggaatatgaaaaaagaaagaaaattgggtggtttagagaaggtattaaaagaaggaaagtgaagcaacagaagatgtattagtgaactgttttggcggtggcatcatcaatattcactcggagtttgataatggacctacttctttcttttgtcctctctctattctattttttcaatcactactcaattatgaagatgatttagagtcatcaatagtggactattagactctactattcagtaatgacgataccaatataggtggttgatgttgaattgttattaaatcactaatgttgaaacttggaacgtgttaaatcgggttcttatgaagttatgatgctgacccattacctgtctcttgttcttcgaaatttcacaaaagaatatagtgttctaaaagaaaaggaaaaaaaaaagagggttttgatttcttttcttcccaaaacattgattcgttttagactacttttgttagtttaagccatgacttttgtatatgtgtgagccaaatttttattatttattgacttaagtttggctcaaactatttacaaaaatgattggactattatttgacaacaaatcatgtaactcattacaagttttctttaaatcaatcatatgaggaaaagagattaaacatattttgtttttagttgcacccacataaagactcgtaaaatacatgattctatctaactgtttattctttatagatgtgattacacgaacacgaaccatgtgatgatagtaattagatgacaagagatgaataatattgtttggtgatagtatttgtatttgtccatataccaagctgtgatttgcttcgcggtggcatttaagagagctgttgtctttcacatgtttttcaagatgagatttttgtttaaataaattaaatataagttgcaatggaattcacataccgattcttctcaaatcagcccaaccgatgagtaaatgtgaagacaaagaaaaaataatgagattggtttgtaaccaatttcagaaactagccgaaaagaaagtctctcatattaagggaggaccaaggagctgagatgatcgtaggtgcaggagacaacaattatcaaccatagttatcctaaccagaattgtatacgtctatggttgaaatggtttatactacttcatagttgaatctcaagaattttatgtattttgatatattttattttattgaggttttattctttaaatcatactttacaacaaagaaagtgtacatatgtaatatatgaatgtaaatgctgttttttttcttaatcatatggttgaagagatttacattatgacatctaagattttaagattaatggtaaagagaagtttgtttgcaagctttacaagagtttgtgcgggtggaaacatactttgagattagtacaagaggtactttgtgactttctttaggtgtgagactgagttgtagttatcttaagaagtgtggagagtcctacttgacattgttgttgtatgtagatgatatgttgatagtgggagcagacttacatgagattagcaagttaaaggtaaaacttttatcagtttgcggtaaaagacctaggaaaataagatcaatataagcaagggagagcatctccaatggaggggtctcttgttattttgagagagttctcttgattttgttgattaaaaaataatcaaaactgattaattttgagagaatcgtctctctgaagagagatttttggagttgagagagccgaacacgtggctctaggtgattggttggtttatttaacaattttttttttatcgtttatgtattcctgtcgtcttctctagcgattgtgcgactcttttttcctgcgattctgctactctggagaaaggaagacgaatgattagttaaagaagaagaagaggagtcttgcgatagaagaagatttttgcgatatcttcatagaaggaagatggtcttatctcaaggctctgcatctctctccttttctcatccatgtaatctctttttctctctttgctacccttcttcttcctctagttgtactttgtattctgaccaattctccaattctctaaatttaagctttagtttgaaaattaggatttctgggtatcctaagcagctcaatttttgatatttctgattcgttttataaactgaatcgttcacatacggttttgttctcttaaattgggggaaacaactatttagcttggctgaacaccaatagtggcaagaaagagaaatcgaattgaaagagaaattgaatgttgttgcggcaggtagtgcgtattggaagaatttaacattgtgagagagtgatcttattgatttagtggtgttacatgaacttagcatgtaaggatcgtgctctgtcttggttattagtggtgaagggtgttcaaaaatcagtgacttgctttgctcaattttcacaagaggtcatgcgtccatgagcaattggcataatacgtaattgtcagatg

SEQ ID NO: 35681 - DNA, 3000 bp, Unknown; identical to SEQ ID NO: 21968
  misc_feature (1)..( 3000): 2750-1469P.txt file - cDNA_ID_3089831; gDNA_ID_2926156; Annot_ID_198421

SEQ ID NO: 35682 - DNA, 3003 bp, Unknown
  misc_feature (1)..( 3003): 2750-1469P.txt file - cDNA_ID_3089835; gDNA_ID_1971822; Annot_ID_176205
tattcgcaactaaatacttacgcccatctatgatagctccagtaataagcagcttttcgtaacttacctattacttaagatcaagttctacttagctactctagaactagcattaaaaacaatcaagatggcaaactctaaagataattttaataggttggtgatctactaaatcatctaaaaccctaatgagaaaccttaaacctaacaagtggactaataatgtaatcagaaaatcttttggtgtgatttatggaaattttaaacttcaaaccgtcagacttcttgttgggccgcgagcggtctcgatcgactccaggagggtgtcgggtgacactcttgccttggtcaaaatccaaattcgtccttcaagtttgagttcttctgtttagctctagaatactccatgaattctcaaacttgtcccgatctttgaaatacctgaaaagcctctaaaaagactctagaaataacaaaaaaactctaaaacttatacctagatatagctaaaatcagtaaaaatagaggtatatcaactcctccagacttagcttttatttgccctcaagcaaaacacaaaaactgaacccgtggaagaggtttgaaaacgtacaaactctcaatattttctagcctattgccttgataattataaccaaatccatatgcctaacatgtctaatcaaatcctaaccaccatgtaattctccacaagcttacacaacaattccatacctaaatttcacaactatattcaacaagctttcatcgctggggtctcatcaatcaaacttatattcaagaactttctagacttattcatgtactataccatgataaatcaaccattctacattctcttgatattctttctctccccaagacttattatttcagagattaaacaaaggagtagtcacatcaccagaaatatcctccgtaaatttccaacctttgcaattggtcattccctagagtgtaaaataatgggatcatgataaatattcctagccctttaccctacaggaaatcctttcaatttctctcttttaccttttttatataataagggagataaatactattttatatggtttcattcatcaggtatgaacaaggagtcaagttctataaatattaaccgttttgacgaggttaaaagaagagtagtgtgattagctccagcctttatggattatgttgacaaagtggatgtcctctattttgtcggtttgcactctggattttctattagtcggattgactcgaacctgcatcattaatcaaccaaacaatagtctaaagaatatagatcataattcctaactaattttgactcaacaaatatttttatatacatacatatatatatatatataattttatatatatatatatatatatatagaaaagactcaaaacattaaaaataaaattactaagactcaaaaataaaaacttaactagtaagcacctcccccagacttaaacgttactgtctcttatggcattcaaatctgaagtgagcgggaaaaatagaagaataacgtaaataaaagaaaagaaaaagaaatcatactagtgggttgccttccactaaacgcttgtttgtaatttatagcttgactgttctgaagttcaggacttagctggatcaataagagatttgtgttgcatctcaactaataacatccttgccttccatggtggtgtataagcggtggagcttggtgcaacaacatgtggattagctcttttacctacaacatcaacagaagaaacaagctctcgagaaactcgatgctcgtttacctgtgaagcatacttcaaagattcgaaagaactaatcgaagaagtagattgaggaacagtggaggagaaatacctttgtgcataggagtgttgcagatgtggatctggacttagttccaagactttattgaagctgaaatttggctctcagctgctcgatggtgtcgatcaacactggtggtggtatcggttgacactgcagctgtgcggctctcacctgagttgtagaaacctctatagcgacctctggagtcaaaatattagtagccttagtagatgtgtccatgtagggtgctttgctactgataggagacttaaaatttgatccatccatgttgaaatccatcacaacatcgcagacatcaagtgaaatccaacctttttctacatcaatcctagcaccaactgtaggtaagaaagatctacttaagataagaggatccttgagttcttcatcatatgccaataccacaaaatctgccaggatgaggcaatctccaactttctcaggaacatcctcgaagataccttcaaggacttgtttagagcgatccgcgaagaaaagaatgattcatgctaccatgtaggtagttatgtttagtctttcagcaacagacttgggcatcaggttgatgatggatcctagattgcagagagagtggctgaactggatagtagaggtcgaacaatcaataacgaaactatcgggatccaagagctacttagttgtctgacttggaatgatgtgttcagacatgtctactctctttttcttgtcctcttcagcccaaccaatatcatctggctcatatatttttatatttcataacaattttttttacggtttatgataaataatttatatagcttctaaaatcaaattcttttactaaactataaacatggaagagaggcagaaagaattattaattgaatgtagtcatataaataagtttccttacacgataatatagcttaaaaataaatgttgagatatggtttgaggattttagaactaattaatttcactataaagaaaagaaatgtacaataatatgattcttgtctgttttggtaaattgttttataaattaattccaaacaattttacattgatgaatatataagattcagtgttatccactacgttacatcgatttcatattacatttttctcacagttcaacaatg

SEQ ID NO: 35683 - DNA, 3003 bp, Unknown; identical to SEQ ID NO: 35682
  misc_feature (1)..( 3003): 2750-1469P.txt file - cDNA_ID_3089835; gDNA_ID_2926156; Annot_ID_198413

SEQ ID NO: 35684 - DNA, 3000 bp, Unknown; identical to SEQ ID NO: 21597
  misc_feature (1)..( 3000): 2750-1469P.txt file - cDNA_ID_3089842; gDNA_ID_2926156; Annot_ID_198411

SEQ ID NO: 35685 - DNA, 3003 bp, Unknown; identical to SEQ ID NO: 20128
  misc_feature (1)..( 3003): 2750-1469P.txt file - cDNA_ID_3089846; gDNA_ID_2926156; Annot_ID_198410

SEQ ID NO: 35686 - DNA, 3003 bp, Unknown; identical to SEQ ID NO: 20132
  misc_feature (1)..( 3003): 2750-1469P.txt file - cDNA_ID_3089849; gDNA_ID_2926156; Annot_ID_198403

SEQ ID NO: 35687 - DNA, 3003 bp, Unknown
  misc_feature (1)..( 3003): 2750-1469P.txt file - cDNA_ID_3089869; gDNA_ID_1620730; Annot_ID_166066
agttaatatgatgagatataaatacattatgattctagagtggaattcaatacgagatggatgaacttgaagtttcatcatttcgaggaggagaagtaatgaatctcacatggataataagtgacatatccagaagattatgttcaatctttgactactaaagatctaaaagttgtataaagcaattcttatacgaatgtgttattagataaaataagttataattagttattactaaaacttcaagacttgaagtctctttgtgaatataactcacattgttaagagaatatctttgatgcggagatggtaaaacagacacttcaacttttacgcaagtattgttgtcttgtagacacaatattttgaaagaaattttgagaactattataaacttaaatcgagtgtttttcaaaggctaagaaaacatatgagttatctatgataagtaatactcatattctgaagtgaatataagatcttacatagttagtcaaatttaatatcgtttatactagaatataaaattttaattattatctcgttattgttttattaacatatgattgattattaaaatacatggaagtaattttggattataagatctcattaagggagtaactgataagcaatgaaaagtaaattagaagttttgaaagaactagaagtttcaaaagaattaaaagtttcaagagtatatttggcttaaccggattggtcatcctggtttaatgatgatgtgaaagtattgagaattatgtggacattaggtgaaaaaccagaagattctccctaatgatttatcaattgttacttgctcagaaagcaatatgataatgtgatttttttacgagtcaaaataatttggactttatctattcgtaagtatatacaaggagatgattatggattgatcacccactgtatgatatttaaatacctaatggctataaaagatgcatcgattcaatggacgcattgactcgattgttgcatcgacaagaaggtcatatttatccttgttataaacccgcaacatagagtttgcgagattactttcttgattaaagtacaagagtatttcagtgtttatttataataaccatttttggatatccgttgggataagtgtttaacattttgaaattcatgttcatacacaaaatggtttagtaatatcgatacgcatcaagccaatgaataattaatagttttccccatcattattggttttgggtcagaaaccaaatagttttcatctaaaatctttgaatgtgaaaagtgctccaccacagcacgctgagatgaaccctcaaaggaggataagtatacatgttggatatgaatgataactaagccatcctagaaggatttatatagcgctcgttttgaacactatcatattatatagtcagctattccaacataagggggagaatgtatacagctggtgaaaaaagataaaaagaaatgaattatcaatgatcctcggagtaaagaatgtatattaagagtccaaaagataatttaattatagaatttagcgttgtaattgccagacgcatttgctgacccaaataaagtgatgaagtcacttataccagttgtaaattaaatgctccagaatataatgagtgtcctgtaaggaccaacttcaaactgctattgagtcttaagatcgcatgaagcgtaatagaccttggttccaaatataaatatcctcgtaaaagtgaaggagcacaaaattaaaaatgaccaaattgaggaaataaatattttgatgatctcttgaagagagtgaatgatctctaaaagagacataaacatgacaaatgaaacattcaagtacttgacaatgaagagatctagctagctatgtcatgtcaaaatataatggaatcaaaagcaaatcgacgtcgtaatatatttgcatgctatgagcagttgatattatagacaaaaaggaggatcatgaaagaaagtctattgaaaagtgtacacaaagtaatgattagccaaaaaatggaaaagaagaaatagacatataattataatttctagtagagatatttggactagtagtctatgcacatgatgtgtaaaaccagtggaaaataaatgagtttttatgtgaaagaatagtgaaattaatgagattttcacaaagataagaaatgtatgatgaagagatatattctcttgtggtggatgtaatattttttaagtatctaaagtctggcaataagagacggaacactggatatgacatttatatgaaattcttgaaagatataatctctgaagattaattatatgagaattatgttctctagaactctactcgatcgaataaaaaaaaaaaaaaaaagaaatatataacatgacatataatcatataaatgtatatttatgttgagtttgtcaaaatctattgatcaaactaatatttgttttgaaaatcattaaaactcctacagagttatcataagtaatacgatgacaataatctatgataaaatatcactagataatgatatttataagtctatatgaaaaccatataattttgatcattaagattatggttattaattccaacgagatattgtatttgattgaaaatcatctcctgaagaagatgtttccgagggggagattgaatgatatgcgtggatgtaccatttttccttatcatagtttttatcccacatgatttttctatgacaaagtttttaacgagacattaaagaacacgcaaataatacacttgatgaatattaagaaattctaccaatcatccaaatgaatattatacactaatgatatttagagaaataaataagatggtcaagatgaatcatctaaaagattcatgagcagaagaatggcgttgtactttatccagaaatttgttcaagagaagatttggcagacttattctcaaatactgtttattctctgccacatcttctaatcatgtagagattttaccaattcatg

SEQ ID NO: 35688 - DNA, 3003 bp, Unknown; identical to SEQ ID NO: 35687
  misc_feature (1)..( 3003): 2750-1469P.txt file - cDNA_ID_3089869; gDNA_ID_1620736; Annot_ID_166280

SEQ ID NO: 35689 - DNA, 3003 bp, Unknown; identical to SEQ ID NO: 35687
  misc_feature (1)..( 3003): 2750-1469P.txt file - cDNA_ID_3089869; gDNA_ID_2926157; Annot_ID_198509

SEQ ID NO: 35690 - DNA, 3000 bp, Unknown; identical to SEQ ID NO: 4852
  misc_feature (1)..( 3000): 2750-1469P.txt file - cDNA_ID_3089877; gDNA_ID_2926157; Annot_ID_198504

SEQ ID NO: 35691 - DNA, 3000 bp, Unknown; identical to SEQ ID NO: 4844
  misc_feature (1)..( 3000): 2750-1469P.txt file - cDNA_ID_3089886; gDNA_ID_2926157; Annot_ID_198487

SEQ ID NO: 35692 - DNA, 2044 bp, Unknown
  misc_feature (1)..( 2044): 2750-1469P.txt file - cDNA_ID_3089890; gDNA_ID_1620736; Annot_ID_166252
cttcttatcatcgaaccaatagaagtaagaccatgattacggcgtcgatggaaagataatcaagccaagagtccatagcagctgacggatctggatttgagattatattcgttaagttatgtgcgttgttttccgcgcaagaaactagtgaatctgtcaaaaactggaagaacggaaccctataaaacagatctgacgcatcatattcaggagaacgtgggagtttcatttgacgaccgatctggcaggaaaatggtggggttcttcatgatactacatactccatactccattttcaactgtgcgattccgattctagtattgtaatcattcatctgtttgtgaagcacatttatttagagtaaatggtacgagtttgtgttctagtttgggtaaacgagtttggtttgagcccaaattctgacaagcattacaaggtcattaaccgcagacgaacagtacaaggtccaaacattgaaaaagatgattggtacgtgggtttattattgcagaagcaagcatcaacgcaccaagtatagtaatttattctaaaatattttccaaattgatgtgttgaaaatgctcaagaactatagaccataaagatgaaaagttaacacataataaatagaccattaaaaatcgttttaccaaaaaaaaaaaaaaatcaaacaaaaatcacaatctgctccaaaaaactatacaaaagttcaaaacctcaactaaaaattcctagattggaaaatcaaaaatccaatggtgcatgtataaggaagagaacatataaattacatgaaggtatatatgcaattctgaccataaaagtcatttacaaagagtgcttatcaaataatacaaaagagtttattaataaatcaaagaattttatatatgtcagacatatgttctttttactagttaccacgtttagaagatttatgtttatcttcttcgtcttctagatccattcattgtatatatgttcaaactttaaagatttccattacacaaattctcatataagtattttaataaaacaaagagaattaacctttattacattttgataagttatcaaccaaatctgcattggatgtaaaaattgtgattttagtaatttagattgctcaaatctggattaaaaaaagaagaagatgaaagtaatagatcttctgattgtatttttgcaagatcataagtgaaagtagaaatttgtgaatctctaagaacttacaaattgagattacttcttccatctaccatttttgttgtttcaaaataaaaatattaaagaatgaacaaatgctcgtgttcaaaataaaaatgaaaaaaaataaaaaagaaaactccacttgattctaaaccctaaactctaaaccctccgaaaatagaaaattattgatttctaatcttttttagactgaaaatagtttttataaatttaaattgcgagaaagttgagaaaaaacaacttaatcatgagaatatcgtatatttcaaatatgataattttttacattttagatatatactagaaaaatattttaaaagggaatcttaactttaataacttataaattaatgtctaagtttacgaaatcgaactctaagttttggctcgtatcattcttcccaaaaatgtctcatgaatttttatcacaaaaaaaaaagtttaggtcaaaatatattatagataaaacaacgttgcaaggagtacaaaatgttgatatggccgagttggtctaaggcgccagattaaggttctggtccgaaagggcgtgggttcaaatcccactgtcaacattactcttttttagtttttgactacaacgaagtaaatcttacgccgtcgatctcatcactcttttgcaaatcatccaacggtctttaccaatccacgtataaaccacttggtcctttataaaaatcatcaatatacaatttaagaatctaattctcacgaaaaagccccataacttccaaaatcaacttttcacccccaaaaaactcatcttcttcgttgaaacgatcgaaatcgataatg

SEQ ID NO: 35693 - DNA, 3003 bp, Unknown
  misc_feature (1)..( 3003): 2750-1469P.txt file - cDNA_ID_3089890; gDNA_ID_2926157; Annot_ID_198486
tctgacaagaaagcatcaagtttttactccacaggttctgttgttcaagtgtagttttcaaacccattagtatagctatgaaagtatttgttaggaattagacggacaatgctaatatggtttgtagttggaatctgtgcaaattcatgttttccagttcctattatcctaacagcaagcagctatgtcttcaaatatattaacaagaacatgtgaaagaattttgtattagttgatctgaattggtgtcggatgatctggtttccactccaataaacgcattctccacatttcattgttgaaagaagtttgtcacaccccaaacccaacttctagggccaccctatttgatttcctaaaaagaaaagcccatgtgtttttatcttcgcctttctcacagccaccatttacgtctccatcttaagcccgaaactaaagtcaccggccatcatcgtttttaagtccgtgaggcattgttgtcactgattctgtagtggtgatcgtatgttggtgagagataggaagagatcaccaagagtgaaagagagtttcggaggtcacgtccaccaaagctaccgctcaccatcgttcatcactggtttgattaggtaaggaaaagctagcatgattatgtcttctcctcctgcaaatctctgtactggtcttttgaatatgcggcttaaatctgaatctttggtgaaaaataataagaagaggacgattgcgagtagcggttttggtgagcagttcccgtcagatctgaaggagtcaaatcgagaatttggtatcgttggatagatcttgctgcaagaaatgagcagaaacttacggttccttgatactaggtaaactccatccgcaaatcaagttacaacttgaccaaaagtcattgttttttgaatatagaaaataagtaagttaaaataaaagtttcagattcgagttggggttttgtgaagcttcttatcatcgaaccaatagaagtaagaccatgattacggcgtcgatggaaagataatcaagccaagagtccatagcagctgacggatctggatttgagattatattcgttaagttatgtgcgttgttttccgcgcaagaaactagtgaatctgtcaaaaactggaagaacggaaccctataaaacagatctgacgcatcatattcaggagaacgtgggagtttcatttgacgaccgatctggcaggaaaatggtggggttcttcatgatactacatactccatactccattttcaactgtgcgattccgattctagtattgtaatcattcatctgtttgtgaagcacatttatttagagtaaatggtacgagtttgtgttctagtttgggtaaacgagtttggtttgagcccaaattctgacaagcattacaaggtcattaaccgcagacgaacagtacaaggtccaaacattgaaaaagatgattggtacgtgggtttattattgcagaagcaagcatcaacgcaccaagtatagtaatttattctaaaatattttccaaattgatgtgttgaaaatgctcaagaactatagaccataaagatgaaaagttaacacataataaatagaccattaaaaatcgttttaccaaaaaaaaaaaaaaatcaaacaaaaatcacaatctgctccaaaaaactatacaaaagttcaaaacctcaactaaaaattcctagattggaaaatcaaaaatccaatggtgcatgtataaggaagagaacatataaattacatgaaggtatatatgcaattctgaccataaaagtcatttacaaagagtgcttatcaaataatacaaaagagtttattaataaatcaaagaattttatatatgtcagacatatgttctttttactagttaccacgtttagaagatttatgtttatcttcttcgtcttctagatccattcattgtatatatgttcaaactttaaagatttccattacacaaattctcatataagtattttaataaaacaaagagaattaacctttattacattttgataagttatcaaccaaatctgcattggatgtaaaaattgtgattttagtaatttagattgctcaaatctggattaaaaaaagaagaagatgaaagtaatagatcttctgattgtatttttgcaagatcataagtgaaagtagaaatttgtgaatctctaagaacttacaaattgagattacttcttccatctaccatttttgttgtttcaaaataaaaatattaaagaatgaacaaatgctcgtgttcaaaataaaaatgaaaaaaaataaaaaagaaaactccacttgattctaaaccctaaactctaaaccctccgaaaatagaaaattattgatttctaatcttttttagactgaaaatagtttttataaatttaaattgcgagaaagttgagaaaaaacaacttaatcatgagaatatcgtatatttcaaatatgataattttttacattttagatatatactagaaaaatattttaaaagggaatcttaactttaataacttataaattaatgtctaagtttacgaaatcgaactctaagttttggctcgtatcattcttcccaaaaatgtctcatgaatttttatcacaaaaaaaaaagtttaggtcaaaatatattatagataaaacaacgttgcaaggagtacaaaatgttgatatggccgagttggtctaaggcgccagattaaggttctggtccgaaagggcgtgggttcaaatcccactgtcaacattactcttttttagtttttgactacaacgaagtaaatcttacgccgtcgatctcatcactcttttgcaaatcatccaacggtctttaccaatccacgtataaaccacttggtcctttataaaaatcatcaatatacaatttaagaatctaattctcacgaaaaagccccataacttccaaaatcaacttttcacccccaaaaaactcatcttcttcgttgaaacgatcgaaatcgataatg

SEQ ID NO: 35694 - DNA, 3000 bp, Unknown; identical to SEQ ID NO: 4211
  misc_feature (1)..( 3000): 2750-1469P.txt file - cDNA_ID_3089922; gDNA_ID_1620691; Annot_ID_164766

SEQ ID NO: 35695 - DNA, 3000 bp, Unknown; identical to SEQ ID NO: 4211
  misc_feature (1)..( 3000): 2750-1469P.txt file - cDNA_ID_3089922; gDNA_ID_2926158; Annot_ID_198590

SEQ ID NO: 35696 - DNA, 3003 bp, Unknown; identical to SEQ ID NO: 19868
  misc_feature (1)..( 3003): 2750-1469P.txt file - cDNA_ID_3089926; gDNA_ID_1620691; Annot_ID_164761

SEQ ID NO: 35697 - DNA, 3003 bp, Unknown; identical to SEQ ID NO: 19868
  misc_feature (1)..( 3003): 2750-1469P.txt file - cDNA_ID_3089926; gDNA_ID_2926158; Annot_ID_198586

SEQ ID NO: 35698 - DNA, 3000 bp, Unknown; identical to SEQ ID NO: 33861
  misc_feature (1)..( 3000): 2750-1469P.txt file - cDNA_ID_3089932; gDNA_ID_2926158; Annot_ID_198582

SEQ ID NO: 35699 - DNA, 3003 bp, Unknown; identical to SEQ ID NO: 18993
  misc_feature (1)..( 3003): 2750-1469P.txt file - cDNA_ID_3089944; gDNA_ID_1971820; Annot_ID_176146

SEQ ID NO: 35700 - DNA, 3003 bp, Unknown; identical to SEQ ID NO: 18993
  misc_feature (1)..( 3003): 2750-1469P.txt file - cDNA_ID_3089944; gDNA_ID_2926158; Annot_ID_198572

SEQ ID NO: 35701 - DNA, 3003 bp, Unknown
  misc_feature (1)..( 3003): 2750-1469P.txt file - cDNA_ID_3089948; gDNA_ID_1971820; Annot_ID_176145
aagagtatatcccttatttattaggtagcttgcaaggcaagcagcattagctttcacctgttttgcataaactttgaagctaggagccataacctgcttcaacgcaacagctagagcaccaatcttgttattgtgaggaccactttgaagcgcagggaataccgcagagttgatttttgcgtcgaaatcgtagacttcaccctcgggttggcccttcttggctggttttggtccctttctataaaagatcataccagcccttggacctctcaagctcttgtgagttgacgttgtcacaacgtcacagtactcgaacgggtctgcggcttcctgagcagcaacgagggcactgttatgagccatatcacagagcaaaaaagctccaaccttgtcggcgacagccctgaatctcgcgtaatcccattccctagggtaagaagtgcctccacagataattaacttaggcctaaaatccatagctttctcctcaagtttgtcgtaatcaatgtaaccagtcttggaatccaccttgtagggaaggttttcaaagtagatcgaggtcgcggagatgttcttcccaccagagctatagtaaccatgcgttatatgaccacctgatggcaaatcaagccccatgatacgatcatgaggctggagcaaggcggtgtaggctgcgaaattcgcaggggaaccagagtaaggctgaacgttaacgccccatttctctggattgcaatggaaggcttcgagagagcgtgagcggcagagactctctatctcatcgatgaactcggtacctccgtagtaacgattaccaggcataccttccgagtatttgttggttaagcaacttccgagagcttccatgacggccacggaagtgaaattctcggctgctatgagttcgattcctcgacattgacgatgtttctccttctcgattaggtcgtagatctccggatcgacgaagtcaagatgcgtgtttccccaagaatagactggttccatctctaagattgttggaaggatagagagacttttggcgggtctttatataatgtgtgtacccacaaaactaaccatttgacttttctgaatttttagaattaagtatgactttttgatgcctttagcaagttattccaagtcaagtctgtcttttaaacagagcaaaagacataaacatttttgtactccaatgtgttcacctaggaaactaatttagtattgccatgacaactaatagtcatgacaattttattcttaattgcaatttgcaagatatatatagcaattgcccttaagatataccttaacgcaaacattattcatttttaagataaccatatgcactaatagataacgtgttgtattcctttttccccatacttcataactctttaatcattctctgcttgttttagttcagacgtttccctcatacagagtggcatgtcttagttacaagacacaatttatactgattttgtatgattgataattctttaactatctttgatacattactctaccattttcgtatgattattgtcttcgttaaaaggttgagtatttaatagaaacggcatatttataatttatgtatgcttagtcagaaccacgtctatgggacttgaatatgctatgttctcatgataagagatttttatattgagcaatcttcctttgatcagaaaatatattaagatccattctcactccatctttatgtgtcaaattaagcttgaaatcaatcaatctaaatctgtctgtttaggattcacgttacgtggctaacaagttttacgtaggatttatttcttttatgagatcttgattttgaaaatttgctgaagcggttacgatatgcagcaaccgatagttatgcttttatagcatctttaccactttttacgtgctcacaaggtaacgtttggtatatttgactgcttcagatctctacggacgattgcttgagtatagcctttggattagtcaccaaaagaaattatgttgttcagtgtggtttaagtttctcattaaagaaaagagttttttttttttttttttgtgcagcaatcgtgattagagacaaagacacaggaaggtccagaggttttggattagtcaccttctccagtgaatctgaagcctaatctttcataacagagatgaatgatcaggtttatatgactccatttgtggtagttgttctgtttatatgatgatggctttggttttgagttttcagatgatggatggtcgtaaaactgaaagtgaaatcttgctgtacagaaacatacaatgtagcatttgaaagtgaattgcatcatttaataccattacacagactttctcttgatgtcattatagtctactctaacctttaaccttccttataagcaagggacggtatcagcatatgtagcaatgcttctcaattagattcttactcaccaaagactagcttagggcagccagttccacgtaaaaaatggggtttgtttgtttctattcaagcttttaaaagaggaatagaaccaagattctaaaacaataaaacatgttccgatatttctaggaagagcggaaaatgatcaatccaaagggattgagtgattaacccccaccgtacggtcgagatattgcgtttgtggttttgaataatcaaaggaatcttcagcaattattaacccacaccacacggctggaagaattggcgtttgtggaaattatatagtttttgtggagaaatacctcatattgctgtcttcaaaggagacgtgtaagacaagctttaatctcctccacaaatgtaattaagagtcactccaatcatatagagtcaggtactcgattttctgtggaagcaactagtcttcacaggagactttttaagtcaagctttaatggtttcccacaaattttatatgagacaatccaatcatcaaatcgtttcacgtacagaaaaacagaaacaaaacaaatcaaacaaaaaatatg

SEQ ID NO: 35702 - DNA, 3003 bp, Unknown; identical to SEQ ID NO: 35701
  misc_feature (1)..( 3003): 2750-1469P.txt file - cDNA_ID_3089948; gDNA_ID_2926158; Annot_ID_198571

SEQ ID NO: 35703 - DNA, 3000 bp, Unknown; identical to SEQ ID NO: 8596
  misc_feature (1)..( 3000): 2750-1469P.txt file - cDNA_ID_3089952; gDNA_ID_1971820; Annot_ID_176134

SEQ ID NO: 35704 - DNA, 3000 bp, Unknown; identical to SEQ ID NO: 8596
  misc_feature (1)..( 3000): 2750-1469P.txt file - cDNA_ID_3089952; gDNA_ID_2926158; Annot_ID_198561

SEQ ID NO: 35705 - DNA, 3003 bp, Unknown; identical to SEQ ID NO: 19007
  misc_feature (1)..( 3003): 2750-1469P.txt file - cDNA_ID_3089968; gDNA_ID_1971820; Annot_ID_176117

SEQ ID NO: 35706 - DNA, 3003 bp, Unknown; identical to SEQ ID NO: 19007
  misc_feature (1)..( 3003): 2750-1469P.txt file - cDNA_ID_3089968; gDNA_ID_2926158; Annot_ID_198547

SEQ ID NO: 35707 - DNA, 3003 bp, Unknown
  misc_feature (1)..( 3003): 2750-1469P.txt file - cDNA_ID_3089991; gDNA_ID_1621093; Annot_ID_170768
aattgtttgagtaggtgtccttgatgttattcttgatgaatatccaagtcttatggacgagcaagatgaagatggtaggacttgtctttcatacggagcatccattgggtattataaaggactatgcaacatcttaaaccgatcaacaaagggtgtttatgtctgcgaccaagatggttcttttccaattcattcggctgcaaaaaacgaacattacgaaattattaaagagtttataaaacgttgtccagcttcaaaataccttcttaacagacttggtcagaacattctccacgtggcggcaaaaaatgaggcctctcttactgcatatatgttgatgcatgataaagatacgaaacatctgggtgttgggcaagatgtggacgggaatacacctttgcaccttgccgtcatgaactgggactttgactccattacttgtcttgctagccgtaaccacgagatactgaaattacgaaacaaaagcggcttaagagctagggatattgccgagtcagaggtgaaacccaactacatctttcatgaggtatttctgattccgtttcatacaacacatttgatccctcataaatgatttatagcttgacctccatatttttggaattacagaggtggacactggcgctcttattatacgctattcactcaagtggtttcgaatctgttaagtcattaacaatacagtcagtgccactagaccctaagaaaaacagacattacgtcaacgctcttctcgtggtagcggctcttgtagccacagtgacgtttgctgcaggctttacaataccaggtggttatatcagcgatagcaaaaaaccaaacttgggcagggcaactttggccactaacccaactctcttcatttttctgctttttgacatcttggcaatgcaaagttctgttgcaacaatatgtactcttatttgggcgcagttgggtgatctagcactcatcctcaaatccttacatgtggccttgcccttactacttttttcattactatgcatgcccgtagcattcctttttggcgtgatcactgcaattgcccatgtgaaatggcttttagtcaccattagcattatatctggtggattcttccttttcgcaatctttatccttggccctcacgtcatgctacagcgctcacaccttccgcccagttctggtatatttctcaagacttttatgctgactatagacatatctgagttgtttgtgattttgatcaaagcttgttttggttgtgtggcgtgttccgaataaatcatcaaaagtttatagatcaaaggatatttttcttctcttttttttttctttcaaaaagctacgagatatgctggtctctagctctgagaagcggcatcttgatcatacaactcattcgaagtcctatcagaattatctgtagttgtaataaagcgtgaaaagtatatcattcgaagagattttcctctaaaataatcgagtgatattttattattcggtttagtggataccagtttactaatctctcgaatttatgaaccacattcaaaggagatgagtttaacaaaaaaaaaaggtaaattgttttttattctcgtcgtgcgttccacatgagtcgttttcaagagcaatatagacgatacttcacaagaattattatttttgttggggtataaaaatttgaagatacgtttggcaacgacaatacgacgttagattgttccaagaggtgcaaaaacttagggaccctctttattcgttcactgtaaccactgaccacaacatgactaggtagactcttctttttgtcaatgttgatgtttatacgattttgatgagactggctctatcaagatatgaatctctgatcatatctccactaatctttcatcttgttattccctcatttacttttgatttccttctctctctctcttttttatgtatacaaatttttctttatttcgcttcactaaaccccaccatgtaattgtgtgagttttggcgaagtggcgcaacaccgtagagcacaccaacactaacccaatccattttatgaccgtaaattttgttgttgattagtgtatttttttcttgtttagttattctgagaagtaaattttttttttacaattagtttttaaacatagtaaaataaatttatgacagattataatattattttaaaaatcaataatatctaacaaattaaataaacaaatcacaaattactatattttaaataaatattgataattttaattatattattttgtttattggttaactcgcaggatatgcgagttaattcatttgagattgtaatccgccatatactaactcgataaccctgactttttagaaatctaaaagtataaccctataataaaatagattatgtccaactcgcggattctaaacctgaattgacatggcggaaccattcataaaaccataccaattcttgcgttttggaaagttggtttccttttcatttctttgaatttgatcctagattgtgtagttctcaagctcatgctcttgctcgtcaaaaacgtatcaacgatttgcttttcctttagacgttcttgcatcggattggtttactcaactccactcgatgaaaaagttactatcttaaaaagaacaaatgcaaattcaataaaattccccaatatctacgcatgaaaatatgattctgtcttttttttgtttgtctatctttcaatactttaaaaagtgtatttctagaggcgatttgtcatttcccgaataggaatttgagtaaaaaaaaacactctgttttttatttccactaatatcaaatcggcgaatatagttcccaccattcttatctccttgtcgtcactcggaattttttaaataataggatcgctttaataatataatctctataatttatagttccttttccaatattggcgtctccgttgaagctttccacaaatctcaaatttgtttggagactctcaaatg

SEQ ID NO: 35708 - DNA, 3003 bp, Unknown; identical to SEQ ID NO: 35707
  misc_feature (1)..( 3003): 2750-1469P.txt file - cDNA_ID_3089991; gDNA_ID_2926159; Annot_ID_198667

SEQ ID NO: 35709 - DNA, 3003 bp, Unknown; identical to SEQ ID NO: 35707
  misc_feature (1)..( 3003): 2750-1469P.txt file - cDNA_ID_3089991; gDNA_ID_2926160; Annot_ID_198679

SEQ ID NO: 35710 - DNA, 3003 bp, Unknown; identical to SEQ ID NO: 17877
  misc_feature (1)..( 3003): 2750-1469P.txt file - cDNA_ID_3089993; gDNA_ID_2926159; Annot_ID_198666

SEQ ID NO: 35711 - DNA, 3000 bp, Unknown
  misc_feature (1)..( 3000): 2750-1469P.txt file - cDNA_ID_3089997; gDNA_ID_1621093; Annot_ID_170763
aagacacaaaaagcccaattatgtctttatactgcataaaagtcacgagaaagtcaccagcgtacttgggagaaacgtatgaccgttgtagcatgacgtgagggccaaggacaaagatcgcccaagaaaagaataaaacagatataatgcaaatgatgactacaagccatttcacatgcccaactgcagtgaccacgccaaaaaggaatgccaagggcatgcagagtaaagcaaaaagcagtaagggcaaagccacatgtaaggatgagcgaatgagcactggatcacctaactgcgcccaaataagaatacctattgttgcaacggaactttgcatggccaagatgtcaagtaccagaaaaatgaagagagttggattagtggccaaagttgccctgcccaagtgtggagcagagctgttaaacccacctggtattgtaaaacctgcagcaaacgtcattgtggctacaagagcagctaccaggagaagagtgttgacgtaatctctgttatttttagggtctagtggcactgacggttttgttaatgagtgtacagattcgaaaccccttgagtgaatagcgtataataagagcgccagtgtccacctctgtaactcaaaaaatgggggtcgagctataaatcatttatgtgatatcaaattttgttgtatgaaacgaaattatacatacctcctgaaagatgtagtggggtttcacctctctctcggcaatatccctagctcttaagccgtttttgttccgcactttcagtatcttgctactcctagcaagccaagtaatggatttaaagtgccagttcatgacggcaagatgcaaaggtgtattcccgtccacatcttgcccaacacccagatgttccgtatctttattaattatcaacatgttcgaaatccaaaatttcccattttttgctgcaatgtggagaacgttctgaccaagtttgttaagtaagtgttttgaacctggacatcgttttataaactcttcaacaatattttcatgacctttctctgcagctgtatgaattggaaaagaaccatcttggtcgcagacataaacaccctttgttgatcgttctaagaggttgcatactccttcataataccctatatgtgctgcgagtgaaagacaagtccaaccatttatatctcgctcgtccataagacttggatattcatcaagaataacatcaaggacacctgctcaaacaattgggaacaacaattagtatacatacaaatatttttaccgccttgaggaggaaattcccgtctcaaactggttttacatatttgaatagaataaatgcagctgctactggttaaagcgaaaaacaaacctatactctgggtcaccaaagcaacatgtgcaagagatttctgcccttgtaactttgactccaagttagacttcttccctttaaggtccttgttgcctatgattttcaaaattgctttcacaagagatacatctccagtatttattgccacaaacaaggaagatactccatacttatttccaagaaaaggagcatcctggtttgcgttcaccagacatacagccatctcgaaatagcgcccttcaatcgcgtagtacagagcagtatttccatctttgtccttgagaacatatgggttcattctctcactctcttcattacacagtctagctgaagaaaatgttaccaatgcgacaaaagcctcaacaatagtggtatgaccgctatgagccgccacatgtagcggtgtctgaccgcttgagttttgctccaagagaagacgcgggcattcacagacaatctccttcactagttctagatgaccccatgtaacagcaagatgaagaattgaatctcctgtattgctcttgatacgtgccactgaaattccacggcttctcaacttctccagacattctttgttcccatcacttattttactaaaaacctctggaatcatccggacatcttcaccacggatagcgtaaagatccgacaatctaaggttagtaaggaactctggcacagattcggtgtctcctgtaagtggcgtgacgccatctcctccgctttgagagaagtcttgtgaaccgtgtatgttcatgggtaagtatgttctgttctgttgatcatgagacgcatctgttgacctttgtgcctcaattctatctagctctgcttcagaactgtccatcgcaaacctaaactaatcacacaaatagtttggaaacacagatttaagttactaacttccacgaccacaaacaaaaaagtcaaccattgcatgaagagggggcagagaaagacttaccaagtggaagaagaagatcagtaatgcaagaggttttgctaaaggttgacgagattgagacaaaaagttcgtccatttatattaaaagttttgtctcgagccacgtcgagtcatgatgatcggaaggagtggtggtcaggtcacctatatataaattaagggaaagtgtttctttagtcggaaataattaggagaaaaattcaagacaaagattaaaaaatgacccgagttattaagtcattaagttataattaaagactttgaagtcgtcgtctcttaataaagtctaaatgtctattttgttgggagaaagttgcggcggggtttcagcggagatgctcctattcctaacataaaacaccgagaatatgtgacatagtggaaactttataaagaagctagtgattttaggctaccagaaatctaagttcatcactcgtttattatagtttgctgagtaattggttggaccttatgcacgttctactgtaaaataattcaacagcttcaaattgaagtatcgaaccaatcaagcgttatactggaaacttatttttttttccatggacatcaaacttttttatatcaatgacttttaacaaagcatttcttattttacctattttgttgcacatcactacattttatattaaacattagattcaatg

SEQ ID NO: 35712 - DNA, 3000 bp, Unknown
  misc_feature (1)..( 3000): 2750-1469P.txt file - cDNA_ID_3089997; gDNA_ID_2926159; Annot_ID_198663
gtattgtaaaacctgcagcaaacgtcattgtggctacaagagcagctaccaggagaagagtgttgacgtaatctctgttatttttagggtctagtggcactgacggttttgttaatgagtgtacagattcgaaaccccttgagtgaatagcgtataataagagcgccagtgtccacctctgtaactcaaaaaatgggggtcgagctataaatcatttatgtgatatcaaattttgttgtatgaaacgaaattatacatacctcctgaaagatgtagtggggtttcacctctctctcggcaatatccctagctcttaagccgtttttgttccgcactttcagtatcttgctactcctagcaagccaagtaatggatttaaagtgccagttcatgacggcaagatgcaaaggtgtattcccgtccacatcttgcccaacacccagatgttccgtatctttattaattatcaacatgttcgaaatccaaaatttcccattttttgctgcaatgtggagaacgttctgaccaagtttgttaagtaagtgttttgaacctggacatcgttttataaactcttcaacaatattttcatgacctttctctgcagctgtatgaattggaaaagaaccatcttggtcgcagacataaacaccctttgttgatcgttctaagaggttgcatactccttcataataccctatatgtgctgcgagtgaaagacaagtccaaccatttatatctcgctcgtccataagacttggatattcatcaagaataacatcaaggacacctgctcaaacaattgggaacaacaattagtatacatacaaatatttttaccgccttgaggaggaaattcccgtctcaaactggttttacatatttgaatagaataaatgcagctgctactggttaaagcgaaaaacaaacctatactctgggtcaccaaagcaacatgtgcaagagatttctgcccttgtaactttgactccaagttagacttcttccctttaaggtccttgttgcctatgattttcaaaattgctttcacaagagatacatctccagtatttattgccacaaacaaggaagatactccatacttatttccaagaaaaggagcatcctggtttgcgttcaccagacatacagccatctcgaaatagcgcccttcaatcgcgtagtacagagcagtatttccatctttgtccttgagaacatatgggttcattctctcactctcttcattacacagtctagctgaagaaaatgttaccaatgcgacaaaagcctcaacaatagtggtatgaccgctatgagccgccacatgtagcggtgtctgaccgcttgagttttgctccaagagaagacgcgggcattcacagacaatctccttcactagttctagatgaccccatgtaacagcaagatgaagaattgaatctcctgtattgctcttgatacgtgccactgaaattccacggcttctcaacttctccagacattctttgttcccatcacttattttactaaaaacctctggaatcatccggacatcttcaccacggatagcgtaaagatccgacaatctaaggttagtaaggaactctggcacagattcggtgtctcctgtaagtggcgtgacgccatctcctccgctttgagagaagtcttgtgaaccgtgtatgttcatgggtaagtatgttctgttctgttgatcatgagacgcatctgttgacctttgtgcctcaattctatctagctctgcttcagaactgtccatcgcaaacctaaactaatcacacaaatagtttggaaacacagatttaagttactaacttccacgaccacaaacaaaaaagtcaaccattgcatgaagagggggcagagaaagacttaccaagtggaagaagaagatcagtaatgcaagaggttttgctaaaggttgacgagattgagacaaaaagttcgtccatttatattaaaagttttgtctcgagccacgtcgagtcatgatgatcggaaggagtggtggtcaggtcacctatatataaattaagggaaagtgtttctttagtcggaaataattaggagaaaaattcaagacaaagattaaaaaatgacccgagttattaagtcattaagttataattaaagactttgaagtcgtcgtctcttaataaagtctaaatgtctattttgttgggagaaagttgcggcggggtttcagcggagatgctcctattcctaacataaaacaccgagaatatgtgacatagtggaaactttataaagaagctagtgattttaggctaccagaaatctaagttcatcactcgtttattatagtttgctgagtaattggttggaccttatgcacgttctactgtaaaataattcaacagcttcaaattgaagtatcgaaccaatcaagcgttatactggaaacttatttttttttccatggacatcaaacttttttatatcaatgacttttaacaaagcatttcttattttacctattttgttgcacatcactacattttatattaaacattagattcaatgggatcgcaaataccaccatatttttcaatattcttacaagaggtagaatatttttcaatattctttttccatgcttctcactttacttgtgtttattccatgcaatgccaactctttggctgattctttctttagcaaagcaggtagccacatttggccgtagactatttggtcaatttgctagttgagttaataaaatctctgacccataaaaaaaagttataaaaagaaaagagaaccggaccatttttatttttgttgacatcaaaccggaccattggtgaaaacccccaaatcgaattccagaatcatcgtctccatcgtaatcgactcaaatcaggcaacggttacctccgcgtcgaatttcagcgaccacccatttctgggaagggaaaaagctgcgcaatttgtggatttctttctcagaaaatg

SEQ ID NO: 35713 - DNA, 3000 bp, Unknown; identical to SEQ ID NO: 6421
  misc_feature (1)..( 3000): 2750-1469P.txt file - cDNA_ID_3090001; gDNA_ID_1621093; Annot_ID_170760

SEQ ID NO: 35714 - DNA, 3000 bp, Unknown; identical to SEQ ID NO: 6421
  misc_feature (1)..( 3000): 2750-1469P.txt file - cDNA_ID_3090001; gDNA_ID_2926159; Annot_ID_198660

SEQ ID NO: 35715 - DNA, 3000 bp, Unknown; identical to SEQ ID NO: 6422
  misc_feature (1)..( 3000): 2750-1469P.txt file - cDNA_ID_3090005; gDNA_ID_2926159; Annot_ID_198659

SEQ ID NO: 35716 - DNA, 2231 bp, Unknown; identical to SEQ ID NO: 6424
  misc_feature (1)..( 2231): 2750-1469P.txt file - cDNA_ID_3090009; gDNA_ID_1621093; Annot_ID_170756

SEQ ID NO: 35717 - DNA, 3003 bp, Unknown; identical to SEQ ID NO: 17888
  misc_feature (1)..( 3003): 2750-1469P.txt file - cDNA_ID_3090009; gDNA_ID_2926159; Annot_ID_198657

SEQ ID NO: 35718 - DNA, 3000 bp, Unknown; identical to SEQ ID NO: 4221
  misc_feature (1)..( 3000): 2750-1469P.txt file - cDNA_ID_3090028; gDNA_ID_2926159; Annot_ID_198637

SEQ ID NO: 35719 - DNA, 3000 bp, Unknown; identical to SEQ ID NO: 4223
  misc_feature (1)..( 3000): 2750-1469P.txt file - cDNA_ID_3090032; gDNA_ID_2926159; Annot_ID_198632

SEQ ID NO: 35720 - DNA, 3000 bp, Unknown; identical to SEQ ID NO: 4212
  misc_feature (1)..( 3000): 2750-1469P.txt file - cDNA_ID_3090041; gDNA_ID_2926159; Annot_ID_198620

SEQ ID NO: 35721 - DNA, 3000 bp, Unknown; identical to SEQ ID NO: 4211
  misc_feature (1)..( 3000): 2750-1469P.txt file - cDNA_ID_3090049; gDNA_ID_2926159; Annot_ID_198615

SEQ ID NO: 35722 - DNA, 3000 bp, Unknown; identical to SEQ ID NO: 6447
  misc_feature (1)..( 3000): 2750-1469P.txt file - cDNA_ID_3090071; gDNA_ID_1621094; Annot_ID_170841

SEQ ID NO: 35723 - DNA, 3000 bp, Unknown; identical to SEQ ID NO: 6447
  misc_feature (1)..( 3000): 2750-1469P.txt file - cDNA_ID_3090071; gDNA_ID_2926160; Annot_ID_198722

SEQ ID NO: 35724 - DNA, 3000 bp, Unknown; identical to SEQ ID NO: 6412
  misc_feature (1)..( 3000): 2750-1469P.txt file - cDNA_ID_3090079; gDNA_ID_1621093; Annot_ID_170805

SEQ ID NO: 35725 - DNA, 3000 bp, Unknown; identical to SEQ ID NO: 6412
  misc_feature (1)..( 3000): 2750-1469P.txt file - cDNA_ID_3090079; gDNA_ID_2926160; Annot_ID_198713

SEQ ID NO: 35726 - DNA, 3003 bp, Unknown; identical to SEQ ID NO: 20783
  misc_feature (1)..( 3003): 2750-1469P.txt file - cDNA_ID_3090120; gDNA_ID_1620806; Annot_ID_168836

SEQ ID NO: 35727 - DNA, 3003 bp, Unknown; identical to SEQ ID NO: 20783
  misc_feature (1)..( 3003): 2750-1469P.txt file - cDNA_ID_3090120; gDNA_ID_2926161; Annot_ID_198796

SEQ ID NO: 35728 - DNA, 3000 bp, Unknown; identical to SEQ ID NO: 7786
  misc_feature (1)..( 3000): 2750-1469P.txt file - cDNA_ID_3090128; gDNA_ID_1621163; Annot_ID_173759

SEQ ID NO: 35729 - DNA, 3003 bp, Unknown
  misc_feature (1)..( 3003): 2750-1469P.txt file - cDNA_ID_3090128; gDNA_ID_2926161; Annot_ID_139732
tcaatgatgataaccaaattttttgaaatttccttctgtttcattctaaatttcgtttaagaatttttcacagtcaattggtaagagcaaatatattttgaaacgtggtcctggccaaatcaaggatgattacggcttgaaaatttgtattaatacacttttatcttataactaaaaaattaacatgataaagataaatttgaaatttcttttaaatatatgaatgaaatacaaaacatatttaaaaaagaataaaaacgaattattaaaactaacatttattgtgaaacagcaaaaaaagaatttatgcatactatcagaaataattttaaatgaattcatcaaacaaatgttttttttctttataagaatgtaaaatatcattataaaatgaaaagtttaagttattacatgacacataactttaaaaaaaagttgcatgccaaaaaaaggtaaaaaaaacatagaaacataaaccattcgaacctcattctcgttgatcaacaaaattttaaacaattaggctcttagtgcgaagatctaataaagtcaatctaaatactctcctaagtaaacatgagacaaataccaagagcagaaaaagaaacaagaacaaaaggtgaaagacgaaaagcgaagaacataaaaagaaataagaaaaaaaatgtgaaaggcgaaaagcaaagaggaagtcctttcgataatagcccgaaaaacaaatgaaatttctttttatgttctttgacatataattttgtagatacgtttcttttttgctagcacctttctctgaactggatggatacgatctcatatctcaccgatagcacgtttgaccctctctacttcactaacttatgcatgtttcatgtttggaacgaaagaaataacaacattcttctacaactacgtactttacacaattaaccaaccatctcagttataattataagacctcgatttaattttaccaaaagttattgtatttttagtgagtcttgttgtattaatgctctaagaaaaaagttttctccagaataaacaatcaaggagcaaatatttcagcgccaataaatatagtagcctttaggatggtccaaatctggtaaaatatatccttagctaaaatgttgatctaactaaagagatttatatgtcaatttccaaccaaaagatttaggccctgaatggatgctgattttcgattcagtttttggattttgattttagtttctagattttagattttagttttagatttttgttaatatatttttgttttaaaaacttcaaaaaattagtttttagtttttgagaaaaataacgttgatggagtaaaaactagattccctaaattttagaaaaactaaaaaactaaaatcatgaatggaaaattacaacaaaatagtttttcaaattgtagggaaaccaaaattttaaaatcttgattgttatgaaaataagtttttgaaaaacaaaatccaaaaactcttacaaaatctacaaaacattcaagaccttattcttctcaggtttatatcttaaacaaaacaaaatccaaaatgctatttaacaaaacaaacaaacaagttctcttttgaaattaattatttatatgatattaatttccaaataaaacctgaaaagttatcataatcagatatacatttttaatgtggaaaaatcacgtaataacattataaatatatatatgtaaactaatattgtgaaatctaagactctgtatatatagtactgactactgaacaagtatataaattttatgtttataattataaaacgaatcattaaagatatcaaatctgaatctcaaataactaacccaaaatcatgatatctatataaatatattcaaatgaccttgcacgacggtctacactgagcttgttgacgatgacagattcagaaattctgattattagtttagaaaaaaaaaactatagtattattattaactattttaaatttttaagaaaaaggcaaaataaatgacgagtttaagactttggtagttagctccggtttcaatgaatggtccaagttggagagattaggttctttttcttccctatgtgggtcccattcttccttgtgtgggtcccactctctttaacgtttcttcaccgtcctttagtgccaccgttatgccgtgccgtcaactccgttgacttcaggacaacgctgctcgtcttttactgagtctcactcacgtcgtctttctccgtcaactttcttactaacggccacttaacggaaatccgtcactgttaacaattaaattaattccgctcgacatttatcgccgatttacacgtcacttttttctatcttaccctggttatttaacacgtgtacatttatgacgctatatatcgaggaatttatccatctcaaggcattttctcaattatattctggctgcaagtatccaaattttataccagttctaaacaaaattagaaagaaaacaaaataacaataaagacatacttataatattgagatcaaatctgacatttaagaaccactcaagatcttcctattttaaaaggcaaaagaaagagtcagactgatacttatcataaataattttcaacatatatatcaaatgtttgagcacataaaatataaatatcaaatataaattttaaatgcaacgctgtaaattttcgttttatgtatgtcataagaattgattagataaaattggcattttcgcataatttacgtaattagtataaactaaatcattatgcaatttcggaaattaccaaccttctaatataatattcccaacagttgcttggtcatttatttgtatgtgtaacatttgacaaaagagtgatttctcgttgaaaatggaaacctttagctaagactttacacaacttatcctcataaatttagtctttatataaagggactctcttttttttctttttcttctctctatctctatctatctctctttgtctgcaaatg

SEQ ID NO: 35730 - DNA, 3003 bp, Unknown; identical to SEQ ID NO: 35729
  misc_feature (1)..( 3003): 2750-1469P.txt file - cDNA_ID_3090128; gDNA_ID_2926161; Annot_ID_198790

SEQ ID NO: 35731 - DNA, 3003 bp, Unknown; identical to SEQ ID NO: 17473
  misc_feature (1)..( 3003): 2750-1469P.txt file - cDNA_ID_3090134; gDNA_ID_1621163; Annot_ID_173761

SEQ ID NO: 35732 - DNA, 3000 bp, Unknown; identical to SEQ ID NO: 17474
  misc_feature (1)..( 3000): 2750-1469P.txt file - cDNA_ID_3090134; gDNA_ID_2926161; Annot_ID_198786

SEQ ID NO: 35733 - DNA, 3000 bp, Unknown; identical to SEQ ID NO: 7790
  misc_feature (1)..( 3000): 2750-1469P.txt file - cDNA_ID_3090143; gDNA_ID_1621163; Annot_ID_173768

SEQ ID NO: 35734 - DNA, 3003 bp, Unknown; identical to SEQ ID NO: 21174
  misc_feature (1)..( 3003): 2750-1469P.txt file - cDNA_ID_3090143; gDNA_ID_2926161; Annot_ID_198777

SEQ ID NO: 35735 - DNA, 3003 bp, Unknown; identical to SEQ ID NO: 32041
  misc_feature (1)..( 3003): 2750-1469P.txt file - cDNA_ID_3090199; gDNA_ID_2926162; Annot_ID_198863

SEQ ID NO: 35736 - DNA, 3003 bp, Unknown
  misc_feature (1)..( 3003): 2750-1469P.txt file - cDNA_ID_3090203; gDNA_ID_1621095; Annot_ID_170935
aaatttcctccaagatctagtatagtcagcttatacttttaatcaacactcagactaatggggccattaaagggtccttgcctttcgccactggtccaaggcgctaggttgttaaaaaaaaaaagttatttgcatacacgtaataaaaaattcatgtattatagttgaactcttgaaacattagccaaaagatgttaactcaaacagtgatcgacagtgagttaccggaagcataacgtaaacgggaacataattaagaagaagcttctcgttgtaattggtagccatttttcttctaaatacaaacaaagaaagaacgtcttttttttttgtttttttgttgagagagtgttgtaggaaaatataagcaatatgagtagtagatgaagctcacatgtctctcttaaagaaagctcacgagctctttatatagaagtagatgatattatgcgagtggttgtgatttttgtgtactgatctaaaacgactggtgctctgttttcagcggtccatttgaggattgtataatgactttattgccctctgtttttggcgtcttccttgtcctctttcgtcatttcctgagattctttggaatgatacctttttctataattgaggttcaccgattttgatttccgacactgattgtgttgtcgccactcgccggccttctttttgtttctccatgtgttgtttttaagcacgtggagtaaatgcaaatgatatttgttcatgtctgtattcaccattcaaatcttgttaccttaataagtaagctcaatgtcaaaatttaccttagtgttgatgtcttacaacttgaatattatagtaggtggattatgtggatgtcaaaaatttggtgtgatggattttataaatcgtgaaaataaactggagtccaaaatctgtaagttactaagttgagctaaatgaagactgaacaaaagggaatcaagagaaaacaacaaagtgaaagagtgatcttattgataatgtgtcaaacaaattacaaagaaagaaaaaagatgtaggtagagtgactttcagaaaaaatagtgaactttacctccttgttatctttgaaattgaatgggcttccgttggattaggttcgtgagggtgtgttttttttgtcgacaattttattagattgactcaaataagccaatgttgagaaatattgtttgcaaatataataatatgtgtttggttcaatatttcgtgccaaataatctgttttaaaatttccacgagttaaagataaatcaaaatctggataataattcggtttgtgttaaatctgaatttttcagaatagttgacttatacttcaagttaatttgagtaattatatatatatatataaaacttaccggggaattgtaaataacatcacacaatacgttttttttaacattaaaatacgattaaactcgacatagatttgttgatctacatgttttctctctcttctctctcctcatctttcagagagagcaaaccagtttcagcttttctggccggcaatgactggctttatcagcagtgtttggtcggcttctactctggcatcgctggcttccttagaagcgttggttggctcagcttccggcatcgaccggctactttcagcggtggtggctggcttatctcccgagagcaagatatcctcttttttgtttcgccgggcttttctccggcgtctttggccggctttctctccggtttcttgaccggatttagatttgttttgttttttttatcttctgcctgtagtttaaagattgatgaacccaagttaaaaagatgttgattgaagaagaagaggaagaaaaagaaaaagaagaagaagaagaatagcacttcgtggagtcaaattctcatccaaggtacaactgaaatttcgccattaatcctttgggcgacgagtgagctatgccagttgaacaagttttccggtgtttcagccggaattgaagcttctgacggcgactcccttctcttccagttcctacgtgtccttcaaaatgttttccactgacacgtgttttctatgcggcgcacaacaatcacttgttctcttccttcagtttagggtttattcatttgagcttttgggaatttttttttttttttgggcttgtttatttcagtttttgtgaattattggcctgttaattttggctctataatattaataaaacacacttgtgatagaaaaaaatacgattaaactcatctgattggactgtttataatattataaaagccaaaaactattttgaaactgttgtcgcgtcatcaattctcacagtgtcggcgtcagcgaataacactgtaaacgcgcgccaacgattcgattgcatatgattcttcctctgtaaattgtaatgcaagctaatctcattaatctctgacatgcatcaagtattttgtgatatctcatcttccagagtacgtgatcttgaagaaattatccatgtgatttctcacccatgcattgtttattcattcgtctacctcactgcagcttcgattcgatcagattcacaaatctcaggaacaaattcgtctaccgaaacagataaaacgcacataaagtgttcgatggaatgcctcacagaaagccaataagttgtgtgtcagtatgaatccgttcgcacattgtgaaatcagttctgacattgtttagtgagttgactattgtctaaaagatctcttcgttgattttatttacttactttaatgaatcaccagttttttcaacgcttacctgatttttcactagtttattcgttcttttgttcagtttttctctctgtacaagaccggattctatggttatgatcacgtggagctcgcgtgatattagtgtatgcgtaagttttgttcaagttatatatataaaactctgacttcattagcttcttcattcatgtggagttttgcttgcttctccttgttgttattagtttctttggctgcttttacctgacaatg

SEQ ID NO: 35737 - DNA, 3003 bp, Unknown; identical to SEQ ID NO: 35736
  misc_feature (1)..( 3003): 2750-1469P.txt file - cDNA_ID_3090203; gDNA_ID_2926162; Annot_ID_198862

SEQ ID NO: 35738 - DNA, 3003 bp, Unknown
  misc_feature (1)..( 3003): 2750-1469P.txt file - cDNA_ID_3090207; gDNA_ID_1621095; Annot_ID_170931
tgcgtagataaacttaagcttgatgtattctttggtacaatgtaattctgtttagttctataacttggaatcactctaagtgtaatgtatattgatgcgaagtcaaatgttgctgaatttttgctctcctgcattttccccaattttttctgagccagtattgtgaaaaattggagtctgagaaaactgaaaagtttaatggattctcatttaatcagtgttcatagattcactagttgtttgaccagggcttaggcttaatcattcttgtgacacttggttttcttttaaatctgttttgatgttcagttttctttggaagctatatacccataaacttaaaatgaataaagatggaagctttagctgatataatttgggtgtttctttctttcttccttggtgtgaagctgtttcaaaatgtctcggaggtatgatagtcgcaccacgatcttctcaccggaaggtcgtctctaccaggttgaatatgctatggaagctattggcaatgctggttctgccattggaattcttggcaaaagacggagtggtgttggttggtgagaagaaagtcacttctaaacttcttcaaacctcttcatccatggagaaaatgtacaagatcgatgaccatgtggcttgtgcagttgctggtataatgtctgatgccaacattctgattaacactgctcgagttcaagctcagcgttacacctttatgtaccaagagccaatgcccgtttagcagctggttcagtctctttgtgacaccaagcaaggatacacccagtttggtggtctccgcccgtttggagtttcctttctttttgcaggctgggacaggaaccacgggtttcagctgtatatgagtgacccaagtggaaactatggtggatggcaagctgcagctgttggagcaaataatcaagcggctcagtctattcttaagcaagactataaggatgatgcaacgagggaagaagtggttcagctcgctatcaaggttttgagcaagacgatgacagcacgacttgacagctgaaaaactcgagcttgctgagttgtatctgactccttcaaaatgtgttaagtaccatgttcactcgcctgactcgctcactaagctcttggttaagcatggtgtgactcaaccagccgcagaaacttcctaagctagaaactggtgacagttttacctgacccgcctggttactgtagatgtccatttgctttctttccctttggagatatcgtatcagaatcaatttaccactctgattatgtcatgtgattcatttgggttgactatcttttatcttgagattgatcttcttctagtctaaagtaaagttagactttagaggttttattcaataaatgaatgagcaatcaccaacgggcccattagaaagcccataacattcattgattgaggtaacgggttttaatggctcaaattaacgaagaatcagaatctctttaagtttcaccacgtcgatttacggtcaagagtgtctgtttattaacagaacagtaaaaatgttaccgctcaaagcgtatatcttgagcgccaaatggaatttcattggtacaatgcccagaagttctgggccagaactggcctcattgtaagagattttttaggagatttatgcagatctggaaaaacaagtttttctctcttggattatctacaaaatattatttacttaagtagttgtcagttagacaatgccctgaatccaaggaattgtatcgaccgggattgaagagaccattcttgcatcgtctcttctttttgcagcatcgcgattgtatgaaacattgatggccagatctttcttctataagtcaatcaaccggccaccggaattaccctaaaaacatagaaaatatgttgaaatatattgagatattagtcatcgactatgactaagtgtcacaaacttttgtgtgataggattcaatcaatccaatggatcttagtaagaatattttacattctataccagtctagttcacatattttctaccacaaattgttaattcctcacaccttttaaattcattttctagtttgcagtttttttttaagtgtcactttaccagattacctcaaacttaaaaattatcaaattattatcaaaatatacaaatttactaattataaaacaagtatatatctaatatcttatcttaaaaggtaaatatataaatattttctaccttttgtcatgtaatacaatttttttcctatttattaggtatcagaatctcaattaattaaattcagaaaaagtgtgagaaaataatttccagtaagcaaaaaaaaaaagtattaacacgacggcttcttctttcagcaaaaaaaaaaaaacataaacggagaaagagagagagaacgatacagaagagaagccaaggtcgcagagagaaacaatacacacggcgacagatatatttcccggcgaaacgggaacaataatatatacagagagagagagagatttagtgagagagctttctagggttttcttcttctcgatttatcttcctttgacctcgatctattcctcttccttctccataaattttcccttcttctcaccttcattcatatctctcctagctccattctagggttcttgatccgtttctctaccttttcgttttcttcctccgggtataatttcttcttcaattcgtttgttttcgcgtctcttcgtctcttctaatttcatcaatttgggtcttgtagggttttgagattttctccttcgtcgggtgaagaaaaccctacattttgttttgtcactgattgtgttttcggtgtttcaggttgtttaatttactccggcgggtgaccaaattggcggtggcaaagtatgagtattgatttccctgggaaaggggagagttagggaagtttgggctagagagaaattggattgggtttccatgagcgatgggggtgtcgcatgcatgcctctactgaatatcatg

SEQ ID NO: 35739 - DNA, 3003 bp, Unknown; identical to SEQ ID NO: 35738
  misc_feature (1)..( 3003): 2750-1469P.txt file - cDNA_ID_3090207; gDNA_ID_2926162; Annot_ID_198859

SEQ ID NO: 35740 - DNA, 3003 bp, Unknown; identical to SEQ ID NO: 17893
  misc_feature (1)..( 3003): 2750-1469P.txt file - cDNA_ID_3090222; gDNA_ID_2926162; Annot_ID_198849

SEQ ID NO: 35741 - DNA, 3000 bp, Unknown; identical to SEQ ID NO: 6483
  misc_feature (1)..( 3000): 2750-1469P.txt file - cDNA_ID_3090228; gDNA_ID_2926162; Annot_ID_198847

SEQ ID NO: 35742 - DNA, 3003 bp, Unknown
  misc_feature (1)..( 3003): 2750-1469P.txt file - cDNA_ID_3090252; gDNA_ID_2926162; Annot_ID_198838
atttaccaaaagttgaatcttgtatcgtttttgttagattctgaatatcccattgcaagtagcttattcctaaactcgtcgtaaaatacagcaaattttcgagtttcatttgtctaggaaattgataatttgtaatcatcaaacttacagatacagccaatgatgttaattatttatttcagagtattgagaaaaactcacatatgatttctctgttaactgtataacaaaacgcaggctactaaaaaacaatcactattgcggtatcgttaatctgatctaaagacagatttgtaggcttatgtgattgtttgttttctcacttgggaaccaataaatcgacagctaagtaatagcttcctacgatcacagtcgatgcaacagagcttcgagccatcctcatcccaatacctcggaacaagagatttctgtctgtaggatggattcctgtccatctctctaatctcttccctggtttattccattttagaaacttcctctcctttgctgtatactgtaagtaaaacaatagaaacccaacagagaaaatgagtttcatatctctttgtaagataaagtggaaagccatgagtagagtttctttaaacctttggcaatattacacactgtgcacgtgttcttgctgtgtcaaagctatgtgatgctgcagctgcaacggcaccagatatcccagcagcaaggctaatggctaccggagataaaggtccaacttcttcttcagaactgaattcatcaagtttccgcataatcattttaacaatcaacaatccaagttcaagtgaattgagaattcagtgtcgattgagagttttaagtacctgggcagaggattcatcccaacagctttccaaccgaccattgcctcgtgaagaaactgccatgttgaaaagaatactccaccgtaaatacaatctcttataagacctgaacgtagattcctccataaagctctatatccttcaagtgatgcaacatcgagcggtctcttaacatccatggctgatggtgggtttcctgttccagtcatcatccaagggtactcttgcaaagcagctgtcatgtttgggtgtttgtgatttaagacggataagagactgactgtttgtgtcaatgactttacatcaagagtgtatcttcttagcagttttgtgatcatgggtgagaccggtgcggtctctgcaacagcggaagcatttggagcccgtgatgcagcagtcacttgttttcggactttgattagctcaaatggagaagtcatcactgtttctgctgcacctcccaccagaccagccagaaaagcttcaccaacactcacgtagttatcatgtcgaccatctggagcgaaatgaattcatattcagattcttcaagacaaaggtattgcccaaaaaggaaccaaatttgcgtataaatgacatgaatgtatgtgaacactgttgcatattctaacataatccatgaacaaatgattgctgtattgactaattaactgatgttattgagctaattgacagaggagctagacacaaagaaacctaatcttgaatcatcgaaatcagacacaacaaaggagacatggacctgtgtaatacctttgtagaaagctgttagaatctcatagacaccaaaccttgcaccaaaaccagaaattcttcctaaagttaacgatccaagaccactgtacagacctgcatttgaagaacatgtcattatgcctgatgcagaatcagaaaatgattggaatctaaaagagtagtttgcgaacctgaatagccagagaatcgaagaactctattaaaaacttgaaaggagcttaatttcttattgggtcctgaaccaacctgtagttcaatgctattcttaatccccagatgaatctaagtgataaaaagaacaatttggtgaagaagagggaaaaaacctggataatggttttgatggtatctaaaggataagcgagagcagttcctaacgagacagaggccgaggcagcgatggcatgtgtcgcaaactgatgattctcaagaagcttatccatctttagcctcagcgaaaacaaatgtacatatacctatacgtttttgtcagcaacactacagactacagtatcagtattcaaacatactatgtcctttactcttatcatagtctccaaaattaagaggtttagaagtagatcaacaagttcttatcatccatttgatccaacacaaaataaacaataattagagtattatcatacctcaagtcaagaagagttttctctcacaggatattaagtaaacagaaacctcatcatcaacctcaaagatgtttcacgttgaagcaaaacccagatcagcgacagagagaagacgaagaagacgaccgacgctaatcggagaagaaaagacgacgtcgttcaatcagaaaatgccctaaaggaaatgacgtcgttttagttatcaagggtaaacaaaaaaaagttaaaaaacggaaaacaaattttagcaaaattgggttggtgacgtcacgatacagatttgccgatttataggtcataaaccagaaaaagctgccaaacctattttcttcgaaccctaaaaacgggccgggtcgatttctccgccatcgcaatcctccaccctcctctgattctctccgccgttcgtcggaaatctccatctccggctgattccagcttcctcttctccagaaccgaagctactgtaccggaattttatcactttccccgaaaccgattcaccgtaaccggccacaaaccaaatcaggtcttttctcttcatctccttgtacaaattttttacgggtttgttttgtttgtatcgaaattgtttattccggctaagaatttggtgcatgaggtctgcgaaatttcaaatcttttttctcgaattgttcattagaggatctaggcttatttacccattaacaaagtctttaccttttcttatatcttcttcctcttgaatgaattagatg

SEQ ID NO: 35743 - DNA, 3000 bp, Unknown; identical to SEQ ID NO: 6460
  misc_feature (1)..( 3000): 2750-1469P.txt file - cDNA_ID_3090256; gDNA_ID_1621094; Annot_ID_170886

SEQ ID NO: 35744 - DNA, 3000 bp, Unknown; identical to SEQ ID NO: 6460
  misc_feature (1)..( 3000): 2750-1469P.txt file - cDNA_ID_3090256; gDNA_ID_2926162; Annot_ID_198837

SEQ ID NO: 35745 - DNA, 3000 bp, Unknown; identical to SEQ ID NO: 6466
  misc_feature (1)..( 3000): 2750-1469P.txt file - cDNA_ID_3090260; gDNA_ID_2926162; Annot_ID_198835

SEQ ID NO: 35746 - DNA, 3003 bp, Unknown
  misc_feature (1)..( 3003): 2750-1469P.txt file - cDNA_ID_3090272; gDNA_ID_1621094; Annot_ID_170878
gaaacaaaggaacttctgcttctgctatgagttccagttattagttccttctcatattactactgaaataatgtttcagtgccatcttttgtatccagatagttcttagcagcttatgcagatatgataaaggttgactttaggagaagtctagttcaactaacaaaaatacccagctaaaattcagtttttgagattactttatcacatagtaagaaagatattaccagaaacatgagtcaatacacaaacgaactagataatagaaatcaaaccaccagcaagagatagaaatataggtttagaaaaacacacaactaagactcgtaagagtttcgagcccccattcatcacaacacgagataatagagaaaaacccaacacaaaatccaatttttaagaaacattcttcttagtattcctctccttcatcatcctcatcgtcaccaccttcagcaccgacctcttcataatccttctccaatgctgcaagatcctcacgagcctctgagaattctccttcttccataccctcaccaacataccagtgaacgaaagcacgtttggcgtacataagatcaaacttgtgatcaatacgggagaatacctcagcaacactggttgagtttgagatcatacaaacagctctctggactttagcaagatcacctccaggaacaacagttggtggctggtagttgataccacacttgaatccagtaggacaccagtcaacaaactgaatagttcgcttggtcttgatggtgccaaccgctgcgttcacatccttggggactacatcaccacggtacatcaaacagcaagccatgtactttccatgtcgcgggtcacactttgccatcatggaagcaggttcaaaggcactgttcgtgatctcagcaactgagagttgctcatggaaggccttctccgcggagatgactggtgcataggacgaaagcatgaagtggatccttgggtatggaaccaagttggtttggaactcagtaacatcaacattcaaggcaccatcgaacctcagagaagcagtcaaggaagaaataacctgagagacgagacggttgaggttggtgtaggtaggtctctcaatgttaagggagcgtctacagatgtcatagatagcttcattgtcgaggaggatggagacatcagtgtgttccaagagagagtgagtggagaggacactgttgtaaggctcaaccacagaggtagacacctgtggagatgggtaaacagtgaaacccaacttggactttttcccatagtcaacagaaagtctctcaaggagaagagatccaagaccagatccagtcccaccaccaacagcgttgaaaacaaggaatccttgaagaccagtacagttatcagcgagctttctgatccggtccaagcagagatcaacaatctctttcccaatggtgtaatgaccacgggcgaaattgttagcagcgtcttctttaccactgatgagttgttcagggtggaaaagctgacggtaagtaccagtcctgacctcgtcgatcacagttggctcaagatcaacaaagacagcacgtgggacgtgcttacctgcaccggtttcactgaagaaggtgttgaaagcatcatcacctccaccaacagtcttgtcaccaggcatctggccatcaggctgtaacattccagatccaatacaccacatcaatacaaaaatcatatacaatagatctaaacaggttcatcgaaacggatcttacatcaactatataaatcaaacacagatctaagcaattacgtacaatatatctacgaaatccgaagaacaaggtgaaaatatctcagatctgatctataagaggaagagacgaacctgaatgccatgttcaagacagtaaagctcccagcaagcatttccgacttgaataccagcctgaccaatgtggatcgaaatgcactctctcattgtcgtttcgcggaagaaagaaagatctagaaaatagatttgcagggaagaagacgaagggcgtttatgaagacgctcttctttagatctgatattttcgatttctaggttatgaggaaggtgtttgatgctgtattttataagcgaaaattatcccatctgtatgtaacggcaggtatattacacgtgtaatgatgtaattgggttgttgttaaaaccacgatttgttgttattctcgtgagctgtgtattttataattttggaatttttgaaaagcaaaatcccttgaattgcgtggaacttaaccggaattttaactggaattgaaccgtatcagaccattatttaggactgaaccaaagtgtatcagataagtaatttccattgtatgtttgaacttgcaatcaatcttcagggaaatgataaatcgatatacaataaaacctctataaattaataatgttgggaccgcgaaattttattaatttagagaggtattaatttatcgataaattaatatttattaatttatacagacattttcctaatttggtaacttttaaaattgttttataagatttctttcattgtagaaaatatatatttagaaccagttacaagtaaaacataataataatgtttagaaaacaacaccaaaaattttgatacaataaaatatgaaaattatactcaaacaaagaacaaatatgaatttaagcaaaaaaaattttaaaatatattttaaagaaattcttttacatataatatatatatagttaatatatttatacaattattaatttatgatattgatgagaccatacattcacatcaaactttcagaaaaattattatcttattaatttatcgtgttcaaggtcggtcttaaaaaatttatgaaacgcactctgaatatttgaagtatcacagtttagtaccttaacttttgttgtttagttaaaaaagtcatcacatcctaaaaagtggtgtaaaaaattagcaaatttcgcagacacgtgaaatcggatccaatgcgatg

SEQ ID NO: 35747 - DNA, 3003 bp, Unknown; identical to SEQ ID NO: 35746
  misc_feature (1)..( 3003): 2750-1469P.txt file - cDNA_ID_3090272; gDNA_ID_2926162; Annot_ID_198831

SEQ ID NO: 35748 - DNA, 3003 bp, Unknown
  misc_feature (1)..( 3003): 2750-1469P.txt file - cDNA_ID_3090274; gDNA_ID_1621094; Annot_ID_170872
acctctatccatctacacagcacctaaaattttccccaatttcagcaaaaattcgaaaatgcaatcaccagagaccatgaatctccagcgtcgatgaaccctaggaacgccagatctaaatcgacgatagatcgatctgcaaatattccctcaatgagagacgaaacgtgacagtaattacagagaataatttccgacgcgacaatggaagactccgccgatcagataacatggattattccgacggcggtgggcggagatgtaatttttccggccaccaacaacgatttaaaatggaagaaagagatgagagtttgtttcacacggcctaattatatgtccactgtaaaaaaaaagaaaaaaaaagactcattactattgtaaatagaattttttgttaaatttaaatttaattgtgttgcttaattatttcttaaacgttgtaggtttgtcacttaccttttctgtttccctccaaatctcgttcgacgatgggaaatcccttagcgttatttcccgatattgaagaataaagtggcaagatctcatccctcgacaaaaggatcataggttatgtcaattatttactactactagactattagtgtaaacaaacatgtccctgagttatatacatgtactgtcccattagtcctagtcaaaatacccaaacataaaataccaaaacgaaaccgaatcctaagtagagaaactgaactaaaccaaaccaactaaattttcgaataaatcataaactctaaaaccgaaatatttccaaaaataatagttattctaaaactgaataatcggaaaaatttaagaatttttgaacgaaaaatacccgaataaaccaaatagatctgaaccaaaataacaaaaaaatattcgaactctgaaaagaaaaatatactcaaaacattttcaattctttgttattcagatatatagaccaaaaccaaaattacttcaaaatttttggttcctaatcggttcttgatctttcaactatcaagaaatgtatataaaaagcaaacaaaattagacttgaattatcgagataagttcaatagtttgggtgaaaaaaaaaaagttcaatagtaaaaaaagttcaatagtttttttttttttttttttttttgatgaaaaaaaaaaaaagttcaatagtttgggtaataaaatctatatctatgtggatgtgatgaaatgactaacatacttcagttgcatgatcatgattatgaatatagattcacccatgatatttatatgcattttgcaagaagagtgcatatcacattacatgtatcaaaagatttataaaaaaatcgttcactacattttctttaaaaatctcaccctcaagtaaaatattatgttaaaattgtcaatcacttgcatagagataattggcgatgaaagcttttttaaaatggcgatgaagtttgataaaggttcacaggaaaaatattacttgcataatgttaattgatttcacttatgaaataaaaagaaaataaggtcgattaagataattatatgaaccgaagaagagaatacaaaggaatgcttcggtaagggttttcggaatcgaataaaggtgacggttcggtctaagtgggttattttaaatgtgggtgatggttcttgtcccttcacgtttgggaatagtggccaaactcggtctctatagctgtccgtagacgctctcttatcgtcggatgtgtttaggtttgcatcaagtcttcagagaaactgtaaacatctttttgttatgaggtttgagggctgatcatgactccgtttttattgttttatctgataattttgtgtaatgtgacataaatataagtccaattttattgtttttggaaaatgatataaaagcgtgcatttagattcttgggcccatcgatgagtggataagtaataaaaattagtatggttttcttatttcccatgacgttttatttttcgatccattatcaagcttaagataggattggcccaactttatcgttgatttgcaagcttctgttttattattagttgtgacgttgctttcaccaaatttttctatgcaagttcaaaatattgaatgggaaaataattaatggtagtattatacattatgtaaaatgactctaatatgttcgaaacaaacttagacaaaacaacaataaaccaccatgaatgtaataacgaataaatcaaaaccaaacccataaagtattaattgacattgacttgttattgcgacttgtgtgaaagtaaataatacaaagttacaaacggtcgattgcggtatgacacgtagtaactagtaagtcatctagaaaacgttttcctctagataggttgatgacaaaattttaaggggacaataatttgatgtatctttcaaccccagttcaaaagagtgtaggaataaatggaaatgttttgtttatacattgaacttgaccactttgttgttgcgtgaaaatgaccacaacctctaacaataaagttcttttatctttatcgttagccgttacataaacatgatgataacacttaaaattattggatgggatgtgtacacgaaacatgtgaaaatggaataagattttttttgaaagttatttttcttttatattcgcattattacaaaaatatattagtgaataataaatgactagattgactgtttcatttatttaaagacaacattgtggtcaagacaacattggaaattacataatttaattcatataaacaattttatgaatatattaaaataaaaatagttattattattatgaaacatataatgtatcactacagacgataaaggatttgattttttcaaatggtaagttcataacttcccaaattactataaataagtgttaaagttagtcattatcaaattaagccactccactaattacaagctccaaaagctttctccttctttttctctctaatctctatttcgtacggatttctctaaccggagcgatg

SEQ ID NO: 35749 - DNA, 3003 bp, Unknown; identical to SEQ ID NO: 35748
  misc_feature (1)..( 3003): 2750-1469P.txt file - cDNA_ID_3090274; gDNA_ID_2926162; Annot_ID_198827

SEQ ID NO: 35750 - DNA, 3000 bp, Unknown; identical to SEQ ID NO: 6469
  misc_feature (1)..( 3000): 2750-1469P.txt file - cDNA_ID_3090281; gDNA_ID_1621094; Annot_ID_170869

SEQ ID NO: 35751 - DNA, 3000 bp, Unknown; identical to SEQ ID NO: 6469
  misc_feature (1)..( 3000): 2750-1469P.txt file - cDNA_ID_3090281; gDNA_ID_2926162; Annot_ID_198825

SEQ ID NO: 35752 - DNA, 3000 bp, Unknown; identical to SEQ ID NO: 17908
  misc_feature (1)..( 3000): 2750-1469P.txt file - cDNA_ID_3090285; gDNA_ID_1621094; Annot_ID_170867

SEQ ID NO: 35753 - DNA, 3000 bp, Unknown; identical to SEQ ID NO: 17908
  misc_feature (1)..( 3000): 2750-1469P.txt file - cDNA_ID_3090285; gDNA_ID_2926162; Annot_ID_198824

SEQ ID NO: 35754 - DNA, 3003 bp, Unknown
  misc_feature (1)..( 3003): 2750-1469P.txt file - cDNA_ID_3090289; gDNA_ID_1621094; Annot_ID_170861
cttcttatcactctcacacccaaaaaaaaaagacccatgaaaatccacccattacccagaaacgaaaataacaacaatctgatccatcacgctcgtgatccgacccgagaacccggaaagaagctccgtcgtctcccacatatcttcagccgtgttctagagctgcccttgaagtcagacgctgacgtggctgttgaagagagtcatgactgcttcaggttcgtcgcggaaacagacgggggaggaggaggaggtgtgagggcttacatggttgagattcatcctggtgtgaccaagattcttgtgagaaccaatggttcatcgtctcttggtttgtcgcttgatgagcttgagcttgacgtgtggcgtttcaggctaccggaatcaactaggcctgagctcgttaccgtggattgcgacggcgatggagaattgattgtcactgtgcctaagattgaagacaatggtagagatttgatagtgcttgtacagtaatctaatgtgtttgtgatcaaatgagaaaaatcttgactttttttatctaatggttatcaaagttaagatctttttgtttctttatgaaaatatggatacagagtaggttttgccttatgtaacgtaacatcaattggttttagttttagagataaaatcctttgagaggggcaaatttattgaggatctctgattcacgtttaagagcattgtctttcttcatttcccattcaggtttcttcaagttagctgcttgaacttcttgaaccactttagggattgagttcgctaccatcttctgaccaaagattagatcaaccttctctttccccttgttactgatgcagcgggtaagctcggttcgtttagcttgaagctgagcgatttgctcgtcaatttgacggattgtctctgagtttctatcgacttccgtttggatattgcctagcttgtcctttaagtcgctgtattcgtacttgagagatgcgaccttcgctttgttaagctcgagagcggagaagaacctatctgcttctactatcatgctttggttctcttgaaaaacttcgctgaaagttggaatttcttcgattagcttcaacctcactatttcttcagctgataggcttggatctttcttgagtttagctgccaagcttgccatctccgtagcttcattagacatgaacaaggaagagaaatctttctccagaagcgatgaaagcttcattcgagcttctgtccattcgtaatctctcactggagagcttgcactaacgggaagtgatgatgaagactcctgtcctgcttctgaaggctgttgctgaagaagattctctagagagttcagataactgtcaaactcttctgggtttatatccacaggagggtgagagactgcaatgacaccgttcatagaagaaacatagatatgcggaacaaaagcctcttcttcttcttcttcgtctgcatagttacctctgcgtttcttcatcctcttgctgcctttctttgcatctgattccttgttttcttcagtcaagtcaaacacatcaccttgttgctgtcttgtgtaacgtttcgaggaagattcccgagctgacttatgttcagcagctggtgttgttgtggctgtctttttcctgttgctagctcgcggagttgctttaggttcattagtctgtatctgcacctgttttctcttcctctggctgtaacgcgaagttgatccttctttttttacatcctcagcatcctcatcttgattctgtccttctttggatgtctcttcaaacagagacgcagcatcaactacagaaaaaaagaaacatcattcatgtgttgcagatagagttttatggctgacgcaacagaagagtgttagttgctacctctttctgcaggctgaaacaaagccggaatgttccaggtaaaagatgcaaagaatgcattagcatccatatcagggaaactagtttcgagataacgcgaaagagtgtttttgcttgcaaaagatttgggtacattcttgcccttaagcctctccgggagaatgagtaagcgatccttatggaacccggcattattcactctcctcccaactctccaagtccaaacatcgccggggctcgggaaatcgacaggtgcaaacggcaaaccttgaccactagaagctggcggaatcgccgggagttgattcaaatcagtgaaggagcttctgtcaccattaaccttcacatcatcaccatcaccatcactgttgaatccgttttcccgataatagtcattctcaaccgggactggttcagtctccttgcttctattactcattgacactactgattcaccatcaaatctgtgcagattcataaatgtgattgaatcaaataacataacttaactaattgctttgcagttataatcacatatattcattactctattcccaataacaaaacaaaatcgatcatgactcaaagtttcctagaatcaatgcagagaaacctatacagaagtgtaaacatattgatagttcttaatgaattgaatttacccaggagaattttgacctatctcttgatccatatccatcgaagcagaccaaaaaccctaattcctgcgatagataaacacccaaataaacaaagcaaaggatgaattctaatctataacaatgttaagggaacaaacccacacaaattaaaagttaagttgattagaaatttctccagaatgcagataaagatacgaactttggagagtcaagaacagagtagccgatcttatgcttcaactacaacagattacaaatttatcaaactcattcgtttcttatatatcctcttttcgatcagattagtcctacaaacagaggtggaataacagttatacccttttagtttgtttttgtttacacagatgaagattgaaattacgattataccgttcaatgtttcttcttcaccgacttgaaagctatgacctttccgatcaccggcgttagttatg

SEQ ID NO: 35755 - DNA, 3003 bp, Unknown; identical to SEQ ID NO: 35754
  misc_feature (1)..( 3003): 2750-1469P.txt file - cDNA_ID_3090289; gDNA_ID_2926162; Annot_ID_198818

SEQ ID NO: 35756 - DNA, 3000 bp, Unknown; identical to SEQ ID NO: 6477
  misc_feature (1)..( 3000): 2750-1469P.txt file - cDNA_ID_3090297; gDNA_ID_1621094; Annot_ID_170854

SEQ ID NO: 35757 - DNA, 3000 bp, Unknown; identical to SEQ ID NO: 6477
  misc_feature (1)..( 3000): 2750-1469P.txt file - cDNA_ID_3090297; gDNA_ID_2926162; Annot_ID_198811

SEQ ID NO: 35758 - DNA, 3000 bp, Unknown; identical to SEQ ID NO: 6508
  misc_feature (1)..( 3000): 2750-1469P.txt file - cDNA_ID_3090314; gDNA_ID_1621096; Annot_ID_171003

SEQ ID NO: 35759 - DNA, 3000 bp, Unknown; identical to SEQ ID NO: 6508
  misc_feature (1)..( 3000): 2750-1469P.txt file - cDNA_ID_3090314; gDNA_ID_2926163; Annot_ID_198931

SEQ ID NO: 35760 - DNA, 3003 bp, Unknown
  misc_feature (1)..( 3003): 2750-1469P.txt file - cDNA_ID_3090318; gDNA_ID_1621096; Annot_ID_170993
catgcatatctagccttacttataagcttttcagtttttattgaagtatactaaatgttttgattgttagaagagatagaacatgtacatattggacaatttactatccaccgttagaacattgcgtgaacgactcagtcatagtactagtcaggtttgtagttatagacatatcaagatttctgtctagttcatgtctatatcaaaggttgtggtatctctgcattcgaagacttatgtttctttttttgtccgtaaatttttaagatttatcttttcttgatagatatatatgtatcacaatgcatagcaatatcgacgtgattggcccagaatcaagtcttatctttggttgtgttcaataatgtaaagtccctttataagctggtacaatatgatggtgcagtgtttggaactatattataaaaggaatgatgactcagggaccatgtaaagcgttagtacaaatgtgtcgttgagacttgaaacttacttgggaccataattatgtttcttgggtttctttttttcagtgctagtaaactttctcatcagtttctctctcgttgattacattctaaaaatttctccatatatgctcatagtgaaaacgtaaatcatgtcttctgagtcgtgaaagctgaagtcgaaagtgttttagtttagggtaatttctgaaatgggctttgcttcaggttgctggaggtggaatcctaggatatttacatatttggagagaagcaaaagttatagcttataagatttttgtcattgttatgatttatcaattcttaagttgtacgtataatttatatttgtcttcggttaataagttattctcattgtttagaactacaactctttctcacattgctctgaactgaatcgcctagaatttgcttcttcttgtttcttaaacgctaagtggtaactaaacattattcatagtgtctgagtattatcagttaaacaaaaacataaataatcgtttcatttttaccaaaaaaagaccattaatggttcttaattccaaattgtaaatacaaaatttacacaagtaatgtcatgcttctaaagtctaggactactgcatgctaaactattcgttttaaaatttaaaatacatcaaatgaaagaaattagattgaataaaaaaatcaaatataaccgagcttccagagtttctctaagtaaattgagaacgcaagccatgaccaatctggtgaatatgaaaaaaactcaaatatttatcatttacatacaatgcacactagatacatatgaagattttaactagtttagtataagataaaaaacacaattttccatgattatttcattaaaaatcttaaaatttgctaaaaacaatcctgatactttgcattattatcattcatattacgttgttttacttttcaaggaactgttttatctaaacatgtataaggttatcaaatgattaacgtcaaatctgaaacaataatgtaaccaatatggaatttcgccataacgtggatacttggcagtggttacttggcttttcctttattttcttttggacggaagcggtggttactttgtcacacatttaaaaaaacacgtgtttctcacttttttctattcccgtcacaaacaattttaagaaagatcgatctatcgtgatctttctatcaaacaaaagaaaaaaggtcttcatagtaacgctacaacatcaaatatgtggttgctctgacatcagtcgggaaaataaggatatggcgccattggccacatctattggggtcccaacttcctttcacaaaaaaattaaattgggtgtcccaacttttatctttgatatagtgacatgagtatcgggagcattggacaatggataaaatgagaactaaaaaaattctggttaatttttgatcattgttatttaaaaggttattttatctataatctacccatattgatcagttttatttaaatttgtttagctaccgctcctcgagagagatcctcatcttaaaaatggaatatggaaattacacacgaccccaaaagtatattttttctctggagaatgctatttagagctttgactatatggtctgaattagaaagacgggaaataaaatctgctaagtgatataagctctaagtaggcgatgtgtgatggagaacaccttttctttaacagtcttcatgttttacagattcgcgaacttcgaatatccctatacggtctgtctaaccctcgtgtgtcttttgagtccaagataaaggccattattgagtaacatagacatgctggaatccaaccattgaagtcacaactgtccatgtagattctttggagaatctgaaaagtcttaataaaggtggtgtttcaaagaaaacaaaacaattgagttaagaaaaaaaaatatcatgtagtggtcgagtattatgttatttattgtgtagctaccaatctttattctttaaatctgacataaaatgctacaaactttttacctcgtctatagccccaaaaaacctaaccacggttctaaaaccacacacagtgattttggttgacgacaatgcctctccttcctcaaaacgatttatttacattttttaaatcaaatgttacattttataccataattaagtctttttacagaatacttagatggaagagatgtataaaaaaggaggaaattgtaaaaaacatatttcgatcaattaaaccaggattcataaaaatataagtatatatataaatgatgtttcgtttagcgatgaacttcactcatatgataatacttaacaatataagtacataaaaaataaaataaaattaattgtttacgaaaagtctacaaatactgcatgtataattaatgttctctttatttatttatttataccttaccaagatatatctataaccgcatagaaatagaaggcgaagagataatttccaaaaacaagaaaaacctctaagctcaaaagatgttgttgagaacgatg

SEQ ID NO: 35761 - DNA, 3003 bp, Unknown; identical to SEQ ID NO: 35760
  misc_feature (1)..( 3003): 2750-1469P.txt file - cDNA_ID_3090318; gDNA_ID_2926163; Annot_ID_198921

SEQ ID NO: 35762 - DNA, 3003 bp, Unknown
  misc_feature (1)..( 3003): 2750-1469P.txt file - cDNA_ID_3090329; gDNA_ID_1621095; Annot_ID_170977
atttgttcttagtcaatgagtggtattcaatttcattgtcccggtcccacggactgactactcagcaacccaatcttacaaagtcaaagtcaacttttattttgtttctctttttttccgtttccatcccaaattcatttctttataaattatttattcctaaaaggatttgtaaattaacctaatttgcatttcaaaatatttttatctattttagtattaaattggaataattgttatttttgtattaaaaaaacactaatatccaaaattgttatattgctttttattttgcttttttctatttttaatttctattttttaatagcatcgccgtatcgtcgcatcgatactcggatttagtaaataagtgttttttagcaagagtttatgcaagtccgcttcgattaaagtatctaaaccaaaatccaaacacgtgggagtttccgttttaatttctagttatattatacccttcgttatttaagatataaaacagcaatttattatcactaattgataaaaccttcattgcaaatataaactagattttaaaaataaaatttgacttttaaaatacaatgtaatattattaatgatataaaaacaaaaaacctaaaatggtattgaagtgtcaaacagaggaagtatatgatatatatgtaattaactagtcaaaatctgctgtgataacgaccaattctaaacaattataaaatcttctaaaaattaatgagaatctactatatttaataactaaaataatagaaggatgacaattgacaactataacaatattgaagaagtcataccaaatatattaagacgtgtataaaaagggtatcataaccgaagacttaagatgaacaagacacaaacacaacagaaacttaaccaaagacatatctctctctcctcaaacccacctcttgtctctatgggatcgcaactctcaaacgcaatcgacggtaaagataacaccaaaaccatcggatcagcggatccggaccagcttatggagatcgaatccttggagaagatcttaaattacaagttcaaagacaagagtttgttgctgaaagcgttcacagacgctagttacgttgatgacaagagtgaatcgtacgaactcctagaacttttaggagattcgatcctaaatatgggtataatctatgattttattaagctctaccctaaagaagcacctggtccgttgaccaagctccgagccgtcaacgtagataccgagaaattggcacgggtcgctgtaaatcaccaactctatagctatctccgtcataagaaacccttgcttgaggagcaagtaagttacattcttaaaaaccctactcaattatcatctttgaaatccctagtatttaaccgtgtcaaatcttataaatttttatttattaattacttcgatcatgtcttattgcaatttggttcattattaaaatccatggaaaataaactttgtcaacctttttttcccattctctatatcactttcatccacaatttgtctcaatgaatgtgttagtttattccataacccatgggcctaattagaaatttaccaacaataatctttaataaaaacgtttgtattggttgtgtgtaatatgtgaatcaatattattatatgcagatactagaatttgtggaagccatggaaaaatatccattacattcaaatggtcttttaaaagttcctaaagttctagcagacatagtagagtctaccattggagctatcttcatggactgcaactccaccgagaccgtctggaaggtaacttactatacatttagttataaatatctagctactagactaaggcaatcgattaatccatgactcttttggtgttgaaaccattgttgacaaaaccattgttgataggtgataaaaccattgttggagccaataatacatttagacaaaatgaagagccatccaatgacagaactcaatgagatgtgtcagaagaggaacttgaaattgacgtccaaagacacttgggaagaaaatcaaacctattgtttccatattgaggataagtttgttggatgtggtcaccatcctgtcaagaaagaaactgctcgtaatttcgctgcaaaaaatgctattgacaattttgctaaatttttcggagacctttagatatatcgaaaagaaaaagaaaaattatatttttataaatttttacagtataaattgtaatatctttctgttttctttttgttaaaaaaaaaaaaggcaaaaagaaaacataaagaaatatgtactgtctttgtattttaaccagcttgtattcaaattcatcatttcatttttcttatgaatggtgcgaaagacgtaaaaaaacgaaaaaggaaaaaatagaatgatgtgaatgaacctagccaaatgttataagcatatataagtgttactcgagaaccataggatatcatttgtaaatcttggttagagacccatattacctctgatcatggcatagcacacaacaaaatagtttattcataaaagtaaatatagtttattcataaaatacaaagatttccaatcacacaatgtaacaagcacaaataagtatacttttacttataagaagacatcggatgtacgtagacaaacaagtatcaaagtatgttcataaaggaaaacaaagttcgcattcaacaaggtgggttaataccttcacgcatgcacaagtgatggaaagcaatacaaatactcagatcaacaaaatgacaactttttcagcaagcaatacaaatatacaatataaaaaatctggggtttcttggttgggcttgaatttgagaaaggcccagatccttccagatactctttatttgactaataaatatcacaaaaacaattttctcttaaagcttttcttgaagaacaagagaaatcagaagctctttcctttgttttttttttctttttcttccaccaatctacagatttcgaatcatcagaaaatg

SEQ ID NO: 35763 - DNA, 3003 bp, Unknown; identical to SEQ ID NO: 35762
  misc_feature (1)..( 3003): 2750-1469P.txt file - cDNA_ID_3090329; gDNA_ID_2926163; Annot_ID_198918

SEQ ID NO: 35764 - DNA, 3003 bp, Unknown
  misc_feature (1)..( 3003): 2750-1469P.txt file - cDNA_ID_3090413; gDNA_ID_1621096; Annot_ID_171049
ggatgtaccgaatagatattggattgtctagcgatgaatatgagatttagtagactggaaagaacgtgtagctatttttgacttgaagtgcatgcaaagttgagcttgtgtagtataactatatggaatatgctaactagtcttgaagaggaaatattttgcaatcttcagcttatcttaaaattttaggtgctgctcaggattctgagcaaagacgaccatcaaacgaagttaagaagtcaagaatatctggaaatcgagtgggcggaacaccaaatatgaaagctggttctggatttggtagcacttcattgtcagagaaacatggagacgtcaggaaaggaacaccattgagaagagcaaaggagaaacaatctgagaaagagaataaattgtggtggctcaagcttccctatgtgctggtaggtaaataatattggatttttggttaaaaagctttctttgccagatccaattattaattcacaatcaagaacgaactatcacaaaatattatgagccagacacttaccgttttctcttttcttcagagaattctcatgcggagtaatatcgatcaagacatatctgagggatattttaccttgaggaccgaatctatggaacaaaatgagggtcaagtttcacatatgattgcatttgaagatcaaagtgatgctagaaacttctcttatctgcttgaatcagtttttgaagacttggatgatttcagtgccgatatagctcccgtaacaaccaaggtagatagttcatttctttaccaacttgattcttctttattaatgtctgtatctgtgaagtttacttgtttaggagaattttgttccttaaacccttaatttctcttcatgatctgagagtatactgaattctaagagcagtgagatcgtatttttatttataggatctttatgaggaagttagttctggtggcaagaatgtgatagttgtgaggaagaggcagcttacgttgtatgctggacaaccatttgaagacgttgaaagagctttgcgaactctgattcaagaacgaagatgaaaaaagtaacaacattacttcggactgaaaaaactagagagcccagagatgatcaatgtggagatgacaggggcagtaagaacaatggttccacaacaacaatttttcatgaagcttaaagaaccactgagcttctgttgtattatggtagtagcattggaattgagaggacagatccactagaaataaaaaagattgtttatatcatgtaaaaacgtattttacatgaatcagagagaacaacattttcatcttcagaattttattgagatgcaacgatcttgatcatggcttgtgcattaagccctgttacattcttctcacaaaacttcttccaagcttcttgcttgcttccttcttcgtcttcttcttcattccatgtaaatttctcgaaaagcgagttcaccatactccttgcagcttcccttgcctctggcaacttgtcactcaactgatccgcagccatttgtgcgagcagaatcatcccaaattcttccatttcatttacctcctgataacaaacatagagacaaatatatcaatcacacaattcaagaaaataataactttgctctgagcattttaatcattgttgaagaattcaaaataccattttagaaacgcagttggaagtagacacagcagctttggccctgacacgagggttactgtgacggacataactctgaagcttacgcagaagcggcaagcgagccaccgagttaaccatcgtgttcagcgctttctctgcttcttcacacacaaacttcttgtcttgtgaagctttcatcagcaactgcaacagctgttattttcaccatcaagataccaaaatcaaactttattattaaatcaacaatccatagccaatcaaaaagctaaactaaccggaaaaaacaaaaaacaaaaatcaattttaccagatcgtccatagatttcaaatgaggtccttccagcaacttttctccataagcagtgaagatatcagaacaagtcataatcgaagtcttgcacaatgcacttctaggattcttcatcgccttcaccatcacaactataagcttttctctacaaattgacaaaaacaaaatcatcaccaagaaactccataagatttcagattctggtcaaaaaataaaaaatactcacagaattggtagcaacagagaagagtgatgaattgcaaatctccttgtgttgttcaatgagtcacatactttaatccaatcctttgatgctaattcttcaagtaatctctgtgatagattgaatcaataatcatcaaaaacaaattactacacataaattcagaatcaattgagaaatttaattacctggacagaagattcaggatctgaaaatggtttgagattctcagaagcaacgtattcgacggtcgattcagccacagcgacagggttgttttcgtcatttagaccaatctccggttgctttgagagtttggccagcttcttaggtcgttcctgtgagatcggaagagcgttttcaatgttcctcaacgccattagagataagagaaagagagagattttgatttgaaattcgttaggggaataataatcaatggtggggttgaaaagcttaatataaagagaaatttttgttacctttttcgcattttatattcaaaaattcaagaggaaaaaaagcaaaagaccgttggtaaggttttggctccaacggtcacaagcatcggttcggtttacatgaattagattcggttatctggtttattgttcaattcacacgacgtcgtttcataacttttaagaaacgacagcgtctaagttatcacttttgcgccacacgcgagtgagagctaagctaattctccgtcttcaatggcttttctcttttccccaattgaaattgaatctattccctagaacaaattgattgtgaatccggcgtcatttttgatg

SEQ ID NO: 35765 - DNA, 3003 bp, Unknown; identical to SEQ ID NO: 35764
  misc_feature (1)..( 3003): 2750-1469P.txt file - cDNA_ID_3090413; gDNA_ID_2926164; Annot_ID_198988

SEQ ID NO: 35766 - DNA, 3000 bp, Unknown; identical to SEQ ID NO: 6530
  misc_feature (1)..( 3000): 2750-1469P.txt file - cDNA_ID_3090424; gDNA_ID_1621096; Annot_ID_171042

SEQ ID NO: 35767 - DNA, 3000 bp, Unknown; identical to SEQ ID NO: 6530
  misc_feature (1)..( 3000): 2750-1469P.txt file - cDNA_ID_3090424; gDNA_ID_2926164; Annot_ID_198981

SEQ ID NO: 35768 - DNA, 3000 bp, Unknown; identical to SEQ ID NO: 6532
  misc_feature (1)..( 3000): 2750-1469P.txt file - cDNA_ID_3090427; gDNA_ID_1621096; Annot_ID_171039

SEQ ID NO: 35769 - DNA, 3000 bp, Unknown; identical to SEQ ID NO: 6532
  misc_feature (1)..( 3000): 2750-1469P.txt file - cDNA_ID_3090427; gDNA_ID_2926164; Annot_ID_198978

SEQ ID NO: 35770 - DNA, 3003 bp, Unknown
  misc_feature (1)..( 3003): 2750-1469P.txt file - cDNA_ID_3090435; gDNA_ID_1621096; Annot_ID_55677
aataatataaccgataaatatatataaaaaattatttagaaaaaatcaattaattacgattttacctttttcacagatgaaacagtagaatttggttacgtctacatagttgaaaataaaactattaattacggataaagtgataaatttgagacgtcgaggctgataattgattagagtcttacctgttggttgcatgcgggaaaggactgctgaactaatattttgtataattaaccttctcatcatatatatgggtccgtagagtattcataattaaatgttacacataaatgcatatataataccaatcatagaaaaatgactagtatactgtatacagtaaaatttgtagctaatcataaatgtccaactaccaaaaatgtgacacaacagcaatgttggcccatagccaatttttacctgacatttttccagctcttatgttactttaaatttagtgtccaacagttcttacttcttagctggcatgaccaaaagtgtatagcctacatatctaaataaattttataaactagaaacatgaattcaaattaaatgctaatctgatttttaattatttttactctttcatggcaaaaaaagagaagagaattacattagaacatgcataaaatacggaaataagcaatgtggtattacaaatgttgtaggtacaacatttctgtgaacgctatagcttgcggttacacggcgatctcgatagcgattctgatgatcagcaggggaagaagaagcaagaagttgttaatggtggttttgctaggagatctagtgatggtggctttgctgttttccggcactggagccgccagcgcaattgggctaatgggtttacatgggaacaagcatgtcatgtggaagaaagtttgtggcgtttttggaaaattctgtcaccgagctgctccttcgcttcctctcactcttcttgctgcagttgtgtttatgtttcttgttgttcttgacgctattaagcttccttaattattaattgtttctgttcttgtcgttttgtgtgatgtaaaataactatcaacaatcatgtaattgtctattgcttctaatgttttatcacatcgttttctatggtgagacgatatattcaaaattcggaaactaattatctctactgattactatataacgacgtgataagatatcctaatcactaatgtggacatatagttagttgtaagcaatgaacctttatatcaattaagtgacacatttttacttttaaacagataagattaagtcactaagaacaattgttctcgtttttttccctgtcaacttcacgaaggactaatgataaaatgagttgccgtagaatgcaagaaactgatcataaatgtgttcattttcttctctacgttcttgccatcgtgataattggaaaatatcacatcaaaacctgaatttaactcatattataactccacgctcaaattcaaaccgagtttaaatagagtaatggaccgtgagttacgtttttgcttggtatcactcatgaacatacgaaatattgaggtagattggtttataatgaacatacgaaaccttttaagtcaaaatctgttttaattttctaaaattccaaccttcacgtatttttctgattaaaggtgtaggaatatcatttccctagacgaactggtcatctgcttagcctgatgtaggagtttatgttgacattcttaattattaatttttttttttatgatcatacattacaatttttcattttattattaacaattttagtggtgatatccaaagttaaaaactaagcacaaagggaaatgtttctttttttccgtatatatcttatatagtgtattattattttattttttttcaccgatcattgactctcattgtcatatgatagttaaaaggaagcattcacagaattaaaaatgtatctattagattgcggattttcaactcaaaattaattggcaataggtcaagaagctcatattttatatataccacctaaaattctattcaacttgacaatatttctaatacattccttcgaaataatagtttttctaaccattaatcttgatatgtttgggcatagatcggtaagcaaagtattgggccgaaccaatatggattgagttgagtatgttcggatcgaattctgataccatattagattgtgagctttcaactcaaaatcaataagcaatagatacgaagattcatattttatatataccacttaaaatcatattttactttcaaacaatattcctgatactatctgtatttgatgcatacaaatacaaataatcatcataattatcagattaaatacttatacaaatttatgtatttgctcgaaaaattagaacgtacaagacttactcgaattttcagtaacttaaatagcccaacaagtttccgaaatcaaaatatctgacctaacagaaatcaatatattttgtgcgaattcacatatccaacaaattccatactattaccaaacgcatatttatccgtatgcacttcgaatatcagtttttttagttttttttttgggtcaaaacgaatatcaggtttcatataccaatgttaccttattttttgacacctacaatgaacacactaagtcaaaaattacacaaatttgttttcctcgcaacttttcaacgtatacacacgtttttttttatatacacaacgtattcacacttcgttcccatacattatccatatatgtttttatttcgtaagctgagattcactcttgcgccacataaacttaaaaagccacgtaaacatcattactatccacaacttgatgtgtgttaagtaagactatttcaattttttttttaatatatatatacggctctctactcacatctagagcatgagaaactttaaagaaaaaacaaaaagaacaaaatttgttatctctctttcctctcattttgaccctcttcacttctttttgatccctaaatg

SEQ ID NO: 35771 - DNA, 3003 bp, Unknown; identical to SEQ ID NO: 35770
  misc_feature (1)..( 3003): 2750-1469P.txt file - cDNA_ID_3090435; gDNA_ID_1621096; Annot_ID_171018

SEQ ID NO: 35772 - DNA, 3003 bp, Unknown; identical to SEQ ID NO: 35770
  misc_feature (1)..( 3003): 2750-1469P.txt file - cDNA_ID_3090435; gDNA_ID_2926164; Annot_ID_139819

SEQ ID NO: 35773 - DNA, 3003 bp, Unknown; identical to SEQ ID NO: 35770
  misc_feature (1)..( 3003): 2750-1469P.txt file - cDNA_ID_3090435; gDNA_ID_2926164; Annot_ID_198959

SEQ ID NO: 35774 - DNA, 3003 bp, Unknown
  misc_feature (1)..( 3003): 2750-1469P.txt file - cDNA_ID_3090447; gDNA_ID_1621096; Annot_ID_171012
ggcacacaaaaagttcatgtatgtttacgaaaaccaagaggttgttagtatatttttttttatggaatttctctaagatcttaatattctttgttagtttctttaacaaaaaaatatatattctttgttagtgtgagtctataagtattaagtagtcttggaataactcttttgtaaagctcttcatatatgttttgtaaagaaatatttctatgcttttaagcactcttcaaggtatagaactagaagttttgacagttttataaaaagtcaatggcttaataagttaatattgacagtattatcaaaagtcaatgctatatgtaattagcttatttgttagttctaaacgcgttatgtcataatttattattaaaaagtgatcaacgttgggcatttggtctagtgatcaaaattttgcagatgctgcaattaacaagtctcaataactgagttttctaagtgattatctttctctcaggcatatcatcgaacaacttacaggcatccaccaaagtctaccaaagaagagctttttcttggttatcctctggagaagatgagttcttatgagattgggcatataaatctgatctgggcacaagccgtcttcgaagttcatggcctacagagaaagaagaaataaccaaaaattgacgtttttgtctgttcggttaattttgtctctttttgttgtttgagtcaacatcaacaaggtatattttttatgtggtgagtcattgtcattgtcatcatcatcatcatcagcagcagcagcagctccttcacattgtaaatagtcatacggtaacgtgttctctctagaaaccaaagacatcaaaggaaaatttagaattgataaaaaaaaaatatggatacaattcgatttttttcttgtagctctctccctcaagacataatcctgaagatcggctcttctcttcaggtttttgcttgtattttttttactaattcttcagttttttttttattgtgatgctacttcttggtaaattgtgtgctatttgatgaataggtgattgatctttgtgcattaagtagctgttctacgttttggagagagttatgtggttctgatatcttatgggaacctctgtttaggcaaagatggcctttattgtcctcatttgaatctgatggagacaatactctgtttctttaaacccaaaccaatgaaaattctcaggtagaaatgagacagttccatggattcttgtttctttcaaattcaagtttctgagttgttttagattttggccatttttgtaggatagtgagtttgtttgttgttgaattgaattctatttatgatgaattggttctcattagatggatgatgtttgattgacatggtagagaacaattgtttagttgagatatttaacaattgttctgtcttggagaaacaaattactgaggcatattgaaggtgatgtgattcttgatattatctgctttaattgtggatagttggattatagaaagcttgagacttttttcttgaagaggtgatagttggaattggacatggtcatcataatcgtttatatatctcaacttgcagttagactttgcttgtttataatttgttgttgtggcagagactaaaattctttgttgttgcgttagcattactttgaggtctattacaggtttcatgaatagtctattttaaagcttttgtaggaatggagaagattttatgtgatgcaacacaaggaaatggcatcaagagcttccgaggtgattaaatatgtgactaagtctcctgctacgttgtctttagaggcaggtatatatctgcacgcggttgaaaccatgagctcgatgcggtttggatttcaagatgtggagttatttttcttcaaaccaaacttaagtgtgctgctcaacctcattggactcatttactgcatacaacacttgaaaccgcgggttagttactcccagagaaagtcgaccggcctttcggaacattttctaacttctttaacattttctttctgcagcgagagcaagtcgtggatgtgctaaggcaatgtggaatctcagagcagctagtttgggtgaaatggttaacgttaggtcgatggtcaggtgggagtcgaatgagagacgacatcgtgtcgcgtcaggtctctctagtcgatgttgtaacagggaaagaagaaacggttctacgagtgcttcaacgaggagttgttcacgaagttctacgtgtttgtatctcaaccgttgatcttgcctgtgcaccttgcagcagtagcaccatcagaaactactaaactgtttcaaggattcgaggattacaagttgaattggattcaatgaatgtgattaaacatgtgatattgaaacagtattgaagttcgagtaaataataacaacgcgcaattcaaatgcaaacgattgtatggagaattaactgtaagaaattcgcggtaaaaaaactgaaattataggattcatatattgggccttagtatattttcggcccattaccaaaattatcttaaacaagtttgagtcctaaacccttttctccggttacagctacaccgccgttttctctctccgccgtcttttctcttcttctccgactggtaaaaatcctctctccagaactctggtctcccgttatatatatatgctcgtctacattctccaattgcttctcgagttcttagctcatatcagtcacatgttgttctctgtaaattcaattccctaatttcaatttgaaattttctctgttggtgaaaaggctctgctatttgattaggttgatgcatagtaattcgatttcgaaactctgcttttaattccatagactatataatggaaaagatgatgataacaagttacttgactgatgattatacaatcacattatgcttatgctaaagtttttttttttgtatgttcatgtagaatctgtgaaggtgaatttcggagttgagaaagagagattagcgtgtaatg

SEQ ID NO: 35775 - DNA, 3003 bp, Unknown; identical to SEQ ID NO: 35774
  misc_feature (1)..( 3003): 2750-1469P.txt file - cDNA_ID_3090447; gDNA_ID_2926164; Annot_ID_198954

SEQ ID NO: 35776 - DNA, 3000 bp, Unknown; identical to SEQ ID NO: 6577
  misc_feature (1)..( 3000): 2750-1469P.txt file - cDNA_ID_3090457; gDNA_ID_1621097; Annot_ID_55740

SEQ ID NO: 35777 - DNA, 3000 bp, Unknown; identical to SEQ ID NO: 6542
  misc_feature (1)..( 3000): 2750-1469P.txt file - cDNA_ID_3090457; gDNA_ID_1621097; Annot_ID_171141

SEQ ID NO: 35778 - DNA, 3000 bp, Unknown; identical to SEQ ID NO: 6577
  misc_feature (1)..( 3000): 2750-1469P.txt file - cDNA_ID_3090457; gDNA_ID_2926165; Annot_ID_139882

SEQ ID NO: 35779 - DNA, 3000 bp, Unknown; identical to SEQ ID NO: 6542
  misc_feature (1)..( 3000): 2750-1469P.txt file - cDNA_ID_3090457; gDNA_ID_2926165; Annot_ID_199075

SEQ ID NO: 35780 - DNA, 3000 bp, Unknown; identical to SEQ ID NO: 6615
  misc_feature (1)..( 3000): 2750-1469P.txt file - cDNA_ID_3090467; gDNA_ID_2926165; Annot_ID_199083

SEQ ID NO: 35781 - DNA, 3003 bp, Unknown
  misc_feature (1)..( 3003): 2750-1469P.txt file - cDNA_ID_3090480; gDNA_ID_1621097; Annot_ID_171108
ttatatttagttacttaaaatttagttttagttttgtggtattttcagaaaaaaaaatagttttatttttgaaaaagaaacatagtgatggtatttttggaacaaaaactcattttactagtattttaaaattaaccatatttatatatgtctagagaaagaaatttaaatttgacgacgaaataggattacaaaatggaagatttctttttcgaaaaagatttgtagatcatgtttatcatataatagtataatgttatatttaatagatctttctgtaactgattgaagaatattactctgttatgctagtaacttttctttcccttaatttgttacttcgtatatcttttttttttataagatacttcgtatatatcttacactactgcgattaagctttttctctctgctctgctcttcgtgtaagtgttcttttctaaattttaaagattgacttttagggttacagtttactggtaaggtgatgtgagatttttggtgttacgatttaatctataggtttgtctaataatattatggttttatattatctttgtttgataatttgacctgtgtcatgtctatacgattatttgtgtcatccttaagatccgatatacttgcttaatctttaatttccgtagtttgaaggagatagatatgtccgagatcactaataatgaaacttctggagaagggactttaactaacaacgtgaatgattgtggttagtattttgattgttttattctcaaatgactctagtattttagttgatgtaccacaagtatgtgttttcgtggtgtttaaattacttgatatcgttacattacataggatcaaatccttctgaactatatgggacatttacatggaagattcataaattttcacaaatcaatgagcgatccgtagcaatgtttttgagattggtggccaccgatggtaaatgacatcattttcataataataaagttgaaactttctgaatatatatgttttttgtttgctttattataatcttacctatgactatgataggtatttgttaatttatccacgaggggttgatgtttccaactgtctctctttgtttctctgtgttgcaaactacgaaaaacttcttccaggtgagtattgtaatgtataattttcactttcttgatttgcaaacctttatcattatataagtttaacattttgagacaggttggagtcatttagctcagttttctgtagctgttgagaataaagatccgaagaaatcaaagattgcaggttattttctgcatcttttactttagcttgaatccgcaatagcgcaaacaaactgaacacgttccttcgcagatacgttacaccagttttggaagaaagagcatgattggggatggaaaaagtttattgagttacctaaattacaggatggattcatagataagtttgactctctttcacttaaagctcaagttcaagtgattaggtaaatgccaagatttagagtctcttgagtgatatatatatatatataaccacatttttccatgcaaccattaacatacaaccaacttttctcaactcttgtagagagtgtgtgaaccgaccttttcgctgccttgatggtcagtataggaaggaacttcttacggtttatttggaaaaagtggagaaaatgttcatgagctttgtggaagagaaaagaagcaagcttatgaaggtgatagacgacaaaaagagatggaagaggtcttttccctaatagtttgagcatgttgcgaatcattacaagaaaataagttttagttcattttttctggtgcagcttatgtgtctttggttagggatggaccataatgcgaggctcgaaatatctagcgagaaaatggatgtgattctgaaacaagttgtgaaacacttcttcgtcaagaatgaagtaacatccactcttttgatggatttcttgttttataggttaaagtctcttgaagaaaaacgcagaaggctcgaaacacttgtaagagtggtcgcaaaagaagtgatcaacagtaaccaaagtgaatccgctatgaagaatcttgaagaggaaactaagaaagagagaacaaatgatgacaaagaattcgctttaaagattaatgaagacgaaactaagaatgaaagaacaattgacgccatggaatttgaagcttcaattgcttatgtggtcaacgatatgcttggtgttacagatccgttgttacgtctagagagatttgttcttgcaccattgcctgaaatgggttctccaaagcttctgcaggttagtctcctatgtctcaacgttaacgtctattagaagttattggtaatgttttctttaaggaatttatttcatgtgactttaggtttccaatctccgtatacagcataatatggaacccgatgagaagcaattagctgattatggtagatgggccttggaggtatttgttcttgaccatatattctgcaacaaaattgaattcacatatgaagaaactattgcattgaaaaggcaagaagaacttattcatgaagaggaagcagagaagaacactaaactcaaaaaaacatttgttggtaaaaaagtgaactaattctttttagtgttttattcctaggctgctctggttttaagactttttaatataagctttctatcttttaactatgtgattaaagattatatatggtggttgtgtttcttttatttttctttaaattaatgctacatacttataaatttaaggttatgttcaatcttgtcactatcctactggcgttaagtcttcgctcacacgtcacacactgcaaagcactgaaattatttcttaattagtgaaaaggtttggggtatgttaacaaataccaataaataaataaaacatatatagtacatgttcctccacctgtcacaggcaacatttgctttcaaaagcaaagaagcattttttcctccattttcttcttcttctccaaatg

SEQ ID NO: 35782 - DNA, 3003 bp, Unknown; identical to SEQ ID NO: 35781
  misc_feature (1)..( 3003): 2750-1469P.txt file - cDNA_ID_3090480; gDNA_ID_2926165; Annot_ID_199044

SEQ ID NO: 35783 - DNA, 3003 bp, Unknown
  misc_feature (1)..( 3003): 2750-1469P.txt file - cDNA_ID_3090493; gDNA_ID_1621098; Annot_ID_171232
caaggtagaaatgaaaagagaattgcattactaattcataaacttatgactactctgttaaattgtttttagtttggaattttcatgatttaatttctcatcatttatatgttaaaactgtgacttgaccttcaagaaaaatcattatatcttaaaatttctatagataatttcaaaatgtaattctgtctacatagttcatctttttatatgtatgagacagttggtggagcaagacgggattaacaaaacacctcgatttcgttagagatcgaataacggagggttatttctcgagtgttggagtaatgtatgagcccgagtttgcatatcaccgacaaatgcttacaaaggttttcatgctcattacaactatcgacgatatatacgatatttatgggacacttgaggagctccaactattcacgaccatagttgaaaagttactattaataccttgcaaaataatatcaaactatttcactctatatctatttgcttatttcttcagtgaatcgatatatcatgcagatgggatgtgaatcgtcttgaagaacttcccaactacatgaagttatgttttctctgcctcgtcaacgaaatcaatcagattggatattttgtactcagagataaagggtttaatgtgattccttacctcaaagaatctgtacgtattctcatcattttatctatgtaacaatagattttgaaatattaatttgttggttcattcaaagttagctataaaaatgaatatacactataatatacatatattgtagtgtgcagcaatagattatcaaccggaaagtatattgtttaagtttaagatttttttcgaagatttcttaaaaaacataaatgaatttcgttttcttttctcatttttttgtcaccaagactttttattaataaatatgaatatttctaaactttttctctacatctcttgataacttagttttttctttttagtgggcagatatgtgtacaacgtttttgaaagaggcaaagtggtataaaagtggttacaaacctaacttcgaagaatacatgcaaaatggttggatctcaagctcagtccctacaatacttctacacttgttctgtctcttatccgaccaaaccttagacattcttggctcctacaatcactctgtagttcgaagctccgccaccatcctccgtctcgctaacgatctcgccacttcttcggtcagtcatggtttcacaacgtacaatactgtaaataatttattgacagatcaaaggcgattatatctaagcaaactttttcagactaaataaacaaagtcaaccaacatatggggactcacacatgtgtttcaaagttatgctcaaagcggtcctataaatatagttattttaacaggaggaattagcgagaggcgacactatgaaatccgtacaatgtcacatgcatgaaactggagcttcggaggcagagtcacgcgcgtacattcaaggaattatcggtgtggcttgggatgacttaaacatggagaaaaagagttgtaggctacatcaaggtttcctagaagctgcggctaatcttggacgtgtggctcagtgcgtttatcagtacggtgatggccatggctgtcctgacaaggctaagaccgtcaatcatgtccggtccttgctcgtccaccctcttccactcaattaattaattagtttctaataataagtcttaaatcacacaagtattggattagacgctcaaagagttgagagatgcatatgtattctctactcaaattatataatgcatgtaaacatttgttagtttttatcaacatcaagagcttgtaaaatcaagttagatgaatattttgtatatgagcaaataatattcacttgatcagtatatactagtgcttatataagaaaagaaaattcctatatacagttttaacatttcgagcaaaggaatcagcataaatgtaagctatgtgagataaagataatttgaaaagacgaaaactgattttggaggagtagacacaaaatttgatcggaaaatggagataaacagagcattgtctacaaacaaaactaattaatagcttagcgtggaaggccgacaaacaacgtcaagagcccttcaatcccatgtggtagcaaaatgtgggtagtgtctagaaggcaccatccaaagccattttgtcgtgtgcattgcttcctaggaaatgtcaactcaacgacatatggcagaagaatcttcgtttcacaatctctttaatacattacttaatttcgtttcaaataaactttttgttatcactatctcactaaaccaacaactcttctttttcttttccggcatttcaattctatgatgttttcaaacaagtgatggacaatttacaaaaataaaacttttttttttttgccaaacaaaaagaaaacttattcatggaaataaacaaaaaaagacaactggttgccattgaattacgccagaagggtttagactgacgtagtacacacgtcagcttacactaaaaaagatccgattctaattattcctaaaattggaataaattaagggaaaggttaattttaggcaacttaagctaataatacggagggaaaatacataacattaattaccgttaccatctacttaaccataacctccttccacatctctccctctggatcgagaaatctccgatccattcttctccgtctgccaaaatccccacttcacgaatcgcaaaagatcaaggtacgtacatacatgtccctttctagaattagggtttttgtttttgcagttagtactagaatctcaaatggatcttttttttttggatgatcaggtttattgatctattgcgaaattagggtttgtgaattcgaatcggagattaataatagattttgtgatggagtgttcatcacgcatagaagaatcttgatttcgatctcgatgaaattaggaatcgagggattttatttataattgagatg

SEQ ID NO: 35784 - DNA, 3003 bp, Unknown; identical to SEQ ID NO: 35783
  misc_feature (1)..( 3003): 2750-1469P.txt file - cDNA_ID_3090493; gDNA_ID_2926166; Annot_ID_199162

SEQ ID NO: 35785 - DNA, 3003 bp, Unknown; identical to SEQ ID NO: 32076
  misc_feature (1)..( 3003): 2750-1469P.txt file - cDNA_ID_3090500; gDNA_ID_2926166; Annot_ID_199155

SEQ ID NO: 35786 - DNA, 3003 bp, Unknown; identical to SEQ ID NO: 32077
  misc_feature (1)..( 3003): 2750-1469P.txt file - cDNA_ID_3090504; gDNA_ID_2926166; Annot_ID_199150

SEQ ID NO: 35787 - DNA, 3000 bp, Unknown; identical to SEQ ID NO: 6592
  misc_feature (1)..( 3000): 2750-1469P.txt file - cDNA_ID_3090508; gDNA_ID_1621098; Annot_ID_171219

SEQ ID NO: 35788 - DNA, 3000 bp, Unknown; identical to SEQ ID NO: 6592
  misc_feature (1)..( 3000): 2750-1469P.txt file - cDNA_ID_3090508; gDNA_ID_2926166; Annot_ID_199148

SEQ ID NO: 35789 - DNA, 3000 bp, Unknown
  misc_feature (1)..( 3000): 2750-1469P.txt file - cDNA_ID_3090513; gDNA_ID_1621098; Annot_ID_171217
aacaataataaactttcaagtccttttgattcttgttgctgaaaaagctgatttgtttctttggaatggttgcaggattcacagtatgattcagaatcttgcacagtttactgatatcaagtgtggattgattgtaggagggctttctgtaagggtatgtatttatctttctctaaggatgtatttgtctgtgtacactatttgatgtttgagaacaagcttattttctctctgagaatcgtttcttaaaatgggaatagcaagattgctaaaatctttaatgtttcttgtgtaaggagcaagaggtggttctgaggtctatgccagatattgttgtggcgactcctggacgtatgatagatcatttgcgtaattctatgtctgttgatttggatgatctagcggttttaatccttgatgaggcagaccgccttctacagactgggtttgccactgaaatcacagagctggtatctttctgatttctttgcgtttatctctttcgtacggtcggttcctgtgacacctagtattgaattgtagtcaataacttcttgtctttgttagtttctaatctgaagaagtggacactatataatttgacttaacaggagagattatgttatgctgttcgttatttgatttatatttgagtccacatctatatgcaggttcgcttatgtcccaagagaaggcaaacaatgctcttctcagccacaatgactgaagaagttaaagagctagtcaaactttccttgaacaaaccgttgcggctctcagctgatccatcagctagaaggccaccaggcttgactgaggagtatgtcagccactacttatcattttcaaccttttcaagagccaaaatatttatccacaaatagcttatgaatatacatcatgtatgccaattagctaactcgtgatctcctaactgtagggtggtaagaatacgcaggactcgtgaggcaaatcaggaagctgttcttctatcattgtgcacaaggacttttaaatcaaaagtcattatctttaggttagaagccactataaatatgatgcctttcaaatccaagttccataaagtgcttgcatagtttggcattttgtatttcagctgagagaattttttgtcccttcttgcgccagtggaacaaaacaagctgcacatagactgaaaattttattcggattagctggcctcaaagcagctgagcttcatggaaacctaactcaagcacaacgtcttgatgtaagaaacttgggcacatcagctttatttgtacatgaatatttctgttctctgtttgcaagtacttaatggtatcattttgcagtctctggagcttttcagaaagcaggaggtcgattttctcattgctaccgatgtagccgctcgagtaagtataagaagcaaaaaacttattttcaagattctcttctcagtagctctgctatttaacctcttgaacactgtctgctttgatcattccagggacttgacatcattggtgttcaaacagttataaattatgcttgtcctcgggaaatagacaggtaaacaagatatatttcctgtattatgattaaattaaaaagctactagttttgttctctttaactgatgtgaggacaatatgttttcctttgattttgcagttatgttcacagagttggtagaacagctagggctggaagggaaggttatgctgtaacgtttgtgactgatagtgaccgatcccttttgaaagtcattgtaagtgaatcatcagacatacatggatcttgcttttacccaattcattatcgctttgtttagacatttgaatcgactttgtttctttgtttaaaggcaaagaaggtgggttcaaagttgaagagccgagtcatcccagagcagtcaatcgtcaagtggtctcagataatcgatgaaatggaagatcaatattccgctgttatttcagcagagaggtttcattcacactcatcaaagaattatggtatcccaggagaattggttgatctgtatacttaagctttgaggtgttttcatcaatttcagggatgagcgagctctaaggaaagctgaaatggaatttgcaaaggtaggcagctttggttcttgtctttgttcaattattgtgggaataatttcaaattcgtgattatgggcttgtttctgcaggcggagaacatgcttgagcacagagatgaaatatatgcacgcccaaaaaggacttggttcatgacagagaaggagaagaagctcgtggcacaggctgaaaaggtgttcttttaatttcctgaggttgttgttgtagagagagggatacacttgtctgaatcattctttatactttctctgaataggattctgcagggaaccctgctggaggcgaactagttagtgctgatagagcagaggacctcaagatgaaggagaagagaaaacgtgaacgcgaggtctgtttatcaagaagctcttcactattcagttgcattatcgttctagtttagtgttgattgcttcttcctagagaacttacaattctcttgaccatgcaagtacagaagaatcttcctaggaaaaaacgtagaaagctagaagctgccagagagatgctagaagataacgaaggagaagaagaggaagaagacgaagaaggagacgaaaagagaggaagatcaagagtaagtatttcagagatacacatcactctctctctctctctctctctctctctctctctctctctctctctctcgccgggatgacaaacattgtattgattttaaatgtgtgttttttttcaggggaaagacaagaaaaaacaggagacagataagaagggattgacactaaaggatcttggttacatgagagcaaaagcggtgaaagcaaaacagagagcaattgattccggtaagatggagagaccaaagccggacaagaaacaaagccggagtaaaccaagaaaccagcctcgtggtgaagagatg

SEQ ID NO: 35790 - DNA, 3000 bp, Unknown; identical to SEQ ID NO: 35789
  misc_feature (1)..( 3000): 2750-1469P.txt file - cDNA_ID_3090513; gDNA_ID_2926166; Annot_ID_199146

SEQ ID NO: 35791 - DNA, 3003 bp, Unknown; identical to SEQ ID NO: 32080
  misc_feature (1)..( 3003): 2750-1469P.txt file - cDNA_ID_3090521; gDNA_ID_2926166; Annot_ID_199131

SEQ ID NO: 35792 - DNA, 1696 bp, Unknown; identical to SEQ ID NO: 6631
  misc_feature (1)..( 1696): 2750-1469P.txt file - cDNA_ID_3090553; gDNA_ID_1621099; Annot_ID_171312

SEQ ID NO: 35793 - DNA, 3000 bp, Unknown; identical to SEQ ID NO: 6683
  misc_feature (1)..( 3000): 2750-1469P.txt file - cDNA_ID_3090553; gDNA_ID_2926167; Annot_ID_199232

SEQ ID NO: 35794 - DNA, 3000 bp, Unknown; identical to SEQ ID NO: 6623
  misc_feature (1)..( 3000): 2750-1469P.txt file - cDNA_ID_3090557; gDNA_ID_1621099; Annot_ID_171311

SEQ ID NO: 35795 - DNA, 3000 bp, Unknown; identical to SEQ ID NO: 6623
  misc_feature (1)..( 3000): 2750-1469P.txt file - cDNA_ID_3090557; gDNA_ID_2926167; Annot_ID_199231

SEQ ID NO: 35796 - DNA, 3003 bp, Unknown; identical to SEQ ID NO: 18023
  misc_feature (1)..( 3003): 2750-1469P.txt file - cDNA_ID_3090561; gDNA_ID_1621099; Annot_ID_171308

SEQ ID NO: 35797 - DNA, 3003 bp, Unknown; identical to SEQ ID NO: 18023
  misc_feature (1)..( 3003): 2750-1469P.txt file - cDNA_ID_3090561; gDNA_ID_2926167; Annot_ID_199228

SEQ ID NO: 35798 - DNA, 3003 bp, Unknown; identical to SEQ ID NO: 32087
  misc_feature (1)..( 3003): 2750-1469P.txt file - cDNA_ID_3090564; gDNA_ID_2926167; Annot_ID_199225

SEQ ID NO: 35799 - DNA, 3000 bp, Unknown; identical to SEQ ID NO: 6629
  misc_feature (1)..( 3000): 2750-1469P.txt file - cDNA_ID_3090568; gDNA_ID_1621099; Annot_ID_171300

SEQ ID NO: 35800 - DNA, 3000 bp, Unknown; identical to SEQ ID NO: 6629
  misc_feature (1)..( 3000): 2750-1469P.txt file - cDNA_ID_3090568; gDNA_ID_2926167; Annot_ID_199222

SEQ ID NO: 35801 - DNA, 3003 bp, Unknown
  misc_feature (1)..( 3003): 2750-1469P.txt file - cDNA_ID_3090572; gDNA_ID_2926167; Annot_ID_199221
tgaaaagccagaagattctccttaatgatttaacaattgttacttgctcagaaagcaatatgataaagtgatttttaccagtcaaaataatttggactttatctattcgtaagtatatacaaggagatgattatgggttaatcacccactgtatgacatttagatacctaatggctataaaagatgcatcgattcaatggacgcattgactcgattgttgcatcgactagaaggtcatatttatccttgttataaacccgcaacatagagtttgcgaggttactttcttgattaaaatacaagagtattccagtgtttatttattataaccattattggatatccgttgggataagtgtttaacattttgaaattcatgttcatacacaaaatggtttagtaatatcgatatgcatcaagccaatgaataattaatagttttccccatcattattggttttggatcagaaaccaaatagttttcatctaaaatctttgaatgtgaaaagtgctccaccacagcacgctgagatgaaccctcaaaggaggataaggatacatgttggatatgaatgataactaagccatcctagaaagatttatataccgctcgttttgaagactatcatattatatagtcagatattccaacataagggggagaatgtatacagctggtgaaaaaaagataaaaagaaatgaattatcaatgatcttcggagtaaagaatgtatattaagagtccaaaagataattcaattacagaatttagcgttgtaattgccagaggcatttgctgacccaaataaagtgatgaagtcacctataccagttgtaaattaaatgctctagaatataatgaatgtcctgtaaggaccaatttcaaactgctattgagtcttaagatcgcatgaagcgtaatagaccttggttccaaatataaacatcctcgtaaaagtgaaggagcacaaaattaaaaatgaccaaattgaggaaataaatattttgatgatctcttgaagagagtgaatgatctctaaaagagacataaacatgacaaatgaaacattcaagtacttgacaatgaagagatctagctagttatgtcatgtcaaaatataatggaatcaaaagcaaatcgacgtcgtaatatatttgcatgctatgagcagttgatattatggacaaaaaggaggatcatgaaagaaagtctattgaaaagtgtacacaaagtaatgattagccaaaaatggaaaagaagaaatagacatataattataatctctagtagagatatttgtactagtagtctatgcacatgatgtgtaaaaccagtggaagataaatgagtctttatgtgaaagaatagtgaaattaatgagattttcacaagataagaaatgtattatgaagagatatattctcttgtggtggatgtaatatttttaagtatctaaagtctgacaataagagacagaacactggatatgacatttatatgaaattattgaaagatataatctctgaaggattaattatatgagaattatgttctctagaactctactcgatcgaataaaaagaaatatgtaacatgacatataatcatataaatgtatatttatgttgagtttgtcaaaatatattgatcaaactaatatttgttttgaaaatcattaaaactcgtacagagttatcataagtaatacgatgacaataatctatgataaaatatcactagataatgatatttataagtctatatgaaaaccatataattttgatcattaagattatggttattaattccaacgagatattgtatttgattgaaaatcatctccttaagaagatgtttccgagggggagattgaatgatatgcgtggatgtaccctttttccttatcatagtttttatcccacatgatttttctatgacaaagtttttaacgagacattaaagaacacgcaaataatacacttgatgaatattaagaaattctatcaatcatccaaatgaatattatacactaatgatatttagagaaataaataagatggtcaagatgaatcatctaaaagattcatgagcagaagaatgacgttgtactttatccagaaatttgttcaagagaagatttggcagacttattctcaaatactgtttattctctgccacatcttctaatcatgcagagattttactaattcatgaagctagccgcgagtgtgtatggctaagatccatagttcaccatatacaagaagactgtggtatgtatgcagggaaaaaaactccaacaattatgtacgaagacaatgcagcatgcatcgcacaactcaaagacggatacatcaaaggcgatagaataaagcacatcctaccaaaattcttttacacacacgatctacaaaagagcggcgatgtacgagttctacagatccgttcgaatgataatctggctgacttattcaccaaggcgctacctactgctactttcaagaagttagtctatcgtatcggattacgccgtctcaaagatctcgacgaatatactcataagggggagtaattgtatgttgcactctttttcccttaaccaaggttttcctattgggttttcctggtaaggtttttaatgagatagcatttcaaatactttacgagttatggtactataatggtcatcaagggggagtgttatgaataaagatggatgcccattataagacccatcatctaagcccatcatttagatgtttgtagagttttacctttttcttgtactcctatataaagaacccttttctcaatagaaaacacactcatttcttctatctctttctcaagagaaatttattttcaacggatacttgtgacttttggagactcgagaatctaaacaacggcgatctacaaagataaagagttattgagctcactatgccaagttctgaaaaggcccacttcaaattataaaggcccagtttaagcccactatg

SEQ ID NO: 35802 - DNA, 3003 bp, Unknown; identical to SEQ ID NO: 18031
  misc_feature (1)..( 3003): 2750-1469P.txt file - cDNA_ID_3090576; gDNA_ID_2926167; Annot_ID_199219

SEQ ID NO: 35803 - DNA, 3000 bp, Unknown; identical to SEQ ID NO: 18033
  misc_feature (1)..( 3000): 2750-1469P.txt file - cDNA_ID_3090582; gDNA_ID_1621099; Annot_ID_171290

SEQ ID NO: 35804 - DNA, 3000 bp, Unknown; identical to SEQ ID NO: 18033
  misc_feature (1)..( 3000): 2750-1469P.txt file - cDNA_ID_3090582; gDNA_ID_2926167; Annot_ID_199215

SEQ ID NO: 35805 - DNA, 3000 bp, Unknown
  misc_feature (1)..( 3000): 2750-1469P.txt file - cDNA_ID_3090586; gDNA_ID_1621099; Annot_ID_171288
atgggaaggcatccaggtacattgttaatgctatgctgatttttgtttaccttctgttatataactaattaagtatacccaaatttgtttttatggcttgtggtcgatccacggttatgtcttacatacatacgtaataatgtttaattataattttaaacatatataggtataaaattaaaatgattatcatcgataatgtttttttcagtcgcttggaagtctcgaagagatggatctgtcagaatctgaaaacctgacagaaattccagatctttcaaaggccaccaatctgaagcatttatatctcaacaactgcaaaagtttggtgacacttccttctactattgggaatctccaaaaattggtgaggttggaaatgaaagaatgcacagggctggaggttcttccaaccgatgtcaacttgtcatctctcgaaaccctcgatctcagtggttgctcaagtttgagaacttttcctctgatttcaaagagtatcaaatggctctatctggaaaacaccgccattgaagaaattctagatctttcaaaggccaccaagctcgagtctttgatactcaacaactgcaaaagtttggtgacacttccttctacaattgggaatcttcaaaatttgagacgtttgtacatgaaaagatgcacagggctggaggttcttccaaccgatgtcaacttgtcatctctgggtatcctcgatctcagtggttgctcaagtttgagaacttttcctctgatttcaactaatattgtatggctctatctggaaaacaccgccattggagaagttccctgctgcattgaggatttcacgaggctccgtgtactactgatgtattgttgccagaggttgaaaaacatctccccaaacattttcagactgagaagtctaatgttcgccgactttacagactgtagaggtgtcatcaaggcgttgagtgatgcaactgtggtagcgacaatggaagatagcgtttcttgtgtaccattatctgaaaacattgaatatacatgtgaacgtttctggggtgagttgtatggtgatggtgattgggacttaggtactgaatattttagcttccgtaattgcttcaaattggatagagatgcgcgagagctcatcctacgatcatgcttcaagcctgtggccttaccaggtggagaaatccctaagtatttcacgtatcgagcttatggagattccctaactgtcactttacctcggagctctctttctcaatccttcttgcgatttaaggcttgtctcgtggttgaccctctctccgagggcaagggtttttatcgatatttggaggtaaactttggcttcaatggcaaacagtatcagaaatcatttttggaagatgaagaactggagttttgtaagacggatcatctgtttttctgttccttcaagttcgagtctgaaatgactttcaacgatgtggagtttaagttttgttgctccaataggatcaaagaatgcggtgtacgactcatgtatgtctctcaagaaacagagtacaaccaacagactacgagaagcaagaagcggatgcgggtatcttttgacttttgattagagctgaaaattataaagctatattttgacttttgatttgattttccaggatcgaaataccatagagacagactatttaatagaatcgatcgtttgatttataatgcagatgacatcgggaacatctgaagaatatatcaacttagccggtgaccaaattgtagcagacacaggattggccgctctaaatatggagctttcgttaggggagggagaagcatcatcatcaacatctctagagggggaagctttgtctgttgattatatgataactaaagaacaagatgaagacattcctttcttggatcctgtttctggtaactgaagcatcttatcattctgttttggtctgttttaggataacttgggatcgaccatgattatatatctataatgataacaagacgatttcataggttttgacacaagccattttttattgatagatggtacatggagatcattttattctgcagaatgatatttggagaaccaaattccgtttaatcatccaactccggagcctgaaagtgtttgtaatttcttctttatctgaatgcagaaacactctgtttgctttgaacattttgtctgccttttctttgaaacatagatctcaatgtgtatattagcacaggttgtttttctctttattagcaatgaatagagaaatcagactttgcgtaaacaaaaatgtatatcgcaaattcacaaaagaattgacaacaagagtgtgttggaactaattttaaatagcaagatccttgtcatcaacaacatttgcattgctgattcaatagccaaaaggcagaagcgtttttggcctaactttggccaaagatgtgaccagcataaggaacaatccatcagctgaaggaaagagcttttaaactttctgcaggagacattgtctggtccacttccaaaccatgaagtatcatccagctatcctacgtcgatgagaaaacatgtcgctgctgttcccccatcccgctgcactctttaattatatgataaagagtgaaagttgtaggcctgaactactcactagaacatctaggataggaagctcattctctggggctgttcttgactgaattggtttgcttcagatctttgcatcgagggcctaagatgatagacgtttggtctgatggggacgacacctttcactgctgaccctgatcagttaagatctgccttgactgaattcacaccatcacattgttaagattcctttcctggatccttagccgtctccacagcttatcacattgttaaggtgacctgaaacgtattacaactctgtttcataatgaacatgggatcgaccatgactatactggtaatgacaagacgatttcttagtttttcacacaagccattttctcctgcagatg

SEQ ID NO: 35806 - DNA, 3000 bp, Unknown; identical to SEQ ID NO: 35805
  misc_feature (1)..( 3000): 2750-1469P.txt file - cDNA_ID_3090586; gDNA_ID_2926167; Annot_ID_199213

SEQ ID NO: 35807 - DNA, 3000 bp, Unknown; identical to SEQ ID NO: 6634
  misc_feature (1)..( 3000): 2750-1469P.txt file - cDNA_ID_3090590; gDNA_ID_1621099; Annot_ID_171284

SEQ ID NO: 35808 - DNA, 3000 bp, Unknown; identical to SEQ ID NO: 6634
  misc_feature (1)..( 3000): 2750-1469P.txt file - cDNA_ID_3090590; gDNA_ID_2926167; Annot_ID_199209

SEQ ID NO: 35809 - DNA, 3000 bp, Unknown; identical to SEQ ID NO: 6636
  misc_feature (1)..( 3000): 2750-1469P.txt file - cDNA_ID_3090594; gDNA_ID_1621099; Annot_ID_171280

SEQ ID NO: 35810 - DNA, 3000 bp, Unknown; identical to SEQ ID NO: 32094
  misc_feature (1)..( 3000): 2750-1469P.txt file - cDNA_ID_3090594; gDNA_ID_2926167; Annot_ID_199206

SEQ ID NO: 35811 - DNA, 3000 bp, Unknown; identical to SEQ ID NO: 6637
  misc_feature (1)..( 3000): 2750-1469P.txt file - cDNA_ID_3090604; gDNA_ID_1621099; Annot_ID_171277

SEQ ID NO: 35812 - DNA, 3000 bp, Unknown; identical to SEQ ID NO: 6637
  misc_feature (1)..( 3000): 2750-1469P.txt file - cDNA_ID_3090604; gDNA_ID_2926167; Annot_ID_199203

SEQ ID NO: 35813 - DNA, 3003 bp, Unknown
  misc_feature (1)..( 3003): 2750-1469P.txt file - cDNA_ID_3090615; gDNA_ID_1621099; Annot_ID_171274
gcaacactcacacatcgactttgattccgacgaagccgctctcagtttctcccgcgagaaaaaccaacaaagaacatctcagaaaccttgagaacgttcttagaacttcgtcaaactctatagatcatatcgaaaatgtaacttctcgtcaagagaagacgacgaagaatacatcgacgtcatcacttctcggaggtttgaatttggcgcgaatatggcctcagatgaaagcagccgtcgacgaaatgtcgccaaagaatctgaaacggctccaaaggcttctctcaaagtcatccgaggaacgttcgccgaagagtaaactcgggtctaaatggcgggagctacacgggttaaacaactgggccgggttgttggatccgttagacgagaatctccggcgagagcttgtccgctacggagagtttgtacaagcggcttatcacgcgtttcactcagacccggaaggttcgccgagacacgtggcgttacctgatgggtcatttaaagtgaccaagagtctttacgccacgtcatccgttcgtttacctaaatggatcgatgacgttgcaccggatctccggtggatgactaaacagacgagctgggttggttacgtggcggtgtgtgatgatccgagagagatccgacggatgggaaggagggagatcgtcatcgccctccgtggaaccgccacgttgctcgaatggtcagagaatttcaggcccaatctcgtttcaatgcctgagcccaaacccgatcaatccgacccgactcgacccaaagtggaatgcggatttaatagcctctacacgacgggtgaccaacacgcaccaagcctcgccgagtctttggtcggcgaaatcagccggctcgtcgagctctatgcaggagaggagctgagtatcagcgtaaccggccacagcctcggcgccgcaatcgcgcttctcgccgccgacgacatcgccgagcgtgttccacacgcgcctccggttgcggtgttttcctttggtgggcctcgagtcgggaaccgtgagttcgcggatcgtttggattcgaaaggagtgaaagtcctccgcgtggttaacagccaagatgtggtcacgaaagtccccggaatattcgccgataacgataaacaggggcaaagtcgtaataacgggagaagtccagggggtattatggaaatggtggagaggaacaatccatgggcttactcgcatgtgggagcagagctccgtgtagacatgaagatgtctccgtacttgaaaccaaacgctgacgtggcgtgttgccatgaccttgaggcgtacttgcacttagtcgacgggtttttggcatctaactgtccgtttcgggcaaacgcgaaacggagtttaaggaaactgttggatgagcaacggtcaaacgtcaaggttttgtacacaggaaagtctttaagacttaaccgtacttttcatgataacggagatgttttgcctagtccgtcgtcttcatgagctttgatttattaaagaaaaaagatttgttctcttttaatactttttaagtatttgtttattttttctaattaccaaaaaaagtatttgtttattttgctataattattatttactttttctaagattaagatattcattattggtggggggaattatttatttatttgtttgttatgatttctttgtcgccattggtgataataaaagattaaaaagttgtgcaatttagactttcgcgtttgttttagcaaatgtgatttttgcacaaaaaattgtaaatagaataaaatgaaataaatgtcattggttaaactattagataaaaaataagttttgctagagaaaaaaacagaaaataacataatctatgtgtttaaaccttaaatttcaattaaaatggtactgattaattattttcatatatacataggaacacttgaatatatgaactgcaaaactatgtttttttaaagtgggactaaatgaccaaattttattaaaacgacatatggaagactagtatgttgtaaccaacaatgaacaataaccaatactgaaataagttattgtttgtttgattttagaattgttacatccggtacgacgaagtctgaatcatcataagagtctggatcatcatctgagtctcatcacacaattgtttgcaatgcggttctaacatttatccacttcatattttttttatataaaaattgtttatacgtttccaacacgtaaacacttctcattgtacattttcttttttttttttgctataatgactgaaaccatgcatgaaaagtcttctaaatagaatcgaactaaaagaaaaattacacttaaaaaaacaaattgcaatattttttggttttatttggtttaaaactatgtatgatctagaaaaaaaatattatgagcctaaagtgaattattctgattctatataaatacaaacggtaagtattaagttagaaaactaaatagtcttatgtatacaaatctcttcataattcattaaatatattgtaaattgtaatgagtattttcatatacatagactgatagaagcactttatcgttaaaattgcaaaataaaagtagttataagtgggcataaatgaccaaaatttgctaaaatagattgtttttttttttttttttttggtaggggacactggacagggagataatccaataatgaaatataaacttttgtttagatatgccgtcggtttaagtattctgataatcaccaccgtttttttgcctattccaaatttccacacattttattttcatttcttaatatttatttccttatcatttctttctctcaccaaccaacaagttctcctttctacccatttcgtctccttcattttgacgttttctttagatctgttaataatcccatccatggcttggtctagtcactagtggtgttatctctctgtgtggaataaaaagcaaggttttttaatcacttggattgttttaagatatg

SEQ ID NO: 35814 - DNA, 3003 bp, Unknown; identical to SEQ ID NO: 35813
  misc_feature (1)..( 3003): 2750-1469P.txt file - cDNA_ID_3090615; gDNA_ID_2926167; Annot_ID_199200

SEQ ID NO: 35815 - DNA, 3000 bp, Unknown
  misc_feature (1)..( 3000): 2750-1469P.txt file - cDNA_ID_3090627; gDNA_ID_1621099; Annot_ID_171271
atccattttctaagttttcctcttacatttctcaatcgaagatacaataataataataattattataatttatcttatagattcaacgtcctttttgttataatggatccgattaagctgacaacagaagctaaggtccctgctaagcgatcaaaggctacaaggtttgttgataaatgtggttatagtatttgaaaactccccacttctgaaactgaattttagggtcccaatttcatatgtttctaatgtcaaaattttgtatattattggtttcttttgagtaatgatttttcgaccaagaaaaataaatatgaagtcgaagaatgattttctaaattttgttttttactttgtttcttagtggatgtttcttcttttaaaaatctcgttttaattttattacacagtttacttaattcatttgattttatattttctagatttttaactttacttttagattcaatgtattaaaataaacaaatcttttatagatactactaatacaatcttaatgaaaatgtctatatattattttatttttggtatatatagtacattgtatagtttgtattcaaaccaaaaattctatatctacctcttgataacactattatatactatattttatcaaattttcacatatctctatttgtatatttctttctttaaacaaattctcaaaactatttaagggtccacatttccgaatctcgcccaaagccctgtgttttttttcatcatgacaggctgttattttaatttaccatttttgtgtatttaatctaccattactgggtaaatttgtttccagccactacttgcctcttcataaacgccagttctatcattcccgaaccggtcaggtgattcatgctccttcttttgcatagtctttgaatttcacgttattatgtattatcaaagtatacttggtcccaattcacgtacctctctggtctgattcttctcatttaaattcgtatttctgcttcggtttgtatatccacgtgaattttttattgtcactaaccaaaaactgcatgtttttgttgttacaaagccattgtcacttgagcaagttatgtctgaccgagatagcgaaaatgacgtcgacaaaaatgatgatgctgcacatctcgaagaaagccaggtatatatatattccatgaattatttatgcttttactaaataaacaacaaaagtggtatacgattattcttgctaatgacatcaatttttctaaaaaactgtagatgcttaatggttccatggatgagaatgaaatcgtagcagagagattcataaaactttggaactcctttgttaaacagcaaaggtaactaacgatatttcttacgctaacatccatacgattaaagaccttttatatatgtcttacattccatacgtttgttaggcttataaaacattagcataactcaaattatgattttatgtttcaggattgttgcagatgctcatattccttgggcatgtgaagcattctcaagattacacctgcaagagctgcgcagtaacttatcactcgacttgtaattatctcttcaaaactatatcaatacaccaacttatacacatacacatatagaattttgttttgtttattggaaaaaaaaaaaattccaggtgctggagacaattcatgatcaaacaatgggattatggacttcttgacagagtcaccatgaacaaatgcaataccatcatctaccataatatctcaactaccaacgatgacataaacaataacaacacaaggacgactgataatatggatgttgtcgacgatgacataaacagagacaagtaatatgaagattttcgattgcaaatttttatattgtttttattgtttaggagcacaaagatatataacttttttattaattggattttatttttttggctagggggaacacagaaactactgagactgccccagttgcaactgaagctactacacatggggaacaagatggaatagatgtgggagaacaaggtaataacgggtcgacattatgcgagcaaatggagtcagctactgttacagaatcttcgcaagatgccacatggtccacatctactcagagaagctttgggaaaaggccgatcgtaccaactccaaagatgatagagtggcaatggagtagtgttggtggtcgcagaagcggtggtcgtagaggtcgtggtcgccgaggccgaggtggtcgtggtcgtgaaggcggaagcgcaagcggtagtggaaacctcatctagtgatctccggtgggccggggtagttcttcattctctcttcccattctctttttcatgcttatgttgttttttcacatctagattaagtgtatgcttaatcacttttatctataaaatactatttcaacatgtagcatgacccaaaaagtcatagccatgtaacagttgcttatcattttaatttgaatatacttttaattatggttttttgccctcctttatgaagccacttgtccacttttcacattttcgatgattccacaaagcaaacaaacaaatagagcagacttaatctgcaaaagaatcttgtgttaaatctaatttatttagaaagaaaaaaaatggcccctaataaaaggaagaaatcagatagaaaaaaaaacacatctaataaaaagaagaaataaatctaatttattttccctaattaagtttatccttattcattaaatttctctcaatgcactattttggacccttaattgaataacatatagcgcaaaaagccttcattagtttgggttttaaattataggcccattaatattataaggtccaacatcaaattttgtttccgctcccccataattttaggtgaaattagcgcgcgaaaccataaaaaaaaaaaaatcgaaaatcaaaaacaaacatctctcagattgcagaatcaaaaactttgagcaaaagagagagagacgaagtggagagctctaatg

SEQ ID NO: 35816 - DNA, 3000 bp, Unknown; identical to SEQ ID NO: 35815
  misc_feature (1)..( 3000): 2750-1469P.txt file - cDNA_ID_3090627; gDNA_ID_2926167; Annot_ID_199197

SEQ ID NO: 35817 - DNA, 3003 bp, Unknown
  misc_feature (1)..( 3003): 2750-1469P.txt file - cDNA_ID_3090678; gDNA_ID_1621100; Annot_ID_171384
tatgggatagacttcaggagaagaaaaaaaaaaaaaaaccggaaattgttcgggggattgaacccgacgtgaatcgaacacgcaaccttctgatctggagtcagacgcgctaccattgcgccacggatccggatgttattatgttgcatttataaaattataataccgtagtatacgcaaattaaacaaaacattttgaggacgcgttcccaacacggccggtgaccaaagagtcaatttaagcccgctttaaagatatcaaaatgatataaaactctaattgatcgagttaacggcaggagaatcaaagctactaatcataatcaagaaatttaatatatatacgctattattattgttttgaacgataaacacgtggtctggtcgtgattaaggtcctaattatgtcaacgtttgcctgccacattgcagaccgaagtactaattccacaccgactggtctacgacatatttaattcataaacacaatactttataattaaattgattcttgtagagatttggcttcatgatctgatttatttagttaataaccatttcaacagataattacagtttagagcctttttccagttgtcaagagtgttatggttttaaaatggcaccctgtaaatatcacatatgttagtggatttattttaccaaagaaacaaaaaatgttaatggattaaaaaacttgtgtttttttagatagcaaaaccaaaagaagatatggtgaccactaacacgatcagtcgaagacaaatgtttcccagactttattattggcgtttccattttgcatattagtcaaattatggagcatcgcaaatatctaataaactaactatataaaaagttattataatacagggttaccaattccgtatattcagaatattcctaagaggtgccattttgactaataaaatggacggatctttgatttattccggaagtgaatggatattagaagaaacaaaagaaattttgaatttcttgtccaaaaaatatttttcccattcttagtatacagaaacatagaaaatatcgtgtatgcttacgtaacaatcaagttgtaaaaagaaaaaaagacagaagataaatagtacagaatgaacataacagaaatcaatctatggaattaggtacaattaggttcggtctaactgaaattacatgacgacagaaaaaactgaactaaacgccgattctattaacttccaaaactgactcgtctcacacgcgcttactatgattcacacgtgcgaatatgccatcatataagcgctactaaaattcattccaaaggaaaaagaaaaataaataatcgatctcaaccgtccgatcatccatcttgccatcaccgttcaccaatcttcttcgtctcctctctctttctctctttttgctgtttctagctcctctctctctggatctcgccggcgaaccgtttctcttgggtggtgagtgttgcttcttatttttaagaatctttttcttttatttccatcgaatttcgtttttttgagtttgatttttggcctgtggaattctcgatgtttctacattgatcgtctggtttcgaatcgtgttttactggtacaattttgattccatctccgtatcttatggattcgaagaactttgtgttttttttttctttcttcattgatgctactttgctagggtttacacttttttcttccatggtaaaaaaatttgagcaaagttgttgagattcttctagactgttttcaattttacgtttcacaaagatttttttagatgatttgtttctaatgaaatggcattgtttgtgttctgtttccatatgtgtagattttgaaaatatgtttgtgatgattgtgcagtaaacagtagcaatcaagctatagaatctcagatatcgctgaattagctgttggattttatccgccttttcttcgttatccggggctcgggtataaggtttcatcgtcttatttcatctgtaaatgggctgcttccactcaaaggcagcaaaagaatttcgaggacacgaagaccctgttaagcttgcctctgagacagcttgtaagtttactcgcgctataagtttaaacctcctctagattcatttctctcaaagctgcatgttcatttgttttctgatatgagatgagaatcatcagttagattcaaatcattctttctctgttcactgatttagtttatctccggtttggatttttttagttttgtgttttggagtctttgtctgcctaacaatttctagtaatgatccttcaaagttggttaacactctatctcatgtttcttgttaccaataccatcaccttaatcttgttccttaacttgtcaagacgagttctctctccatgcaaattctaaatgtgaattattagtctctttgtttgtttgtttgtttgttcctggtaattctttgttttgatctcgtagtgttgcttgtttttttctcttttccagttagtgtgagtgaggttgaagcattatttgagctattcaagagcataagcagttcggttgttgatgatggtctgattaacaaggtacaaagtttgtttcttttgacccaatttggatcttttcatgaccccatcgttgtatctttttgttctttacgctattcatctacagtatttttcaacttagttgactttatttgagcaataattattcttccatgacgatatgtctgttccatattgcatcgattcaatgtatcgtagcccttaatgtttgacttgaacttaacttattttattgattgctttgattttgaattttgaagccttcatggcccaccttgtttatgttgttttttaatcctggcttcacatgtatgcaggaggagtttcaacttgctttgttcaaaagccggaagagggagaatatatttgctaatagggtaaaatcttaattcttcaggcttttacaagattcatcttctggaagagtgatctaaaccaagataatatg

SEQ ID NO: 35818 - DNA, 3003 bp, Unknown; identical to SEQ ID NO: 35817
  misc_feature (1)..( 3003): 2750-1469P.txt file - cDNA_ID_3090678; gDNA_ID_2926168; Annot_ID_199303

SEQ ID NO: 35819 - DNA, 3000 bp, Unknown; identical to SEQ ID NO: 6674
  misc_feature (1)..( 3000): 2750-1469P.txt file - cDNA_ID_3090684; gDNA_ID_1621100; Annot_ID_171382

SEQ ID NO: 35820 - DNA, 3000 bp, Unknown; identical to SEQ ID NO: 6674
  misc_feature (1)..( 3000): 2750-1469P.txt file - cDNA_ID_3090684; gDNA_ID_2926168; Annot_ID_199301

SEQ ID NO: 35821 - DNA, 3000 bp, Unknown; identical to SEQ ID NO: 6675
  misc_feature (1)..( 3000): 2750-1469P.txt file - cDNA_ID_3090698; gDNA_ID_1621100; Annot_ID_171375

SEQ ID NO: 35822 - DNA, 3000 bp, Unknown; identical to SEQ ID NO: 6675
  misc_feature (1)..( 3000): 2750-1469P.txt file - cDNA_ID_3090698; gDNA_ID_2926168; Annot_ID_199294

SEQ ID NO: 35823 - DNA, 3003 bp, Unknown
  misc_feature (1)..( 3003): 2750-1469P.txt file - cDNA_ID_3090704; gDNA_ID_1621100; Annot_ID_171366
ctataattaatcatcattttaatttacctttgttaattttttgttaacatgtgtgatcgcggtcatagttcagttaataaaataagaacgaaaagtttgatcgtataatatactagttcatacttaaattgttcttctcgaattccattcaacaaaactattcaataacttccttaatagaatatttattttttggcaattggacataaatagttactctttctgaacagtatactacaattaagttggaatatgtaatttctacgaaggtactataatactattctataaatacttgtgtgtaaaagtaatcaaaatgcatgtatccagtctatttcaaccatatgattgaacacgtgcatttcttacatttatctcacttttatatatatggtgtacagtttcaactttaaaaactgaaaattgtcaaaagtacgaatatttaaagaaaatgtttgaatgcttttttcttttcttctggtaagtatgtttttgtgttttgttaaaatataaaaatgagaattttagaatttaaaaggatatatagttaaattggtaaagatcttaggcgaaatttagaggttgtcagttcgagtgacgtttggaacgaaactaacattacatgctttggtttcgaatctggaggaattacggatttcggcccaaaacctcataatattcaggaaaaaaaaaaaaaggatattttttttttctttcttgaaacaccatttctattaaaagtagttttcttatgcggggaaaatgggatagttttcttaatctttcaacgtaccaacaaacttttaaaagtattctttgttgccagaacaaaagtataccatctttgtcgaagaactcaattgcagtgggaatgcacgtgtggttttgttttcacgtacacagatgtttgtagaaagtttgaaaattcttatggtcaaaagtctcacacgaccggatttggtcaatttcaaagctgatgtgtcatagactcattcactcatatgcttcccctctttcaaatgtataccatttttttttgttaaactcaataaattattaagagaaactcaaactattaagtatgtaaactaatgtcttatatattctaattttttaacgtatctttgttttaacgtatcttttaaactacagattcggatgattacgaaaattaataattatgaatattcaaataaaatggacagtaattcttatataaaaaatccttttgtcaataatctaaccaatgattcactccaaactcatctgacatctctataggcccttattatgattggtatgtccattttggaagtcgtcatgacttatgagcataaaatgaatacatgaatacatgttttgcagtttttttttgcttcttaaacagttgatgtctttaatttgtttcttgtaagtttaagatgttatctatttatataccttgtttcgaaatttgattgtcccattatgtttctgacgtggaattaaaacccaatgagaatggggtcctcctgttagattttccaacaacgataagaatatagaggttgatgtgatttaaaaccaatagaggcagcgcaattgagtaatcatcatcttaccatccttcctcgaagtagtcttcattgcaagttggcaaaagcgagagacccacccattcactttttaacttttagtttagctcgacatgagagaaattatattatgaacaactatctttagtttagctcacatgacggggttttttttttgagaaaagaaaattttgaatttttggtttatcatacaggaactatctttctccggcgggaatttggaagtcattatgcccattaaggagtcataatatatatttgtagttattattgtatctggtgtcaaacaaaaattaatgttagttgtacattgtgagatctaaaacctcgagagatgaagtcttagtaatgtttgaacaaacaataatcacgttttccatcaaattcgagcatttaaagtttatattactacatgccccaagatgataccgtccatctcatccgaaaatatttctgaaattgcgctaagacaacaatgtttgctcaaattcgatcatttaaagtttacaaatctctcatcactcttacaaacttctcacactaaacagaggtacatattttcttataaagacaaaaggttcgaacagctggcttctcaactcgagttgtttgtcagggcctctcttcactaactacaagttggtacttcaaatattggtggctagcttcacgtgatattgtctacaaattaaacccatgaaaaagctgcattaattgttccaagtgaaccctgaggagtgtcaatagtctttgctttagtgtgatcattaaaccaaatctctaaattcctaatttgtactaacatttggaacgtatttcctactcttctccctgctccaactcccaaaaataagattagttagatttctataactaatatacatgtatactcccaaaaacagtaaaaccatattaataaagctaattttgcatagatttatttcggtaaaccggcggttcaagttggggaaaaaaaagacaaacggtctaaagtcatccaaagacaaaaaaccaaagacaagttgagagagacgagaccaatcacaacattgcttcgtagattgcgtgacatcatccttgacggctactttcatttgtgtcttatttggataaaacgcacgtgtttaattcacgaaccttcatagcaataagaaatttccattactttcatattttcaactttttttattacccattacatgcttaaaatattaattcacaagtctttgtcaaaattcaatattttccaggttcatgaaccctttttatctcaatctactctataatatctccctataaattacaacaaaacctctttatttttcattcacaccggacattttgaaatctcaacaagaaccaaaccaaacaacaaaaaaacattcttaataattatctttctgttatg

SEQ ID NO: 35824 - DNA, 3003 bp, Unknown; identical to SEQ ID NO: 35823
  misc_feature (1)..( 3003): 2750-1469P.txt file - cDNA_ID_3090704; gDNA_ID_2926168; Annot_ID_199285

SEQ ID NO: 35825 - DNA, 3000 bp, Unknown; identical to SEQ ID NO: 6680
  misc_feature (1)..( 3000): 2750-1469P.txt file - cDNA_ID_3090710; gDNA_ID_1621100; Annot_ID_171363

SEQ ID NO: 35826 - DNA, 87 bp, Unknown; identical to SEQ ID NO: 223
  misc_feature (1)..( 87): 2750-1469P.txt file - cDNA_ID_3090710; gDNA_ID_30962; Annot_ID_146872

SEQ ID NO: 35827 - DNA, 3000 bp, Unknown; identical to SEQ ID NO: 6680
  misc_feature (1)..( 3000): 2750-1469P.txt file - cDNA_ID_3090710; gDNA_ID_2926168; Annot_ID_199283

SEQ ID NO: 35828 - DNA, 3000 bp, Unknown; identical to SEQ ID NO: 6666
  misc_feature (1)..( 3000): 2750-1469P.txt file - cDNA_ID_3090724; gDNA_ID_2926168; Annot_ID_199267

SEQ ID NO: 35829 - DNA, 3003 bp, Unknown
  misc_feature (1)..( 3003): 2750-1469P.txt file - cDNA_ID_3090728; gDNA_ID_1621100; Annot_ID_55840
gaagacgaagaaatagaagaatcgagagagtgagacaaatctagtgatgggttgcgactcacatggaaatctaagcgacacagagttcagcaagccgttgccatccataggtgtatatgtcgctgcagcttcactgatctgtggagttgctatgttttccgatcttcttcacggcttccggcaccgtaagttctggtttccttgcaaattcttctctctcaacgctaccactctcacctttatctctgtatgcgtcaaactctcattggatctcaacacttctatgcctagtcgccaagatcagcttgctaaactcagcagcagcgtcttcgtatgcaccgtgatggctaattccatgccttctcttggttacatggtcacgcaagatctcctcatgaacctcacggctcttgggattctagtcatcaccgatgttgttaacatctgtatccaattgggtacaggagctatatatgtgttccctcaagaacacgctctggtcattattctcatgcttttgatgtttatgatcttgagtttctctgctatcactgtcccagccacaaagcgtttcttggagctcaagtacaagaagagatacgagtttgctttgaagcagtgtccttcgtatacagagagaagaagaggggttcctaagcttaaagaagatctgatgaaattctggatgatggctcacacttctagccctcagtttgtgatggctcgctctgttacttgcaccaccactggtttcctctgtttcttgattgcaatcacattggctgaagccatggtccggtcttactttcttcaaccccggtcactagggttctgcaatggagattctgattacaaatggtcaaccactttggttctagtctcccagacagctgcagtggccataggaaccgttgctccagcgagcagatggctcaaggcagtgaactttaggtgtccatttagaaacaagaaatctttgaaagatgagttaagagtagagagttattgggtagagtgtctcgctgagaagaaagaacgtcccttgaacttttggatgctccatggtcgctgcagcaggaagcttgcacacgacttaaaccggttgatgcttgatatctgcattgcaacacagtatggtatagtgctggctagcaagtttctccgtttcatcacggtctattgttcgagtagaatcttgctatgttgttttcatttcaccttcaaaagtgattctgttgcaaacgctgagtcctccgggttcaaatccatcaaccagacaattcgttctgcatcttgaaggagaggaggagatggtggactacatggcacgtagcaaccgtgtggccacagaccacttgatacaaaagggtcggaagaaccaacctgtaacttgatagagctcttggaggcaacaactttcatctcaaaaggatttgaagggattcgagattttgacagcgacgaggtttcttctctggcctctggagagccacctaatagttgggcccttccattggtaacactgacgagtatcgctgtcgctcttcctaacatcaagccttgctcgctcaagaagttagtgaaagctgtaaacgaggcattggtctatgtcaacaagttcgaagaggtcttagacatcgaaggagagttagctaacagcaggaaagctgcagaagttgtttggttaggagttgatctctaccataaatggctcaacgtggatcttcgaaaactatccaagcaacatagcaaaacaccacaggaagttcttaaagagctggtagatatagcacaaaaagagtttacagagtcatgggagaaaaatcggatactatgcatgaagcataagccctcgcactggcccatcaagactcaagcagcaaactcaatgtaccgaatcagccaaacccttttgatgaagtacgaattcaagaaacatttgaaacagaggagactctgttgaaagatgtggaaaagatggtatcggacatagtatcaggatgcttttgcaacacggcacaagttattggaatgaagtgtttggttacagcagtggaagtgagggaagcgtcggtgagagaagcggcaatgcatttggggagaacagagaagatacttgagatcgtagacaggagatgcatgcctgctttgtctcatcacaaagtggcaaagattgatgaatggagagagttttataggaccaataaatccatcactttcactcatccttcgtcccagtgtacgacccgtgaactcattatcacctagaataacacattttcttgtcacatttaaagaattaattacgttttgtacatgataaaccctaattagcaaataaaatcctttctttgtcggttgatctaactattaacacttgatgccaagtctaaagagtttattagtttttaaaacccagtttaccaataataagtttcctttgtcggttgatgcactagtcaaactatcaaagtcgtcaagtttgctttgttgacaaggcaaagctactcttccaaaacattgatccattcttctggaaatttgcaataacgtctcaagaccaatgcaagtaataatttaaccatgccatgttatcaacaaaagctgcttctctgatttctagagtattattttttaaccattattgaagtttgaagatttcttattattgctaaatggtaaaaccatcttgaggggaacaatttgataaaactgtgtgctgcttcctgtctccgaccaaaacatgtttaaaattagattcggaccaaacaagttgtcaatttttagtacaaatcaaaggttcaaatgtcaataaataatcattacattttaaaatttcgaaataaaaggacaaacatgtaaaaaccaaaaaagtgaagcactgatatttgtcatttctgcctataaaatgtacacttcccactcacacggtcacagaaaccaaattcgaagaagaaacagagaatcatcaaatcaaatccctaaaaattgatttttgaaatg

SEQ ID NO: 35830 - DNA, 3003 bp, Unknown; identical to SEQ ID NO: 35829
  misc_feature (1)..( 3003): 2750-1469P.txt file - cDNA_ID_3090728; gDNA_ID_1621100; Annot_ID_171342

SEQ ID NO: 35831 - DNA, 3003 bp, Unknown; identical to SEQ ID NO: 35829
  misc_feature (1)..( 3003): 2750-1469P.txt file - cDNA_ID_3090728; gDNA_ID_2926168; Annot_ID_139979

SEQ ID NO: 35832 - DNA, 3003 bp, Unknown; identical to SEQ ID NO: 35829
  misc_feature (1)..( 3003): 2750-1469P.txt file - cDNA_ID_3090728; gDNA_ID_2926168; Annot_ID_199263

SEQ ID NO: 35833 - DNA, 3003 bp, Unknown
  misc_feature (1)..( 3003): 2750-1469P.txt file - cDNA_ID_3090734; gDNA_ID_1621100; Annot_ID_171334
gactctctttcttctcagtaaggactttcatgtcttccacagctcttttctctgcggttttcgctttctccaccgctcttccaactatctcgagctgtttcactgcttcacccattaccatatgttttgctgctgcttctctcctgagttcatccacgttcatcctcatctcttccgcttcttttcttgttttctctgcttcacgcatgatttcatcaactttacgactcgcttctacccattctccttcttcagcttcttgtctctccttctcctttcccttcaattctctgttttctctctgcactccatctaattccacagtgagtgaacccaccaagcttttgtatgaactttcttcatcataaatttcttgcatcgcactctttgcctctttgagctcgccagaaagtttaatctcctcctgtaacctctcgttttcggtagatatctccattaactcctcaatatctttctttagctcagggtcacaatctcgcttgagatcctccagcctttgcttagcttctagcttcttacacacgtaagtttctctcaaggcaatactctcttcctttatctgttcctcttcctcttttttccttgcagcatcagaattaagtcgctcagcagcatcacgcatttccgctatgtcatgcgacatgtctttgatcttgttggagttaaccatagacgcacactctgcttcctctgccctctgaagttcagctagtctctcttccacggagaggttaaactgttgttttaattccgcgagctcgtatttcgccatgaacagctccgcggtaatcaaaatgtaatcctctcttgtgctctctgtttcttggttttcagattgaagttgttctaaccgttgattcatggtgtgtttggtagagatagcacatttccttgaatgtttgatggattctagtttaacccttaaatcagcagcctttcgttgagcagagtcgagatcagagagagcttgtgctttagctgcgacagagccatcaagacatatcttgactctatccatttcttgttcggctaacagaagttgcatctccttatccgacacatccgttgttgtgtccttaacgaagaaagaaaagatatttatagagagacacgttttgtaaaatgagagaaagaggcatgcagagaggaagaatgtgtgtatacctgagactgagaagaggaggaggaggagagacgaggtggttgcttcttggaaaagctaacttgacggaataaactaagggcgtctctaacggattggaagggagcgcgggtgtcaatctctcccacctcactgctccgaggaggagtctccggaggcatcaccggagcatccgttctgatcttcgccatcaatcctctcaacacaaacttttacgtaatgaagcaaagagagagagggtttgatgttgatccttaggatctttgtcttccaaataatgaactagagggtcgccatgttttgcgctcatgtcttttgtcactctaaggtcttcctttatctatttgtctattttcaattttgattattaatcttgttttcttttgttgggggcatgggcattggtaaactcaaaacatcaatatcttgactcctaaaataagaacatgtctatatactgatatatacattatagtatttagaaataagataatttcgttattaagatgaataattgaatataacctgagtctagaagtttattagtaaagaatctggaccggctattctaaacttggtgcttggtggtcattttgtggatttggttcggatttgtgtaccgtaccgttcacctaaaccccttgcttagttattccttttgggtttatttgtgtaacacttttgaaaactatttaagaaatcaaatttgttattaatatgtttatagttgtgcaactgaaatgaaaattttaattaattaagatttgatttaaaactattgaatacattttgtatgtgttgatataatttgtttatttttatttttatttctatcattttatcaacagttgttggttaataatatcttttgtaagaaattatctatagaaaataatttaattaacaaaactatatatattgcattgatacgtcaacaaaaaaaataactctactttaaaaataacaattagatatttccttcttggtaactatcacaattacataacaatgacatatacaattatatatatatataacaatgaaatatacaattatatatttatatatatatatatatatatatattggctataaataataaaagcctgatgcactttttagttaaagataacactataattatgtgaaattgttgatctttttgtgtagttataattgagaaaatgcaataaatagagattgaatgaaattataatattgataggtcatcatagacacatcattcaaataaacatttttgtatttatccttggagagattattgataaccaacccacacaagaactctcccaaaaaagttgtctttgggacaaagacaaatgtctagaagaaaagaaaaacagttggggcaggcttgattatttgtcaattgtgactttaaatttaggttagactttgaaacataatattaaaaaaataaagacatttgtaaagaagaaacgtcgcataccgtactgatatttgaccaaagattgatcaaagattgatcaaatttattaactagaagaagaaaagaagaagaagaaagaaggattaggcaaacaagtaatttctactattatataagcaaggagatatataattaaggagtcatataatttgaccaaaaaagataaaagtcaaattatggaagaggcatttttacttataaaaaagcaaaataaggatctcatattcttaatttattcaactaatccattcatttttgtgtgtgtatatatataacacatccttgcttgttccatttctaagccagttggtagtttttcacatatatacgaccttgaagattaaagatg

SEQ ID NO: 35834 - DNA, 3003 bp, Unknown; identical to SEQ ID NO: 35833
  misc_feature (1)..( 3003): 2750-1469P.txt file - cDNA_ID_3090734; gDNA_ID_2926168; Annot_ID_199256

SEQ ID NO: 35835 - DNA, 3000 bp, Unknown
  misc_feature (1)..( 3000): 2750-1469P.txt file - cDNA_ID_3090777; gDNA_ID_1971815; Annot_ID_175943
tgttcaaaaacaattcatactataaataaccttccttgatgttcaatgcattgctggagtttcccatcagaagacacaactagtcctcttacttttacaggcttcgttttgcgtttaatttggaatcttggcatagtcttaatacagttatgatcatcttctgcgttagtcgatttctctccttcttccaaaaactcatctgcaacatctccatcttcatcaacccttagccgttttgtgtaccatctcagtccctggttcaacacaagagagagctataatacagcttgtgacagaaccaatatccaagaagatatgcaagctcttaactaagaaaaattcactagtctaacattagaaataaagtaacagctaactggaggaaccacaggagtaaaaatataaacagaagtgatacagagtcgttgtctaatgtcaaagaaaagacaatgtgaaaccagtttagaggcaatgattatagttacgcttctactacatagaaagttaaggtaagccatattggtgaacttacttctactcattttctttattgcatctaactgttactactcatgagaacatctaactcaaaacctcaataatgctaaagcaagaacagagagtatcgaaatcaattttgtacactatgctaagagagtcaagctgaggactatgtagcacatgaaccatgattactaacagctaaagtagaactaaagaatgaggaatctttaatggaacttactaatcaatctcaaacccaatgtatgatgttcctaagctaatctaactaactagaatccacacttccgtataaagcaatcaaccactatagcaaccgttccagcacaggaatcccaaacctgaataccaccatctccattggcgcaaggctgaagaagaggaccaagttgagacctttcgacagcaacttgaaccggaactccaaatcctttccttggtaatccagtttcacgaaatctctgctgattacctccgtcaccgtaaacatcaatatcatcttcctcatttttcaatacttcctggccaaatccaaacacaccagctaatttcttgaaaaaacccatcctaatccttacaaatcaaactctcccaaaataaatccgttactaaaaatacaaactttctctcccagaagctacaatttgcatactagtttctagaccaatccgtcactaagagaaacaaaaaaaaaaatgatctttcctataagttaatcagacaacagatacttattagggtttatgaaactgaatcctttagacccaagttctacttcataaactgaatccgaatatctccactctctctgcgacgacaatggaggaaagtggatcaaagagagaatcttcttcttcttgcttttgctcatttctctactttccaaatctaacccttcttcttctccattaacgagcggtaaattcttatttaccacaattacatttcactagtgggctacattagtgagagttaagcccattaataaaagcccacctgaccaataattatacttttggtcaattgcttccaagttcattagtttccgtaagtgttttcatttttcaatgcaacactcttatgtgttgcagccttgcagcaccaagtgataatagagattatggatctttcaggtgacttgaatcatatgataaactctaaagtactttaaaagaaaaacattcgttatctgtctcgaaatatttctatgttcaggtactaatttttcacagcatctggttttacgtgtccagtttcttaaggtacgcgcatggcgtaaactgttgataacatttgctttttattgcttgttggtctactaaagtcaatcactttagtcgctacctagacataaaaagtttagtacttttagtcttttacattgattatcatctccaacaaaaccggatacacatcacatattttatcctttggattaaaccgggatacaaaaaaaaatctaatcggtaaattccattttctcgtgaacaagtatgggagaagagtacataaccaattaaaatatacacttttgttcctttacacagatttttgttttggattctaaagttgcatatattaaatatttggttgctacattctattccaactccagtgggtctttatctatgtgatatagtagcattaaaaattagtaacttgagtttgtcaattaatttggaatctatagagagtatatacaacagtattctgaattctgaatgatagatttttcttaaaaagataggcaatagaaggacaaaatagtcaaaataagctgctgtcattttcaaactagtgattgtttttaagatctgaaggatatacttaagaaaaaaaatctgacacatcaaagtacaaaccccatctttattatttttgcatttcccaaacacagtcaaaccaaaatctttagtttacataataatttatttgatatattattctcttattaattcttgtgcatttgtttgcattttagagattttctaaaaagacactgaactaaaataacctcctaatattttattaaacttcaatgtctcattccggtttgatttctcttccaataaccaaacttggttcattcaatgcaacaatggaaattatgtgaaaaaccccaaaaaaattgaaaaccatttattaaaacagaactagtgttaaaggagagaacaccaaaccatttacattagattacaactagaaactataactggactgaacatcatcattattaaagacacaaactctttatttcattcacattttaacaaaaccctaattatattatattttaaaagttaaattcatcaatattaaagaaaacaaaaacaaaacttaatctcctgaaaactgaaaaccataaaccaaagatttgtttcctcaatttcttcttttatttatataattaaaaatcttcaaaaacacaaaaaaaaaataaaaaaattagacactaactagatcgtccctcgtctgatg

SEQ ID NO: 35836 - DNA, 3000 bp, Unknown; identical to SEQ ID NO: 35835
  misc_feature (1)..( 3000): 2750-1469P.txt file - cDNA_ID_3090777; gDNA_ID_2926169; Annot_ID_199374

SEQ ID NO: 35837 - DNA, 3000 bp, Unknown; identical to SEQ ID NO: 8533
  misc_feature (1)..( 3000): 2750-1469P.txt file - cDNA_ID_3090788; gDNA_ID_2926169; Annot_ID_199368

SEQ ID NO: 35838 - DNA, 3003 bp, Unknown
  misc_feature (1)..( 3003): 2750-1469P.txt file - cDNA_ID_3090796; gDNA_ID_1621101; Annot_ID_171427
cattttttgtaaagaaaattaccaataatgttgacatgatatcatatatcactaccatctattggaaatagtttatagaagaataattaaatgaatcgacaagaactcacacatatacgcaaattgttatgtatgtgcacctaatgtagatttgtaggcattatatggtggggacgtgttaccatttatattgacattaatgatggtattgacacttttgtggacctaatcatgatacaaacatacatcaatgctgcttatataatatacttatatgtctatgtcgcgcacacacacccacacatataaacggtgggaatttatcgaatgatatgctaatcatttctgtatactaaacgtacaatgtctcatttgtgtatgtatatgtaccgatgtacgtataaaccaatgtatatagatgtatagaccagagagacctaatatacatggaaaaaattcttactagagttaataaaactgatgaacctagcgagtcactgagacatgcgagaatctctcctttttgaatgaactatatatagtctaatcaataacatattaataaatttacggcaatttgcaccaatttgataatctaatcatatattctttgtcgggttgataatctgaaaggacattataaacaatgagaaatataaatcctattatatacgaaagtataaacaaatcattcctttcgaatcttgacaaccaataaatcctaccctaagagatttaattatatattgattagagaaatgtattgtattcttcgaaacatatgctcatgagcacggacacggtatattgttttactgatcatcggtttaaacatttgaaattttgaacttactatctacatatgtcttcggtgaacaaacctttatacggattgataaataatactcttcgaatttattaatcttattaagcccacttggcgtgagaagaaggtatataaatactaatagtagttgaaatatactacaataattactaaagtaactgcagtagttaagatttaatttaaccatagtcaacgaaatcgacgctgatattgatatttattggaatttcgacttgcgagcctcttcacatgaatttaggctttgaaattagagttatgatcattgaagttaatgtagcgatccaagcttattattttaatttttaatagcatttctagtagtagtagatagtgaatttaatttggactgtccaatttcttttattaatacatagctgatattatgtattttattgaatttaaatttggattttaagttacgaaacaaatacaaatttagaagtttcatattgattaaaaaaacttattgctatccaaattatattaaaaaaaacttatagctatcgttttataattcgaaaacaaatttaaactaaacattatattatattaccttcattttaattacatatttacctaatgactattccagcaacaatgacatcattagttcaattgctttaaccatttgaattcttatataacaggggagaaagacaaattaaactagatacgaactgtgttcctcaatcaacaaagacatcaagagatttgttgtcttttcactcacaaattattaaagttaaacatcaaaattattatttatagaaaacgaccactgatcaacattaatatcatttttttattgcattattctaatgcctagcttattttacacacccaacaacaaatctatcaagtttctaattcccaaccttaaatgatgcgtattagtagaaaccaaaagaatgtgattaaatagtatgttttaatacctttgtctcctatgtttggttataaccacttgtaaatatatcttcctaaaacatttagtcacatgaactaagataaataataatgttgtttatgcttatggatgctttgtatatatctatatttaaatccccataataaatatttttacaaaaaataaaagagaaactagtcacataaaaagaaaaaaaagaaaaatttatgtagcaaaatataaaaattgaaaaagttaattggcgtgtattttctttaacaaaattcatatttcgacctttttttcttttataaatattgtgtactcattgtcatatggactatcaattacttccattacatgattggtcataaaaaccagaaaactattgccgtatggagagaaagcagagaagagaatcttccaaaaatgttaaatcttgtgaaacaaataaagcatagcaaagcaaagtccaaagtccaatgagctaaaacaaaatcaaaaaggtttctttatgtttttttttttgaagtaagaaaaaaaaagagtttataaagaaacagtggagaaataaatagcagaacaaagagaaagatcggagaaaagaatctttttaggctctctctcgcagacttcgcactcacacactcacttccattgctccaaaaaagtgagcttttttcttcctttttcctattttcctgatcatcttctttgcatcttatgtaactgtagaatctgactaactttcagtaacccaaagttttgttttttattttcattttttcctccagctgtgtgttctgatcttgcttgtataagtgtaagctctggcttaagcttttttttttttagttgttctaactataagacatgatttctgactacttgaggttacatttatgacgcattttgattatttgtcgttgttccggcatgtgtttgtctgcatataagctgttcgaggttttgtgaaatttgttcttttgatttcagatttagtctccactaattgtgtctagggtctgagatctgctggttctgtccccagtttttgtaaaaaaggaaacctttacctgagatttttagtttctgtttaagtttgaaatgaatgatctttgattaaagttttggtcttttgttaaattagactaatcaaagttctgatctttgttgtgtattttactgttgcagacattgtatctacttcacttgctgtagagatatg

SEQ ID NO: 35839 - DNA, 3003 bp, Unknown; identical to SEQ ID NO: 35838
  misc_feature (1)..( 3003): 2750-1469P.txt file - cDNA_ID_3090796; gDNA_ID_2926169; Annot_ID_199345

SEQ ID NO: 35840 - DNA, 3000 bp, Unknown; identical to SEQ ID NO: 3834
  misc_feature (1)..( 3000): 2750-1469P.txt file - cDNA_ID_3090819; gDNA_ID_2926170; Annot_ID_199451

SEQ ID NO: 35841 - DNA, 3003 bp, Unknown
  misc_feature (1)..( 3003): 2750-1469P.txt file - cDNA_ID_3090839; gDNA_ID_1620735; Annot_ID_166229
tgtacatatgataccaataatttcagaatatttttcttctatatataccaataagttttcttaaagatgcaaatgcaatactctgctttgtaattttgcaatgcatttgaaacaccgaatcaagagcaaacaacgaagtcagagagacaaataggctaaaacagagctttgagcaaaaaaaaaaaacaagtgaacagatataatacccacttacttggaagccactgacataacagataaacaatgtagtgacttgcaacaaaactccttaaaataccaaaaacgtatactctaggagcttggcttcttgtatctttgttgacttctgatttaacgtcaatagacactgaggaaaaagagttctcttagagccgccattcaaaagttttaagaattttaagtcaagtgtaagcaaataagaaaggtcaatggtcagcatgagactactaaattatgatactgctgtcatctatcacctgacccatctttattattatacacaaattagtaaaagtctgccaagtttgattagtgcaacttgtatctggggtatttagttactataataaatatcattttgtgtataaagaaaggtctcttctgtatctaaaagacatatcaaacgaaagaaatcaataaacacaatattctttcttccaaattttctcatttctcatgggcatatctcaagtacactattgcaatggtaagcaaaaggtacctgatgacgttagatcatttgatcctctttcgatgaaatataataaccacgagtgttaatttttcaggtgaccagaacttagaagcaaaccttctagatcatgaggaaactgaatcattttcagtacctcaaacgaagaactgtaagaggtggctccgtgtctccatatacgcaatctttgtcatcttctgccaaccacttgctacagttctgggtagactgtactatgaaaatggagggaaaagcacatatgtggtaacacttcttcaactcattggcttccctgtactgattctcttccgcttcttttctcgaatcaggcaacccaaatcaacagatacaaatttcagtcagtccccttccttcaccacccttgcatcggtttacttgtgcactggactgctagtgtctgcttatgcttatttgtctgcagttgggttgctttacttaccagtctctactttctccctcatcttggcctcacagttggccttcactgcctttttctcatatttccttaactcgcaaaagttcactcctttgatagtcaattctttgtttctccttacggtttcctctgccctcctcgtggtcaacactgattcagaaaacacaacaaatgtatctagagtacaatatgtgattgggttcatctgtaccattggtgcttccgctgggattggattggtactatctctgatacaactgctcttcaggaaagttttcacgaagcatacatcctcagcagtcctggacttggccaattaccagtctctagttgcaacttgtgtggtactcataggactgtttgcaagtggagagtggagaactctgccaagtgagatgagaaactacaaactggggaaagtgtcatatatcttgactttggcctcagcagctattttctggcaagtatacactgttggttgtgtgggattaatcttcgagtcttcttctgtgttctccaattccataactgctgtgggactgcctatagttccagttgtagcagtgatagttttccatgataagatggatgcatcaaagattttctccatcattttagctatctggggcttcctttcatttgtctatcagcactacctcgacgaaaagaagttgaagacttgccagacaaaacctgttgaggaagaaacacaaactttatgaaacaagttgtatcgaaggtctcagaaacaaacatacatagttgtacacagtcatgtaaataacctatataaagcttgtatgtgtaatatccgtaatggtccatgcaaatgggatatgtatgtcgctcatatttcaggtatttagaacttttattcaaaagagtattgtgtaatacgagcagagtgataaaagcagtcatttatttaacagaaaaaccatgtcaattttgtgatactttcattgtgtgagtgtgaaacccgataaaaattgaccagttagcataacttacagatatgtcaatgcaatattctcctttctagttttgaaatgcacctaaatcttgggaaacaagaacaaacagcaaatcatgtataatgagagatagaagataatttgtcagattggtccaacatccttggggaaacagagctttgaacaaaaagtaaatgaccagaaataataccattttatatagcgacttcctctgccgtccagtattaagttgttgcgaatgtcttctcttgaaaagataggcgagacataatctttagctaacgtcagcatcatcttgatggcaaaaacttcatgactagccatggaaaccgaagtgtgtacccaatccaaataaatttaaaaagacaaataacttttagaaatgtcgtcctcatcaagatcacagaatactacaacttgtgtacacgttcatacatatgcgtatgcgtgttaagtttctatttgtctatgcgtatggggttcatgtcctccacatagttgcagaagaaagtctgaatgaatattgcctacacataatttcctcctagacttaactcatctcttggtcaacaatagaggcatctttgcatgtagaaagactacagatactaaattcatggaaagagaagagatatggttggcatttactgaatgtggggccaagaacaaagaaaacttagacggtgaccgattcctaatcccagaatatataacttagcatatctcacccatatcaaaggagcaatcacttggtagcattatcaaccaagagaattgataataagatacgttagttcctccttgtccatctccaaggtggtgattccacatccaccatg

SEQ ID NO: 35842 - DNA, 3003 bp, Unknown; identical to SEQ ID NO: 35841
  misc_feature (1)..( 3003): 2750-1469P.txt file - cDNA_ID_3090839; gDNA_ID_2926170; Annot_ID_199419

SEQ ID NO: 35843 - DNA, 3003 bp, Unknown
  misc_feature (1)..( 3003): 2750-1469P.txt file - cDNA_ID_3090841; gDNA_ID_2926170; Annot_ID_199417
caagggggtgagtatgagctcttgagggagatttttccttcaattttctttaagcaagagccttgatcgatcattgttataactacatatattatatatattgagagagagaggtagagaaaaaaaaaacttatatgtaacttaagatcttattttgtctctcttatttgcatgtacatattttttcatgaaagaatgagacagttgggcttgcttatatatttgatgatgtttaatgtgttaccgttggatacatattttcgcttccattttgtgaaattatattttcttcttttggttagttttttacattatgatattatgctgtgtaatttgtactatcatatgtagaagcgaaaaagacataactctagctaggagcctacgattgatctcccaaatgttgattataatatatacatatgcttttgggaaacttaagtattaaattgacaagttcaaatggtcaacttcttactgatttatatcttaataatcaaaaattacaaaaaaaagttacaagctcatatgtgatgaagaaattagaatcggaaatttaatgtaagggtgttgatataaaaggttcaagttgtagacgacgaatatctatgtgtgtgaacaagtaaagaaaaaacaaaacaagttgagatctaaccttgtgtcctaagagaatggacccgaataaaagatttgactgcttctgctttctatcttatccacacacacatggaaacatagactgtggaccaataatattacccctaccatcaaaactgaaaacaatgttttaattcaaaaaacgaaaaataaaaagaaaatactaaacaataataaaattatatatcaaatctcagatttataaagagtgaatgaattacaaaaaaaatttgaaggaacgagaaggatgcgaagaagaaccttagaaaaagatctctttatatattaacttgtaaatgtgtttgtgcaaatgaaagtataggcaacaaagtaatagtggattctctatatataagtattttatgaggaacaagaggaccaaatttctgaattaataagcaatactattatttgggagcgcatttgtgtcatataccaaagtcattgaatttagctgaaacttgaaatcatgagatgaacgagtcatgagatcatagaacatgtggatttctgaaatttcaacatgcgcgctccaatgtaacttcagtttcctatttgaaaactattcttaaattttgaaattcaactgatatgtccaatctcgaatcttttcattatcaattatcatactcaatttgtattaaatcacttcaaatacagtagtttttttttttttagtttaaagacgtttcttaaaggttttaaatgttatgacacattcacaattatcatcactggtaaaatttgcattggagtgttcttggaaaacattctttcaatatagtcataaaattacgtttgacatataattcttacaaacctaaggtatattcgcaaaaatgttatagcaactttgagaaaacatattaaatatatacataaatcctttctatgttctagattttgactaaatatgtacatgttttgactgaagaatgatttggcctacacagataactattaaaatgatcatataccaagtcaaatcatatattgaatcatacgggaaatccatttgacacaaatctgtattagatggaacatttattttagtattttcatattattttgcttataaaaagaaatctcggtgataatgattttggttttgttttcggggtcgttatcaaattcacctaacaaaaacaaaaaaggaagccagaatgttagaaagagaagcaaagttataaaagatcttccgggagaatcaagtaattgccaaaccccctagtccctagacaactacaatcatatgacaaacattatattattttagaaaatacatacaaaagctccgtttttaaattgaaaaataagcttatatctaaagaaagatcaatttattacgtcaattttaagaagaattttaagcatattctaatggtggaatatcatctttcaaatacttcccaaacaccaaatctaggcatcgaaaccgttgtggacgtgtagatatcatttgtaatctattgccaatgaccgattgattgtatcatcatcaaaatgaaaaatgcgtggatattgtaaaaataaaaattttagttgacaaactcatgtcatgcgacataactcattgggtcaggcaaaatactacattcgaatccaaatctggcaattatagctagcactattccttgtatcaaaccggtaataaagctagaggtaaagttggcaaacatagatagtttataaacaactatgctttcggatatcattggtcttctttttgacttacattcatattatataatgttgttgcaagtatatgatatgtttcgaatgaaaagaaaaaaagtttcgaatgaccaatcttctcttctcgatcaataattggattttgctggtaaatgaattatttactatatatcttctttgatacgtctcttcttatttaaatgacataaaacaaatacaataatccaaattttaggcacgtcaacattattaactcttaagtggacataaataatctcactcttgacggtctttcaaaggtattgtattagcatgaaattctatattaattcttaacatttacctttatcttgtttttgttcctaagaacgttttctaaaattctccaaaatgggcccaaaagtatgaaatccaaattgagcccaaagttgtgatccagtgaaacgataaagctctcacgaggttcaagctcccacaagctcagatcgtgggcggtaaaagaaacggttaactaattgtaaaaaatgatttttttttttctacttcactaaaatattacagttttttttagcaaaagtaaaagtttcgagaaactctgaaaaagcagttttcaatcttaggagcagtgtatgtgtcatgtacatcgagatg

SEQ ID NO: 35844 - DNA, 3000 bp, Unknown; identical to SEQ ID NO: 29133
  misc_feature (1)..( 3000): 2750-1469P.txt file - cDNA_ID_3090849; gDNA_ID_2096290; Annot_ID_195342

SEQ ID NO: 35845 - DNA, 3000 bp, Unknown; identical to SEQ ID NO: 29133
  misc_feature (1)..( 3000): 2750-1469P.txt file - cDNA_ID_3090849; gDNA_ID_2926170; Annot_ID_199413

SEQ ID NO: 35846 - DNA, 3003 bp, Unknown; identical to SEQ ID NO: 29132
  misc_feature (1)..( 3003): 2750-1469P.txt file - cDNA_ID_3090853; gDNA_ID_2096290; Annot_ID_195340

SEQ ID NO: 35847 - DNA, 3003 bp, Unknown; identical to SEQ ID NO: 29132
  misc_feature (1)..( 3003): 2750-1469P.txt file - cDNA_ID_3090853; gDNA_ID_2926170; Annot_ID_199411

SEQ ID NO: 35848 - DNA, 3000 bp, Unknown; identical to SEQ ID NO: 8483
  misc_feature (1)..( 3000): 2750-1469P.txt file - cDNA_ID_3090871; gDNA_ID_1971812; Annot_ID_175793

SEQ ID NO: 35849 - DNA, 3000 bp, Unknown; identical to SEQ ID NO: 8483
  misc_feature (1)..( 3000): 2750-1469P.txt file - cDNA_ID_3090871; gDNA_ID_2926171; Annot_ID_199537

SEQ ID NO: 35850 - DNA, 3003 bp, Unknown
  misc_feature (1)..( 3003): 2750-1469P.txt file - cDNA_ID_3090879; gDNA_ID_2926171; Annot_ID_199528
gcacaatcacaatcaagccaaaagcagcactgatttctctttttttttttctttctaattagtcttaattcggtccaaaaccaaacaaaaatatctttaaattatattggaacctgacgaaaacaaatcttaaattcccacaaaatgctatatatatagtatctaagtttgaatgccaattccatatttttacggaatttataaaagtacgcagaatctatttctagcagtttggaaaattttcaaaatatttgaaaattttcaaatggtttgtggtctgttgatctactaatcacgtcatactaattttgggatggaatgttacagaatatataatttcaaaacagagagagtattcttttgttttctgtgaactgattttattctaggtaatataatgtatccattttttttaatgacgaggaagaaaaattaaggaacaaaagaatatgcattaaatttgattaggtagtgtcatttaagtgatcccttctccaacacaaaatgtatgattcgacgtcaaattaatgttttaaatatttattgcttttattgatcatatataatttaatatttataatcattattacgtgggaacttatctagtacacattctatgtctttgtgaacttagtacacgagtaacggtttttctattaaattaaaaccttcaaaacaacatttgatgaaaatttcatagattttacaccaaaatttcgtaagaaaaattgttggagttcgtattgttttcttgtagtagatgacattaaaaaaatacattaagatacactaaacaagaattatgcatattgttttttggtcaaaatcgagcctttaccaaattgatcgatacattttttctgatgatacgtttagactagttggataaaatattaatctgtcctcaaaaccaatttgcagtggatcaatccatatatcttctatattattaggatctttgtctaacttccgatgtgtgatattgttattcctaagataaaacaccattgaaaaacagtattttaaatcgggtaaataattcagcgagtcacatatttttgttttaataaaaactcaaatcaaaagtgatcaaaatatggtagaaagcaaccttcgattgtggtccatcatgtaagatacgagaagattttatggtttttaaaacccacttcgaccatgaaagcttgacccaaagcaattgagttgtttcttttataaatgacctaatcaatttccatacatacaagcatacatgtgacgtaaaggaaatctaattatgtactaatttgtaaattttactagtattcaattcagtaattcttactaaacttactttaactcttgctaattaaatatactactagagaaggtaaattacatgcagttaagctatactattttttctaattgcaagaaagaaagaaaaagtacaaaagaaaagaaagcacattgcaagtggatgtatatatagttatagggaaataaatatgaatatggactgtatatacatataggtttctcttatctctatcaaattaccttaaatgggttcataaagatggagatcaaagactacacatcacatgctactctccctcttcttttggcataaccttactccatttatacattgtgctcctcaattattcaacattttttaaaaataacttatttaacaaaatgttagaaaatatctacccaatttttttcttccacatacgagctacaaagatctttatcaaataaaacaagaaagattattaatccatattttgggttaaattttaatccatttagccaattaggagaactattttaacagttagatacttttcaacaaaatttattaagtagtcacctatgtatattcatatagtagtttcacaaacaatatggagagctgtgatcttgaagagggcgacaaaagtcaaaaagaaaatgtaaaaaaagagagagagattaaagtagttggagaagagagaaaagtctggttaccttctaattgagtcagaagcattacacttaaataactttccaaattaagccctacgtcttgtccagccccttaaaagtacgcttcatctccctatttcccctataaaccctaaaaccctatttatcttattaatttatcattttttttatatgtcaatatcacaacaagtaaacatcatcaacttcaaatctcactaacataaatagtatgctaattttcttcactatctgagtaattttctccttctttttacatcattcgattctatatttgccacaccattaaatagataagtatattggttcttactactaataatcagtttagccatatatctaattacacagttttcttttatatgttactttatatttgtacaccatcagttactatatacggaataaattacacctcatcatgtaattacaatattatcataaattttttgaaattctattctttaatattttcagtatccagaatccattttcttatatttattctggcaaaataatgtaaaatggtatcaaatatacaacaccatatatttgtttataaataacttccttaattagtgaaacaaattttcctgcagaatgtcacttaaatctttaaaacaattcacaaaagaaaagggaatagagctgaaattttttcctctttaaaaagatcaagatttagtaaaaactagaaacaaagaagaagatcgatatttgttgtaacaaaaaaatgtactgatcagatttacccaaagattttagtgcctcaaaaactttcacatgaaaagcaaagacaagtaatggtaagtagagtctgcatctcatgagtgattgcccaacttgaaccctcttttcatttagacctttgtgaaagaccacacaagaactacccaccaataactctctctttttttcttcatttccaaaaactatttattcatttctacaatttctcaatttgggggtgtccttaataagtattatatttatgaaaagtccggatgtatg

SEQ ID NO: 35851 - DNA, 3000 bp, Unknown
  misc_feature (1)..( 3000): 2750-1469P.txt file - cDNA_ID_3090894; gDNA_ID_2926171; Annot_ID_199482
ctgttttgatgctgactttttcccgcattgctttctcagcacatctcatcatgcatattgctttcccccttcttttgcgtgttcatgtgtgttaaacttcttgacgaaaaaaaggtgtgttaaacttctatttgtgttttgatcaaacacaaattaattaacacatctatttatataataaaaataaaaaagtttgacaaatgacactacaactctcatttagtaattgtaattaaactataaaacaaatcgatgatgaagtagaatgacgtgagatattgataatctaatgaaccttaattacaatgcaacttattgattgcagtcatcattgaaactcgaatatgggtcactttattaaaattttgattgtatttttttttgtcaacataaaatgttttattgttaaatttgtattagacaaaaaaaaaaatagaaggtataaacgtatacgtggtttagtcatttagaggtttcttagattgatttattgaggaaaaaaacttagctaattactatgaaagtgaaaggagaaattaatgttgagcagcgtcgaagaaggggaaagaacagagaattgaaaagaatgtcacataaccttgtgggggtgaatatatctattcatatgtgtgtatatatgtatatgtttcaattaataaaacccttaataataatattttgaaggtggtccttttacaaaaaatcaacatcttgtctcttctatagtttgctgtaacatacaaaatatacacaaatttatacacattaacacatgtgtacacatacctaactatatcttatacataaagattgcttttccgattatgatcccttgtgacatgtttttgttttgaacttgattccatcgtaatagggattagattggatcagaagataaaaatctagcaaatttactatttattttgttaaacttttggtcggtacattaaataaggttcattagttttgaagttggtgatgctgacttgtctagtaacaaaaatgtaattagacatattaagagaattgttcctattttgagtattgcatctttgtctctcaaaaaagtgggctctattgaatttgttggttaggtcatgaacacttgttgtatgtgtgaatttattaataggatttgtgttggggactcttagccatatttgaggtgttaaagggagctttctcttcccacatgcttttgttttgtttattcttctaagttctaagcagaacgataaaatgaaatggtatccatatctatctataagccatcagtcattaatgtaccaaccctattaatctaatagccaaatcttcatttcaagttttggactatactttttaactctatttttgttgttgtttgctatagataaacgtttagcttttaaatattttatatattagtcatttcgacaaaccctatcggtgaaggtattacacaatctctgtgtgcatctacagttacacgtctctgtatgtgaccgttcgtttttgtggagacagtagtgaaatggagcctcgtgtagccaccatgcattggactcaggaccattttcactaaaatgttcatactttaacattagcaattattacgtactgttgtacatttggatttctgcagctgtacaatcatatgtaccatgtacaacaaattatcaaaaatttcaccgaatattgtggcggtcaaattgagaatcatctaatctttgtgtaagagaggcgtatgaacaagtacatgagaaattaggcctatatggacgaaagatgtactcttcaagcccattttgtaaaaaggcctatcttcatggtttagtttgaacataaaggatttagtacccaataaaatatgtaaatctgcagattagtgtatcgaacaatttattatttaattttacccactaatccgctatatttaatcatctagatttgtttcacagcttttatatgcataacgtgatataataaatgcagggttgtaattagtagacctccattggttacgaagcgtccactactaagaaaatactaattaaaaacaaaataatctatatttgtgatctgaaaatgaaatcatgtaatgtatcaatatgtgggttttatagttggtaaacacataaatgacatgaccgtcaatttcggagctatacctggctcattatcgactatattatctgagataatgttaaattatttgtataaattttgttgcaaatcacttttaatggttttctataacaaaaacgaatatatgatattattccaaagaagataaagctgtatcgacctatccaaacatatagtattacgttagatagcttgctccacgtttacaagcaattgacaattactcaattagtgacatgaccacactataatgctttcacgtaacatgatgattcaatctcatagcaatatacattaatgtttttatatggactatttttaaagtacatatgctcgattcgtaatttcattcgaattttgactttacggtttaacaaaatataggaataatcaaatttaaaataatcctagtttggtaaggttcggtacaaaattagtttcactgttgattccttataaaatatatcttcaaatttgagtaaatttgacattgaaccgcttttaggtttggttaaaccatttgcagcatggcaaaaagtgaaaaaaagattacaagaagagaaaggaatcgtttgtactgtgtatgttgatgcaaaggtgagctattgctttccttaaacgttaaaagaacatcttttcggatcaattaagaaactttatcaaataaaaaatactttatattttaataccatatcgagaacgatacttcctctgcaacacgcctacaatacgccaacgaatatttatatcatcaaaccactctattgttttcatttttcaacaaaattcatctttaatttttcgatccaaggagcttctctgatcctaattaacctaaacaaaacattcattacaggtatcttaaagattatg

SEQ ID NO: 35852 - DNA, 3000 bp, Unknown
  misc_feature (1)..( 3000): 2750-1469P.txt file - cDNA_ID_3090932; gDNA_ID_1621085; Annot_ID_170495
aggttgaaacatttggagtttctgaatcctctatgactcaatctttgacaagtactcaataacaagtgaatatatgatgcattgcgtgtgagctaaactggtataacaaatgagaaatctttaataccaaccttagcatagtaatccttccagaccctgcgagcaatctggtgaccacccaaatcaaaagccttaaacttgattttcccaatgctgagttcttcagaagttggatgctgcgtaggctgatgctgtaccaatctctgtttcaccaattcaaccatgttcgattatcgatcagttaagcaattaaaacacactactcaaggactcaaaattcaagcagtaaactcagattcctaaatcaaatttaagcatctaatccagaatcatataaaaacaaaattggagatcgaataaggttagggaattggatcgattagataagaaagatctgaataagaaagtgagagcgaacctcgtctttcaacatgtgaagcagagtggttttaccagcattatcgagtcccagaaacaagatcttagcctctttctgccataaccctaacgaagcgagaacgccatagaaccaatcgatcatgaacatgactaactcagatcctccaaccacaaagctcaaatattatccgatcgagagagagagagagagagagatcgtcaggtttctaatttagctttgaagacgacgagagaggcgtttctgaattgaaaagtaaagtagaaacggaaaacggcaagcagtgcggattcctaaatcacaaacgggagtcacaacgatgcttctgtcttctacgtcaaaggcaagcccattagaggacccaataagcccatttatatatttacattagctcaagttccaaatggccttttaggacaagaaataaattttcctttgcgacaatacaggtatgtaatgtaagatctaaaatatttttaaaattttgtcgatttttgtgttttcaattgaaatacttcataatcatgaatcggaatttatcgtttgtttataacgtcatagcataattagaacacattttaaatttgattctattaatttatgtaacattacacaaaacaattttacgactgattacacaacatttaaggttaactggtatatcagataaataaatgaattgcagaataagcgaacaatggttaactggatgaactgaattagagaaagttctcatacaaatatttataaaatgctaaaaaacctagttttagtagattgatttttttttctagttatattaattaacatgttaatagaataatagtataaaacaaaattttttaaaaaagaattaatgttgttgttcacattaaacttttttttgtgtgacacttttaattaatcaactcagttttaaatttatatcttattgaaaaattcccacaaatagcacatttttaagttttttggacaaaaatagcattaaaaagttgtttacacataattagcactcaaatgattatttgaaaaattcttaaaagtaacactaaaacaagttttatggacaataataataccacaagtttatataaaatctattcaaccaaaataaattagaaataaatttaaatattatatttgagttttctatttccaatatagggtatatatttcaactatttaaaagaaatattgattcattttaatataagtttatggtattatatttgggtttcctatttccaatttagggtatatattttcaccatttaaaagagattttttattttaaaattagtttgtaatattatatttgggttttttatttccaatttagggtatatatttccactatttaaaagtttttaattcaatttaatattagattagtgtttgctctcatttttatttgggagattgatacaaatggtaataaaaaaactttattattgaattaatttatagaggattaaaatttttatatactatttttggaagtttcaaaaaaagatgccatttttggaataataaagttttttagtgctatttgtgtcaatcgccctatcttattatacttttctgccacggtttttttttgtgacgaatttaatcaaatctatttacacaattacgcgaatacctcttcatattttcatggcaaagtttttttttttttaaccgcaatatttatattttatgccggcacaatttatattatattcgtttaaaattgaacaaatcaattatgtgtataatgatatttacaagaatctacctgaaaatgattagtcggcgaattttgaaatagagtgagttaaatatcaaaatatttgttttaattgattccttttagtcgttgaaacttgaaccccaacaaaaatagaacgtagaaagataaggtcgccaaaaaaatgagataagcacaaatgtcagcgtctaagtgtatggaaacaaaagaagctaataattatgcaatacaataattacataactaatattataacaaatgaagataattgtctattgtcgtgatatgttgtcatgttgatgatcagatgatataccttgttgtcttcgttttaaatagaaaacatcagagtatggagaagtataatctaatatggaaacttgaccttgattctttgaaaaatatgtgttttgctaaaataatgataataaaacgtatattcagtatgggtcaattttcatttgcatttatggtctcactttttttcaagaataaacatgaaatttcaggaacactaataatcataagattttgtaatgggttttttggtttggtatactgattatttttaaaaataaaaataggacccacgagtttaaatttctggtgtactcaccagctgatcaggcgaccgttgataaagcaatcatagaattcgtgagccttattaggcttcatattcaaattcgttccagtttcacatattgcacaatcattttgttatataatatgagttacatgataaattttctgtgtccacaaaaaaataatg

SEQ ID NO: 35853 - DNA, 3000 bp, Unknown; identical to SEQ ID NO: 35852
  misc_feature (1)..( 3000): 2750-1469P.txt file - cDNA_ID_3090932; gDNA_ID_1621086; Annot_ID_170529

SEQ ID NO: 35854 - DNA, 3000 bp, Unknown
  misc_feature (1)..( 3000): 2750-1469P.txt file - cDNA_ID_3090932; gDNA_ID_2926172; Annot_ID_199594
tcataagattttgtaatgggttttttggtttggtatactgattatttttaaaaataaaaataggacccacgagtttaaatttctggtgtactcaccagctgatcaggcgaccgttgataaagcaatcatagaattcgtgagccttattaggcttcatattcaaattcgttccagtttcacatattgcacaatcattttgttatataatatgagttacatgataaattttctgtgtccacaaaaaaataatgataaatagtcactatcaggttacctaaacttttttttatgttgttagctaaatcgagtttaaatttcagtttatcacatatttaaggcttgaaaatcagaatattatcgcttatttttgtggttggagttttttttcatccactgttgagtttggttcttgcctctttgtgagattgtatcttagtattttattaagtgtttttttctttcgtattattgatatgattagttaagatactagttgacaaaatgaactttctaaggccagaatgtataaatcgacaattccaagaagatattgaaatttgatggcatttattatgatgtgtgtatttagtttgttgctgaactagtcaatcctatggtttgacgtaattaatccaaatacaaaaatgcaatactaagagaagggcaagaaatgacaagttaaaaagtttttgtgatatgaaagctaacctaatgtattattattttttagggtaattgagttttagatataagaccatagtgatttgaagttttttttatataactattcttgcagttatatgcatatccaatagacatcatccaatcaaaagatatatgtaagcagaatcttattaatacataaacaaatgcttcaaattctgaacaagaatcaaacatttttatgctttgaatggatgttgtggttagtgcggattaatccgtcagcggtgcagtccatattatttttaggacggataacaaatcgttgcgaatttagtttttgcgagttttgattttgagacgtacattgtcattctattattcggtcatcaccactaaactagaaaatatttttttaatatttcctatactgaaataaattcgaatataatgtcaccaagtacaaaagtgaagaaatcactttttcgaattaggatcttaagttgttgttgagcccaaaaataagtaaaaatgtgaaggtaccaatagatcctctcaactatcacaatcttctacttgcacaagaaaccaattcgtttaaaaaagaaatacatcaaacaaagtttattaaattataactaaaaccaatatatgttaagttctttccatttattatgttcataaagaaagaaatgagaaaagtcgaggcttgtgttgacttgtgagatctcatagttgacaattatacattacttcattttgcctgaactcttaaattgaaataatcattcttccagctcttacataaccgcgttttgttttattaacttttgatcttttttcttggtcgttatactcatttatgttatggatatactttaaaactcaattaaacaattatactcagtttctcaaaaaaaaagttgtatactttatgttatggatatactatttataaaaccccatagttattcttcctagtagtattataagttcttgaatttgaaacactaaaaccataaaaaaagttcttgaaacacgtcaaagctgccatatgcatgatttaaatcctgctttgtttcatgcaataatgcacaccatattctctctttgtcctaatttataagattctttggctaaaaagctaatatcaaaaaaaaaaaaaattcttcacaaaaaatatcgtttcatttataaattaataatttaatctatgtaaaaaatactacataactaggatttaactcgaagtataccgcatggaattttatgtttcacacaatcttaattaaatcaatctgattcaacatgtctaagattggtggtgttgacttgttaagaaaacaacaaaatgaagatttaacatgtattgcaatgttagattaataatattttaaattgttactaatgtctattcaaactcgttttgtcatataacacatccaacaatataacccatcacatgttattttttaaaaattattaagtttaaatatatcacttataatatttcatatttttaaaagttttaaatttattatatccagaaaaattaaatagttcgacaaaataaccaaactaaaccgtatacaaatttttaaatttggatgcttgttaagttcaaaattaattatattctttgtaaatatttgatatattaaaagagatatttttatgctcatatggcaagctcacaatatttctcatctattttacttaacacctttatttccatatactatctattttgatgattctaagtttctaataacaattgccaaacatatttgaagaatttttaacttaccaaaaataattacttcaaatttttttaatatgaaaatcttataattaaaaatgaacaaaaatttcataataaaaaatggattttaatctatttagactacaacaaattttgttctaaaattaaaatcattatattgaaaccacaattaaattttactacaaataaataaaatcaatacaaaataaatattaattatattctattaattaacataaacaagaataaaacaattttttttaattttccaaggaagaagaaagaagaaaacacatgttaatagctagggaaaatgattttattgggaattactgaattagacgttaaaaacatgatattggaatttgaataaaagaaatataagtaagggtaaaatagagaattcgaaaaagctgtgtatataaagttgcagacccctctgcctaaagctcctcttcagaagataacaaaaacagagcaaagtttttcaaaaaaaaaaaaaaaacagagccacgaagaaatttacagaaaattcaaaaccatcgataaagatg

SEQ ID NO: 35855 - DNA, 3003 bp, Unknown; identical to SEQ ID NO: 17743
  misc_feature (1)..( 3003): 2750-1469P.txt file - cDNA_ID_3090935; gDNA_ID_1621085; Annot_ID_170489

SEQ ID NO: 35856 - DNA, 3003 bp, Unknown; identical to SEQ ID NO: 17743
  misc_feature (1)..( 3003): 2750-1469P.txt file - cDNA_ID_3090935; gDNA_ID_2926172; Annot_ID_199589

SEQ ID NO: 35857 - DNA, 3003 bp, Unknown; identical to SEQ ID NO: 17745
  misc_feature (1)..( 3003): 2750-1469P.txt file - cDNA_ID_3090939; gDNA_ID_1621085; Annot_ID_170488

SEQ ID NO: 35858 - DNA, 3003 bp, Unknown; identical to SEQ ID NO: 17745
  misc_feature (1)..( 3003): 2750-1469P.txt file - cDNA_ID_3090939; gDNA_ID_2926172; Annot_ID_199588

SEQ ID NO: 35859 - DNA, 3003 bp, Unknown
  misc_feature (1)..( 3003): 2750-1469P.txt file - cDNA_ID_3090944; gDNA_ID_1620806; Annot_ID_168875
cctaattatctaaaacaaaaaaaaagttttgggattagtttaagacgaagaaaacgatatttctttagttatagttttttttttcttagatggatttcatcatatgtttgggacaagaaattacgttgcaatttttcataacagatttatttgaatgaatgtgtagcaaatttgagatatttgggcttgcgatggattttgtttcaaaataatagatttttggtagtagccatacttcggaaatgtaacaagtttttctcttaattaaaattcgattattacaagggggtttattccccctttgggacggaaatgcattttttagataacaatggactaaaggctggctctagaggcaatcagttgctccatttccacaaatttttgcaaaattcttctgcttcatctacgtctttagcttctcaaagtgaataaattagctctgagctccaagtccaatcgatttccttcttgttatgcctggaaaagacagtttaaacttgataagataggttgcattgctaacttgataagcctggccttctgcagcaagtcccaaactcgctgaaccgcggtagcatcagatagttcagcatatgagctattgagaaaaccatagcaatcagatttggaaaacaacggcgtgtactttttaatgtagtaaaccgtatgttattattgggccgacttcatgtgttaaccttattcgggccttggaaaccttgggccaacgtcatgtgttaacctagttcgggccttgagaatcttgatttcaactctattaattgttaaagatagatgttcttgattccaacattatcatggagtttatattgccgaattcatgatgagccttcttttgatttgagtccccccaaactcagataaacgtcagtaacatttgagattccagcatatgagcgagcaattatgtttgcaaaagttcattgttctcgtatatttcttattcatttccattaaaacagctttagttagaatgattttagcgaccatcacatagattctccttcatgtacgtttaagttctttttcgttttatgtatctctatgtacacacgttttatgcatatagatctaaggcaaactataacgagaacatgagtccgaacaaaatgcttcaaatgcttagttttacagaacattcacttatcattactaagctttaggatgaatcaagggcaaatcttgctaagcaaacattcttgctcttcgtctaccaggatcccttgttcttccaatctctttttcatatccggacaagctttccctgcagcgaggtaagtcttcataagaagagtgtaagtttcagaactgaggggactccatttcgtcaaggttttgcagaattcttctgctccatcaacgtctttggcttcctcaaagtgaagaaagaacgaactgatcagctctgagctccaagtccagttcttgtcttgatccaaaaccgccgcttcaaaatgcttcagagccaaatctgcctgatcgttcttcaacaggtgcatcatcaaaagctgccttgcctttgagaattgacctttacactttttcatggcgccgttgaaaacagcctcagcttcttcgtacatgttctgctttaagtagctgctaatcgctacattcgccatccgcatatcgtaagtccagcatgtcgattcccattctgcaaagactttcttgactccatcaatgtcatcgagtttactcagtgctcgaagcattgtaagatagcttgaattgttgacattagggtatcttttcttaagcaaatcccaaactcgataaacctcagaagcatttgcaattccagtatacaagttaatgagaaaatgataacaatcacgtacgtcaggattcatattgttctccagagatttcaacgcctcttctgctttaccgtagagaccgactttaatataaattgctgcaagattagcaaatgtattccaagagaaaataccttcaccttctgctttcatttcatcaagaaccttctctactccatctaaatcctttaaacttccacagctttgtatccacatggagtaagtaatatcacaaggagtaatactcttctctttcatcgcaacaaccaatgcaggcaccttctctggttgacctagccccatatacatagccatcaggttattaaacggcaaagaattactcacatgattgagatcaaccatattttcaaaatgagcctttgctttaacttcctccttttccacacagtaacagttcaataaggaaccataagtggactgattcttaatagaatcgtctaaactgttgaagtaggtctcagccgcctctaagcctttactctttgcaattagattcaaacgaatcgcgtgatcgctgccagtaaacgctatttcctttctttccatccactcaaagatctacacataattcagaaaaactcaaacactatacacatttaagcttcctatacaataagcctctaacaatggtggctaaaatcaattccaaaggaaagaggagacaaacctcgagagcgcgttgaggttgacgaaacttgcgaagatcctttgcgtagcgaatgaggtcgtgttttttgacaggtacgccttccatgacgaactgatttagcgtttcctccattttccctcctcccctcgtgccaaggcttgagagtttcttgtatattgaccgatgctttttcgccttcgtcggaacagaagcagcagcctcgccgctaatctccgccgtagcagtagcgagcgttgcacagaacctcctcgcgagccgtgaaacggaatgcatcatcagatttacggattttgaatttttttctgagtctcactcgaatctatgattttgctagggtttaaaaggcttttagaaaataagaagtcgaacttcatgtcgtttttatataactaaaaacgacatatagtttatttttgtaatcgtctctcttttgttattggagcagaaaaacttgtaaggccagaaatg

SEQ ID NO: 35860 - DNA, 3003 bp, Unknown; identical to SEQ ID NO: 35859
  misc_feature (1)..( 3003): 2750-1469P.txt file - cDNA_ID_3090944; gDNA_ID_2926172; Annot_ID_199585

SEQ ID NO: 35861 - DNA, 3003 bp, Unknown
  misc_feature (1)..( 3003): 2750-1469P.txt file - cDNA_ID_3090951; gDNA_ID_2926172; Annot_ID_199571
aaacgtgtgtacatgttgataaaacattttcaggtgagcgtggggagaaagcagagaagatgactggtgatatgctttcaccgtcttaggaacaaacagagctcaagaatggtttttttttttttcatttcggtctctagattctgcgaataataatgaatggagtctgtgtttggtttcatgttgaatcgatcaagatgtgtttttaactgtacatgaattatgcagaaacatctgtcctggttctcagacatcgaaactctgttcctaataaaagccgaagtccctgtttttattgtggtactagattttaatcacaatttttttttaaagttagtatatataaaaatttgcaaattgtatctatctattaaatatttttattttatagtttacaattgttattaagtaacgtcctgccaaacccgtaccgccaacccgtcccgtaaaaaaatttatttattttattaatgttgattttatttatgatatgtttatgaatcattgtttaaatattttgtaattttgtagtaattaattgctatcaaatatctctatggtttgcggcttataatcgaattgttataatcatgaaaaaaagcaatatcaaaaatgataattttgtagtgtttaaatcatattaattattttagaagttttactttagtaactaatcgtatagttaatgcggagagattttgggaaggtagttaaatgcaaatatttaattcgaagatttactttctaattatcaaaaataattattaaatatcagtggcagccactgtaaataagtcccaacttgaagatttatttcacagaatggctgcaaaaatatatatgtagattctcaaacaacaatgctttgaagacgccgttgtccaagacttcttgcgacaacgatacttcttttactttgtttcataatgatttcaagtaaccaaaagtgcctagtactactagtgttgtttgttagtagttctttgtctgctcctctagcaacatcatttctcatttttcttctctcttttgacaaggccaaatgtctcataactcaagagcctctggaaacacttgtaaattgaagaaacttcttaaagtctataagaatgttactgaaaccaatatttgaaaagacaacaaccgttttccagtgtaaaggagaattgcttctaatggaagcacaatataacctaatctatctagatttatatgcatatatctagatttaatgaagacgcttttggtcataagatctaaatgtaaaagcagacaagactgatagtattgtgttcttcatttttaatgtgagattttgtagaaacgaaaggcataacacgtttgaaatagctggatcatatcaaattaaaattgcaagattcttatataaataatacatcaacgaaatcaacttataatggaaatgaacttgtagaagaaatggtacaagatatctaaaagaaacccccactccctagacattttgggctttaagggtataccttcaccccactcgcttgacatctatccaaaggcgcattcaatagagcaaaagtacttatctgaggttccaactatcttcaagatgataggaaaaatgcaatgcatcttacacccgctgcaaaatggacgcgatatactattattgagtaccaccttagataattcgctaagatctatcgtgcttcctggcatgagccatgaaaagtctccgagcacacactttatatgcaaactagcccggtaatctttacatgtgtagaaccatgtctctggattggtttctttttcacaaatgtcacaccagtatttaccactagcctctttgtcaaagcatagtgagagaggatgatcgtcaactctatgctttaccacttgtggaaaagtggcgcatttgaagcatatggcaaatctgcaatcgtcttcaatgcaccttagcacagaataagaactcttattgcagccattgcaactactcttagtctcttcatctagtaaagtgtaatataagggatgatcgggatgacttggatggacaaacggctcagagattgaaccgcacccaacatcgaatgtaatgcccgaatactggtaactgaaaccattggaaaatctattacaagcttgacactgaaagaaatcatactcgtatgaaactagagtaagacgttcattgtgtagcacatgccatctctttctaggaaatccagcgcagttttggtggagaatgaagtcacaatccatacagccgtagaaagattggagacatatgggatgagtgcatgctctgcaccgcttcttgtcgtcacaaagaacaccattaacgtggagtcttaggtaatgttttttgtggctgaaatgttgtattgtgttgttgtctattaccacaaatggtttgatatcttctgtttcttcaggtactccttcgagttctttcccgttccacacatctttgttggtagcacattttgaatgaacgacgtagccggagcacctctgacaagaaaaacctccacaagtccaatccaccttccggtgacaaacttcacacacagaattcacaacaccaagaacagaagttcgcgaaacacggtgatcatgccgattaatgtttatgaggcgtggaagggaaagacagtcttgatggatcatgaaaccacattgaaaacacacgtaagggcttcgatctcccttcagcccgcaagcattacatgtaaaagaatcaagtcttgggagaagggtgagttggtgatcatgagctttcaaattcagaagagattgttgtggtggatgtagaacacaacgcatatccaaggtgaagttgcaagaagaacaatgataaaaatatctatcatcaatctttcttgcgcaaagacgacatgctccatcagaatagtccggtcgttgacctgtgtggagcttaagagggtgcgaggggtggtaagagtggtttacctctaaagggtgatatacctctgacggatgccatacgcaatccacatg

SEQ ID NO: 35862 - DNA, 3003 bp, Unknown
  misc_feature (1)..( 3003): 2750-1469P.txt file - cDNA_ID_3090954; gDNA_ID_2926172; Annot_ID_199567
gtcgtggaagtagctctctggagctccgggaatctgctcgggcttagaaattccggatcgggttttgtaaatcctggcggatccgtttctttccgaaacaaagacgacatcatcgcttttatcgttgacgaattgagcgttgaagttcacggaaacgccgtctgttaaacggcgttcgacggaggtggctatgttgagagagaagacgtcgaagccgtagtgagttcgaccgacggtggtgaaaatgatagtgcctttgggagtttccattgtcgagtttttgatgaattgttggtggtaagtgattcgagtatttatagaaggttgtggaggtgtttgactatttgactgagtgtgaagtgtgaacggaacaaaactgatccgtacgtgcgtgtgtaatgacgttgcagtcttcataggatcttttatcgttaattacgtggaaaatcgacgcagaagagattcatgtatgtgtaatagaatgtgagaaaattggttttgaatactaaacagtggatttgaccaaagacagagaatgagctaatgaagttgtgacttaacaagcaaaatcgctgtcgtatacaccatgtgtaatatctcttctagttttcaccaaccaagtattaaataaccaacaagaatacaacatcaagcaatagaaggattgggttttccggcgatcagtaaagtattttccggcgagatgcttgccgggatatacttcactagctttgaatttaatccatgtttcttaacccacttcatcctccctgcatcgatgatctgtttgcatttgaatcctaaaacagctctttccatgggtttcattttcttcacaacttcctccacgctgatcaaagaagcatctcttacttctccttcttcctcctcctttgcactgcatcagaagaacaatcaaatatgaaacaacttatatgcagtaacttctttatcatctttaaatccaagaaaatgttactttgaatcaagaaggtcaatgtcatcaacaccgggaagcttggaaccgtgatcatcatctactgcccagctagtgaacgaagtcatgatatggaactcgtccttggaaatccccaggctaaggatatattctttatctgagagacacataaccatattcttgattaaatagagaagttatataataatctgatagatcaaagaagtcacagtgactgtgagtttacttatgtagcttttccattgggaaagatgatggcaacaagtcgcaatagcgagacctctaagtactgggctttcaccatcttgtctggataaacaacatcttaagctcaaatctattatcgacacataagaatgaacatcaattagcaaaaccagatgctataaatgaagtggaaatctaatagtgaaggagcaaagacataagcatgtagtgacctgttgcaggaccacagagatgtttccctacggccacataaggaacaccgtgcaaagattcaaccgcgttaaggttcaaatcctcaactgaaaacacacaaggttttttccatcattaatacataacctggaacaagtaaacaagaaaaggtactagatttacgggaaccttactatcgattctcatacgctctaatactaagctctccttttgcctcaatgacctatcagcctatatgcgataaaacaaatgtggactgaaaaacaagatagattactaaaaataacagaatgaacacaaactagcaagcttaaccaaccttaagcttgtaagatttcctctcaactagatacacttttttgatcccatagcaatctgctagcatctgtgttaagtatcctctcccagcgccaaattcaacaaccgctggcgcagtattatcgtctttctcttccagatcgctttcgcaacattccacatttatgttgcacctcttcaatacaccaatctcttccaagttaccaagaattgaaccttgctgcaaaacatgtttctcttgaaatggtaatttcctgccaaacaatatgtatcagtcccgaaacttctcctcgccctatccatacccaagaaccaaagctccaaactattctaaccatttatgatttacctatctatctccttattaaaccatatgttacaagcttcaggtgacaaatacgaatcttcgatatctttacaaataccgccatgaacatcctcaattttcttaataagctgatgaaacttagaaacactcatactatagagcagatttctcttcatctctgaagtaacaagagaacaagatcccatcttttcttcttcttcgtcgttcccagcattaatacccttctgataaaatcgttgaccagacaattctacagtttgtttaagtaaaggacatctctttacatgccattcgagattctcctgcaacacagagctaacaaaattcgaatcaaacagttgctacaatagcagaaaaattgcaaactataacctttgaaaaaaaaaacaaagtatttgactcactgagaaggatcaatagggcatggaatccattgaccttccaatctctggctatggtttccacaaaacctgtttgataactttgaaaaattagctcctcactaatttgaacagaagaaaaaaacgaaactttactctttcacttacatagaactctcgattcgagtattcgcgcatgatcttttcttcttcggaagccagaaactgcatcgattgctacttttcgcctccattctctcagccagagttttgctcttgagacaaaggagacggaggtcttcaacgggtcctaaaaagggctttttttggcccattaagagcccatttaagtttaaaatcgaatcaatctaagcaaccatttgaaaaatgacacgtggcatttccaaaaaaacaaagaagcatgtttcttctcctccttacatactctttaacgccataagtctttacattttcttccgccggaaaaacagatatcacacagaaaacacaaacgacgacgaagaaagaagaagatg

SEQ ID NO: 35863 - DNA, 3000 bp, Unknown; identical to SEQ ID NO: 5605
  misc_feature (1)..( 3000): 2750-1469P.txt file - cDNA_ID_3090958; gDNA_ID_2926172; Annot_ID_199557

SEQ ID NO: 35864 - DNA, 3000 bp, Unknown; identical to SEQ ID NO: 4754
  misc_feature (1)..( 3000): 2750-1469P.txt file - cDNA_ID_3090968; gDNA_ID_1620728; Annot_ID_166004

SEQ ID NO: 35865 - DNA, 3000 bp, Unknown; identical to SEQ ID NO: 4754
  misc_feature (1)..( 3000): 2750-1469P.txt file - cDNA_ID_3090968; gDNA_ID_2926173; Annot_ID_199674

SEQ ID NO: 35866 - DNA, 3000 bp, Unknown; identical to SEQ ID NO: 20333
  misc_feature (1)..( 3000): 2750-1469P.txt file - cDNA_ID_3090972; gDNA_ID_1620728; Annot_ID_166003

SEQ ID NO: 35867 - DNA, 3000 bp, Unknown; identical to SEQ ID NO: 20333
  misc_feature (1)..( 3000): 2750-1469P.txt file - cDNA_ID_3090972; gDNA_ID_2926173; Annot_ID_199673

SEQ ID NO: 35868 - DNA, 3003 bp, Unknown
  misc_feature (1)..( 3003): 2750-1469P.txt file - cDNA_ID_3090986; gDNA_ID_1620707; Annot_ID_165335
gtaaaccgaaatcccttctttggaccgatgagggatctctggttcctgagcttcctataccagtattaaccacatcagcattgtaatcggatccttctgggttaatgggaagagaatttgcatctctggtcctgagtttatccatagcacctaacatagtcctggtatctgctgaatagtttagcttgtccactttcacaactgttgctttcacacgctgttcgtcgctgaatgtttcttcttttaccttcagcttgaagttgtacttggtaaaagcaaccttacggatgatatcttcgaatttttcctcatccttgtgttcattcttcacataatacaaatctttagcagatatgcccattatctcttcaccagcctcctggaatgctgtgacgcaagtaagatctgtatggtcctgtatctgaagctgcagtatatacctgtagtcacattcatcaacgcttttatcacacttttcgcaccgccatgtcccatctccattgtctgttacctttttgctgcatggacgatcaccgttcatgataggacaagctgtgtagcagaagttatcaaacttcaagtataaaattgtggcactgactgtgatccagtctggtttttcggaggttcctagtttctcatctttaatttgagatattgtcttacgaacatctactttgccactgccggaaaactcccgagataaggagatacaagggacactctttccttctctctcaaaccagttcttcagtttctcagcttcaacaaaatctgggtcaatgaacagctgacttgatccaatggtgctcactgtctttccattaaattcactaatcctgcccgccttaacagcaagaaccggaaacacaccagaatcacaaagactttgcagcctttgtccttctgcattgcagaagtcaccccacatagttacctcaacacttcggcctgacatatccttcaactgaagtgatcttttcggtgttgcagttccgtttttcctcgttattgttacagtaggactgatagatgacacaataccaattacatcaacgatgcagttattctccatgctctcaatatccccaatggtacggaaatggaactgatggcgcggaattgcagcatcctcttcatagcattgttttatagttgatgcattatccagcatgatctcgtaatcatttcgaagatgattaaagttcttttgtgcaggccgcaaacttcccctcgagataagataaagattaccaacaacaatctggtcatagaattgatcagccacagcgttaaaacaagtaacacgtatttctccgccatcagcatcaagaagatcaaagttgaacactttcccttccccacggggattactgtattgcttaagtgctgctttattcgtgactctggccttgatggtccacctacctgaatatggactaagagcattaactggaattatcttaggaggtgcttcattcctagccactggtcccctgtttgcatacatcggtggtggtggttgaggctgatgaggataacttgttggaggatcacgagcatagtcctgcctagtgactccattacctgaagacggattgctgtatgcccgagtggaaggtgttgttgatgcaggaacactagaaccagtaccaccaacctgaggtgaaatagctgcattacttctccctggctcgatattgtttacttgacggataccactaccttgttgctcagttgtattaaacttaataccagaatctgctccacgttgatcattatgctttcctcctggaacaggatgcccgataatatcagaaatctgttttaacacctccagttgcggaacaataacaatcctggcatcaaaaacaaaactttataagattatgtgaaattttggtaatgtagtctctaacatgaagcaactatcattggctatatatccaaacttcaaaatcatgttcacaaccaattaccttcgacccttgatgacatcaccgacgaaacgagtaagtctaacaatagaaccgggttgaagagtcccttctttgacaagattgttgagatcagttcctagcattccttgatgcaagtatgtcccatcagataacaccatcctaaacctctctcttgttggatcttgttgagccataatctgcttcaaatccgtcacttgcaacaccggaatcatatctgcttcagtcgtcacttctccattcattatcttcccgattgctcccgccgtcaaacttacctccatcattacagattgacactaaaacccaaattcaaaagcgttacaaacctcaagaaaatttggataatcagtagaagcaattcgagattcgaggaggaaaagggtgaaatctttataaatgaattcaaaattgaggagacgaaaaacgatttgtttgaattgacagagaccagaggttgaagaagatgaaggatttgagattagcccctagagtgaaaggtggaaactttacgctccctttgagagggaaactaaagaaggagggtttcaagaatttggaaatcacaatcgagccacgatttggtgttattacggatctaccccttcacaaaattcccttacaagcttcgttaagatgtagactggtaaggctcaaagcacatatataggcccatttgaaggcccaaaatggcaagtaaacgaacatattacgtggaagacgtggcaagtgtactgctgagtcagcaatctctctccatcacattcacattgatcaaccctgtccgaaaaaattattttattattattttttgttgtaattgcatttaacacactcgcatcatagtcaaagactcaacgcggaagggaaaaaaaaaaaaggcgcaattgaaagaaaaaaattgataatcggtaagatttgatgtcccggcgtccgtcgttttgatcaccgtgagaaatggattcttcgaattgttgttctgagtaaaactcactcaccgtcaccggagaagaaagtgtaaatg

SEQ ID NO: 35869 - DNA, 3003 bp, Unknown; identical to SEQ ID NO: 35868
  misc_feature (1)..( 3003): 2750-1469P.txt file - cDNA_ID_3090986; gDNA_ID_2926173; Annot_ID_199642

SEQ ID NO: 35870 - DNA, 3000 bp, Unknown; identical to SEQ ID NO: 33951
  misc_feature (1)..( 3000): 2750-1469P.txt file - cDNA_ID_3090989; gDNA_ID_2926173; Annot_ID_199640

SEQ ID NO: 35871 - DNA, 3000 bp, Unknown; identical to SEQ ID NO: 4465
  misc_feature (1)..( 3000): 2750-1469P.txt file - cDNA_ID_3090993; gDNA_ID_2926173; Annot_ID_199638

SEQ ID NO: 35872 - DNA, 3000 bp, Unknown; identical to SEQ ID NO: 4395
  misc_feature (1)..( 3000): 2750-1469P.txt file - cDNA_ID_3091033; gDNA_ID_2926174; Annot_ID_199739

SEQ ID NO: 35873 - DNA, 3003 bp, Unknown
  misc_feature (1)..( 3003): 2750-1469P.txt file - cDNA_ID_3091045; gDNA_ID_1620660; Annot_ID_163794
aatgcatctagttctttgtccatatttatccttctagaaactagcgcagaacagtattaagattattactgagtcctttttccatgttgtcctccctcctcacccagacgattgctacagtctgcatgttccttgcgggaaaagtggaagaaactcctaggccgttaaaagatgttattgttgtctcctatgagataatacacaagaaggatcctactactgcacagaaaatcaagcaaaaggtctgaatattctaaactttctctaatccggtttcctgtttagtaataagcgaatttgcactgtttctcgcatattctattttactatgacataagttttctactaaacccaggattgcacttgtttgtgaacaatcctcctatgatcattgtccttgtcgttggatctctcatctgtgctggtcaccgtctctattatttctcttctttgtactgaacgtatttcacttttgcaggaagtatatgagcaacaaaaagagcttatactaaatggagaaaagattgtactttctacgctgggatttgacttcaatgtttatcatccttataagcctcttgtagaagcgataaagaaatttaaggtcgcacagaatgctctggcccaagttgcatggaattttgttaacgatgggtacgttaaaagtctgtttccttgaaagcttcagatagatctatctgtcttgtattttcttcttcatacaatgaaaagatgcttgcagtctgcggacgtcactctgcctgcaatttaagcctcaccacattgcggcgggagcaatttttcttgctgcgaagttccttaaagtgaaattaccatcagatggagagaaggtctggtggcaagaatttgatgtcacacctcgacaactagagggtgagagaactatctttatctttgaattaattttatgaaactgtttccactttttctgtttgacttgtatgccttattttgcatctgatgctaagagctactcccttatgtatactgcagatgttagcaaccaaatgcttgagctctatgagcaaaaccgtgttcctgcatctcaagtaagcgaagtcgaaagtagtgtaggtggaggatcagctcatcatgttgggtctaggccatcagcacgtctaactcatgaacattcaaattctgataatctcgggggctcgacaaaagctacacaaaaccggagcaatgataatgggagtggtgaggcaggtagtgtcatcaccgagcagaagggggaaagagatacagaaacgaaagatagcatgcatactgaaagtcatccagcccataagtctagatcgggagttgaggcacctggggaggataaaatagagaaagcaggtgcacattttccagaagatgataaatctagaattgttggtacagctgatgtcacggtcagccaatccccaaaagacataaaaatgtttagagataaggtgaaggccaaactagaggcgaagaaggtccaaggtgaaaagacgagaaagaaggatttggtggatgaggatgatttgatagaaagagaactggaagacgtggaattagctgttgaggatgacaaagatatacaaaacaaaagctccatgggtacagaacatggcgagattcttgatggaaacaacttggtggtcaataccgaggaaggtgaaatgatagatgatgtttcttcaacaatgcctagccggaagagaaaaatggaaagtccttgtgaaaaacagttaggagaaggaaagagacgacacgacaacagtgagaatgtggaagaaggtcagaagacaaacccaggaggaagtagtcatagttatggtgacagagagccaagaagacactcccaagagaggtagatgatcaaaaccttctcatggtctattagagacatttcccaaccatgatgcgaaatgagtccactgtatttacaatgttggttatcttttcattttccttggcacttgtattcaacagttgagaaactaaatcaggtttccatccatcccataggatttagggtctctataattttgatctttgttagcattcccttttgtatatcgggggaataaaaaagaattttgacgaatttatttagagccaagacaatattagtgttttgtcattcattgccgaaggatgttttgataataacaatatgaaacagagtggtcaattgatttgtcaatgtgtagttgtttttgtaaggtttgttttatgttaagtccactcgtaaccttgttcccattgtcattatactgcttttcgtatgtatcggttagcttggtgaccaatccggttaaccacaaaatcaggcggaatagttgtcaaattaaagagcaaaaaagactcatgaaaaagagctgtaggggttttcattttttcaattcgttttcaaaattttcaggtttaaaaataaatacaggtctgaattaattcgctcggtttgaattttcgggtttagtccagtgtgatttagtcggttaagttgctcaaaattttggatttggttcggtttattcattatcaaacacaaaaacacaaaaaaagccaacctaaagaaggaacaacaaaagacctaaaaaccctctcgtcttctcttcttcttcttcttcttctccttgctctctcttgtcgtcggcggcagattatccaatcgttaggctatcgttccgacactctacagtcattacaaacatttcaatacaacaaaaactcatccttttcttctcttattaaccataatttcggattccctttctaagtatacagctttcccagaacgagctcttgcaaagccaaagaatgtaagtatttgtttctttagggttttagcgaattcaatcttagtaagtcatcttcttcttttttcgacctttgtataattgcaggtcgaggatttgtgttaagaatttgccaaaacatgtgaaagaggatcaacttcgagatcacttttcacagaaaggagaaatcactgacgccaaattgatg

SEQ ID NO: 35874 - DNA, 3003 bp, Unknown; identical to SEQ ID NO: 33721
  misc_feature (1)..( 3003): 2750-1469P.txt file - cDNA_ID_3091045; gDNA_ID_2926174; Annot_ID_199713

SEQ ID NO: 35875 - DNA, 3003 bp, Unknown
  misc_feature (1)..( 3003): 2750-1469P.txt file - cDNA_ID_3091065; gDNA_ID_1971816; Annot_ID_175972
tcatatagtgagcatctctacttgctttctttttgtttcactcttgattctcaaactctttgagtttttacctttttttatttatttttgtgccattttccataagaacttgaaatcaaaatgtcatatatttcttgattttctgatccttgttattcatctttgtctcgctccatatgattctgatgtggatttggtactcaacgaccaatcacttaatttgaaaccactgtgggcagattacatcaacaattcaaggagattgcagaatataacataaagaacttaaagaggaaagttgaaatgtgaagagataatgaagaagaggaaagagagagcttatggaatgcgaccaccacctctgccactgaaagatgggcctgcatcgatctcaccatttgtttgataactcctcattcttctccctaacaaataacaatcattattattgttagttttcatggaagacaataatttactaagtcatacgacttgacatatgtgtagtgtagagtgtaaaatatatatactatgagagtctatggaacactaaccagctcttgggagtgattcttgtttagaagcaagaacaagactgttgcaacgaagaagaagcagaagcaccataaagaacacaaaacccaactgtgaaaaaacctgctttaccattttgctcaatatctatgattctatattggtttttcgtattttttaaagtgttgtgtatatatagagagatagtagacgctgattagagatatggtttattttaataggatttgtttaatgaaagattcgcaatacagagtgacatgataagtaatgagatggacacaaggaatctcacgtgtcctcatcttccaacttgttcttccaatggtgagctcttatcttctataaatctataaaaatatatataatctctttcttaattttgatcttcgaggcttttgatgtagacccgtgaggatagagaaaaaatagttctaagacagagccaaaaggacaccccttttaagtcagtggcacaagattttaagattatttgcaaggttgaccatatacttcattaaacttgagagatcaagtttgtgacatcagtagagtttatacaagaatatgaagaagctgctttcttttcatgcaagaaatattaagtttcatgtcttagatcccgagctgcaaaaaaagagttaaagatgtttgaaattaatgcaatgaagtatccacgagaatctttatagtctcatgcaaatgatgtgaactcaaatctatgttcaaactcactcttgttgttggcggtagtacagagcgaacactctcaacgggtgtgagtatgattcttctgattgacattgcagtaactaacctggttagtgagatcttctgtttcctcttgagacaccatctctatctgcaaaaacatgacacagccaatctttgtgattgaaccaggcttaaaagcatgctcttaaagatattttttgtgatattttgtaccgtcatcattatcagtgagaacttgacctttgggattcaagaaccttcaaagctgcaaaacccaaaaaagaaagaagttgggccactggaagcaaagcccaagcccaatgcgcagcctttgaaagatcctcagcaacggtcatgtccacctgtcaataaagccaaaactgcagtcatcacacagctaagagaacgtacagattcaacgatacctttgaagaaccaatttgagtgtcttggatccggtgatgattgccaagactgacacctgtcattattagggtttaggctacatcaccttgtattcaatataaaaggactttatgatgtaatgtgaaacctaagtcgaaatataagaaagataagttctctatatttcagattacgttcatggtatcagagccatggcaaatcagtccatggagctctattcctatcctgttctaaacatctcaaactgtgttactgttaagcttactgagagaaattacctgctctggaaaactcagtttgagtccttcttgtctggtcagaaccttctcggcttcgtcaatggcgctaccaagagtccagatcctgtctcagctgtcacgaacattgatggtgttgttacagagatcccaaatgctgactacagtgctaggcacagatctgaccaagtggtgaagtcatggatcttaggctctctctctgaagacattctggaagaggtcatcactgaatccactgctcaacaagtctgggaaggtctagccaggtatttcaatcgtgtctctactgctcgcctatttgaactgcaaagaaaacagcagactatgtgtaagcatgatacacctatgatagattacattaagggaataaagaacatttgtgaacaacttgcctctgctggtagtcctgttaaggaacaaatgaaattttttgctgctcttaatggtcttggtcgtgagtatgaacctattaagacatccatagagggtagtatggaatctacacctgctcctactctagatagtatcactcctaggcttacaggctttgctgaccgtctcaagagctatgaagtggtgtctgtcactccccatctagtcttcactgcagatgctcctgatgctggcaactactatcagaccaactacagtggcagagggaatttttctggcaagggaaacagaggcagaggagcatacaacaccaagggacgtggctttcatcagcagaccacaactggctcttccatgtcaggagaaaacagacctgtctgtcagatctgtggaaagctaggccatcctgctctcaaatgttggcacaggttcaacaatagctaccagcatgaagaactgcctagtgccttgacagctatgcacatcacagaagttacagaacacaatggacaagagtggttccctgatacaggagcttcagctcatgtgaccaacagtcatcagcatctgcaacaatcaagaccatacaatggttcagacgctgtgattgtaggaaatg

SEQ ID NO: 35876 - DNA, 3003 bp, Unknown; identical to SEQ ID NO: 35875
  misc_feature (1)..( 3003): 2750-1469P.txt file - cDNA_ID_3091065; gDNA_ID_2926175; Annot_ID_199820

SEQ ID NO: 35877 - DNA, 3003 bp, Unknown; identical to SEQ ID NO: 16931
  misc_feature (1)..( 3003): 2750-1469P.txt file - cDNA_ID_3091079; gDNA_ID_1620645; Annot_ID_163215

SEQ ID NO: 35878 - DNA, 3003 bp, Unknown; identical to SEQ ID NO: 16931
  misc_feature (1)..( 3003): 2750-1469P.txt file - cDNA_ID_3091079; gDNA_ID_2926175; Annot_ID_199812

SEQ ID NO: 35879 - DNA, 3003 bp, Unknown
  misc_feature (1)..( 3003): 2750-1469P.txt file - cDNA_ID_3091085; gDNA_ID_2926175; Annot_ID_199807
actgttctttgtggcaatgctatgtgtgcaagaacatagtgttgagagaccgaccatgagagaggttgtccagatgatctctcaggctaaacagcctaatactttctaaatgcagtgatgttatatatataagagactaaatatatatttttctgttttatgtgtttcatagagttttgtttttagaatttgtaatgatggtttggtggtgatatgagtttatattgaaattgaggaggaaaaaaagggttagcattatatcttcctatcataaagtatcaagcaaaactaaataacatttgctagaaaattatgaattatgtgaaagatttgaaaaaatagataactgttctttgattcatttggaattataaaaatcatgatgaccaaagaaaaatgttgaaatcactcaagcatttgatttaacatatgattatccaatatctatagaaatagttagcatttgagtgtttttactttttagtatccaattcactatcattgatatttttaattttgttgtctagctcgatttataacatttggctagttgtaaatcgttatcccaacattgtattccaaaaaaaaaaaccagttagttattcagtggttttgaactgagcccagcccaaatccaatgatgtggttctcgaaactttttgggttggtttaacaaaaaccggttcagatcttttcttttgatccaccaattgattggactaaaccgacttataacagtcgctacactcctatagaaaagcttgaaattgaacacagtcgatgaattttcctctccgcctggaagattgtggagctcccagttgttgttaacaacggtctagagattcgtgtctcttgaaattcgatctgagtttcaccttcaaggttcgtcaatgatccgtagcaatttgcttcgttctaaaccctaatttgagatctcaattatgtgattttttcgtttaggttttaatcaggaatgaagcattcaaaggatccgtttgaagcagcgattgaggaagagcaagaggaatcgccaccggaatcacccgttggcggaggaggaggaggtgatggtagtgaagacggacgaattgaaatcgaccagactcaagatgaagatgagagacctgtggatgttcgccgtccgatgaagaaagctaaaacctctgttgttgttactgaagctaagaacaaagataaagatgaagatgatgaagaagaggaagagaatatggatgttgagcttactaaatatccaactagttctgatcctgctaaaatggccaaaatgcagtgagtctttgtagaattttgattgttcttcatgtttctttgatgattgattgtttgttgaattcttcagaaccatattatcgcaattcactgaggatcagatgagtagatatgaatcttttaggagatctgcacttcaaagaccacagatgaagaaggtatatatgttatatgatttgtggttatcaacattcttaattttgtttcattgcaaatatgaaccatttagcttttatgttaatgcagttattgataggtgtcactggtagtcagaagattggtatgccaatgattattgttgcgtgtggtattgcaaagatgttcgttggtgaactcgttgaaacaggtaagccagtgcaaaaatttccaatgattttgtttatgtgccaacaaagctcatttactgaacctcaatacattatctgtagctcgagttgttatggcggaaaggaaagaatcaggacctatcagaccttgtcatatcagggagtcttatcggagactaaagctcgaaggaaaagtgcctaaaagatcagttccacgccttttccgctagtcaacaagagccaaaagagaacttatatcagcctaagactggggaatttaccaatgctgctcaaggataagggtctacggcaggtttaagctggcgagatttgcctatcaatctcatcataaaggagaacttctttggcttccctggtggatcatattgttctttgatgttcttaactttgtgtgacaacttttgtagtaaatcaatctttggatacagaccctgaaatggctatcagtcttacggtttggtttttatttggtttacgtttccagttttcattttcaatacaagatcaatctttgactacagaccacatggcctaaaagtggcaatccggtttactaggttggattcggtttcatttccggttttatagaattcgaaatcaaataaaatcatttgtaatccggtttatttggttaaatttggctatacctaaaaattggttttagtattgattcgtttttggtcgaacattacaagaactgggtttataagttcaaattcaaattgtgtatttcttcggcgtgattgaaaaccgtcgcgatcagaattcggtctactgtcaaaattggtacggagacgttttgaatcacacaagttccggcgaaagaggatctagtgggcctgataatgggccgatctcgaaacgaactattacgtgaagagaagaaaacaaagtgggttgcgaattgaaagtctacagaaaataaaaggactggattggaaaaataaaaagaataaaagaagttttgacacaataacgcacccactatctttctccttcccttccgccttccttcttcttcttcttcttcttcatcctcctcactgtttaacgcagagcgcctccgtttcttctcttctcctcctctctcttttctctctacacaaatatttttcccttcttttttcattctctttattcaatataatccttttgattcgctggtgatcggtacgagaaacttagaatcacacgaggaagctgtgtttcgtttatcctcgtttaatcggaatcgaaatttgttctggagaagaaatttaacgaatcatagattcctgatacaaaaaaaaaactatcacagatcggaatcggaaacgtaaccattacataattcgaatctggttttcacttgggtataatgatg

SEQ ID NO: 35880 - DNA, 3003 bp, Unknown; identical to SEQ ID NO: 19103
  misc_feature (1)..( 3003): 2750-1469P.txt file - cDNA_ID_3091087; gDNA_ID_1620645; Annot_ID_163204

SEQ ID NO: 35881 - DNA, 3003 bp, Unknown; identical to SEQ ID NO: 19103
  misc_feature (1)..( 3003): 2750-1469P.txt file - cDNA_ID_3091087; gDNA_ID_2926175; Annot_ID_199804

SEQ ID NO: 35882 - DNA, 3000 bp, Unknown; identical to SEQ ID NO: 19115
  misc_feature (1)..( 3000): 2750-1469P.txt file - cDNA_ID_3091104; gDNA_ID_1620645; Annot_ID_163186

SEQ ID NO: 35883 - DNA, 3000 bp, Unknown; identical to SEQ ID NO: 19115
  misc_feature (1)..( 3000): 2750-1469P.txt file - cDNA_ID_3091104; gDNA_ID_2926175; Annot_ID_199789

SEQ ID NO: 35884 - DNA, 3000 bp, Unknown; identical to SEQ ID NO: 8466
  misc_feature (1)..( 3000): 2750-1469P.txt file - cDNA_ID_3091118; gDNA_ID_1971811; Annot_ID_175750

SEQ ID NO: 35885 - DNA, 3000 bp, Unknown; identical to SEQ ID NO: 8466
  misc_feature (1)..( 3000): 2750-1469P.txt file - cDNA_ID_3091118; gDNA_ID_2926175; Annot_ID_199775

SEQ ID NO: 35886 - DNA, 3003 bp, Unknown
  misc_feature (1)..( 3003): 2750-1469P.txt file - cDNA_ID_3091129; gDNA_ID_1971811; Annot_ID_175743
ttaattatatttagtgttgagatagtacgtttttttttttgttatttgtaagtattaaagttttaaacttataagaaattcttaaaggtaaacctctaatttatattccagtgttgttgtttgataattttaatacttttattcttgaagtgtatttgatgtagttcacataggtttattatagatgtattcaaatagtaatatgaaataaatttaaaatggtgacaatagaacatatataatcagattgaaatcttagacaattaaaaaaatcacagctatcaaattttactctatatgtcattaattaatcataacactggaataaaaattgtcatttgcattatttcttatgtttttggcaataatttgtaacactgcacaatcgcttaacgacataagttgcaaatgaaaatttgcagaataaatatttgcatgataaaagttatataataaactattaaacaactatatactcatttatttgcataataaatttatttgtatttttaggtaaaaatataagcctatcgttttttgcgttttggtaaacattatataaattttcttaatgaatattttttttgcataatcacattagaaaacgtaattccattattatttgtgttactaaccagagctaaaacataagaaataatgtaaaaaacaattattatatactatttcttataattattaattgtgtcggcaaaaacctatagttttgacctcgtttgttcattgttatagtgttcccaaacgtatggcgagacgtccttattgtagaatctgtaagcacacccgattttgaaatatctgcaagtttgtagggatttaaaaatgagcttctactgttttattattcctcaaataattcatgtattaaaatgtagagttgttcacaaaaacacaagttcaaaaaattgtcacggttccccactataaaaaaaaaaaaagatttagttttactacgcttttgattacggtaaatcattacaaatattttaaatgatatagtactttctttcacatatctaaaaactacttctagatttatgacatggatcctctataatatttacataaagaaagtggtgaaatgttcaatcttaattattgttacaaaaccaagtcgttgaaatgtgtctaacaaggtatggtctttgatttgctggcgggaaatcatatactagaagacaactcaaaaccctggccattgtattaaattatcattaaatttgtatagtaatataatactaagagatatttcttttcctaatagcatatgttatagcctacagtgttgataaataattatggtgaaagctacggtgcaaccaaaaagaacgaagaagatataaaattcgagaaaggaaaaattaagattttgaaaggacaaactttcaaccaataaaatttgatctgtaagagttttataagaattcatttgaaccagttttcaaaacagaaaatactttcgtcactcacatttcaaccgtttgctataatacttaacaacacttatatattacaataaattcaaattacaaatttaacaaaaccataatattaataaaccttttgtaaaaaaaatactccataatacaattaaatttcaaaaatctaaaattttgtatttattatcaaaatttaacacccgagcgaagcacgggttatcaatctaataatacgttaatttggaagtataatccaagttccaaccatgaaataagaaaaaaaaaaaaaacttatccaaccaaaaatgattaactacacatcatctaagacatgactttgagttctgagttataaaatcacttgatgaattaagagtatcagtcaattatgtacaatttcataaatgaaaagctcataccgaactttctgacaaaaatgaaaaatcaaatcttacagagttttctttagacttggtcttttttttttggtaaacggtataccgtattcgagtaagactagtctttaactctttatcagtatttctttttgtttggtcgaaaactaatatataattcattcgagaagcatagagttcgacgcttcctagtgtagtcattaatcaacgaattaatttgagtcattcacttaataaaatcagtaaaggggagtaattaaaatataactgcggccacgagtagtcggagataacgtgagcgtgatcaaaactgaataaaaagccacgtgttgtcactggaagaattaaacaattactaattgtcattcaattatgtgaaataaaatattaggtgaattctgagaagaaagtttcaatttggggttatgaagagttgaagactattgtttcccaatctatagattattattatgcattcgaaagtcgcaactagtttcagtgatctgttccaaggttatgattatattttgacatatatatgtaattatgtattatggattcgccagatagatttttttctaattaagctagtacttagcgcaattattatacgtaatgttattaaataaaaagttactgtatggtttattttttatttaaaaaaagaagagaaataattaatgttatgtccgtctctcatcgaccaaatcatgtttctctcgggtcattcatgtatctctttgtctttttctgcacttttttcccattatctgatgattcacagtttaatattcgtacacgattctatatcacttgtatagttatatatatatttttaaacactcgaatatataatttggaatcggtctgttctcttgattctctacactctaataaaaacaggaattgatttcaaatggagaaaaagagttggtaaaagaattcattcataaaaatcattgctacaaataaataattagtgtgacaaaacaagaacaatgaccttacaaaactgccagtgatgacgtttgccttgaccttttgtacttaactataagaaccgacaaaataaacagagaagagaacagagaaaacgaaagaaacgctttaaaccccctcaagaacacatg

SEQ ID NO: 35887 - DNA, 3003 bp, Unknown; identical to SEQ ID NO: 35886
  misc_feature (1)..( 3003): 2750-1469P.txt file - cDNA_ID_3091129; gDNA_ID_2926175; Annot_ID_199768

SEQ ID NO: 35888 - DNA, 3003 bp, Unknown; identical to SEQ ID NO: 19048
  misc_feature (1)..( 3003): 2750-1469P.txt file - cDNA_ID_3091133; gDNA_ID_1971811; Annot_ID_175741

SEQ ID NO: 35889 - DNA, 3003 bp, Unknown; identical to SEQ ID NO: 19048
  misc_feature (1)..( 3003): 2750-1469P.txt file - cDNA_ID_3091133; gDNA_ID_2926175; Annot_ID_199766

SEQ ID NO: 35890 - DNA, 3000 bp, Unknown; identical to SEQ ID NO: 4345
  misc_feature (1)..( 3000): 2750-1469P.txt file - cDNA_ID_3091158; gDNA_ID_1620701; Annot_ID_165067

SEQ ID NO: 35891 - DNA, 3000 bp, Unknown; identical to SEQ ID NO: 4345
  misc_feature (1)..( 3000): 2750-1469P.txt file - cDNA_ID_3091158; gDNA_ID_2926176; Annot_ID_199897

SEQ ID NO: 35892 - DNA, 3000 bp, Unknown; identical to SEQ ID NO: 8549
  misc_feature (1)..( 3000): 2750-1469P.txt file - cDNA_ID_3091174; gDNA_ID_1971816; Annot_ID_175984

SEQ ID NO: 35893 - DNA, 3000 bp, Unknown; identical to SEQ ID NO: 8549
  misc_feature (1)..( 3000): 2750-1469P.txt file - cDNA_ID_3091174; gDNA_ID_2926176; Annot_ID_199844

SEQ ID NO: 35894 - DNA, 3003 bp, Unknown; identical to SEQ ID NO: 24452
  misc_feature (1)..( 3003): 2750-1469P.txt file - cDNA_ID_3091184; gDNA_ID_2926176; Annot_ID_199837

SEQ ID NO: 35895 - DNA, 46 bp, Unknown
  misc_feature (1)..( 46): 2750-1469P.txt file - cDNA_ID_3091188; gDNA_ID_2926176; Annot_ID_199833
tcctgcttctataggcaacagtctctctctcattcctcagaggatg

SEQ ID NO: 35896 - DNA, 3000 bp, Unknown
  misc_feature (1)..( 3000): 2750-1469P.txt file - cDNA_ID_3091202; gDNA_ID_1620683; Annot_ID_164541
tttcttctaattagtttcatttttgtttggtttctctctctcaaaaagataactggtcatcaaaaatgattggcaagtgtatgtgaacattaaattaggtcgaccctaaatatataataacaccatgacatttcgaaacaacttgatggatatcagaaaatccgcaagatagcattttggtagttagatagtaaactcttggtattttcaagattcaactatccacccccactattttggtacgacgtgacgagtgaacgtctagtggttatcgctctacgaaaaaacgtttctcatttaagttctaacatgaagagtcgcaaaagaaatgtccatataaaacttacgatatttgcaggttaatcagttaatcgaacctgcaagaaccaacaatagaaaagaaaaaaatgcaataaagatatgacatccaacttcaatcatttgaactaggcgtgttaaaacaagtcgatcttaacattacaccaaaaaaagaagaaaaaaattgattttatgatacattgacacaagtgagaacgaagatatggaggtggttctggtcttgaattggtccaacaagtcgtagacaataaaaatagaaaagaaaaacaaagcatgtgatgattagaataagatccagcaaaataaccgttaccctgaaaccttgtcggctcatacgtggtgatttctacgatcacatgcaatttttggcccgagttttctcgaatgcaaatatttgcatcaaacaatgttccaattgttgtttctttcccttattaaatagcatttttcttggtacttgtgaaataaattgatcagtcaaatggttggcttcttcttctgatgacttctggaagaaaattctttgaaatgttggagaccacgtgccaacaaacactgtgtaacagaaaactaacaaacacatggtctgattttccttgaccacctctgtttcagtggtataaaatcttggtagaacaaaattttgattacagaaaaacgttatgttctgtaacattttaagagtgatgttttgtagtcaatagaatttaattgctcaactaaagcaaagcaaaactgcaaaacatatttcttgttctcgtttgtaaggacgttttaatgataacagatcatttcagaacagaccttctaacatttgcataatgtttctttgaactcagtcctttagagatgttgttatactagagattcaacattcgctaaaactgtcatggagatcgaacataagatagagaactagcagtttccaaaacagactcaatgttaaggaactttagaagtcaatggaaactaaattgtagccacaataaaatgaaaatcgtgtagctactcgccttacttccatagataaaggtgtaagaaacaattttgctgcagacctagtatttcaaaacgctaaaccctaatcaatacaagtgcaatactatgtttttcactcatttacgaggcaaaagagtatcaaaactcttctttgtggatcaatttagaaatgtgttcttttgaaatagacacacgcacatgttctttataggattattatacaacaatgctcaagtctctgcggtttcttctttccttatagctttcagtctttcttgaagtttcttgctttgttcgaaatttaccttccgcttcacagctttctgcaaatatattgtaaagatatcatctctaagaggaaaactttgaaccgaaacatacttaatcgactattagtaacttattacctcttggcggaaacatcgatcaagctttactttcagctctgtacattctccaaagaatttcccaatcggatggtctatatgacacttttgaaattcctcaattatctaccaaacatatgacaaacagaaagaattagtaagtagaacaaaacatatcaaactgatttcttttgaaaggtttgctctttccaaatgcagtcatgtagcttgtttgcaaaggcttactaaagctagagattgacacacataggagttatcacataaattgcatatattttacaaaaatctctcatctcatttgcgtacagctctaatacactgttataagattgatcttattctcaaagaagcagtcacagaggttaaaactaacagaggattgaaactacaagttgagcaaactctcacctccagacacattggatgtctatgtggtgtaagtggaggatgcatctttcacttcttctgcaagaaaaaagcaaaatctgaatcgcttgtaatggatgttaaaaatcagatcttttatttctctgctaaaaacccataaggaatttacagcaaaactaagcaaaagacccttatgttgaagaagcaaaagaaggaaagatatggtttttgtatcatactaacatttcacaagtcattctaatattctaaaatttcggatctcaatttaacatggagcagaaccacatgattttcaagagcaaatcagttcgaaaatcatcgattcgagattcaaaccaaaacctaatcgaagaagaatcacgaagaagagtaaaattaccttaatttgggtatctataagctgagagagagagaattcgtttccagctcagagaatcgatggcgaagaggaaagagatgaagaatacagacgacgggtcaaaattttcaggttaatgggcctatttaactttactagttaatgggcctatttaactttactagttaatgggccttatccgttacttccataaacgcatttcgtatgttttggatgagaatcagacatcagagggaacttggaggacacagagaagcgcaaattatcagacagagtgagaacgaagaagaagaaagcacaggtaagttgaacaatatgtgtttcgattctctagaaaacttacacaattgtaaattgaattcactagatatctctagtggctgaaaaggagaaagctttaagatttctgggttcttcttcttcttcttcttcttcttcttcttctctgaattgatttttttcaggatg

SEQ ID NO: 35897 - DNA, 3000 bp, Unknown; identical to SEQ ID NO: 35896
  misc_feature (1)..( 3000): 2750-1469P.txt file - cDNA_ID_3091202; gDNA_ID_2926177; Annot_ID_199945

SEQ ID NO: 35898 - DNA, 3003 bp, Unknown; identical to SEQ ID NO: 19705
  misc_feature (1)..( 3003): 2750-1469P.txt file - cDNA_ID_3091206; gDNA_ID_1620683; Annot_ID_164538

SEQ ID NO: 35899 - DNA, 3003 bp, Unknown; identical to SEQ ID NO: 19705
  misc_feature (1)..( 3003): 2750-1469P.txt file - cDNA_ID_3091206; gDNA_ID_2926177; Annot_ID_199942

SEQ ID NO: 35900 - DNA, 3000 bp, Unknown; identical to SEQ ID NO: 4348
  misc_feature (1)..( 3000): 2750-1469P.txt file - cDNA_ID_3091218; gDNA_ID_2926177; Annot_ID_199914

SEQ ID NO: 35901 - DNA, 3000 bp, Unknown; identical to SEQ ID NO: 3257
  misc_feature (1)..( 3000): 2750-1469P.txt file - cDNA_ID_3091269; gDNA_ID_2926178; Annot_ID_200018

SEQ ID NO: 35902 - DNA, 3000 bp, Unknown; identical to SEQ ID NO: 3256
  misc_feature (1)..( 3000): 2750-1469P.txt file - cDNA_ID_3091277; gDNA_ID_1620635; Annot_ID_162859

SEQ ID NO: 35903 - DNA, 3000 bp, Unknown; identical to SEQ ID NO: 3256
  misc_feature (1)..( 3000): 2750-1469P.txt file - cDNA_ID_3091277; gDNA_ID_2926178; Annot_ID_200013

SEQ ID NO: 35904 - DNA, 3000 bp, Unknown
  misc_feature (1)..( 3000): 2750-1469P.txt file - cDNA_ID_3091281; gDNA_ID_1620635; Annot_ID_162855
tccttggctcacatcatgtatgtatgtatatgcagggatatggccagagtcaaaggcagtcaacgatcaaggccttggaccaatacctaagcgttggagaggaaaatgtgaacctggagaacagtttaacgccacaatacattgcaacaacaagctaataggagctaggtactatctaaacggtgtagtcgccgcaattggaggaaaattcaacagaacaatcatccaagatttccaatccaccagagatgcaaacggtcacggtacacatacagccacaatagctggtggctcatttgtccccaacgtgagctactttggtttagcccaaggtactgatatatatatatatatatatattatttcaccacagaagttagcttaagagtcaaggtactagttttataagacaatagtttgtttcctttttaaccgatgtgtgattcttatcaggtcttgtccgaggtggtgctcctcgagcccgaatagcctcgtacaaggcgtgttggaacgtaatgagagatgaaggaggaggaactgatggaagatgcacatctgctgatatgtggaaggcttttgatgatgctatacatgatggggttgatgttttgtcggtttctatcgggggaggtattcccgaggattcggaagtcgataagctcgattatatcgcggcttttcacgcggtggctaaagggattacggttgtggctgctgcgggtaacgaagggcctggtgctcacactgttgacaatgttgctccttggcttttgactgttgctgcaactactcttgaccggtcttttcctacaaagatcacacttgggaataatcaaaccctcttcgtacgttttactagttagagaaaacagttcaaagtttggagttcttttttgagtaacttgttgttcttttgttcgttcgtttttaggctgaatctctgttcactggaccggagatttcaaccggtttagctttcttggactcagacagtgatgacactgttgatgtgaaggggaaaacagttcttgttttcgatagtgcaactccaattgcagggaaaggtgtagcagcagtgatcctagcccaaaagcctgatgatcttctttctcgatgcaatggtgtaccatgcatttttccagattacgagtttggaactgagattttaaaatacatacgtaccaccaggtctctatcttgaaacaaaaacactctcttaactacacaagtgcatgtatatatatacatcattgatcgtcgtgccaacagatctcccacggtgagaattactgcagctactacactaactggtcagcctgcaacaactaaggttgctgcattctcatgtagagggcctaattcggtttcaccagccattctcaaggttattaagccattgcgtctcttatcaatgtttacttcaaaaggtttaacgtttctgagtaaactttgctaaatatgtggtcatgttttactctgtagcctgatatagcagctccgggtgtgagcatactcgcggcaataagtccgcttaatccagaagaacagaacggatttggacttctttcagggacatcaatgtcaactcctgttgtttctggaataatagctctcctaaaatctcttcaccctaagtggtctcctgctgcagtgagatcagctttggtcacaacaggttcctgcttcttcttattcttcttttccataaacaaaccgttacagactatcatctgtttcttttgtagcttggaggacaagtccatctggagaaccaatctttgctgaaggatcaaacaagaagcttgcagatccatttgactatggaggaggacttgtaaaccctgaaaaagctgctaaaccaggacttgtctacgatatggggattgtggattacatcaagtatatgtgttctgcgggttacaacgactcttcaatctctcgtgtgctcggtaaaaagactaattgcccaattcctaagccatcaatgcttgatatcaacttaccttcaatcacaattccaaatcttgagaaagaagtcacactcacaagaactgtaaccaatgttggacccatcaagtcagtctatagagctgtgatcgagtctcctctcggtataactctcaccgtgaacccaaccacactcgtgtttaagtctgcagctaagagagtactcactttctcggttaaggctaaaacaagtcacaaagtcaacactggctacttctttggaagcttaacatggagtgatggtgttcatgatgttataatccctgtctctgttaagacaacgatttcgatgtaataaaaagagccatatgatgctcattgtgtttgttcttatgtaatttgttgcaaatctaagtctaaaatgtcaaatcaagattcaagatcatcataataaaagatcaaatcacaaataccttagaatctcttataaaagatcatgatcataacctatagctgtaacattacatacaaatatataatcatcatattgactatatattataaagatgtgatattttagtgtacacataaatgcaaaaaatggaactggtttgctctcctgtgatcctatatatattaaagttcagaatataatctgttttactaaaatgagtaattcagacaatcatgatctaccaacttatacagatacctaatctactctattagttagaaatgattgatatcctcttatactcagctgaaattaaagtaggtacactattagtatatctataataagaaagacatcaataataagaaagacgacaattgtaagagttaaaactgagccctcttgagatccatggcgggaaataacgttacacaagagataaaaccggtatgattcagaattaccataccgatattgagccgaataaaccaataattgaattcgaatcttacgcaatagttcactccctaaagacacactatgtatataataaagcttctcttcgacagaatcacacacacttctcactgcataaaatg

SEQ ID NO: 35905 - DNA, 3000 bp, Unknown; identical to SEQ ID NO: 35904
  misc_feature (1)..( 3000): 2750-1469P.txt file - cDNA_ID_3091281; gDNA_ID_2926178; Annot_ID_200009

SEQ ID NO: 35906 - DNA, 3003 bp, Unknown
  misc_feature (1)..( 3003): 2750-1469P.txt file - cDNA_ID_3091285; gDNA_ID_2926178; Annot_ID_200003
aattgagggagcatgagaccgccattaatggagtcacaaacgtggtcgtattataaaaatggcgacgcgtttaccacgtgagagagacgctacgattgcataaaaagaagtcggcattggtatacatgtgtctctctgattcgtccacacggttttgtcgcatttgttggagaaaagataagtcttttaaacagaggtcggtatggtatgtatttggtttcaaggattcatgaaattgatatatgattgtgatgtaagttattgattttttcttcattcattacacgtcatgggctgagagaagaaatcaaaagagaggatttgtatctttgagcccaaaaaaaaaaggcaccatcttggaccattggtttggttggaccaaataatataatgatgtggtgaaaagttttttagcggttatgaaaatcaaaataaaaaaaaaaggcggtaagaaaaatggcaatgcagtagaaatggtggttcaaaaatggttttagaagtgagatcatctttatgctcatttatcttgggtttgttcgggctctaacaccatgtacaattttaatcatttgaaaataagtggaaagatctatacatttcatatactttatatacttatgttgaattagctccacatcttattggtaatggtttgacagtttgaattatagcagaaataaaaataaatatatagatttaagaaatataattgctccaaatgaatgacatatagttgaatgattggaaaaataggtgcaaatggttgcctaaaattaagaagttgaaagagttgaatgagcatttatctattttttttaccatttaagatgaataagttggaaaaatgattcaaccctttcaacttaaaaagttggaaaaataaactaattataaagaaattttttcaacttgtatatcttctatttcacagagaaatgagttgaataatattcaacttttatttttcaactcaaaatttccaattatttcatctctatgcaaccattttcagcaaaaccaagttgaacattattcaactcattcatctacaaaagagtagatgaaatggttgaacaagtttcttttataatttgttcatttttcttttttttttgttgaatgagttgaatcaattttccaacctattcatttcaaatcgtaaaaataaaataaatagttattcaacattttcaaccttttattttaaaacaaccaattcatctaaataattttattactttataacaatcgcttgttgaggagatgacttaatcacttttcattttctcttcgtgaattcgttttactaagtttccgttactttcaaatgtactcaaaacaaaaaaaacaatcgcttgttactataataaaagatcgatgaaacaagattctaatgttaagcattttgaaatgttacgaaaccgtacaaacaatttatgtgattaacgtcaaatgcataaaaacgcaaacacaaaaaatagcagttaaatcttataaagatatttcataaaatattacacactcatgaaaggtcttaaaagcttaattagttctcattatcaaagaaaaaaataaaagcttaattagttcttaccgaaaaaaacaaagcttaatgttgatgagtgaacgagtctttccacgtcgtccacactgtcctcgtcgtcctcgttgtctacgtcgtcttcgtggtccaggtcgtcgtaattggaagtggcgagagaaaatccgatttggcggtgcccaaaatcaaatatcgtatgatatctctgagtaaaggcattccaagaatattgtaaacaaattaatatataaatttaattgataagtaatttacgaaacaaaacgtacttaatgtgacgaaatggagagatagtcctccgaagtgaaataaaaagcacatcgggcaaataatttgctaccgctgctgccactttggcatttgtaaatatcatcctttccatatgactagaaaatagaaaacgaaaagagaaagtattaagttaacataaaacaacaaataataataaaatgttgtaaataaaacttacacgtctaccacaaatttgagagtaatctctcgggtaatgagatagaaaaataaatataaatgataaattgcattagtaaatagtatttgatacaaaataaaatttaaacattaaatcctttactaaccgggggaccgtatatatacggacagctcatatgaattaaagttttatgggtgagtgatcctaaaaagaaaaagaagatgtaaagtttatgtactgaaaacacacatatatagatagactcattattgtaattaattattacatgatatccgttgacttggatggaatgcatcctaatgattcatctattaccttcaatgaggttgaagtatatatgctcaacgacaaaatgaatctgatcaacatcccgaacgattgtttctcctcccaaattatagctgtcaccataatgaacttattcatagtaattctgtagccacaccgacaatatatttcgatgtaaaaatctttgatccatcatatttgtcctaaaattatttctaatttatttcttatttttatttgttatctaaatatacctaatctcatagctctattaatattttgacgttaaatcattgtataataaataaattgatgtacgtaacatgttcaaatatatacatttattttcagtagacttttagacacacaatttatatgattagagtcgaatgcataaaatctcaaacgcgaaaaataagcggttaaacttttaaacacaaaataatataaaaattgagcggttaaatcccaattgcggcggttgaatagtaccgatcaaaccaaagattttggaatttgacggaacaaataaaccgtggagcattggtcaataacaacactctttactctttcttccgtttgctcgaaccatctagtctaagagaaagaaaaaatactaaagagaaagaagaagaggacttgaatacggaagcttgagagaatg

SEQ ID NO: 35907 - DNA, 3003 bp, Unknown; identical to SEQ ID NO: 33576
  misc_feature (1)..( 3003): 2750-1469P.txt file - cDNA_ID_3091289; gDNA_ID_2926178; Annot_ID_199999

SEQ ID NO: 35908 - DNA, 3003 bp, Unknown; identical to SEQ ID NO: 19026
  misc_feature (1)..( 3003): 2750-1469P.txt file - cDNA_ID_3091303; gDNA_ID_1620640; Annot_ID_163020

SEQ ID NO: 35909 - DNA, 3003 bp, Unknown; identical to SEQ ID NO: 19026
  misc_feature (1)..( 3003): 2750-1469P.txt file - cDNA_ID_3091303; gDNA_ID_2926178; Annot_ID_199991

SEQ ID NO: 35910 - DNA, 3003 bp, Unknown; identical to SEQ ID NO: 19030
  misc_feature (1)..( 3003): 2750-1469P.txt file - cDNA_ID_3091307; gDNA_ID_2926178; Annot_ID_199990

SEQ ID NO: 35911 - DNA, 3000 bp, Unknown; identical to SEQ ID NO: 21148
  misc_feature (1)..( 3000): 2750-1469P.txt file - cDNA_ID_3091311; gDNA_ID_2926178; Annot_ID_199988

SEQ ID NO: 35912 - DNA, 3000 bp, Unknown; identical to SEQ ID NO: 4800
  misc_feature (1)..( 3000): 2750-1469P.txt file - cDNA_ID_3091322; gDNA_ID_1620733; Annot_ID_49430

SEQ ID NO: 35913 - DNA, 3000 bp, Unknown; identical to SEQ ID NO: 4800
  misc_feature (1)..( 3000): 2750-1469P.txt file - cDNA_ID_3091322; gDNA_ID_1620733; Annot_ID_166149

SEQ ID NO: 35914 - DNA, 3000 bp, Unknown; identical to SEQ ID NO: 4800
  misc_feature (1)..( 3000): 2750-1469P.txt file - cDNA_ID_3091322; gDNA_ID_2926179; Annot_ID_140458

SEQ ID NO: 35915 - DNA, 3000 bp, Unknown; identical to SEQ ID NO: 4800
  misc_feature (1)..( 3000): 2750-1469P.txt file - cDNA_ID_3091322; gDNA_ID_2926179; Annot_ID_200060

SEQ ID NO: 35916 - DNA, 3000 bp, Unknown; identical to SEQ ID NO: 8678
  misc_feature (1)..( 3000): 2750-1469P.txt file - cDNA_ID_3091351; gDNA_ID_1971851; Annot_ID_58404

SEQ ID NO: 35917 - DNA, 3000 bp, Unknown; identical to SEQ ID NO: 8678
  misc_feature (1)..( 3000): 2750-1469P.txt file - cDNA_ID_3091351; gDNA_ID_1971851; Annot_ID_176383

SEQ ID NO: 35918 - DNA, 3000 bp, Unknown; identical to SEQ ID NO: 8678
  misc_feature (1)..( 3000): 2750-1469P.txt file - cDNA_ID_3091351; gDNA_ID_2926179; Annot_ID_140489

SEQ ID NO: 35919 - DNA, 3000 bp, Unknown; identical to SEQ ID NO: 8678
  misc_feature (1)..( 3000): 2750-1469P.txt file - cDNA_ID_3091351; gDNA_ID_2926179; Annot_ID_200103

SEQ ID NO: 35920 - DNA, 3000 bp, Unknown
  misc_feature (1)..( 3000): 2750-1469P.txt file - cDNA_ID_3091359; gDNA_ID_2926179; Annot_ID_200096
ccggcgatgaggtctggctccggcgaagtcttgccgacttgcccatgaagtgtaaatttgggcagagagagatatagagagagacagtggaacatgggttttgttgttttggttttgattctttcaactttaaaaactgattagactaaagtggttccactttcgattaaaagcaactttttcacgtatacgaaagttgttcattaattccgtaaaaaaaaatcaattttctcttcttaatctattaaattcgctaaaagattattcggaaataattctccatcagatcacattttctcaaacatcatgaaaaagaaaaatcctctgataatctcaaacgattacagtataacataaagcatattaacaatttaataattaaaaaaaaaaaaaaaaaaaaaaaaaaaaaaaaaaaatttaataattaatgctagttttgtttctggctaagcacacgcgcataagagaacacgctttagaattaacaaggagtgtattacacgcgcttggttttcgcgtaaaagccttgtttagcgtattattatttcataagttcgatttcctaattcctaatccgtttcctttttattccgatcaaagcagcgaaaaaagcatcggagatatgtcgtctaaggacaagaaactatcgaagccaacaagtggtcgtactggtggtatccgtacactttccgatctgaaccgaagatcagaacctgattccgatagtgactccgatggacctcaagaatacttcaccggtggcgaaaaaaggttcgtacttaaaaaacccttaaatcactagttttactatgatctgcttaattatgatgtgttaactaaagtttttgatgattcaactataatggtcttaggccaattaagtgttttaatcaaaatcattactttttgagatttgtgtagtttagtgagtaatttattaatcatcaattatctatttgatgattagtatggttggtaaattgttggatctttgttttgtgttttatgtgtgaagtggtatgcttgttcaagatcctacaaaagaaccaaaacacgatgatgttgatgagatatttaatcaagcaagacagctaggagctgtggaaggacctcttgagcatccttcgagttctagaagctttacaggaacaggaagattgctttctggagaaagtgtgccaacggctcttcaacagcctgagcctgtgattcacaatattattttctggtctaatggattcactgtagatgatggacctttgaggaagttggatgatccagagaatgcttcttttcttgatgtgagtgtgaattttattttggttaatgcttatgaattggcttatgaatattgtgttgaactgtcttgtattttcgtgtattgcagagcattcgaaagtctgaatgtccgaaagagcttgagcctgttgataaaagagctcctgtacatgttaatcttatgagaagagatgagaagtgccctgtaagttcctattgggatacactaacttgtgcttgatccatcttatgactatggtaccaacacttataacatctttgtttcttcttcttttgtaggagaaagaaaagcttaaggtttcatttcaaggagttggaaggactctaggtggtgcaagctcatcaacagcttcaagccaaagtaacctaactgatgtagcagcggttcaatcaccgttacagagccttgtagtagatgaaactcttccatccacatcgatccagcttagactcgcggatgggacacgcatggtagcaaagttcaacaaccatcacacggttaacgacattcgtggtttcattgagttttctcgaccagggaatccaaacaactatacccttcaggtcatggggttcccaccaaagccacttactgacccttctcagaccattgaacaagccggtctagcaagttctgtagtcattcagaaattctagaaaagtttcgtttctctttttttgtactagagagagatttcaacaacttggaattgtactgaaaatattcaatcggcttattgttgtggcaagagaaataaaaacatcatatggtttctatcttgtttcgtttcaatgtgtttactttcatacttgttacctatatgagagtgaaaagtttgagttctaacattacttcaaatttcacatgaacaattatttgattttctttgttttattaaagttcaatctaaacaattagtgtatgacagtttggtaatatcaaaatatcattgaacttttgattaaatattcatgttattgctgtgccaaactggctattttggacgtacgtatatccatgattaatttagtttcattcactaatgttttgattagtttcatcaaataccaaaactagtgattattgtatcaaacaattagtaattttcattagccgaaagattaaacacgcgtgctaccattctagatttaaatataaacattgatcttgccagtaaatggctcaaatacatgataacataaataaaaaaaaaacttgaataaccatgaaaattattgtactgtttcacctataaacttttacttttacttgctcaaaatattcaatcaaagttcaaaacgacagtaaaaatttgaaattcgagccacttttttttcccattttacggtaaatgtggcaggaaaaagtaacaatatttccaaaattgttataagagaaataaaataaaagcaaagggcaaaaaaatgaattgggctttgtgaacagtaaaactcccaaatttgcaaatgactcatcttcttcacctggagagaatctagggttccagatttactcttcgtcttcctctcttcgcttcttccccactgggattttccttttcttctccttttttctctacccatcgatctacacatcctgatcttcttagaagccccaatccttatacattccgggaacaaaaaacctagctttttttttattccggcttaaccagttttcgaaaaaccctagcttccatg

SEQ ID NO: 35921 - DNA, 3003 bp, Unknown
  misc_feature (1)..( 3003): 2750-1469P.txt file - cDNA_ID_3091362; gDNA_ID_1620646; Annot_ID_47613
attcgtaaagatgatgatatatagaaagagcttttacagtagcaagtacaaataattgataaccaaatgggtagaatttaactcgaagacgtggcagagaaggtgtactataaggaatttaagaacacaagtagaggattaacaaaagaagaaaaggctttggaaaaagcaaaacaaaactgatagcgaaagccaaatagcccaaaaagaacgcgagtcaaatgttgcctcccaaaatttactatttttttactctcatattaaaatcactctaaatatacatagaaaattgttctccaaaacattaaaatatgttgaaaaaataaaatgaaagcaaattccaaactcccaccgacaccaacacaaacacacaagtcagtaagtcagattcaattatcaaatatggtcaagaaattcaacaatctcatatcaatcacacaagataaagtataaaaagacttatataaatgattgaatcagtgatattaactactattaacaatcttgtcttatgagttaaatgaagtcttaaatacgttttaccaattaatgtgaatgaatctacggagaaacagaggtttttagtataataatcataaaataaacctgaattaaaatattatatactaaaaaatagtttctctctcttcataactcagagcaagcttggaatcaatctctcaatctctcactctctcactacctatccttttctttaatggcgatgtctctaactactactatccccaacacacactgttactcttcttcttcttctctgtcactgtctattctctcttttggacctttcatggctatgtttctctgcaatggaagtccaagctcgtgatcaccaacaccgacacgctaatggctattggagatagagctatgtttactgttttgcttctattcattgcttcgatctctggattctctgttgttcgttgtgttactgatccatctgatggtaaagtattcagctttatgagttttcttcttctctgcttttaacctcattgttttgattgatcatctatgtgatttgagagtgaagggtttttaaaagttgattactttagatttagaagatgaaacccttttgcattaatgtagatttgatgatttttgacaccgtctgttttcctgagaacccgccggaaaataatatttctgctttacttacttttttagctcaaaaaggaaagttgtaaactttatgaaagatttttcttctttcttgatagatcctttgatgtgtttttctgacttgtgagctgttttcttctttctggtattattgcagttcaagcccttcaagttttgtatacttcactaaatagtccttcacagctaaccaattggaaaaatggtggtggtgatccatgtggagagtcatggaaagggattacttgtgagggctctgcagttgtcactatgtaaagaatcagattttgagtattatttttgttctttccacttgcattgatttgtgattgtcttataatgttgttgttttctgttgttatgattgtaacagagatatatcggatttaggagtctctggcactcttggatacttgctctcagaccttaagtcactcagaaaattgtattgtttttggaattttccttctgtttttgtttgtttgatctttctgctctttggattttggttcaataactttggtctctttcgttttggttacagggatgttagtggtaacagcatccatgatacacttccatatcagttgccaccgaatctcacaagcctgtaatgctgtgtttgcttagctttgttgttatagtatttactctcagttttcaatttgaaactaacagtttaaagaaaatgtaatgcagaaatcttgcgagaaacaacctaagtggtaaccttccatactccatatccgccatgggttctctttcgtatatgtgagtttgcctttctagaaccatacactgtgagattagcatgtttagttttcttatgtattatagtttgaaatgttattgtgtaggaatgtaagtggtaattcacttacaatgtcaataggagatatctttgctgatcataagtcactggcaaccttgtaagatcgcttacctatcactttagcatagtcatatcacttccagtttccattgatctattgtttctttattcagggacctttctcataacaacttcagtggcgatcttcctagttccttaagcacagtgtccacactttccgttctgtaagtgctttcaaacaatctttagtggaacaatacttaagaagtgcgaaaggaaattccatgataatatctgattatcttcatttgtgacagttatgttcagaacaatcaattgacaggttccatcgatgttctctcggggttgcctttgaaaactttgtaagtttcattgcaagtagaaaaagaaacgaatgtatatattcctccatcacacttaccgtctatgttttcttggcagaaatgttgcaaacaatcatttcaatggatccatacctaaggagcttagttctattcagaccttaatgtaagttttcaataacaatctgttaatttcaatttaaactgtaagtttatgtctttgacattcctaaatgaaacagatatgatggtaattcctttgataacgtccctgcctctcctcagccagaaagacctggcaaaaaagagacaccttctggttctaagaaacccaaaattggttctgaagagaaatcttcagactctggcaagggtttgtctggtggagtagtcactggtatagtgttcggttctctatttgttgctggtattatagcacttgttctttacttgtgccttcacaagaaaaaacggaaagttagaggaagtacaagagcttcccaaagaagtcttccgcttagtggaacacctgaggtgcaggagcagagggtaaaaagtgtagcatccgttgcagacttgaagtcttcacctgcagaaaaagtaacggttgatcgcgttatg

SEQ ID NO: 35922 - DNA, 3003 bp, Unknown; identical to SEQ ID NO: 35921
  misc_feature (1)..( 3003): 2750-1469P.txt file - cDNA_ID_3091362; gDNA_ID_2926179; Annot_ID_140484

SEQ ID NO: 35923 - DNA, 3003 bp, Unknown; identical to SEQ ID NO: 33603
  misc_feature (1)..( 3003): 2750-1469P.txt file - cDNA_ID_3091362; gDNA_ID_2926179; Annot_ID_200095

SEQ ID NO: 35924 - DNA, 3000 bp, Unknown; identical to SEQ ID NO: 3441
  misc_feature (1)..( 3000): 2750-1469P.txt file - cDNA_ID_3091366; gDNA_ID_2926179; Annot_ID_200094

SEQ ID NO: 35925 - DNA, 3000 bp, Unknown; identical to SEQ ID NO: 33608
  misc_feature (1)..( 3000): 2750-1469P.txt file - cDNA_ID_3091399; gDNA_ID_1620733; Annot_ID_166156

SEQ ID NO: 35926 - DNA, 3000 bp, Unknown; identical to SEQ ID NO: 33608
  misc_feature (1)..( 3000): 2750-1469P.txt file - cDNA_ID_3091399; gDNA_ID_2926179; Annot_ID_200067

SEQ ID NO: 35927 - DNA, 3000 bp, Unknown; identical to SEQ ID NO: 4311
  misc_feature (1)..( 3000): 2750-1469P.txt file - cDNA_ID_3091429; gDNA_ID_1620698; Annot_ID_164964

SEQ ID NO: 35928 - DNA, 3000 bp, Unknown; identical to SEQ ID NO: 4311
  misc_feature (1)..( 3000): 2750-1469P.txt file - cDNA_ID_3091429; gDNA_ID_2926180; Annot_ID_200212

SEQ ID NO: 35929 - DNA, 3000 bp, Unknown; identical to SEQ ID NO: 4312
  misc_feature (1)..( 3000): 2750-1469P.txt file - cDNA_ID_3091433; gDNA_ID_2926180; Annot_ID_200211

SEQ ID NO: 35930 - DNA, 3000 bp, Unknown; identical to SEQ ID NO: 31763
  misc_feature (1)..( 3000): 2750-1469P.txt file - cDNA_ID_3091445; gDNA_ID_2926180; Annot_ID_200187

SEQ ID NO: 35931 - DNA, 3000 bp, Unknown; identical to SEQ ID NO: 8516
  misc_feature (1)..( 3000): 2750-1469P.txt file - cDNA_ID_3091451; gDNA_ID_1971814; Annot_ID_175893

SEQ ID NO: 35932 - DNA, 3000 bp, Unknown; identical to SEQ ID NO: 8516
  misc_feature (1)..( 3000): 2750-1469P.txt file - cDNA_ID_3091451; gDNA_ID_2926180; Annot_ID_200184

SEQ ID NO: 35933 - DNA, 3000 bp, Unknown
  misc_feature (1)..( 3000): 2750-1469P.txt file - cDNA_ID_3091455; gDNA_ID_2926180; Annot_ID_200180
aggagcttgggcctttgtgaagacaaggaagacgaggttaatggtgaggaagagagctatagcgtttttcatcatgttctttgaagccatgttttgaaaatgttaattatgctctctctcttttgtttagttctgagaggagtattgagtatttagtttgggaggtgagagtttgtatttatagttgttagaacatttggttagattactgtttgatatttcttttggatgaaagtttacaaaaataaaaaataatgccaacttttcggaaaattaatttgaatttcgcattttagccaaaagtaaaaaaagaagaagaagatactatataatcaactctcaagatatttaaaccttatctactcatctagagaagaggttaggcaaggaacaatttgtcaatgcccaaaacaatacaaactctatcaaagttgttattcttgctgaacgcacactattagtattaatttaacaaatgtcttacaatagagttttggtgaccaaggtgtaatttgaaaatttgccaagtctacgaataaaaggtttggcgatgaaattaatgtaaaacgtctacccaaataaagtcaaattccacattccataacgtacttaatcggtcatcaaaatttgcaatagaattagtgatttactcatattcatatccaaagttctattgaatatgaataaatttactcatatgagtcatatccaaagtcccatttagtcgataatttagtaaatttctataatatatatggatgaacatctcagtattattatttttaattctgattagttaaaaattgttatagatgctaactgtctactcttattgtgattgaacaaaataaacaattaacactggccaacgtcaattcttcttcctttgttttttttcataactcagggttttgttgacgaatgagttttgttgaattaaaacatttattccctacgatactacccctaatcaggactttataaaggatacaatttacattcatctctttaaaatctttgttgaactcattgctgtaaatctgctaaaaaaagctcttagcatgggattattcagtttcttacttacatttaatgtgggaagcaatctctaggaagaggtatatgttctaattgatattaccaatcaaaattgctccagagacaacctagtggaaacatgtattttttgccttttccacttctctcattgctccagagaatgtaattctcggtgactagctttttgagctcattaattatgacacttggtagatgctagcatgtagagcaattttcgacgttcggctggtacagtgatgtttgtttgtggtaggcatttggttcaatcaaacatgaaaaagatagtaatagctagaacagccgagcatgtgaaacacaatccaagattcatttatttcaaacataacataaagacataattacttttttttttaaacacatatagttgcaccatgaaccgatattacggaacttgtatacttattttagtgatcttattacatataagattctgcatattgtttacttataaaaggcagttgaaaccaggttgtaccggcaaacgacagagaccaaggagcccattaagcctcaaattgaggttgacggtgatgccgagaaggttaagaatattgagtcttacagcctcgcatgcacatacagacacaagaggagtattattaagaccagctaagatagaacaacatcgggccacgttgctggtggtgagggagatgagaccaagtacgttgacgcaaatccccaagtcagaccggttaagaggacacacaggttgggctgaggtgaaacccaagaagacgaggttgaaggtgaggaagagagccatgattgttgtcatattctttgaagccatattgtgtaaatgctaaataagaatttgatgattattgtagttggagagattgagatgtgtgagttatattagtcttggaggtgagggtttgtatttatactgtttagaagctttagttggtttacgtagaatattgtgactattataagttctctaacgtaaagtcattttttttttttttgataaattctaacaaaaagttaattgacataattgcaagtacggttcaaacgtagaatagcgaaatcgtggaaaatgaggcacaccaaaagagatatttctcaaaaattctcaaaaaacatttggttacagatcgtatttattttttacttatacaggattgtgaaattgattaattaatgaaaaatatgaattaataaaaattgtgatcagaaaaaaagacatgcggaatcacaaattcattcattctgttaattgagtcagattgatacgaaatgtttgctcgcatcattaaatttactagccgaaccttttcctctagaatgtctgaaactgcaacttgggccacatgtatgtagagggaccaaaagctacaactgtggctaggtatatcattatttatatatgcttaggtctacaaaattatcaatatatccggttccttgaactagaatccgcattagttgttcattctttttggttaagggtgatccttatagagccaatatatctggttcagctaaattttggtttggttttagatcaacttttgttttgtttctggttcgttcgttctgaaatgcaaattatctctaaccaacactgttattgatatgataaaatattactgacatatttttaaactctaaagaatatcttatattctttttttttttaccgaaaaccaaaatttatttctaggtttgttttgatgaaattcagttttactttaataatttcaactaactctacttatgttctaatgcatcttcatgttcgagtagtttctaagaaatctacatgttttcattctctttctcattttaactgagttcgacatctcaagctacatgcaaaagtactaaattatacaccaacaaacaaatacgtgcatcctagttgccgaatatgaaacaaagcacatg

SEQ ID NO: 35934 - DNA, 3003 bp, Unknown
  misc_feature (1)..( 3003): 2750-1469P.txt file - cDNA_ID_3091458; gDNA_ID_1971814; Annot_ID_175889
tcaccaccatcaaaatttgtatataaaagtgaaaatgtataaatttagcctttgatgtcattgatgaagttatcaccaccatcaacttcattgatgatttttttaccaaaaaaaaaaaaaaatcattgatgatgttttgtttcattagtattggaagaaagtaaaaaagtttgaagcgctttaagatattgtacttatatttacaagtgactttatcatctttggtaaaaaaactaccgatttcgattagatgaatataatacatgtacaagtaaaacgaccgcctgaagtcaagggtcttgtagcatgggtaaatgggtgggaaatgttccgtgaattagtcatatagatgtttaaggatatccgattgagacaatctaagttaccttggcaactacgtctctaaagttaggctctatattgaacatatatgtaattatcaactatctctagttagacgttatagagaacccttcaaaatgggccatataaattttgtggccacatgaaaacagttttaaatggtgatctttagctccattacaaattttttagctaatccatggctctttagcaacggatttgctacagaacaaaaaaaaaaaccatgacatcaagccaaaaaccaaaaacgtggtcatatggcatgggttataagagctacacacgtcaaatcgccatattttcatagagcctaagttaggcctggttaaaaaaacgtacttgttaagcttgtagggttttcaaataatcacaagattgaatatgcactgcaaatcggaccatgcactgaaaatagatatcattatctttcttcttttttttttttttggaccagatgcatttactttatgaaatgaatacttcttttattatttttggaaaatagaactaaacaccatgatgcctatagtggcttctgctggttttgagctagtggtcactggaccccgaaaaattgaagtaaaaccaagttttttatgaatgaattcagagtatggaatcacatacttctgaccatcactttacaagacaatgacgagtaacctcatataaacaataaatatgtataattaattaactatatatagattttggataacacttctatatattgatctttttattgggttattatttgtaaaaatgttttaattttgttattaagtaatagtttttgttagttttgatgatttttatgtcgaataaacctgtaaattaataaaataatacgttgtcgaaaatgtatatatgtttggatcatatttcgcaattttctttttcatttcaacatatcatatgggagacaggaagagacacaaagtgttatactttatttaatattattcttcatagacattaatagatatgcttaacaactttttagtaagcatcgatagtccttataattacgttctaatcaacaacgaaacacacaccaacactgtaaaacattaatagataaacccatacttttggtaccagcaaacttatagtgcaaggaaacaccggatagggctcttatttaggggaattaagtagtagttactgtggtggtggacactggaaaccgataggaaaaaccctattgcaagcaaaaaagatttctctaacggccacatcaataccgaaaaccaacggaatcggcctgaagataaagcagagacaatcggttacttgaacattagtgaggccattgagggcagtgcaacactgtcgtgctctggggtcgccagctgtaacattggctaggccaaggacgttggcacatacgcctagttgcaatgggtttctgggacatgagccaaagttgttggtcggtgtaggcgagcttaagaggtttgcttctgcgaggctgatgaggaggatgatgatgagggaaatggtggttgagctctttgaggccatttttttattttattttgtggatatgaaagtgtggatgctttcgatgatgttgtgtagtatgtatttatagagccaagagatgccttggaatcacaaacacttgtgtatcatttattttttttgcctaacattactcttttttaattaatgaggttttagagatttaggcaagttgttggttctctctcttatgtacaactttacgctcaaaatgtctagtttggcttccaaggagttttttcttttgttttcagatttgttttttctttctttcatatattcaagagttcaacacaaattataaccagtatatacggtttaaatctaaggtcatgaatgtatgcatttttttatgaattgaatggatgtaattttggtttttttaacacttgatatatgaaccaacttgaaattacatatttacagaagtagatatagaccatcaattgatatagatgttacaaggaacacaatacacacaataaacattaataaataatttttcacaagtgcgtcttcaatactaattttatttcccggatttcatgtcttctaaataattaaaatttatcttccacattcagcctccaataaaattctatgtcttcgtaatctaacgaaatgaaaacttctaaaatctccatccccgtctttgtatggaacaataacttgatgtgtcaattgaaattctatgttctacttatagaaaccgatgccatgcatgatctagttttagaaggaaaatctttgattactgagggttctttcattgtctaagaatgaatatacttgaggtttaccgaagcggggatcaaacagaatgcaatcattttgtttgagatttgaatttacgtatgtaagttcttcaattacttttttttccagtaatatttgtaaactccaacgtgattcaaaatctaaaataaagacaatcaacactcccgtacaaactttattttattttttattacattattggaacaaagtatatatttagaaacaaaagaaaatcacggttaagtgtatagtaagtaggttttttagtttattgtggggaaaggaggtggtcatgggcaagtgaagcctgggggaatg

SEQ ID NO: 35935 - DNA, 3003 bp, Unknown; identical to SEQ ID NO: 35934
  misc_feature (1)..( 3003): 2750-1469P.txt file - cDNA_ID_3091458; gDNA_ID_2926180; Annot_ID_200179

SEQ ID NO: 35936 - DNA, 3000 bp, Unknown; identical to SEQ ID NO: 8522
  misc_feature (1)..( 3000): 2750-1469P.txt file - cDNA_ID_3091472; gDNA_ID_1971814; Annot_ID_175879

SEQ ID NO: 35937 - DNA, 3000 bp, Unknown; identical to SEQ ID NO: 8522
  misc_feature (1)..( 3000): 2750-1469P.txt file - cDNA_ID_3091472; gDNA_ID_2926180; Annot_ID_200168

SEQ ID NO: 35938 - DNA, 3003 bp, Unknown
  misc_feature (1)..( 3003): 2750-1469P.txt file - cDNA_ID_3091476; gDNA_ID_1971814; Annot_ID_175878
gtttagctatagacgatttacgttcataacattgcgttctctaaactctagtagatcctcttcatcaacaatatttgcgactagatttacttttgattgagattgatagtttcaagtcatatcaaattgcaaaagaccatactgataagagttttacatataaatttcagtcgattacatatagaagaacactatcttattatttccttacgacatcatactacgtacatagggttaagcttattagtactaagatctcacatgggtttaggattttgccatatcctttccccctgccactgctactgttactgtacctgaaatcaaacacagatcaagattttcttctacatgtttcaaactcaaaaacacttgaaatagtcagattttagataaagctcctaagcttgtttatgttaaactatgataagattggaaatctcacatcgaaagaaaagaagatgccaacttaaggaaatactcaagatctttagatccatttcacttaccttaatctaatgtttgggctcagaagtttcccttgctttgctcatagcttcagcttgaatcccttggacagaaaaccatccctgagaatgtaacacaagatgtttaagcatgttgatacggttaaaccctttctacaattcttcatggaaacaaactgcgtaagaaaacactaactagagaagggcataccaccttttagtactctttggcatcatcttctgatctttactgcgctgagcttgagtaggatctcctttacatcccaaaacaaggctactcacgaggatgtctgcggtaaatgaactatcacactctattccggcagttgtaagactctgactttccaaatcaaaccacatgagattcgccgcattgttaatctccagcaaaatcttgctcctgtccttggaacagatcagaggtctaatgaactcaaccgattcaacactctctggtttcggcaccctatacagcttagtccaagatttataatcctcatactctttcaaaacccaaacatcaacatggctatactcgtcgtaacacatcaaacaaacgcagccatctaacacaccaatatccatgttatcttcaatgtaaagctcctgtgggaaactgaggactccaatgtcatcagaggcaagatcatatttgattatcgcgttaaaggcaatgactccctgccttcgaggcaaaatccagtgaagatggttgttaacaaccacaccatagccacgacgaggcaagagatggtaatagtacgaaatccaaagaatctgaaactcgaacataagacacactctcttccacgaattcttcttcaagctgaaaactttgacttcaacagggcaaggaaatttctttttaccttctttaagcttacactgaacaatcctcacaactttaaagtcatcgcccacagaatcataacccaaaccgtaaaacacatactcacgagtgatgtcacgttctgggaaatcaattggctcaattggtaaacggtgaatcttcctagtcgaaggattaaagatcgctagatcaacaggagagttacataaccctatgacaccgttaaatgaaccaaaaacctctgtaaaacctccggcttgtaaaggatgagggatgtcggagacgttctcaggcgagtctagctccaccgtgcgtagaagacgaggtcctcggagtaagatcatgagatgttctcccgtttcgagtctgcgacggagatgagatgagacgaactcgggactgtcgatcaaagagaagcaaggctttgagaggacgcgacactttacgagcgtagttgctctgagacggagaaacatttcgttgatgagatccgtcggacattccgccatttctgttctccggaagaaaattgacgttagagaggaattagggtttcagaggatttgagagatgaattttcgagtccagctctcgagtgttgagacatgagaagtctttagctgtaaatgtttccgggtttttgttggttcgggttgataaaattgatccgaaccgaaattaattcggtttatttctatcgaattctgattcttcggtttaagttcggttcttttggtccaatttggttgtgtctcgatttgatattggattgaggtaagagaccgttaaaagagacttatcaatggcgggagatctggtgcttgacacggcgatctgagactgggttttgatccctctctccgtcgtgtggttcttataggaattctccgagacttcgtttctaagctcatgcgatcttctccgactactttttatctttcacctctcacatcttatttctttgtctacatcaacttcacaaacatcttccctcgaatcacaccattattattaataatttcgttaaacttacaaactagaactaaaaatttttataaattgttgcttgggttccttattttctcttagggtttaatttttttctaattaaaaataatcaaaatcttataggatttgaatgtatttttattcataaaagatgaaaaaacaatccaaacattttatcaagtatttcaaaatgtacgtaaaacattgaactttaaaatcaaacccacatattatcaagccaattcaagtccattaaaaacctcaatctaataacaactccttaatctctctttacgtacatttaagagaaaagtagtactagatctgttacttaactggcatgcatcatcaacattaatcttatgtttgttttgttgttgaatgagatatttcccatccaccaagggtttgttgtatacttgtatgtgcaagagatatgttgactagactatcagaagaattcatacgaaatgtttttgtagatagagtaaagcagatataaatgtgagtgtcaaacaaaacttaacttgtgaaggtatgttattccaaatttcccaattcaacctttacttttgtgtccttacgtctccaaaaaattattaccgtctttggtaacttgataacgtgacgagcatg

SEQ ID NO: 35939 - DNA, 3003 bp, Unknown; identical to SEQ ID NO: 35938
  misc_feature (1)..( 3003): 2750-1469P.txt file - cDNA_ID_3091476; gDNA_ID_2926180; Annot_ID_200167

SEQ ID NO: 35940 - DNA, 3000 bp, Unknown; identical to SEQ ID NO: 8686
  misc_feature (1)..( 3000): 2750-1469P.txt file - cDNA_ID_3091484; gDNA_ID_1971851; Annot_ID_176407

SEQ ID NO: 35941 - DNA, 3000 bp, Unknown; identical to SEQ ID NO: 8686
  misc_feature (1)..( 3000): 2750-1469P.txt file - cDNA_ID_3091484; gDNA_ID_2926180; Annot_ID_200161

SEQ ID NO: 35942 - DNA, 3003 bp, Unknown
  misc_feature (1)..( 3003): 2750-1469P.txt file - cDNA_ID_3091488; gDNA_ID_1971851; Annot_ID_176406
aaagtataacagtcgataaagatgaaagtgatttagtatggccctgaataacttatgtgatttaattcgaccaaaaaattgttccattgaattgtcataatgaagattgaattgttttggacctaatcaaaggaataaacatttgtcatttggacctaatcaaaagaaatatatttgaattgaaccaactcaaaggaaaatgttagttttgttttgaccgaaactaatcgttaattgtcgctgtcgcatatgaaacagagtacttgcaaatgaattaagaaaacgagaagcctgggaatgagtttgtgatattggtttgaaatagtagatgtgaacaataaccattttcagctccagaaattagactgaatggacctcttgttgtatattagaattcataaaacaagatatgtatattacccccaaaaattagagaagtgtttgttctcgatgaaacgttagatcttgtaaaccaaactaagtatttagatctggtagagtaaaccttctaatacactgcaatcaagtcccaagcaaacaagatttgaatttgaaaacacaaatttaaaagcgttctcatcttgcaaagctgaaaaatgaaaatccatagtaagggaaaacaatttcagtttatgtactacacaattatatagagttcacacaattgaccattccttaggttggttatacccaatctcaaaagccgccataacctttgcgcattggaatgtgttcaatcgtcaaaagaaaaattagccctgggcatgtgggtattcgggtcgggtcgggtcgggtcctttcgggttcggatttttcgggttttgaaattttggacccgtatggttatatcaacaatttcgggtcgggttctatccgggttcacttcgggtccggataattcgggtattgcccataagtaaccaaaactatctcgggtttgagtactacttacccaaactttatttaaatatacccaaaaatacataaaagtattcataaaacccgaaaaaaccgcaattataacaagtttttccttaagagaataatataaaacaagaaataaaccttattttgagcttattccataactcatatcattagacaagtcacaaattcaagctattaatgcatatataccatcatatgtatatatatgttcgggtagtaaaaaatacccacgagtatcgcgttcggttcgggtaatacccgatacccttggttatttgaaaacagaacccgatcgggtaattagccggaaccgaagtagaatgggttcgggtatttcgggtcggattcggttcgattcttcgggttcggatattatgcccagacctaaaaaaaatcttaatgtccaaaaggtccatccgcttttgttataatccatgatacagcatcttacttcactaataaaaacactcaagtctcaaattttccaataaattgttttaccgggccacttggtcgtgaaaattccaactgtaaacgcatttgctcataatgtgtttcttctttgtaccaccaatgaagatctaacatgctcggaagagtgctcaatgtttgttaatcatccccaaaatagtcaaacaatccttcatacatataacttgtttagcaatatacattagtaatcatcaataaaaaaaaagaaaaacgaatatagtactatcactatctaacaatgtacagttaaggttaactgtctgaatatggtttcttctctttcgttaagaaacagtctcatgttaaatacatctagtcatagtaaatgattggttggtaaagttcattccctaaatccgtgcgaacttttatgtctctgactctaataagtaccaaaaaccattaaagtaaagtggatttacacgagttttctagttatattattaatccacattaagtaaaaacaggaacaaagaaggatgaccttaaacagaaattactgattcaccaaattttaccgaatcccatgtcgacggaagtgtgcgccgctcttaggtttttaatttcaattttaatattcttttacaatatccaaaattccggcaggtgataagacgggaatacccctcaattggcgaaattcagaaaaggaccaagagagagaagaagacgaaacgatcgtcagagatagagagagagaaaggtcatcacccattctcactcgcagaatatttgttctcatctgattcctccgatctgccatgtctcggcttttctaacgctaagaagtttcacagacgcggcgaaggagagggaggaaggagatagatctctttttccgtcgcgataataataaaaaataaacggtttgtttttcgttctcttgctgttcatgtggatcggatttttgttttcgtgctagattccattagttttttggtttcgggatcgactagtttcgtaatggatctgatttttctattggatctccctagttttgacctgagcaagcgtttgtgaggacttcatgttcttatgacctagattcgttgttttagatgtggaatttggtgtttcactaatcgatttattcgatttctctggtttttggtgatgattgatcaacgtgatgatttgaagatattcattgttcatgtgcattgttgtaaagatgttttcaagtttccagtgtcttgattaatcaatcactgtgttatgggaaaagtttggaatcttaactgctaccattagcgtgttggtttgttaaatcactactttatatacttattatggtatgttgcttgtttctgcaacttaactcttattggttactgttggagccttgagaaacaatcagttaataaagtcaattagcagagataatcttgttctttcttttgcgttatttcatttcatgaataaatcagatgttagtgttgtctttccctcttctgtttggtcttctcagatggtttttgactgttttgtggcttttattttggatctctagtgtctagaggctgttactgaagagttgattcatacggagagaggatagaaatg

SEQ ID NO: 35943 - DNA, 3003 bp, Unknown; identical to SEQ ID NO: 35942
  misc_feature (1)..( 3003): 2750-1469P.txt file - cDNA_ID_3091488; gDNA_ID_2926180; Annot_ID_200160

SEQ ID NO: 35944 - DNA, 3003 bp, Unknown; identical to SEQ ID NO: 24491
  misc_feature (1)..( 3003): 2750-1469P.txt file - cDNA_ID_3091492; gDNA_ID_1971851; Annot_ID_176403

SEQ ID NO: 35945 - DNA, 3003 bp, Unknown; identical to SEQ ID NO: 24491
  misc_feature (1)..( 3003): 2750-1469P.txt file - cDNA_ID_3091492; gDNA_ID_2926180; Annot_ID_200157

SEQ ID NO: 35946 - DNA, 3000 bp, Unknown; identical to SEQ ID NO: 8682
  misc_feature (1)..( 3000): 2750-1469P.txt file - cDNA_ID_3091495; gDNA_ID_2926180; Annot_ID_200155

SEQ ID NO: 35947 - DNA, 3000 bp, Unknown; identical to SEQ ID NO: 8696
  misc_feature (1)..( 3000): 2750-1469P.txt file - cDNA_ID_3091499; gDNA_ID_1971851; Annot_ID_176394

SEQ ID NO: 35948 - DNA, 3000 bp, Unknown; identical to SEQ ID NO: 8696
  misc_feature (1)..( 3000): 2750-1469P.txt file - cDNA_ID_3091499; gDNA_ID_2926180; Annot_ID_200151

SEQ ID NO: 35949 - DNA, 3003 bp, Unknown; identical to SEQ ID NO: 27485
  misc_feature (1)..( 3003): 2750-1469P.txt file - cDNA_ID_3091511; gDNA_ID_1620682; Annot_ID_164483

SEQ ID NO: 35950 - DNA, 3003 bp, Unknown; identical to SEQ ID NO: 27485
  misc_feature (1)..( 3003): 2750-1469P.txt file - cDNA_ID_3091511; gDNA_ID_2926181; Annot_ID_200260

SEQ ID NO: 35951 - DNA, 3000 bp, Unknown; identical to SEQ ID NO: 19784
  misc_feature (1)..( 3000): 2750-1469P.txt file - cDNA_ID_3091543; gDNA_ID_2926182; Annot_ID_200346

SEQ ID NO: 35952 - DNA, 3000 bp, Unknown; identical to SEQ ID NO: 3201
  misc_feature (1)..( 3000): 2750-1469P.txt file - cDNA_ID_3091554; gDNA_ID_2926182; Annot_ID_200335

SEQ ID NO: 35953 - DNA, 3003 bp, Unknown; identical to SEQ ID NO: 18907
  misc_feature (1)..( 3003): 2750-1469P.txt file - cDNA_ID_3091560; gDNA_ID_1620631; Annot_ID_162686

SEQ ID NO: 35954 - DNA, 3003 bp, Unknown; identical to SEQ ID NO: 18907
  misc_feature (1)..( 3003): 2750-1469P.txt file - cDNA_ID_3091560; gDNA_ID_2926182; Annot_ID_200331

SEQ ID NO: 35955 - DNA, 3000 bp, Unknown; identical to SEQ ID NO: 3198
  misc_feature (1)..( 3000): 2750-1469P.txt file - cDNA_ID_3091564; gDNA_ID_1620631; Annot_ID_162682

SEQ ID NO: 35956 - DNA, 3000 bp, Unknown; identical to SEQ ID NO: 3198
  misc_feature (1)..( 3000): 2750-1469P.txt file - cDNA_ID_3091564; gDNA_ID_2926182; Annot_ID_200328

SEQ ID NO: 35957 - DNA, 3000 bp, Unknown; identical to SEQ ID NO: 3563
  misc_feature (1)..( 3000): 2750-1469P.txt file - cDNA_ID_3091577; gDNA_ID_2926182; Annot_ID_200310

SEQ ID NO: 35958 - DNA, 3003 bp, Unknown; identical to SEQ ID NO: 20530
  misc_feature (1)..( 3003): 2750-1469P.txt file - cDNA_ID_3091612; gDNA_ID_2926183; Annot_ID_200435

SEQ ID NO: 35959 - DNA, 3000 bp, Unknown; identical to SEQ ID NO: 20528
  misc_feature (1)..( 3000): 2750-1469P.txt file - cDNA_ID_3091616; gDNA_ID_2926183; Annot_ID_200434

SEQ ID NO: 35960 - DNA, 3003 bp, Unknown
  misc_feature (1)..( 3003): 2750-1469P.txt file - cDNA_ID_3091622; gDNA_ID_1620751; Annot_ID_166806
catgtgcaactttcacatattttctggagaaatcaaatataataataatcattatcattgattgaatgatcatttttgacttttgatggcgctcctcctatcttccaattagtagtaacttttaagggttaagttgtatactagtcactttttaaaatttaattgaaaaaatagtcactttactatttataatttgcaaaatagtcacttttcactgtttgattcgtacacttagtttgtacaccacttttagtgatcagatgtatataaaaaatacacagcgtacactttacatttgtacaataaaagtgatgtacaatccaagtgtacgaatcaaacagtgaaaagtgactactttgcaaattatgaatagtaaagtgactactttcctaattaagtttgaaaaagtgactattttgccaaaacaccccttgaacgagatttatttaataaatactgtattaattaacgaaagaaattttaaaactttaatgacaaattgggtcaagtaagaggaacctgagattctttcgaaacagtattctctctattcgtcgaaaattgggactaagaacatcattattggtagtatcttaggttagtcttagcttagttcttaggatttttttataattgattttgaaaattttgaaatgaaagctaagaacatttcattttatctcttatgtaaaagactcttttaacaaatatatgattaaaaagccaaaattttctaataattaacctaagcaactaccaataaatgtgttctaacgttttgatttaatctggtatttagggtattttgtcattttggtttatctcttatggatttttgtttccatgtttgttgtgtggcattgcttaccaatacatagaatagaaacaataaatgaaactatgatgcttttcttacttaaagagtctgaggtcatcaaaattcaatatgtagagtgagtgagatgcaatttctatataaccgaaatccaactgcattattgtttgcatctggaagctcctctctttctgatgtattttatctacaaactaaaaattcatttgtctatcttgatgatggttcttttcttctttatcctcattttaacaaatattcgagaatcactttcgctatgaacgtgtgctaacatggatatatttctttttaatattcaatattgtgattcaaaccaaccatcgaattatatcagccttctttttaccacagtttggctcaaccaagtttcttccttttatttcaaatgagattgtttgagagattttgaatatgactgtatgtaacgtattgtatgcgcttaaactaaacttagtgctctccatatctgtttttactcgcattttgtcaactattgagttttatattgcccccttagctagtggatcttgtcgtggtgtatgcttattttgagataattaaaatcgaaagcatgatatcatcttgaagtttacagactgtccgagtgcaaagtctacgaaagatttaaagattagaaacttgaagaaatcaatgtgaaaattaatggtcatttacacatatatatatgtgttggggaaacaacggacaactgtacagcaataaagttccaccctacatatttatgtgagtttgtgaaaaaaaataaaaaatattttgctagcaaaaaagtaaaaaataaatgagacaccaaattatacgtaaaaatcatcttaatgtgaagagtaaaaactatgggaccgtagtacactcaaaatttcagacacgaccagcaaatgtccaaacgttctacacaaaaaaacctaacagatctatttttctcctcctctagatcttaaacctctcttttcttttgtttcttatacacaaacaattaggttaagagtgtttatatactccctcataacccttacccaaattccaatctcatggattaataatataaatggttgaactccaagtttggttctccaaatcaaaacccaatttggttcccaccactaggaggaaaaccaacagactcccctccgataaagtactggaggaaacaacaatcctgactatgataacatcgtatttttgcatgttttagatatagattttttatgttttaaaaaagtttttgtttgattttcaaatttttttagtactaatgtagtttatacgagattaatattgtagtctttaatggactgtatcaaccaaacctgactttgttggggcaatttgtggtaattgtatatatgaaaaaatggtaatgggcttgaatatcccacgaagccttttaccaagaagtttcacgcatcccacatcggaagggtaagagagtttgatagtggaaacttttatataaatagacttcactctccctcagattcaaatttcgcagctatgtggtgagcacaaagcgaactattctttcgccttttactaaagaataccgtgtgctctccacgccaagtggcttacgcctatttttggagggcccttacttaatcgtgaggcccaacatttaacctagtctgaatgtttcatttgctaaaaactttgtttgttgctactgggcccaaaggtttgaaaggccagttcaattgaaatatcgcataatcaaattgaatttaatctgcaagaccaattcgttaatcaataagagcatactaggatttcaaaccaaatgattcagttcaacgatgttttaaattatcatctagaaattataaaatgtgtaataaagcattttttttttttttaaacttgacaaaatctctaaatgtaaagtctaatataaaccttaaaatctaaaaactaattatgcttgtttttgagaaatttttaaaaaattgtgaaaaagaaaagtaatgaaaaaaatattgagagtgagtgattggaggaaaataacacaacgcaacaatctaacaaagagagaccttatcatcatcagcatcaccttaacccatataacattcctcttcgaaaatgccaacaacaaatttcatagagaagcagaaatg

SEQ ID NO: 35961 - DNA, 3000 bp, Unknown
  misc_feature (1)..( 3000): 2750-1469P.txt file - cDNA_ID_3091622; gDNA_ID_2926183; Annot_ID_200430
gtgcaactttcacatattttctggagaaatcaaatataataataatcattatcattgattgaatgatcatttttgacttttgatggcgctcctcctatcttccaattagtagtaacttttaagggttaagttgtatactagtcactttttaaaatttaattgaaaaaatagtcactttactatttataatttgcaaaatagtcacttttcactgtttgattcgtacacttagtttgtacaccacttttagtgatcagatgtatataaaaaatacacagcgtacactttacatttgtacaataaaagtgatgtacaatccaagtgtacgaatcaaacagtgaaaagtgactactttgcaaattatgaatagtaaagtgactactttcctaattaagtttgaaaaagtgactattttgccaaaacaccccttgaacgagatttatttaataaatactgtattaattaacgaaagaaattttaaaactttaatgacaaattgggtcaagtaagaggaacctgagattctttcgaaacagtattctctctattcgtcgaaaattgggactaagaacatcattattggtagtatcttaggttagtcttagcttagttcttaggatttttttataattgattttgaaaattttgaaatgaaagctaagaacatttcattttatctcttatgtaaaagactcttttaacaaatatatgattaaaaagccaaaattttctaataattaacctaagcaactaccaataaatgtgttctaacgttttgatttaatctggtatttagggtattttgtcattttggtttatctcttatggatttttgtttccatgtttgttgtgtggcattgcttaccaatacatagaatagaaacaataaatgaaactatgatgcttttcttacttaaagagtctgaggtcatcaaaattcaatatgtagagtgagtgagatgcaatttctatataaccgaaatccaactgcattattgtttgcatctggaagctcctctctttctgatgtattttatctacaaactaaaaattcatttgtctatcttgatgatggttcttttcttctttatcctcattttaacaaatattcgagaatcactttcgctatgaacgtgtgctaacatggatatatttctttttaatattcaatattgtgattcaaaccaaccatcgaattatatcagccttctttttaccacagtttggctcaaccaagtttcttccttttatttcaaatgagattgtttgagagattttgaatatgactgtatgtaacgtattgtatgcgcttaaactaaacttagtgctctccatatctgtttttactcgcattttgtcaactattgagttttatattgcccccttagctagtggatcttgtcgtggtgtatgcttattttgagataattaaaatcgaaagcatgatatcatcttgaagtttacagactgtccgagtgcaaagtctacgaaagatttaaagattagaaacttgaagaaatcaatgtgaaaattaatggtcatttacacatatatatatgtgttggggaaacaacggacaactgtacagcaataaagttccaccctacatatttatgtgagtttgtgaaaaaaaataaaaaatattttgctagcaaaaaagtaaaaaataaatgagacaccaaattatacgtaaaaatcatcttaatgtgaagagtaaaaactatgggaccgtagtacactcaaaatttcagacacgaccagcaaatgtccaaacgttctacacaaaaaaacctaacagatctatttttctcctcctctagatcttaaacctctcttttcttttgtttcttatacacaaacaattaggttaagagtgtttatatactccctcataacccttacccaaattccaatctcatggattaataatataaatggttgaactccaagtttggttctccaaatcaaaacccaatttggttcccaccactaggaggaaaaccaacagactcccctccgataaagtactggaggaaacaacaatcctgactatgataacatcgtatttttgcatgttttagatatagattttttatgttttaaaaaagtttttgtttgattttcaaatttttttagtactaatgtagtttatacgagattaatattgtagtctttaatggactgtatcaaccaaacctgactttgttggggcaatttgtggtaattgtatatatgaaaaaatggtaatgggcttgaatatcccacgaagccttttaccaagaagtttcacgcatcccacatcggaagggtaagagagtttgatagtggaaacttttatataaatagacttcactctccctcagattcaaatttcgcagctatgtggtgagcacaaagcgaactattctttcgccttttactaaagaataccgtgtgctctccacgccaagtggcttacgcctatttttggagggcccttacttaatcgtgaggcccaacatttaacctagtctgaatgtttcatttgctaaaaactttgtttgttgctactgggcccaaaggtttgaaaggccagttcaattgaaatatcgcataatcaaattgaatttaatctgcaagaccaattcgttaatcaataagagcatactaggatttcaaaccaaatgattcagttcaacgatgttttaaattatcatctagaaattataaaatgtgtaataaagcattttttttttttttaaacttgacaaaatctctaaatgtaaagtctaatataaaccttaaaatctaaaaactaattatgcttgtttttgagaaatttttaaaaaattgtgaaaaagaaaagtaatgaaaaaaatattgagagtgagtgattggaggaaaataacacaacgcaacaatctaacaaagagagaccttatcatcatcagcatcaccttaacccatataacattcctcttcgaaaatgccaacaacaaatttcatagagaagcagaaatg

SEQ ID NO: 35962 - DNA, 3003 bp, Unknown
  misc_feature (1)..( 3003): 2750-1469P.txt file - cDNA_ID_3091625; gDNA_ID_2926183; Annot_ID_200428
accgacaattaagtgaaatcagacaatcttaactgtcgtgtccaaaaacacaaaaactctcctcgcttctcttctcttgttgtagtaagtaactttggtaattaacagtgttattatcaaattcgaatctcttacattaatggaaactcagatcttctcttaaaaacacataaagcacagatcttttacagagaatcttgtaagaagaaagaagatgattgagaggtgtttaggagcttaccggtgccggagaatccaaagagctttacgccaattaaaggtaacgattctctgtcttcttcttaccgttgttgtcctacgtagcacaatcggcgccggtaaattcggaactccggagcaagatcttgacgagatccgtcaacatttccacgcacgcaaacgaggtgagcctcaccgtgtcctcgaagaaattcagaccggaggagattcttcttccggtgacggtggaggtaattccggtgggagtaataactacgagacgtttgacatcaacaagattttcgttgacgaaggtgaagaagagaaacccgacccgaataaaccttacactctcggacccaagatatcagattgggatgagcagagatctgattggttagctaagaaccctagcttccctaatttcatcggacctaacaagccacgtgttcttttggtgactggttcggcgccaaaaccatgtgagaatcctgtcggtgatcattacctcttgaaatcgatcaagaacaagatcgattactgtaggttacatgggatcgagatcttctacaacatggctcttctcgatgcagagatggctggtttttgggcaaagcttccattgattaggaagcttttgttgtcacatcctgagattgagtttctttggtggatggatagtgatgctatgtttacagatatggcttttgagcttccatgggagaggtataaagattacaatctggtgatgcatggatggaatgagatggtttatgatcagaagaattggattgggttgaatacagggagtttcttgcttaggaacaatcaatgggcacttgatttgcttgatacttgggctcccatgggtcctaaagggaagatccgtgaagaagcgggtaaggttttgacccgtgagctcaaggatagaccggtgttcgaagctgatgatcagtctgctatggtttatctgttggctactcagcgagacgcttggggcaataaggtacaaactgattttgactggtatataactatgaacttgattccatttcagcattggtttgatgtggaaaaaaaaaaaaactaaatttggaaacttgtggtttgcttgttgtggtttatcatgtctcttgaacatcaaaaataacaatgtgagttgctttttgtggtttatcatgtctcttgatcatcaaaaatgacaatgtgagttgcatcttgtggtttctgacatctgtgtaagggtctattattgaagtaaactcaaatctttgcttggtttggattttgttgagctactcatttgagccactgcattgttgttataggtgtacctagaaagtggatactatcttcacggttactgggggattcttgtggacagatatgaagaaatgatagaaaactaccacccgggtctaggagatcacagatggccattggtgactcactttgtcggttgcaaaccgtgtgggaaatttggtgattacccggtggaacggtgtctaaaacaaatggacagagcctttaactttggagataaccagattctgcaaatctatggtttcactcacaaatctttggctagtcgtaaagtcaagagagtgcggaacgagactagcaatccgttggagatgaaagacgagctcgggttgcttcatccggcgtttaaggcggttaaggtacaaaccaatcaagtttgaatcggttttgcgtttaggatttgtgttatgtttctcgctatatttatgtcttgtgtctttgcttgttgttgtactaagatggatgataaagtattgtgcagagacatcagttaattctttggttttactttgtctctacgtctagagttctattacgaaatcaaaatgttgtttttcttcctttttgttctttgtaatccattagaacttgagattttgtagcttcatggatcaataatctgtgttaattcaagaacttttttttaacctgatttcacattcaactaattatttacttttagtatgcaaaatgtgaaaaaatcacattgagttagtatagttctgagatcatattcacaagttttgtgtagtttaggagtttaattcgaaaaacaaaatttggcatgtggtcagattcttttgcagtatgggttgttgtatctgaaatctgaatgtctttaattgataataaaatcatgtatacgggctattattagggggaggccttataaaagcccatctgaaaactaaaatcacggcctaatatatggaatccgtgttatacaaaaatccaagataattcgtagataatggtgagaaaatcgtttgtggccaagcaatttcgggtagggaggatcaacaaagatacaaaaaagatttctttcttctttataaaacccaaatctcaaaatgttatctcgttttttattttaaatgttttattttattttgttgttgtgtggtttttttggtttttagtaaagagaagatataacaaaaccctaattctcatgagttcaaaaaccctagatttagtgagcccatcaaaacattttccattggggaagattttaacatttggagaattgtgcataataaaaacaaaatattaaacagtaaatactttccaaaaagtgactaaaatattctaaatttactcaacaaaaattgaaaattcttgacaaaaaaattactgttttttaaaatgatacaatgtttttcaaattttaaccacaaatgattattgtacttcttcctcaaataaaaaaagaaactctatatattttggcttgagccaatg

SEQ ID NO: 35963 - DNA, 3003 bp, Unknown
  misc_feature (1)..( 3003): 2750-1469P.txt file - cDNA_ID_3091633; gDNA_ID_1621162; Annot_ID_57137
ggtggaaatgtccctgctgctggttatgaaattagaccaatcgtgcaccttcttggtgaatcttcttcatttgatataaggggtagcatctccagattactggatgaacgaagggaagtgaaagaattcctcagagaatttgacctttcatcaactatatcgactagacgccaagcttttaaggatagtctgcgaggaggagtactcaatgctcaaaacatagatatttcttttgagaacttcccatattatttaaggtaagattgcttaatattatgttacatttgtattacacatcttgctttcgatggtttgatgatttatagccaaaaatatatctaaattgtctcagtgctacaacaaagggtgttttgatgatatcgatgtatgttcatatgaacggtggaagcaagtatgcaaattttgcaacagacttgactacagcctgtccccgtatcttactctctggaccatcaggtatttctactttttgctgagtccattcctctaaacaagtttacctttgtatatataaggtctgagattcctatatttcttaccatttgaaatatttttaggctctgagatatatcaggaaatgttggcaaaagcgcttgctaaacagtttggggccaaattgatgattgttgattctcttttgttgcctggggtaatcttcttttcccctttattttttttttcatcttttagttgacagacctaagtgatctagtagaatgaggtccatgaacaggatcttgataaatacatagatacataaatcttgatccaaaaagaaaaaatcctaatagtcgagaaccaatcaggagtgtttcagcttatattactactaatgtatatacacattccaatgttgttttatttattacaatatttattgcatcttgagcaagtggatattaactggtagtgttgactttttcgtcccaaatagcttatattactacctatcacagtgtccactcggacatcggacattatttttcagcaggctcctttataagtaataggtttgttcattccggtgaattcaatgattttgtactgtttctggatggtttcagggatcaccagccagggaagctgaatcctctaaagaaggttctaggcgtgaaaggctgtctatgcttgctaaaagagctgttcaggctgcacaagtattgcagcataagaaaccgacttcaagtgttgatgctgatataacaggtggctcaacattaagctctcaggctttgccaaaacaagaagtgtcaacagcaacttctaaaagttacacattcaaagcaggcatgatgtttttcttttcatctgactgttcaacttcttttgatgtaccactcctgttttgttgaacaagcatttttatcattttcaggtgacagagttaaatttgtaggtccttcggcttctgcaatttcttctcttcaaggccagcttaggtattgtttactgtttttaaaagtcttcacatctgctgtaaatgtgtgttgtattcacaactttgctcttactttttccctgctatgtaatataggggaccggccattggttcccagggaaaagtagcccttgcatttgaagacaactgtgcttcaaaaattgggattagattcgataggcctgtacaagatggcaatgatcttggtggcctctgcgaagaagaccatggttttttttgtgctggtaatcgcgggctgttttttttctttctaactttacttaacttaaaaagtgaactttattaatattattctttgtgtgcagctagctcacttcggttagaaggttcttctagcgatgatgctgataaactcgccgttaatgaaatctttgaggtagcttttactttaagttttgtgataactacttatggcttgtagctacaggatagtaacctcttgacccataccataggtcgcacttagtgagagtgaaggagggtcattaatattgtttctgaaagatattgagaaatctcttgtggggaacagtgatgtgtatgcaaccttgaaaagcaagcttgagactttaccggaaaatatagttgtcattgcctcgcagacccagttggacagccgaaaggagaaagtaggaaactttttcagtcttctctatttctgttttggtatcttttaagttggttttaatttgcttatctgtatagttaattagagatttgatggttctttttcagtcccatcctggaggtttcttgtttactaagtttggtggcaatcagacggcactactggatctagcatttccggtatgatgacctgacttatcttgaactattttccatttcttgaaatagttgtgtacctaaataattctatcctgatggtaaggttcaccaaagtcatcttagatttggtatcttattgatgaaatgatttttcctattatctgcaggataattttggtaaactgcacgatagaagcaaagaaacacctaaatcaatgaaacaaataactcgactatttcctaacaaaatcgccatccagttacctcaggttgttaccttcattcatgatttcttgtctgggataattttatttttcctttttcttatgctccgaagatgtaataggaagaagctttactctcggattggaaggagaaacttgaccgtgacacagagattttgaaggttcaggctaatataaccagcatccttgcagtgagtatcttctaatcatgcccttagtaatataagcgttccttgtttcttttcatttttttccttttgcttatttctttgtaatgatgcctgcaggtcctcgccaaaaacaaacttgactgccctgaccttggaacgttgtgcatcaaagatcaaacccttccatctgaaagtaggcctcgttcacttgctttttctttctttattttgtcctgataacccggttgtttgactaaccaaaaactatgtgttcataggtgttgaaaaagtggttggctgggctttcggtcaccatcttatg

SEQ ID NO: 35964 - DNA, 3003 bp, Unknown; identical to SEQ ID NO: 17511
  misc_feature (1)..( 3003): 2750-1469P.txt file - cDNA_ID_3091633; gDNA_ID_1621162; Annot_ID_173721

SEQ ID NO: 35965 - DNA, 3000 bp, Unknown
  misc_feature (1)..( 3000): 2750-1469P.txt file - cDNA_ID_3091633; gDNA_ID_2926183; Annot_ID_140663
ggaaatgtccctgctgctggttatgaaattagaccaatcgtgcaccttcttggtgaatcttcttcatttgatataaggggtagcatctccagattactggatgaacgaagggaagtgaaagaattcctcagagaatttgacctttcatcaactatatcgactagacgccaagcttttaaggatagtctgcgaggaggagtactcaatgctcaaaacatagatatttcttttgagaacttcccatattatttaaggtaagattgcttaatattatgttacatttgtattacacatcttgctttcgatggtttgatgatttatagccaaaaatatatctaaattgtctcagtgctacaacaaagggtgttttgatgatatcgatgtatgttcatatgaacggtggaagcaagtatgcaaattttgcaacagacttgactacagcctgtccccgtatcttactctctggaccatcaggtatttctactttttgctgagtccattcctctaaacaagtttacctttgtatatataaggtctgagattcctatatttcttaccatttgaaatatttttaggctctgagatatatcaggaaatgttggcaaaagcgcttgctaaacagtttggggccaaattgatgattgttgattctcttttgttgcctggggtaatcttcttttcccctttattttttttttcatcttttagttgacagacctaagtgatctagtagaatgaggtccatgaacaggatcttgataaatacatagatacataaatcttgatccaaaaagaaaaaatcctaatagtcgagaaccaatcaggagtgtttcagcttatattactactaatgtatatacacattccaatgttgttttatttattacaatatttattgcatcttgagcaagtggatattaactggtagtgttgactttttcgtcccaaatagcttatattactacctatcacagtgtccactcggacatcggacattatttttcagcaggctcctttataagtaataggtttgttcattccggtgaattcaatgattttgtactgtttctggatggtttcagggatcaccagccagggaagctgaatcctctaaagaaggttctaggcgtgaaaggctgtctatgcttgctaaaagagctgttcaggctgcacaagtattgcagcataagaaaccgacttcaagtgttgatgctgatataacaggtggctcaacattaagctctcaggctttgccaaaacaagaagtgtcaacagcaacttctaaaagttacacattcaaagcaggcatgatgtttttcttttcatctgactgttcaacttcttttgatgtaccactcctgttttgttgaacaagcatttttatcattttcaggtgacagagttaaatttgtaggtccttcggcttctgcaatttcttctcttcaaggccagcttaggtattgtttactgtttttaaaagtcttcacatctgctgtaaatgtgtgttgtattcacaactttgctcttactttttccctgctatgtaatataggggaccggccattggttcccagggaaaagtagcccttgcatttgaagacaactgtgcttcaaaaattgggattagattcgataggcctgtacaagatggcaatgatcttggtggcctctgcgaagaagaccatggttttttttgtgctggtaatcgcgggctgttttttttctttctaactttacttaacttaaaaagtgaactttattaatattattctttgtgtgcagctagctcacttcggttagaaggttcttctagcgatgatgctgataaactcgccgttaatgaaatctttgaggtagcttttactttaagttttgtgataactacttatggcttgtagctacaggatagtaacctcttgacccataccataggtcgcacttagtgagagtgaaggagggtcattaatattgtttctgaaagatattgagaaatctcttgtggggaacagtgatgtgtatgcaaccttgaaaagcaagcttgagactttaccggaaaatatagttgtcattgcctcgcagacccagttggacagccgaaaggagaaagtaggaaactttttcagtcttctctatttctgttttggtatcttttaagttggttttaatttgcttatctgtatagttaattagagatttgatggttctttttcagtcccatcctggaggtttcttgtttactaagtttggtggcaatcagacggcactactggatctagcatttccggtatgatgacctgacttatcttgaactattttccatttcttgaaatagttgtgtacctaaataattctatcctgatggtaaggttcaccaaagtcatcttagatttggtatcttattgatgaaatgatttttcctattatctgcaggataattttggtaaactgcacgatagaagcaaagaaacacctaaatcaatgaaacaaataactcgactatttcctaacaaaatcgccatccagttacctcaggttgttaccttcattcatgatttcttgtctgggataattttatttttcctttttcttatgctccgaagatgtaataggaagaagctttactctcggattggaaggagaaacttgaccgtgacacagagattttgaaggttcaggctaatataaccagcatccttgcagtgagtatcttctaatcatgcccttagtaatataagcgttccttgtttcttttcatttttttccttttgcttatttctttgtaatgatgcctgcaggtcctcgccaaaaacaaacttgactgccctgaccttggaacgttgtgcatcaaagatcaaacccttccatctgaaagtaggcctcgttcacttgctttttctttctttattttgtcctgataacccggttgtttgactaaccaaaaactatgtgttcataggtgttgaaaaagtggttggctgggctttcggtcaccatcttatg

SEQ ID NO: 35966 - DNA, 3000 bp, Unknown; identical to SEQ ID NO: 17512
  misc_feature (1)..( 3000): 2750-1469P.txt file - cDNA_ID_3091633; gDNA_ID_2926183; Annot_ID_200422

SEQ ID NO: 35967 - DNA, 3003 bp, Unknown; identical to SEQ ID NO: 17509
  misc_feature (1)..( 3003): 2750-1469P.txt file - cDNA_ID_3091641; gDNA_ID_1621162; Annot_ID_173723

SEQ ID NO: 35968 - DNA, 3000 bp, Unknown; identical to SEQ ID NO: 17510
  misc_feature (1)..( 3000): 2750-1469P.txt file - cDNA_ID_3091641; gDNA_ID_2926183; Annot_ID_200420

SEQ ID NO: 35969 - DNA, 3003 bp, Unknown
  misc_feature (1)..( 3003): 2750-1469P.txt file - cDNA_ID_3091645; gDNA_ID_2926183; Annot_ID_200417
tctgcatggttgtgttggttagctttaagagaccgtttggtgtgatggtggcaattcctaggatggatatgtctgtcggtggaggacggaagccattgtaagtgaagtcgataatttgggaagaggactttagggattgccaaaagaagcttaagaagaagatggtgaagagcttgatgaagaacatggtgaagagttttattttatttttgttggctttggtttaggtatttgagtttgtaaagaaaatttatggagagtgtggaaaagtcattttttgtattggtcaagggaaaagtcgtttcggcttaacctatattagaggtcatggtagagactcacgaagatgaatgacggatcataaaggttttcaatttgtaatgttgtggtacaacgtgtgtttgtctccggtgtaacttatcttgtctcacattaatagaggctttgattagagatgtacaacgtgtatcatctcattatgtgtaagtcactattgagtgaagctgatgagttagtaaacgatagccataactaaatctaattgcaaaaacaatgtgtcactactctgttttccattgtgttaaggtttgggatttaatcatttggtatcaaatcacgttttggttttgatccgaaccacaatagtggtattagtaccgcacctaactttcattcttttgtttttagtcaaaactattttgtggtagacaaacttccatctattatcttggttttaattcggaccacaattgtactatcaagtctctatccggaaaaaataataattgttcaccctcgtgactacggcattctatttgcacaaggacagagagtcatgactaagtctttcttttaacttccatcaattgcaaataattgtgtcatattctgattcatataataaaggagcaagagtaacaatcatagttgtcttttttagttacatttgtctacatatactctccgcgacagagtcccaaatgaaggtcaccaacttggtttccgtaaacggaatggtcttttgtgcagctatacacgcattgtggttttcgtaaatctttctccagatcgtcgaatctttgagacatccatatcaccaaaaaaagggcacagatttttctataaaaaaaatgtttgacaaagctctttacagtttcaggtgttaggacaaatacatattaacgtttctccaataagacctcttctcttggtatctgtaaacaactcggtaagaatgtctgcggatcatcatgagggtggatgagcatggagtcaacagttttgttatgttcatcatctcatggagacattactgaataactgaatagtaatgtctttgttatgttcatctcatggagtcaacagttttgtagtcatgttgtcttcttcgccggcacctgaattgaggtttactatctgagaatttcgtctcaccagacatccccattgttgaatctgtatctgctccaaatccaaaacactcaccaatcactaaacatatcaaaataccaagtacatacatatccatttcagacaatgacctaacatgataagaacccaattccacaatgtacaatcattatttcattccctaacccaaatttgacaactttctgacaattcctatgaggcaatgccataatagacaagcagagcaaaatcagactcattttcatcagaagaaataacactaaagttgtcatctttaatctaatcaatgatgatcaatctccaaatcttcatagcaaaaaccacgaatctcaagatggaacacaattgctataaaaagtctctgaatttaatacctccccaaaacaatggcttgacatcttcttcttcatcatcaaattcatcaccatagccaaactcagcatcacctctgtaaccaggctcactcccatacccagattcattccccattggatcaactccattagcaaatccaaatccaccagaagcttccttctctccaccagaatctcgccgctctctccgtgaattcctcgccgcctcactcacatcagaagcccaattcgcttcaccaaaaagctctccacttgaatctgtaccaacagcgaaaggcaaatccgaacaagtcccatgagcaccaatggagcaacatctccgagtcccactccgatcactactccgaccagacaccgatctcgaattacgccgccgccgcttcctcgctactaacctgaaacttcctctattgctgtaattggaagctgataatgtcttccctccattgtcgtcgtcggcgagtgagagacggctcatagcttcgatggtgaaagaagtggatcgatcggagaagcaagggcgtttgggagtaaaggagtgaaacccattggtctgcggtggttggtcagatgagtctagggttttggagcggtgaaatggtcgccatgagagaagctgtgaagtgcatgattcaatagagcttcgtgatgactctagatgtttcggagacattgttaaaggtaacaactttccagatcacaaaaagcgaaaatgaaaaaagaaaaatccttttgagtgaatctgaaattgggaatggatctgtgttgttttcaagttctttgagaatatcgagtagtgaagatttggagttgttcttttgggtttaagagcttttgattgaagattacgatttgttgcaaaacgggtcaaatgtattttatacggtcaagacacaatgtattttaatacgtacccggtcggtcacgtgactcacgtgatgatctctatggtattcgaaagccctagtcagatttcaattttcgcctttcttcttctcttccatcggaattttctctcaggtgatcggaatcgttactggaattttagttcatatatagacgatcaatcaaacctctttagttttccttaggttaatcgttatccaatgagttttttttgtgtgtgatcgcttctttgtttcgatctattgacgtttcgaatctcaattttgattttggtataggaaagaaataaatg

SEQ ID NO: 35970 - DNA, 3003 bp, Unknown
  misc_feature (1)..( 3003): 2750-1469P.txt file - cDNA_ID_3091648; gDNA_ID_1621162; Annot_ID_173728
tttctttcacatgcaaatcttgtaaagacatattcatcacataacacaaaattcgatcctgagttctgagttcttaaattaggagaaacgagtaatttaccttactgaacaagtcttcaacttctctttcacggatatcgccgggaaggttcccgacgtaaatcgttctactcgaacggctgctcatttatttctttcctataccaaaatcaaaattgagattcgaaacgtcaatagatcgaaacaaagaagcgatcacacacaaaaaaaactcattggataacgattaacctaaggaaaactaaagaggtttgattgatcgtctatatatgaactaaaattccagtaacgattccgatcacctgagagaaaattccgatggaagagaagaagaaaggcgaaaattgaaatctgactagggctttcgaataccatagagatcatcacgtgagtcacgtgaccgaccgggtacgtattaaaatacattgtgtcttgaccgtataaaatacatttgacccgttttgcaacaaatcgtaatcttcaatcaaaagctcttaaacccaaaagaacaactccaaatcttcactactcgatattctcaaagaacttgaaaacaacacagatccattcccaatttcagattcactcaaaaggatttttcttttttcattttcgctttttgtgatctggaaagttgttacctttaacaatgtctccgaaacatctagagtcatcacgaagctctattgaatcatgcacttcacagcttctctcatggcgaccatttcaccgctccaaaaccctagactcatctgaccaaccaccgcagaccaatgggtttcactcctttactcccaaacgcccttgcttctccgatcgatccacttctttcaccatcgaagctatgagccgtctctcactcgccgacgacgacaatggagggaagacattatcagcttccaattacagcaatagaggaagtttcaggttagtagcgaggaagcggcggcggcgtaattcgagatcggtgtctggtcggagtagtgatcggagtgggactcggagatgttgctccattggtgctcatgggacttgttcggatttgcctttcgctgttggtacagattcaagtggagagctttttggtgaagcgaattgggcttctgatgtgagtgaggcggcgaggaattcacggagagagcggcgagattctggtggagagaaggaagcttctggtggatttggatttgctaatggagttgatccaatggggaatgaatctgggtatgggagtgagcctggttacagaggtgatgctgagtttggctatggtgatgaatttgatgatgaagaagaagatgtcaagccattgttttggggaggtattaaattcagagactttttatagcaattgtgttccatcttgagattcgtggtttttgctatgaagatttggagattgatcatcattgattagattaaagatgacaactttagtgttatttcttctgatgaaaatgagtctgattttgctctgcttgtctattatggcattgcctcataggaattgtcagaaagttgtcaaatttgggttagggaatgaaataatgattgtacattgtggaattgggttcttatcatgttaggtcattgtctgaaatggatatgtatgtacttggtattttgatatgtttagtgattggtgagtgttttggatttggagcagatacagattcaacaatggggatgtctggtgagacgaaattctcagatagtaaacctcaattcaggtgccggcgaagaagacaacatgactacaaaactgttgactccatgagatgaacataacaaagacattactattcagttattcagtaatgtctccatgagatgatgaacataacaaaactgttgactccatgctcatccaccctcatgatgatccgcagacattcttaccgagttgtttacagataccaagagaagaggtcttattggagaaacgttaatatgtatttgtcctaacacctgaaactgtaaagagctttgtcaaacattttttttatagaaaaatctgtgccctttttttggtgatatggatgtctcaaagattcgacgatctggagaaagatttacgaaaaccacaatgcgtgtatagctgcacaaaagaccattccgtttacggaaaccaagttggtgaccttcatttgggactctgtcgcggagagtatatgtagacaaatgtaactaaaaaagacaactatgattgttactcttgctcctttattatatgaatcagaatatgacacaattatttgcaattgatggaagttaaaagaaagacttagtcatgactctctgtccttgtgcaaatagaatgccgtagtcacgagggtgaacaattattattttttccggatagagacttgatagtacaattgtggtccgaattaaaaccaagataatagatggaagtttgtctaccacaaaatagttttgactaaaaacaaaagaatgaaagttaggtgcggtactaataccactattgtggttcggatcaaaaccaaaacgtgatttgataccaaatgattaaatcccaaaccttaacacaatggaaaacagagtagtgacacattgtttttgcaattagatttagttatggctatcgtttactaactcatcagcttcactcaatagtgacttacacataatgagatgatacacgttgtacatctctaatcaaagcctctattaatgtgagacaagataagttacaccggagacaaacacacgttgtaccacaacattacaaattgaaaacctttatgatccgtcattcatcttcgtgagtctctaccatgacctctaatataggttaagccgaaacgacttttcccttgaccaatacaaaaaatgacttttccacactctccataaattttctttacaaactcaaatacctaaaccaaagccaacaaaaataaaataaaactcttcaccatg

SEQ ID NO: 35971 - DNA, 3000 bp, Unknown
  misc_feature (1)..( 3000): 2750-1469P.txt file - cDNA_ID_3091648; gDNA_ID_2926183; Annot_ID_200415
ctttcacatgcaaatcttgtaaagacatattcatcacataacacaaaattcgatcctgagttctgagttcttaaattaggagaaacgagtaatttaccttactgaacaagtcttcaacttctctttcacggatatcgccgggaaggttcccgacgtaaatcgttctactcgaacggctgctcatttatttctttcctataccaaaatcaaaattgagattcgaaacgtcaatagatcgaaacaaagaagcgatcacacacaaaaaaaactcattggataacgattaacctaaggaaaactaaagaggtttgattgatcgtctatatatgaactaaaattccagtaacgattccgatcacctgagagaaaattccgatggaagagaagaagaaaggcgaaaattgaaatctgactagggctttcgaataccatagagatcatcacgtgagtcacgtgaccgaccgggtacgtattaaaatacattgtgtcttgaccgtataaaatacatttgacccgttttgcaacaaatcgtaatcttcaatcaaaagctcttaaacccaaaagaacaactccaaatcttcactactcgatattctcaaagaacttgaaaacaacacagatccattcccaatttcagattcactcaaaaggatttttcttttttcattttcgctttttgtgatctggaaagttgttacctttaacaatgtctccgaaacatctagagtcatcacgaagctctattgaatcatgcacttcacagcttctctcatggcgaccatttcaccgctccaaaaccctagactcatctgaccaaccaccgcagaccaatgggtttcactcctttactcccaaacgcccttgcttctccgatcgatccacttctttcaccatcgaagctatgagccgtctctcactcgccgacgacgacaatggagggaagacattatcagcttccaattacagcaatagaggaagtttcaggttagtagcgaggaagcggcggcggcgtaattcgagatcggtgtctggtcggagtagtgatcggagtgggactcggagatgttgctccattggtgctcatgggacttgttcggatttgcctttcgctgttggtacagattcaagtggagagctttttggtgaagcgaattgggcttctgatgtgagtgaggcggcgaggaattcacggagagagcggcgagattctggtggagagaaggaagcttctggtggatttggatttgctaatggagttgatccaatggggaatgaatctgggtatgggagtgagcctggttacagaggtgatgctgagtttggctatggtgatgaatttgatgatgaagaagaagatgtcaagccattgttttggggaggtattaaattcagagactttttatagcaattgtgttccatcttgagattcgtggtttttgctatgaagatttggagattgatcatcattgattagattaaagatgacaactttagtgttatttcttctgatgaaaatgagtctgattttgctctgcttgtctattatggcattgcctcataggaattgtcagaaagttgtcaaatttgggttagggaatgaaataatgattgtacattgtggaattgggttcttatcatgttaggtcattgtctgaaatggatatgtatgtacttggtattttgatatgtttagtgattggtgagtgttttggatttggagcagatacagattcaacaatggggatgtctggtgagacgaaattctcagatagtaaacctcaattcaggtgccggcgaagaagacaacatgactacaaaactgttgactccatgagatgaacataacaaagacattactattcagttattcagtaatgtctccatgagatgatgaacataacaaaactgttgactccatgctcatccaccctcatgatgatccgcagacattcttaccgagttgtttacagataccaagagaagaggtcttattggagaaacgttaatatgtatttgtcctaacacctgaaactgtaaagagctttgtcaaacattttttttatagaaaaatctgtgccctttttttggtgatatggatgtctcaaagattcgacgatctggagaaagatttacgaaaaccacaatgcgtgtatagctgcacaaaagaccattccgtttacggaaaccaagttggtgaccttcatttgggactctgtcgcggagagtatatgtagacaaatgtaactaaaaaagacaactatgattgttactcttgctcctttattatatgaatcagaatatgacacaattatttgcaattgatggaagttaaaagaaagacttagtcatgactctctgtccttgtgcaaatagaatgccgtagtcacgagggtgaacaattattattttttccggatagagacttgatagtacaattgtggtccgaattaaaaccaagataatagatggaagtttgtctaccacaaaatagttttgactaaaaacaaaagaatgaaagttaggtgcggtactaataccactattgtggttcggatcaaaaccaaaacgtgatttgataccaaatgattaaatcccaaaccttaacacaatggaaaacagagtagtgacacattgtttttgcaattagatttagttatggctatcgtttactaactcatcagcttcactcaatagtgacttacacataatgagatgatacacgttgtacatctctaatcaaagcctctattaatgtgagacaagataagttacaccggagacaaacacacgttgtaccacaacattacaaattgaaaacctttatgatccgtcattcatcttcgtgagtctctaccatgacctctaatataggttaagccgaaacgacttttcccttgaccaatacaaaaaatgacttttccacactctccataaattttctttacaaactcaaatacctaaaccaaagccaacaaaaataaaataaaactcttcaccatg

SEQ ID NO: 35972 - DNA, 3003 bp, Unknown
  misc_feature (1)..( 3003): 2750-1469P.txt file - cDNA_ID_3091652; gDNA_ID_1621162; Annot_ID_173729
tctggtgtacgattacatgcccaatggaagtttagacaagtatttgtacaatagtccagaggtaaccctcgattggaaacagaggtttaaagtcattaatggcgtggcctctgccttattttatctccacgaggagtgggaacaagtggtgattcaccgcgacgtcaaagccagcaacgtcttgttagatgcagagctcaatgggagactcggggatttcggtttagctcagttgtgtgatcacgggtctgatcctcaaactacgcgtgtagttggaacttggggatacctagcccccgatcacatcaggacaggacgggccacaaccactactgatgtttttgcatttggggtgctcctactagaagtggcgtgcggcagacgtcctatcgagattaataaccaaagtggtgagagggtcgtgctcgtggattgggtttttagattttggatggaggcaaacattttggatgctaaggatcctaatctagggtctgagtatgaccaaaaagaagtcgaaatggttttgaagctaggtttgttgtgctctcactccgacccactagctagaccaacaatgagacaagtgctacagtatctaaggggagatgcaatgttaccagatctgtcgccgttggacttgcgtgggagtgggatcatgttgggaacccacaacgggtctaatgagtcgggcatgtttaccagtggatcttctgttgcttattctctactctccagtgggaggtgattttcgtataccataacgtttgtagaaagcaattatctgcaaaagatagaggaccatgaactcaaacgtgaaatatttgaaactctaacgtttagttttattgttgctgcattgaaagtgtatggttatcgaagtataattatgtatcacatggcttttcgattaatagtgtttcctaagagcatgtccattgcagagaccttacaagtttcttaagagaatcctaatgaaaagaagcaaaaaaataaattaaaattgtctaattaaccaaggtgcgaaccttaaataaggtatttttgggtgagtaaggttcgctgacgtggcactatatcattggaggaccaataaaacaaaataagtttttttccttttttctttctctcctctctcttggtttcgtatagagtttctgggctttggtttatgttcaaatttgtgtttgatctgttggtttttaagataaaaatgtgacccttttgctgcttattcacttctcattagcattacaacggattggtgacacaaaataattggttctaggtttatgtttatgctcttttgtttgctcatttagttggtgttatcaaataattggttctaggtacgtgctttcatttaagttcatgacagtgtcttgagctggagatagattattctatgttcttcctttggtgacaatttcattaatagacctctcatcttggactttagtttcctcttgtaagccttttgatttgtattctttttctttttttttttgcttttatgtcatcatatatgtttacaatttgtaatattttttaataacttttaagttttatcaaataaattattttaaaaatatttttgctttttaaaaaaattttcataaggactccaccattggataacaaaaaatttagagactcaacaaaaactctaaactttaaaattaccaaaatatattattaaaaaatgttaaggattttttataaggattcaatcaatgggcatgctctaagacttttaaatatttagagatattttttcttggctgatatattgtcctaaaacacataagtcacaaaatgataggttaatttcactatatcatataaatctcatagagtttcactatttcaaactatttttacatattgtgtgtacactttaagaatatgattgctacaaatttggcgttaatattttagattaatggtcgctaacaccaacttgtctcccaaatttagagttgaattcaatggcaataaaatagacataatttaatcacggaaagagatatcaataaactaataagattatatattacattaaaaatatatgtaaatataattagaagcgataaaaattacaaaattatcaagtgattattactttattagtctagtgatagtgagtagtgagtttcttgaaagagtacaaaaacattgacaataatgctttcggattatttttgaaagaaatagtctaaagacggcatctagatcaaatggatatcataaacttttgatccgaatgttgcggttatcaaaaaagaaatgacaatagtataaaatatggtagaagtattgtctatccttatttcttaagcaaaaatgatctctattttatgaacaactagcaataaagaaaatgtggaaaacagatgataagttactctggttcctatattatatgaaacagagtagtgacaccattatttggaattcatggaaattaaaagaaaagactcggtctctttgaattagtcatgactatccttgtgcagatattaaaatgcctgacggtgaacaatttttttcaagttattttatactacgtgtgtggtcaaaatcaaaaccaaaatcactttttgataccacaaagtaatttgaaatatgcttttgctcttttgttataggaaacagagtagtaacaccattacatgcagttaacaaaaatcaaaagaaacacttagtctctttggttttgttatgactatggtttgtttttttgtcagcttcactaaataagacaagagacaatacacgtagtagttgtaccacaacatcattaccaatcaaagcctttctgtctttgtcttcgtgagtctccacaccatgacttctaatttggggtaaactacgacttttcctttgaccaacaaactacgacttttctacactctctttacaccatatattattactcttattttcattacaaactcaataatatctaaaccaaaagccaaaacacacaaaaacagagccatg

SEQ ID NO: 35973 - DNA, 3000 bp, Unknown
  misc_feature (1)..( 3000): 2750-1469P.txt file - cDNA_ID_3091652; gDNA_ID_2926183; Annot_ID_200414
ggtgtacgattacatgcccaatggaagtttagacaagtatttgtacaatagtccagaggtaaccctcgattggaaacagaggtttaaagtcattaatggcgtggcctctgccttattttatctccacgaggagtgggaacaagtggtgattcaccgcgacgtcaaagccagcaacgtcttgttagatgcagagctcaatgggagactcggggatttcggtttagctcagttgtgtgatcacgggtctgatcctcaaactacgcgtgtagttggaacttggggatacctagcccccgatcacatcaggacaggacgggccacaaccactactgatgtttttgcatttggggtgctcctactagaagtggcgtgcggcagacgtcctatcgagattaataaccaaagtggtgagagggtcgtgctcgtggattgggtttttagattttggatggaggcaaacattttggatgctaaggatcctaatctagggtctgagtatgaccaaaaagaagtcgaaatggttttgaagctaggtttgttgtgctctcactccgacccactagctagaccaacaatgagacaagtgctacagtatctaaggggagatgcaatgttaccagatctgtcgccgttggacttgcgtgggagtgggatcatgttgggaacccacaacgggtctaatgagtcgggcatgtttaccagtggatcttctgttgcttattctctactctccagtgggaggtgattttcgtataccataacgtttgtagaaagcaattatctgcaaaagatagaggaccatgaactcaaacgtgaaatatttgaaactctaacgtttagttttattgttgctgcattgaaagtgtatggttatcgaagtataattatgtatcacatggcttttcgattaatagtgtttcctaagagcatgtccattgcagagaccttacaagtttcttaagagaatcctaatgaaaagaagcaaaaaaataaattaaaattgtctaattaaccaaggtgcgaaccttaaataaggtatttttgggtgagtaaggttcgctgacgtggcactatatcattggaggaccaataaaacaaaataagtttttttccttttttctttctctcctctctcttggtttcgtatagagtttctgggctttggtttatgttcaaatttgtgtttgatctgttggtttttaagataaaaatgtgacccttttgctgcttattcacttctcattagcattacaacggattggtgacacaaaataattggttctaggtttatgtttatgctcttttgtttgctcatttagttggtgttatcaaataattggttctaggtacgtgctttcatttaagttcatgacagtgtcttgagctggagatagattattctatgttcttcctttggtgacaatttcattaatagacctctcatcttggactttagtttcctcttgtaagccttttgatttgtattctttttctttttttttttgcttttatgtcatcatatatgtttacaatttgtaatattttttaataacttttaagttttatcaaataaattattttaaaaatatttttgctttttaaaaaaattttcataaggactccaccattggataacaaaaaatttagagactcaacaaaaactctaaactttaaaattaccaaaatatattattaaaaaatgttaaggattttttataaggattcaatcaatgggcatgctctaagacttttaaatatttagagatattttttcttggctgatatattgtcctaaaacacataagtcacaaaatgataggttaatttcactatatcatataaatctcatagagtttcactatttcaaactatttttacatattgtgtgtacactttaagaatatgattgctacaaatttggcgttaatattttagattaatggtcgctaacaccaacttgtctcccaaatttagagttgaattcaatggcaataaaatagacataatttaatcacggaaagagatatcaataaactaataagattatatattacattaaaaatatatgtaaatataattagaagcgataaaaattacaaaattatcaagtgattattactttattagtctagtgatagtgagtagtgagtttcttgaaagagtacaaaaacattgacaataatgctttcggattatttttgaaagaaatagtctaaagacggcatctagatcaaatggatatcataaacttttgatccgaatgttgcggttatcaaaaaagaaatgacaatagtataaaatatggtagaagtattgtctatccttatttcttaagcaaaaatgatctctattttatgaacaactagcaataaagaaaatgtggaaaacagatgataagttactctggttcctatattatatgaaacagagtagtgacaccattatttggaattcatggaaattaaaagaaaagactcggtctctttgaattagtcatgactatccttgtgcagatattaaaatgcctgacggtgaacaatttttttcaagttattttatactacgtgtgtggtcaaaatcaaaaccaaaatcactttttgataccacaaagtaatttgaaatatgcttttgctcttttgttataggaaacagagtagtaacaccattacatgcagttaacaaaaatcaaaagaaacacttagtctctttggttttgttatgactatggtttgtttttttgtcagcttcactaaataagacaagagacaatacacgtagtagttgtaccacaacatcattaccaatcaaagcctttctgtctttgtcttcgtgagtctccacaccatgacttctaatttggggtaaactacgacttttcctttgaccaacaaactacgacttttctacactctctttacaccatatattattactcttattttcattacaaactcaataatatctaaaccaaaagccaaaacacacaaaaacagagccatg

SEQ ID NO: 35974 - DNA, 3000 bp, Unknown; identical to SEQ ID NO: 7772
  misc_feature (1)..( 3000): 2750-1469P.txt file - cDNA_ID_3091656; gDNA_ID_1621162; Annot_ID_173730

SEQ ID NO: 35975 - DNA, 3003 bp, Unknown; identical to SEQ ID NO: 17508
  misc_feature (1)..( 3003): 2750-1469P.txt file - cDNA_ID_3091656; gDNA_ID_2926183; Annot_ID_200413

SEQ ID NO: 35976 - DNA, 3003 bp, Unknown
  misc_feature (1)..( 3003): 2750-1469P.txt file - cDNA_ID_3091678; gDNA_ID_2926183; Annot_ID_200397
gctctgagttcgtacaaacaaggcttgtaccacaaacaaagaaaacccctaaatcaaggaaactgaaactgcgtagtcttgtttaccagaaggaggattatcatacacccaaagcagagacacaataatcgaccacaaacacaatcaatcctttagcaaacagataaagatgacaaatcacccaaaagctgaagaacactcctccaacaagcttactcgaatgcagaaaacggactgtacatatgaagatgagaacttgatgttcacattttctagtatacaaggtaaaggcaacgataactatagcctctgcattgttggccaataaggagaatttgtccgtttgtaaattcaaaaggaacgtctggaagctgcactagggagcagagaaagaacaagcaatgtagatctaaggagattagatcataaggggtgagagaaactgtaaagtataactgtatatgctttggggtagtttttcaagtagtacatgatggagagtgagtctttagctagagaaaagttttagacgttcactagtattatcctgtaatcaccctctttctccttcgttgtgaacaaatacttgtgtgctcctcttcttcctattctgctctgttatttcctctacttctttatatcttgcttactctgtttccgtgagttggtgtggatggcaaaggtttaagcttgatgtgttgtagagtttaacaaaacctaagagtatctccatcaaggagaaacccaaaaagtttctcgaacaagaaaaatattagtattttattataattttattatatgattaaatttttattttagtgtaaaaattgaatcaattaaaagaagagaaatgtaatgatggcttgtagagagtatctcatagtttctcacttgagaaactttctacactctctcttctctttttattatttctgttattttaatagtgaaaaactctcttgagagattaccaatgtagatggtctaacaatacatagtctttgcaagccccagcgcaattgcaatcaaattcaccattatgattgttcatggatgaaccatcaaaaagcttcatatcacaacatccaaaaaatcatccataaaataataaattatttagactaaaatatataattattttagacccaaacatacaacaatttttagtatttttacccattgtgatttagatcaaaactacacatcccaaaataaaaccatggtaggcccatcattgactatgtacaaatgtgcgttgacctttttctcgtatcacacaattctctccgaacccaccaaattaagaaacatggcaaaaactaggaataacctaaaaatagaatgaaagaggaagaaaagaacttaaaaatagaataacagatgtaaaagaagagttggataaaaaatagaatcaacccaaaaatacatttctcaaagctctttaaataaccaattttcaatttgtttgtaacaattaataaccacgagaagagaagttgagaaagaaaaaatagtaacgatgaaaatggccggaaggatctttctccttttcctctccgtctacgtcacggtggccatcgccggtaaagctccaccgccaacattcaccgagaaaggcaaagcctagcggagaaactctgcgagaaatccgaagacaaagcgttttgcgttgcaagcctaacgtcccgtcctgaggcagcaaccgcaaccgcaccaaaactaggcgtgatcgcgttaagcatcgcgtcctcaaatgcttcggacacatctttctacatcaaagccaaactaaagcaaaagaacctcgagccggctttagaagacaccctcgacgattgctctaagaattacttagatgcggtcgcgcagctcgacgattctctagccgctttgatgcaaaactcgttcatcgacgtcgatatttggctcaacaccgcgataagcgacggtgaggcttgtgaaaacgctttgaacgatcgtgccggtaatgatgctgagcttgctcgtaggaacacaaacttgttgaagctttgcaaggatgctcttctcattaacactattttaactccctaaatttaaagttattgcccattaattattttatatttgttcacattgttataatttttttttaaatggctcgttgatttgtcccgggggtaaattgtaacgatatttgaaatacttgtttttgggaatttttgaatgagcttattaaattatatataaagtatatacaaccaatatgcatattttcttgtttatattcacctaataataaccaatgaaataataaaatacaaatgtatattattttccttttggtcacaaatgtattttcttttcccttcttatattatatacacaataaaataaaataaaaatatgaaattatcctttttttgtgtggacattttatcatttaagaaaatgaaattaataattctaaattactatcttattacaaatgaaaattgtaaattaattaaatatttacaagcatccatataattttggtcattcaatataattcctaaatactaaaaactattgactttttttttttttttttttttttttttgtaaaccctaaaaactattgactaaaaaaaagtattttaacagaaaaagaagagaatatataattttaatgtttgaccacaaagggaaaaaaatatctcaaagttttttctttctttggtatatcggacggtatttgtgtggccagggagggctacctgagactccatatctgtctctcttcttcttcttcttcctcttcttcctctgcttcttcttcttcacatcactgtgtgcgtctctctatctctctattctatcatttcgaaatcctctctatccgaatttgaactcgtctcttcttcgtaaagagttcttaatctccgtctctgtgatttcggaatctggaggttttgaatttcttgttcgtatcaatcaaatggtggatcgatttagtgagattgctttacctcattagcaatg

SEQ ID NO: 35977 - DNA, 3003 bp, Unknown; identical to SEQ ID NO: 17590
  misc_feature (1)..( 3003): 2750-1469P.txt file - cDNA_ID_3091682; gDNA_ID_2926183; Annot_ID_200396

SEQ ID NO: 35978 - DNA, 3000 bp, Unknown; identical to SEQ ID NO: 6258
  misc_feature (1)..( 3000): 2750-1469P.txt file - cDNA_ID_3091690; gDNA_ID_2926183; Annot_ID_200389

SEQ ID NO: 35979 - DNA, 3003 bp, Unknown; identical to SEQ ID NO: 20287
  misc_feature (1)..( 3003): 2750-1469P.txt file - cDNA_ID_3091710; gDNA_ID_2926184; Annot_ID_200495

SEQ ID NO: 35980 - DNA, 3003 bp, Unknown
  misc_feature (1)..( 3003): 2750-1469P.txt file - cDNA_ID_3091714; gDNA_ID_2926184; Annot_ID_200494
tctatagtgtgtatattcagaaaagttatcaatagttcaatactaagaaaccggcctatatatatatatttgtggtcactaatttctccaaaaaccagttgccttccgtaaaaagatggaacctcagagaaaacactcgacagccctccacacgtgtcatccctgccggcgaaccattccatacagaatctacgccgtatttcacacgtgtggcatcatagctctcatgtatcaccatgtacactcaattgtcaacgcaaacaacactctaataacatgtcttcttctcctctccgatattgttctcgccttcatgtgggcaaccacaacttccctccggttaaacccgattcatcggaccgagtaccctgaaaaatatgctgctaaaccggaggactttccaaagctggacgtttttatatgcacggctgatccgtacaaggagcctccgatgatggtggttaacaccgctttatcggtgatggcttacgagtatccgtctcataagatctcagtgtacgtatcggacgatggaggatcttccttgactttgtttgctcttatggaggctgccaagttctctaagcattggttgcccttttgcaagaataacaatgttcaagatcgctctcctgaagtttatttttcttcaaagtcacattcttcgagtgatgaagctgaaaatcttaaggtatgtatgtattagtttctttgttcctaactaatccaaattttagaaaaaacattgtttcaaaaagatacatttttaaagttttctatgcgttctaaattagttatggatgataaattatagatttcaacaaaaataatcaaatattcttggtttagatttatagaaagttgaatcacaaaaaactaagcattggttatcaaaattttaaatgttttttttaatatgtgggaaaaagtttaaaattagactagttatgatttaggaacatagggagtatttatcaactagtcacttttttctttctatttctaagtaaatatcatataaagaaaatggtttggatttatatgttgattaccatcaactaatcacgtataattaggtttaatacataggtcaacagaaatttacacataacagattaatagtcactgttgtcctttaaagccttacgacgttcttgtcgacaatcttaatggcgtttttgtcctttacgaccccaaaagtttgtgggagactgtgacatatacccatgatatttcctattcatttattgcagtacaatcatgacactttaatgatttcttctcctaaacgataggagtatgtattagttttcttaatgacagcagagaagtctttatttgttagaaagtttgaaacacccatgagaaaaagatatttaattgtgtggtggaacagatgatgtacgaagacatgaagagtagagtcgaacatgtggtcgagagcggaaaagttgagactgcgtttatcgcatgcgatcaatttagttgtgtgttcgatctgtggacagataaattcactcgtcatgaccatcctaccattattatggtatgtaactattttgtaatgcatggtaaaagtttcgtcacaaattaatgtttctaaaaactcgtttttatctattaatttgtggtgaaggtgctacaacataacgaaacagagatgatgccaaaccttatatatgtttcaagagaaaagagtaaagtttcaccacatcatttcaaagccggtgctcttaatactttggtatcaactaatccatatctcggttaaactgtcatttctatatttgtaatatttcgttaaccacaacatgtattttctttgtagttacgtgtatctgccgtgatgacaaactcaccaatcattctaacactagattgtgacatgtactcaaacaatcctacaacaccacttcatgctctgtgctatttgtcagaccctaaaatcaattttgatttaggatttgtgcaatttcctcaaaaatttcaaggagtaaacaaaaatgatatttatgcatccgagctcaaacgcccatttgacatcaacacggttgggtttgatggacttatgggaccagttcatatgggaactgggtgtttcttcaatcgacgggcgttttatgggcctccgactactttgattttgcctgagatagaaacatttgggccaaatcggattgccgataagcccattaaagcccaagatattttggcgttggcacacgatgtagcaggatgtaactacgagtgcaacaccaattggggatccaaggtaagattaaaatgaactttagctttcttttatgtatgttgattttttggttatgtttacagattttgtttcttttacatcaactagtcttctcaaaatccatatttataaacatattaacaaaatttttgtgtaattaacataaacacaaaacacacataaaaatgaaaaaaatgaaaaaaaagtatgtttgcattcacatgtaaaacaatcgactctccaatcttgatttctgtgacattgttttgttattacttactagccatttgtcaaactttacagataggtttcagatatgggtcattagtagaagactacttcacaggatttatgctccattgtgaaggatggagatcaattttttgcagcccgacaaaagctgcattttatggagactccccaaaatgcctaacggatgtaataggccaacaaatccgatggtccgttggacttcttgaagtagctttttcaagatacaatccacttacctatggaatcaagccattgagcctattaatgagcttaggttattgccactatgcattttggccattttggtgtattcctctcgttgtctatggaattttaccccaagttgccctcatacatggagttagcgtctttcccaaggcatcggatccatggttttggctttacattatcttgtttctcggtgggtacgcgcaagatctatcagactttttattagaaggaggaacttatcggaaatg

SEQ ID NO: 35981 - DNA, 3003 bp, Unknown; identical to SEQ ID NO: 21047
  misc_feature (1)..( 3003): 2750-1469P.txt file - cDNA_ID_3091718; gDNA_ID_2926184; Annot_ID_200493

SEQ ID NO: 35982 - DNA, 3003 bp, Unknown
  misc_feature (1)..( 3003): 2750-1469P.txt file - cDNA_ID_3091722; gDNA_ID_1620724; Annot_ID_165894
ttcgtggggcagagaattatataggcgaccaactttaccattattcggacacgtagtgaagtgtgctttggggtaagaagatgacgtcactttgccgtgggatactagaatagtagaatttaattattcaagtttgctttgctttactatgcaaaaagtgtaagaaccatctattacgttaatatcttataagcataatcaaataatacaaaacaattgacaagtccattaatttacagtcgatgttgatttacgggaaggttatattgaattgaagataactggttaaattgtaagagatctgaaggtaaaaattagagataatcagtttttaccaacgatcgtataagtatctgcgtatgtgaatgtaaccatagtctattgatgaatttaaggtaaaccaaggaaaagtgattctattgcatcattaatcagtcaataagctttaccatgactttaaagttttctctaatgttgctcttctggaaatgacattaagtaaatcggtcatctttatccaatttttaattattatctagcggaataatcaactacaagacgttttcatatatttttttacaaaaagaaaaccaactttccactgaaaaaaattggtgccgtgccactggcggcatatgacatggtcaattacttcattttgaactggtctaactaaataattgaataatatttacaaaaccaagataaaaaacaaatacgaaaacaagtgtatatttgtcacagataacagattctttatgtaatttggcgtaaagtccgttcgtccaaaaccaacctattcacaatgtacaattaggtcaagtcgagttttaaacgaggaaaattgacagtattttgtataagcgcttcttgatatgagaaagaaagccttgcacagcagtaaggctgcataacaaacacgatcttggtcattactcaaaatcggaagatgaattgaattaagaaactcatacacacccaaaacaagtatgtatctaagtatcttccattactagaaagttcaaatcctctattattgttttctcaatttttaaaaaggaacagttactagtatagggagatgatttcgtacgtggatattcaacaaatgacgttacacttgattatgaagataccaagtttgtggaaccatacttgtttttttaatcgttgtcatttatgatgataaaataacaaagaaatcacatttagatttttgtttttgtttttgaaaggtacaatatcaagagaacatggaaagttgtataaattcaggcgaatccagcaatatatcaaaacgtctatggactcatttttgaaagtaacttatctcatatttatagtcgtcttctacattagagtttcaagtaaaggtgcttatgcaatggcaaacctatctccacccgttcgagtatatttctctcttaccaccagaggtttttgcatctcctttaagagttttctaacgagtttttttttatgtgtaataactgtagacttgcgttctgagagttggaatcaagtgttgcaaaggctgccagacaaaagcaaagagaaagttgctaaatgtctctggtaatagatccactagtgaaatattgttaaagctatagtgttgttataaatattctagctaatattattttcgaaacaggggtgagtacagttgagtataacgcagaacaagggctcttgacagtcacaggtgatgccaacccaacaacattgcttcataagcttacgaaatggggcaaaaaggcagaactagtctcttttcttggagacaactactcttcccatgttcctagaaccccggaacaaaaccaaaacaagacaatggagaagaaaaagaagaagccaacaaagtgttgtcttctaatgtgttttggaaataagagaagcaagaacacaaagattgagcctatggcgataccaaactggcaatatcgaggagtaggaaatgaaaatggcaatgccaggcctttcattaacgcggcaatgtcacctccaatggtgtatcctcctccacaagcagtgcctggcttcacaacacccataccataccctcctcctagtttttttccaggaagaccaccaccaccatacactggtgctggtatgttccagtcagctccaccacaatccccaccatattttccagttcccaaccctaggctgcattacccgcaccactgatacagttctttcagacgatacattcattgcctgtttcttctcttagctatgactcaaatgctgagtaataataagatggtaaattcttttcaacatgtaaggtatatgaagaaatgcaaatgaatgatttccacaataaggcagactagaaaacacatatagacaattaacttgataaacttttttttcggccggactcatgttttaaatgataccaaaaataaacatatcttgttgggaaattagtaaatattttatcaatttattaggattttttatagaaacgtatatattatttagtgtagacaatagagagaaacaaagaagtggttaatacttttattgagataacgcgttgaaagcttaccaaattttggtggattacgaccaaccacccaaaaagatttttacgcttgactaagtcctggttctctcttagtctctaccctttgctatcaaacattcagtctgaatctgagattaacataattatggcaattaatggcactcaaacaaaaaacacgattgagtcaaaaacaaaaaagaaattcctagtttgatttttatttatggttttgacttgagagggattttttttgtcccaacagagaaacgaacattgtgaggcttttaaatgggtcatatagacttatctgggcctaaccacaaaaaatggcccacttttggagaaactttgaaaataaacccgaaggttcgggaaaatacagagagagaaaatttccagtcgccgtcgtcaacattctccttttggtacacagacgagaacgaaagagcgaaaagaagatg

SEQ ID NO: 35983 - DNA, 3003 bp, Unknown; identical to SEQ ID NO: 35982
  misc_feature (1)..( 3003): 2750-1469P.txt file - cDNA_ID_3091722; gDNA_ID_2926184; Annot_ID_200481

SEQ ID NO: 35984 - DNA, 3003 bp, Unknown; identical to SEQ ID NO: 22293
  misc_feature (1)..( 3003): 2750-1469P.txt file - cDNA_ID_3091726; gDNA_ID_2926184; Annot_ID_200466

SEQ ID NO: 35985 - DNA, 3000 bp, Unknown; identical to SEQ ID NO: 19291
  misc_feature (1)..( 3000): 2750-1469P.txt file - cDNA_ID_3091748; gDNA_ID_2926185; Annot_ID_200576

SEQ ID NO: 35986 - DNA, 3003 bp, Unknown; identical to SEQ ID NO: 19273
  misc_feature (1)..( 3003): 2750-1469P.txt file - cDNA_ID_3091752; gDNA_ID_1620653; Annot_ID_163562

SEQ ID NO: 35987 - DNA, 3000 bp, Unknown
  misc_feature (1)..( 3000): 2750-1469P.txt file - cDNA_ID_3091752; gDNA_ID_2926185; Annot_ID_200563
tcacgtcggcgacagtgaagtcacgtgcacccttgaagaagtagacggctcggacgtagtggagcttcatggctaagtccatgggtgtgagctgtcgtggcttgttctcacctaccacagaagcaggcaccaccgaagagagcctgacactggtcactgggcttccctccattttatttttgtgagagagctgatatgtgtagcttataggcttaaatgggatgtgttatataaggattgagtttcgaaagagagttgagttcagaataggcatgggtatcactgatttaggacagttgggaaaactgtttccgtgacggcaacattaaatgtgggtgggatttgggtctttagcaacaacattagagttggacagttgagtcatcatattcagatccatccaacaacaagcacactttattacgtccaccttgtccttattggcttcaagcaataaacgcacatgtacgtgtcgtagccaactagtattatattacggtacctaacaagtcacattaatctataaaaaaccaagttcagtttcctggtaacattgtttccaccagcaaaaatgatcttaatacggatgcggttcatttccacctcaaacacaatcatgcaacaaatttcctgataatgattttacataattgtacgataactaaatcttgcgaaaaaacagtaaaatttttggtagagaacatccctattgccaaccaatctactcctaattgcgccctcagagatgttcatcattcgctgttgtgtcttgttaagaaaataaacacaagtcactgaacaatacctagttcgaaagagtcaacggtgatctttccaggtacctcagatgcttggacttggtgtattttcactaggccagttgtcctgattaattgcttgactcatcgcatgtagcaccatctagagaagcagcaaggtactcagcaaggctctgctgattactgctagttttgtgggtagcttctgaggtcacagatttttttggtgctatagacttgggaagccaggcttgacctgttgagctgctgctcgaagcatctgagcaattcttccataagactggcttaagatgcttccatggatcttcagccatagagttggagtaaaatcgttctgcccctggttccatgggtcttcttcctccatctctcccaaagcttgtgttcataccgcgtcctcgacttctgcctcttcctgagttaggatacgtgtttccaccccagtttgcattttgtcgtccataattggaaaactgtggaggagtattgttgtagctgcctcgaccaccaaatctattattccccatgttcggcatttcttgagagaatggaaaagggcgaggtacccattgaggtggacctgaatggttaactggtggaggcctaaagttgttattccaaccggcgggtggacctctgtgtgagggtgaaagatgtgccatccctcttggttcataatgagctgcatgaaagccaccatgattggtctgtgcctgatactcactacataatgatcctgttcaaagttataatgcaaggatcagaactggattactgttcattgcaaggcacaggacacaaacctaactgaattccataattgatgtgattttcatactgtcaattcctagaaagtgaaacttaaagagatatatcaaattaaagtagctaaagctaataagtttgaagcctgagactgagagacaaatttcttcctccattgatcttgatttgtagattataatcaagaacacatgactaaacccaaacaaagaacaaaaatttcatatagatttgtagaagagaatcatcacctaactctacgaaagcccaacaaccaaataccaaagtgaattcctgattctgttcaatcctatacctatactcaccaaggaccaactaacatactgtaagttaaactctcatgatattaggcaatcttctttatcagtggactactttctttggcctcacaagaatatagacaaaacaaaaattaagacagagtcattgactatcaaggcagaaacaagcacctggaggaactgatggtggaaactgaggtggtacaggagagcttccttgatgactaggagatgagatgtattgttgcttaggggtcttgtttttcttgaaactagaataagcagccatgggatcggtataataatcaaacctttgcgtttcaaatgaatcctgctggtgattggatgtctctgccaatggattggagaggtgacctgtgctcatagatgtttcagtacctgtagtagcatcatcatcattctgcgctgcagcttccattcgcattgcttttaacatctgttttcttttctctgaatcttccattgtgattcaactacaagatcaaaaggaaatttagaaatcaatccttcaaaatccaaaacacgagctactacaatgtaaaagcattagatacataatcaatctgaccttaaaaccccaaattcttacaattatcggatacccaaattggaaaaacgaaattgaaggtgaaacgaaccttcacaaaagtatggtttctccaaaaatcttcactttctcgtgaaaaccttcaactgtgaaacaacgatgatgacgaagcctttcactacataaacgaagacttccaaaaccgggttagtgttcgaccgtatttttcaattaaacccggtttactggtttaagcgattgaaatcattaaaccggcccattaaattttccgatagaaccttctctcagtcgctcaattgcccgaaaacaaaagtctctctctctcgatcgacgccgcaacgtgctcctttcaggtgatctgcttcttattctccatttcgtcatctctgttgtttctagatttggatcacgttttttctttcctcgatctagtgtttgttttaactgttttcgtaatttctgatcagatttaaccggaaaagttgaatcacactgtcgcatctctcacagtcgtcggagaagaatg

SEQ ID NO: 35988 - DNA, 3003 bp, Unknown; identical to SEQ ID NO: 20146
  misc_feature (1)..( 3003): 2750-1469P.txt file - cDNA_ID_3091756; gDNA_ID_2926185; Annot_ID_200562

SEQ ID NO: 35989 - DNA, 3003 bp, Unknown; identical to SEQ ID NO: 21100
  misc_feature (1)..( 3003): 2750-1469P.txt file - cDNA_ID_3091760; gDNA_ID_1620712; Annot_ID_165490

SEQ ID NO: 35990 - DNA, 3003 bp, Unknown; identical to SEQ ID NO: 21100
  misc_feature (1)..( 3003): 2750-1469P.txt file - cDNA_ID_3091760; gDNA_ID_2926185; Annot_ID_200559

SEQ ID NO: 35991 - DNA, 3003 bp, Unknown; identical to SEQ ID NO: 20156
  misc_feature (1)..( 3003): 2750-1469P.txt file - cDNA_ID_3091764; gDNA_ID_1620712; Annot_ID_165479

SEQ ID NO: 35992 - DNA, 3003 bp, Unknown; identical to SEQ ID NO: 20156
  misc_feature (1)..( 3003): 2750-1469P.txt file - cDNA_ID_3091764; gDNA_ID_2926185; Annot_ID_200549

SEQ ID NO: 35993 - DNA, 3003 bp, Unknown; identical to SEQ ID NO: 20158
  misc_feature (1)..( 3003): 2750-1469P.txt file - cDNA_ID_3091768; gDNA_ID_1620712; Annot_ID_165478

SEQ ID NO: 35994 - DNA, 3003 bp, Unknown; identical to SEQ ID NO: 20158
  misc_feature (1)..( 3003): 2750-1469P.txt file - cDNA_ID_3091768; gDNA_ID_2926185; Annot_ID_200548

SEQ ID NO: 35995 - DNA, 3000 bp, Unknown; identical to SEQ ID NO: 3127
  misc_feature (1)..( 3000): 2750-1469P.txt file - cDNA_ID_3091785; gDNA_ID_1620627; Annot_ID_162517

SEQ ID NO: 35996 - DNA, 3000 bp, Unknown; identical to SEQ ID NO: 3127
  misc_feature (1)..( 3000): 2750-1469P.txt file - cDNA_ID_3091785; gDNA_ID_2926186; Annot_ID_200648

SEQ ID NO: 35997 - DNA, 1154 bp, Unknown; identical to SEQ ID NO: 18864
  misc_feature (1)..( 1154): 2750-1469P.txt file - cDNA_ID_3091793; gDNA_ID_1620627; Annot_ID_162500

SEQ ID NO: 35998 - DNA, 3003 bp, Unknown; identical to SEQ ID NO: 18865
  misc_feature (1)..( 3003): 2750-1469P.txt file - cDNA_ID_3091793; gDNA_ID_2926186; Annot_ID_200632

SEQ ID NO: 35999 - DNA, 1882 bp, Unknown; identical to SEQ ID NO: 4610
  misc_feature (1)..( 1882): 2750-1469P.txt file - cDNA_ID_3091862; gDNA_ID_1620717; Annot_ID_165665

SEQ ID NO: 36000 - DNA, 3003 bp, Unknown
  misc_feature (1)..( 3003): 2750-1469P.txt file - cDNA_ID_3091862; gDNA_ID_1620647; Annot_ID_163302
ttgcggtgatatattaatttcagtcagtccaactttattataagagagtgttggggtttagtagattttgtatgaaaggcttgtattttattttttatggaacttgatatcccaacaatgtggttgttcttgttcattcgcatgttttttgtgtttctaagttttgagagttgatataagaattactttaatttgtcaagatctcgtcaagtgtttatacttgatgaaaatcttttggggatcaaaacggtttgaagtaaagatcgtactgtcgtactggtgtctgtagattgatattaaactcgaacaacatgattattgtaatataccttaactaccatataatttttttcaattctttctggatacaattgtaagaaaacagaaaaatcggaaaaatgagaaaattcaccaaaactaatggggttgttttgaaattagtttgatacttgaggattgacaaacgaattctacttttccggggaaagaattagagagcgaaacagaacaaaacaaacaaaaagtcatgtctccgacgacgacatcgttacgatccctaagcttctcgctttacgcttcttctaattctactccgatttctacaccaattgaggcccgacagttactgagttcatgcaatagattctacggtctgtcctcttcgagctcttcttcctcccttactacttcatctttgatcggaaatcttgttttctcatcaaggaatcagtctctctccgtaaaggtatacaatttcgtaaatttttgtgatggatttcaactttacggcctaaattcgagaacccatgttccacttattgagaaatctgcttaattcttatgtcacttgtagtcgattgggaaattagggatttctatatgtgccattgattgtgattactctttatgtggtctttttggtccatttgaagatgttttaagttaggtctctcagccacatagacgattacattagtcctgtgtttaagttcacactgtcttactttgattgaagctaggttgcgttaagggcttttaaataacatctaactttatgagtgtttggtgttgtcagtgtggctacatattgatgaaatgtatgtgtgttttgggataggtccaagcgttagctgctgaaaccgaacagccaaaatggtgggagaggaaagcagggccaaacatgattgacattacctcagctgagcagtttctcaacgcgttaaaagatgcgggagatagattagttatcgtagatttttacggaacttggtgtggttcttgccgtgcaatgttcccaaaggtaactttcccgttagctacttaacgattgtatctcttcgtgtatactcgatcatctctcatttcattcagttcgcgagtcttgaaccattatgtttcttaagcttgctcaaattatcggcttgcttattctaaagctgagactcttttcttattcttttccagctctgcaaaacggcgaaagaacaccctaacatcttgttccttaaagtaaactttgacgagaacaagtctctctgcaaaagcttaaacgtcaaggtgttaccgtatttccacttctaccgcggtgctgatggccaagtcgaatccttctcatgctctcttgccaaggttagttcttcttgtcccagctttctttaatttcaaacgtcacttgtctatcacgaaaccagagaatagttactgcattgtatagtcttgatggcgacctctaagtctaataagcgtctgcaaacatttatgcagttccagaaactgagagaggcgatagagagacacaatgtaggaagtatcagtaacatctcttcttcagcttctgagaaagttgaagattcaagtgaataatcaatgcctggttcagattgatcacagattattttgttaaatcgcttccctgtatatatgttgactgcattttccatgtggtgcatcataatttttgtacataaataaatgagtctgacttcgagttcatcgcctatcaagtatcagcttccctaaaccgagtaaaaccgggaagtgttgggtttcaaaattaacttggtgagttaacagttaacacacacatccaccgtttttagatagataagaggatgccctaataaaaccactgctttgtcttgggtaagaagaaacgttaacatgttagttgtcctacaaattcattcatctataaacgttaaagtctgtattaacgaatgaaagtaatcaaaagctacatatttattacacaaacaaaaatgcatcagttgcatctcgtctaagaaagcattttttcttcactcgaagaaaaataacaagaagttgaagccttaggctcacgagccaactcctttaacatgtcgagtttctaatccgagtaaaggatttgtatttcgtcgagaaagttgccgcttcttcaaatgtttggcatttgttaagttgcaacttgtctctcttcttcacgttgtccattgtatccttcccactggaatctttgtaggtggaataacaaacaaggaggaacagaaatcggtttgctaattggcgggttaatagttttgtaaaatggtagattaaacatgcgctctatcctgtaacatttctgagcttgagaacttgtagttgaggagaattcagtagcaaattcgttagtagcttccaccgctcgtttttcctagtattgtagctccaaatgtacatcattaatagatcatataaaagaaaattataatttcaaaaaaggctcaagttgaagtatccaacggtggtcaatttaagactataccaacgcctgtacttcaaaagtttctgcaagtattcattagcagtgacgaattcaaatttgaaaaaaaaaacttttatctgtaaattctccatccttaacggtcaaatttagtcgggcagcagacaaactctcaagtccgatcaggaaacgaaacgagaacaaaagaaaagagattggattttggtgacggcgtttccttcgccgtcgtgttcaccatg

SEQ ID NO: 36001 - DNA, 3003 bp, Unknown; identical to SEQ ID NO: 22338
  misc_feature (1)..( 3003): 2750-1469P.txt file - cDNA_ID_3091862; gDNA_ID_2926188; Annot_ID_200814

SEQ ID NO: 36002 - DNA, 3003 bp, Unknown; identical to SEQ ID NO: 22220
  misc_feature (1)..( 3003): 2750-1469P.txt file - cDNA_ID_3091881; gDNA_ID_2926188; Annot_ID_200778

SEQ ID NO: 36003 - DNA, 3003 bp, Unknown; identical to SEQ ID NO: 21309
  misc_feature (1)..( 3003): 2750-1469P.txt file - cDNA_ID_3091885; gDNA_ID_1620628; Annot_ID_162565

SEQ ID NO: 36004 - DNA, 3003 bp, Unknown; identical to SEQ ID NO: 21309
  misc_feature (1)..( 3003): 2750-1469P.txt file - cDNA_ID_3091885; gDNA_ID_2926188; Annot_ID_200775

SEQ ID NO: 36005 - DNA, 3000 bp, Unknown; identical to SEQ ID NO: 3141
  misc_feature (1)..( 3000): 2750-1469P.txt file - cDNA_ID_3091891; gDNA_ID_1620628; Annot_ID_47181

SEQ ID NO: 36006 - DNA, 3000 bp, Unknown; identical to SEQ ID NO: 3141
  misc_feature (1)..( 3000): 2750-1469P.txt file - cDNA_ID_3091891; gDNA_ID_1620628; Annot_ID_162555

SEQ ID NO: 36007 - DNA, 3000 bp, Unknown; identical to SEQ ID NO: 3141
  misc_feature (1)..( 3000): 2750-1469P.txt file - cDNA_ID_3091891; gDNA_ID_2926187; Annot_ID_140860

SEQ ID NO: 36008 - DNA, 3000 bp, Unknown
  misc_feature (1)..( 3000): 2750-1469P.txt file - cDNA_ID_3091891; gDNA_ID_2926187; Annot_ID_200752
tataaaactgtaagaactatatacagtaaagggtatttaaaaaacttctggttagataaagtaatagagcgagtagtgcaattggaggggtaggttctcagcgtcagcttccaccatgactaaaggaaaaacggatattccattagtttccaatcactttcacttacgttctccatttccacattcttcctcttccattttctttaatttcttcattcgtactttaagatcattgtttaatgtgtccactagtattacagtaagcaataatatatcattacgtcaactaaaaggaatttctaaggcagaaccttttttaaagcatccaaacccccaaacaatgttatgtgcggttaatatgccaacacaatcactagtcgcttacattaatctttggagataagttttacttttaaatcccctcactgtgtatatattagttttaaattattatgtgtgtgggctgtataatttattccctgatccgacttaaattccggatttgatttgtgtttgtgcatgaatcatagggaatcatattctcgttaaataggcacgttacatgtgaagataatgtataaaataaatacatatacctaggaacccattatttagtttctcgaacaaacagattaagtacgataattaaatattggagttctattcttcttcctttccggtaattattctgccagaccaattagaatcggtatgttgattgttgaaaagattgattgatgggtgcttcattttgtgcttggttaacaatcagaatacttgccctctttacttttatttcttttgaaatttcctaagaaatcgttttcggtgttgaaagaattaacaaaggttccaaatatctcaacttctcaagtcagagattagctttcatgtagtttttcaaattgtgtttatttcttcatctaattacttttaaaggtggctcgttcagtttttttcagaacttatctccgtacattctaaaactcatttttagttatcaagatatttttctttctctttagatacggattagtgaacttgagataggtatatctaatttaaatagacagctttatagagctatgatgacacttttaaaaactgatagatatgcaacaaatatcattattgcatgcctcacagttcacacatgttatttgaagtttgaacattaagtcataaacaacagtttaattacaataaaataatcaacatttgctagcaagaaaaagagaagatatggtaataaaaataaggtttattgaaagaaaagatgagaaaaggagatgaaagtacaataattgtatatatcgtcaaccatggcgacatgatcatatacatacatgtttaaaataattttggaaagtgtaaaagcaagtgtctaaggaagtgttatgcactaatagaagtataggacggtatctagtgagaagaaacaaagagtaaagatacaaaaaaaacagagtgattaacatttcctacatatattctatagttttttttttggaatatgttgtaacagttatgacatgattcatgtggaagctgctacaaaaaagtggaggaacgagagggaatagtaataaagcagaaaggggtgtttctttgagagagtacatttgtgaacgaggaccagcctttgtgggacctaagagtggagggtggttcagcttttagccgagacgtcctcatcgcccagcaccctggtctggtccatcctcctccactgtcgcctgtcggccttcattactctttaacttacccacacacattcttttcacttttcagttttgggtctgttcttgcagttatgatatatacggcatggtatatttatcttgtgacattgcaagttgcttttcacacatttttttcaatattgatccacattcaaatgggcttatttctgatttcctaatgtcaattttcttctgtttagccctgcactctgttcttgtttttgtacccgttaaggggctttgaaacaacatgctactttttattatgtgtagaaatttaggaaaaacacaacatgagatacggatatattgatggccaaagaaagtgaagagaatgctttattagtataacaaactatataaacatatcacatatgtgatatgtataacaagttactataatatgattcaaattctgtttagaatattttctttcatagataaagaaattgtaccatttacaattatttcacctattaactcctaaagtttattcatttgcatgtacggtgatatacctaaagtaaaagcaaccacaagtaactataactaactaacgtttaagccagattgtttttatagaaactccttcaaatccaggactggtcacgtcattaatatgtaattgtaaaaatggtttggcaaattgtgtgccaaacaaacaaaggaagatgcagagattgggaaatagacttgtacgtgatttgcaattttctgtgtaataattgtcagcaggcccgtgacctttatctgcattcccctttggctttcttcttctcagtttctcaacaatatatattcactatgacacacatgcatattcatttgatccatctttacatgttttcaataaatgtgtgtatacgtaactgttagcaagctttctttatgagaatatatctaagaattttcgtttcttctggatccaccttctcactaataactccatcttaatttggacttgaatctctaatgatctcttcaatatctgactctctcttgtcttactgtcgcatcctggttacatcaccgtttgaccacaattatattcgatgagttctatgtaacgcaaaattcaaaatgacagaaaagacaaaataattaaccaaaaggtcaaaaaacaaataagaaagaaaaaaagactgaaaaattgtcaatttcattggaaaatacaaaacattccaaactcaagcatcaataaattctctttacaacactcacttcccttctccaacctttaaacatttctctcaaaatg

SEQ ID NO: 36009 - DNA, 3000 bp, Unknown; identical to SEQ ID NO: 36008
  misc_feature (1)..( 3000): 2750-1469P.txt file - cDNA_ID_3091891; gDNA_ID_2926188; Annot_ID_200767

SEQ ID NO: 36010 - DNA, 3000 bp, Unknown
  misc_feature (1)..( 3000): 2750-1469P.txt file - cDNA_ID_3091934; gDNA_ID_1620620; Annot_ID_162249
gacttcagcttgatttgggttcgttcccaaattctgtctcagggattttgaccataaaccctaaaccctacagtgttgaagtgtttgagacttgagagaactgaaagaattgaacagagaagaaatacaactttaaccggtttagaaacaatcgagcctttttaggtttttggtttacaataatcgaaaaccgtacaaaattaataaccaaacgcttaaaacggttcgacgaaaccgaaccggattgcacaatttcgattcgatcctccttttctctaatggcatcctcttgtctcgtccggaaaggatttgtcgaaaatgtcgcatttgttattctctcactgtgatcccaattgatttcttcttcatcttcttttatgaacctggctttcgcatcttcttagctctgggccattcctccggtgattttggtgagcaaaatggttgatttagttgtcacgctgagtcacaaatgtcagcttttttggtttctggcttcatgattcacttccatttctgttttagtattttaaagtttgatcttgtccatttttataacatcacagtagcatctttatgtagtcacacgaacatagagtaagaagaatggttcttgtacaacattttggaagcttgatttgagtgatatctagacaagaaactcacagaaaaaaatatatatgttgtggaggaaagaatttagtaggttaactaataactatagtgcttgtggtgtagcaatttcttattttatcactgaaaccgagataagtcgtatttcagaacatgatttgctacgatggcgtttgtcttctctgttgggtgaaatgagtcccaaaatacatatttgcttgcatccgaacatgtgaatgggttcattttatcacacaagtagctcatctcatagtatcccgttccgcaacacgcacttcttacgttttcgaaacctgcaatgcacataggaatattatcataagaattcttgatttaagagcatttggtacatattgaaacttagccctatgtctttgcagggttgcaatggttgggaaaatatttttgttagaactttgtactaaccgaatgcttcaggatggtatatgatttctgaaacaaggtcatatggatttgaaaacaccagctggattccgttcagatctctgttcaactggaagactttctcttccatcttgatgttgaaatctctagccacaatgttgtattcttcaatacatttgcttccataaaagagctgagttgttctttccaggggtaagcatccaaaaggagagagtcccgacaaagacatcttccgagctccgagtctgtatatatctgtcacgaaatctgctgctattcctatcaggaaatattggtactcgttcactgagtacttccgtaacttgcggggaagaagatagtaattctccaggaaatcgttggttccgatactaatcaggtaaagtgattcactaataatctcattagctttctcttcacccaagtagcttcttagcctggtttggtattctttgtagtattccacttccttccatagcggcattacagactttagaaatcgatgacaattcagagaaagcatgtcagaaatctaagtccagtacagtagaatatatatatgttgtaagatatataactatgcttgacttactaacacggcagaggttgcattgtctaagccggttccagctgaagcgaaacagacaccagtggcaaagtctgcaatgttgtatgctggatctaggtaggcagggactgcgttcttgagtcccaaaccttcagaaatgaagtctggtgcaatccggccatttgaaaatctcccagtcgctttgccgtcaaagtaatcccggccatatggctggaaattgctcttcagaacagtagaaatctggttgttgttgcctgaatcaacagttgagtcaccaaatacgataagtgcgggaaattttgcacacgtttcaggtatcttcaccaagagctgagctgctagcaacaagaacgcaagaactctgtttcgctgcatgctttttacacaagttttttcaattttttgcttctgcaaaacaagaacctcacgattaattgggaagaacaattggagcaagcatttaagatggagaaagataggtatcttctatcaaacctgactaaaacagatttagctcgtgtagttaataccttggcctgttgttagatgatgcttattaaatactccttagtctgatatgtctctgtttatttttggccacagagagttagttgaggtgagtaatgagctgaaaatgattgagagtttcaataatagttgtgcagcagagagccgtatttatagctactaaaaaagagagaaagacagaatattttaaaatagaaggattcgtaccattgcaagcttcagatgtatatgtaacgcatcttcctttttaccggattcacgctcaaaactcaactctctgttcttgtatcacttactgtttttattgcttactgagtctagagtcttgaatgtaaagattatttgcactttgggtgaactgtgtcgcacgttttggggctttttagttcaaccatagttttggttgttgcaacgacaataacaagtaacggcaagaaagtgtctctcatgcgtcaaatgtgacatttccgataaagtaactttgttttttgagtctcaactaaagatttataaatttattgacaagtggttcataacataggtttgcgttttgaattaactagaggctattagcaattaagtggtcatttatcgtttgttgaattatagattaagtagttgaacattaatttccaaattctcccatccaaatgacgtcaaatctacacaacctctatattaatccagcaattttaattaaacacaagaatgaaactaaaaaagccaaaccacttagcaacagtaacatactgctgcttgttctgtttggtaggactgtaccaatcaggcccaggagataaatg

SEQ ID NO: 36011 - DNA, 3000 bp, Unknown; identical to SEQ ID NO: 36010
  misc_feature (1)..( 3000): 2750-1469P.txt file - cDNA_ID_3091934; gDNA_ID_2926189; Annot_ID_200911

SEQ ID NO: 36012 - DNA, 3003 bp, Unknown
  misc_feature (1)..( 3003): 2750-1469P.txt file - cDNA_ID_3091942; gDNA_ID_2926189; Annot_ID_200879
cctgaaccaccagagaaaagaattaagaccaaaagcaaaagaggtacaagcattagatgcctatgttggttccctttaggacttaaagtaatcaaaatcagtaaaacacacaagaagaagcttaaccattttttagcatataccaacacagaggattttaatattcaaaatctcaactttgatcaaaaaaaaaaaaaaaaaaaagatacaatggtctcaggaaagaaaagttgcagaaattggttggctaaaaccacagctggtttcactagacaggtatgtaaagctgattgtatataaaaccccacaagtctcagctaatggggctttaagaaacatcacatgtctaacggtagactgaaacagggatcatctgaaactcctttcacattttttacttattttatcagaaagaagtaaagcaaccaaatctctttctttttttctgtagtccctcaaaccaacttgcatcacttgattagacaataccaactttgagtatctagattctagaagaattaaaaaatgaacaagaaacttcgcatgtctaatggtggcatgaatatagtaccatttttctccccaaattcctttttcgctttccctaggtgctgtgatctttctaacgattcaaacttagccaaatggacaacaaccttgagcattctctctattcatctctcaaagcgtaggtacaaaacttaatatcaggaaaccatatcaaaacaaaaaagaccttgaccctcataagataaagggaaatcagtttgaaaatggtgaatcatgtggcgattggcgaaaacattatttatatccttcaatatctatctctcatttaacacaatcctgatcgagctcttaacattattagaaggtccagagaacaatatccaaagcaaatggaccaaaagaagtaaaagaatcaggacctgacttcttccaatgttacaccctcaaacctcagcaggagtctttgccacaatagagagagcatgtaacccgctcttcaactcatcttgcaacaagtcatatatcagcctatgtctcttgaccaagcttttaccttggaaagcatccgaaacgattcgcaagttgaaatgtgtttccccatcatcaccagcactacctctaacagcggcatgtcctgcgtgctggtaagaaacatcttcaacttctaactcaacaggatctagctccttctccaatttctctcttatcctcatccctctactccctaaagcaacaacatttgacccactctcagaatcatcaatcttttctgttcccaaatcctcaactagatcaggtttagactccaaatccacctccggaacattagcttcgtccttagtctcaggaatagacacaaagctggattctgaactctctccagaacttgaatcttcctcacctttgacttccaaatgaagagcctttttctgcatcagcttaagcatattaagtaatccattgtttctagaaggagacagactctgctgcaacccgagaagaacagcgaaatcaggtgttatcctcaaaatctcagggacaggtcttccagataaacccttgactaatagagcagctaaccctttagtgagaaccgaatcagaatcagcttcatacacaacattacgttcctcatcaaagaaagccctaacccaaacctgagaaacacatccttctactttattctccctcgtcttgaattgagaatcgagaggtgtcagattcttcccgtagaacataagctgctcgtatttagcctttggctcttgtaccgattggaaaagcttgacgatctcttgtagcttcggtggaagctcttcgattggttgaaggtctccatagctcgacggagatgatgaagccgatggtggaggaacaatcccggttgaaattttctggaaagtgatgatcgtccggcgaaaggaaggaacttccgacggttttagtggtcgtagaagaagggttttggccggataatggattgaagaaaacaaggtccgtttgaatgggattaaacgaagcgaggaagcgcaacaagaagaagacatcgctgctgccatagtcgcgaacttgaaacttcgagagagactgagatgatgatgaaagctctccttcttcactttttctgagtcaaaaaccaataccgccaattaggtagtaaccgggaattaaaccgggaatgtaccaaaatccaaaaattagatgtaaaatcaattgtggggttgattatgaataattagaaagtatacgactcttttcataaataaggaaaagaaaaagatatctagattttttttgttttgttttgaagcatcgtcttcctggttcttcgttctcttgcgttcgtcacctcaaacacgtccgccattattatatatcaaatcaatcatgtccgaatccagcttttaccaatgtaagcaattaaattaaattaaataaaaacacttttatcaaatttaatcaaattaaaaaactgtccctttcttatctgagattctattgtttctgtctacttccacagaaagaaactgcatctccgtttttttttctgatttgaggctttccttagatccttgagagcaaaactgaatctgggtaattttaaaaatctcatttttacgacttatctcttttgaacgatctgttttttcatgtaagtacgatttcacctcgagatgatcgatcattgctcttctggttcttccatgtttgattaaatgttataacttgagggttttgtttcttttggattgttctcgcatttgttgatctatggttatcaaaagagtttggatttacagtttttggttgcagctgaaatttttcactcttttcttctctgttttgctggataaagttggatttgattcacattgttgtttagaatctagatgaagttgtaagattccttgtattgtgtttgcttatgcatgattgtgataaagatttaagttattttaccaatgtacaatgtccagaattgtcgtcgggatg

SEQ ID NO: 36013 - DNA, 3000 bp, Unknown; identical to SEQ ID NO: 18108
  misc_feature (1)..( 3000): 2750-1469P.txt file - cDNA_ID_3091950; gDNA_ID_1621102; Annot_ID_171464

SEQ ID NO: 36014 - DNA, 3003 bp, Unknown; identical to SEQ ID NO: 18109
  misc_feature (1)..( 3003): 2750-1469P.txt file - cDNA_ID_3091950; gDNA_ID_2926189; Annot_ID_200865

SEQ ID NO: 36015 - DNA, 3003 bp, Unknown; identical to SEQ ID NO: 18106
  misc_feature (1)..( 3003): 2750-1469P.txt file - cDNA_ID_3091954; gDNA_ID_1621102; Annot_ID_171468

SEQ ID NO: 36016 - DNA, 3000 bp, Unknown; identical to SEQ ID NO: 4613
  misc_feature (1)..( 3000): 2750-1469P.txt file - cDNA_ID_3091954; gDNA_ID_1620717; Annot_ID_165695

SEQ ID NO: 36017 - DNA, 3000 bp, Unknown; identical to SEQ ID NO: 4613
  misc_feature (1)..( 3000): 2750-1469P.txt file - cDNA_ID_3091954; gDNA_ID_2926189; Annot_ID_200861

SEQ ID NO: 36018 - DNA, 3003 bp, Unknown
  misc_feature (1)..( 3003): 2750-1469P.txt file - cDNA_ID_3091991; gDNA_ID_1620620; Annot_ID_162274
gctggtagtttccatagccgcccccagcataaccaccgtagtaggcgttagggtcctgaggaggaggtgcatatccgtatgcttcatatccttgaggaggatacccatagtatcctccaccaccaccatactgggcttgatcaggttgagtctgtgaaattcgtggatcaacaagtcatcagatcacataacgtatatgaaagcgtagtaagcttggtgcattgtctaacagatacaaacctgtttgttggaaggactgcgaccccatgaaagacgaatgctttgtcccccaagttgtgttccgttcaacacagaaagtgcttgctcagcacatgccctgaagcatacagacagattaaatatgtgaaaaaacattctcaaaataagtaaagatgaagttcgtctccaagttcacatttacctattggcgtattgaacaaatccgcaacgttttcctgcgggtattttcacatgaactagttcaccaaattgaccaaaaactgacttcaaatcatcttctgttacactttgatccacagctccaacaaaaatctggaatagagaacataacgcttcaatttcaacaatatatcccacagagaaaaaggcttaggcaacgtcaaagaaaaaaaaggcttagggaaaccaaaacaagttacgcactgttgtgttagttggatcactttctcctgaatttccttgagtgttctgatatgaagctgcaataaaacagtcaagagaaggtaaggaaaaaaacctcaaacatctatttatttaattaagctgacagtgcaaggacacagacactaacacaaacgcacacacacgacaatagcagtagcagaacttatccaaatcaagacccaaaattatcaacatataaagcaaatgccatacataggttacagctcgaagataaaggtaaagtgattctgaagttagttgctaattaatacaaaaaagcacattaaagatatactaggggaagtgcctgcaagatccaacttcgagaaattagagaatcggacctaaattctctagggtatcacaagtaacctaaattccttccaaggtctgacagtcttaccattgtaatcaacttttccgaaagacgaaatgtaacactaaaaaaggttgcaagtataaatttagaggcacaacgtaactgaaagaaggaaaaaaattgcagcactaactactggaaaaagatgaattgagaggtatgaaaaagatatcaaaacactctttaaggattcaaactggacaaaataaagcgaagagtaatgaactatgtaacatgaaaagaaataaaagatagggctaaaaattaaaaggaaagacttatgcttgataagtaagaaactggaaaataatttgcaaatggagtaaaagctttgtaattaacttcttctgaaaacataaccaactgacctaaatgaggccacgcaaggtggaatcattttcagctgaaatcagttccaggcccccgaaagagagcctcttgttctcctgcttaaagacaacatgagtttttttcttataagttttaggatgttttgcgatattaaattctttgaagagctgaaaggcaagaagcgggagaaaagggtagacagattctccagtaatcagaaagatagcagtaaaggagtaccccaaagaaaagacaatcaactaacatagacagtgtaagacaaagtgagtcatatcatcactcaacttattcataagtgatcagatatcaggctccttaatatcaaaacatacctggttgcattgtaagaggcttcttgttggcagcaggaccagtacgcataggccttgatgagcagtattgaccattcatttcagtcatggcacgaatctgctcactttcatccgcaaacctgacaaatccataacccttggaccgtccagtagtcctatcattcacaactttagctcccttgacagaggaatacacagctttaaacgtttcagtaagcatgtggtcggtaacatcaggtgccaagtctccaacaaaaactgtgtgctcaggcccttcagcctggcgtctctctccagctccaagctgagcccagttcaacctgaaggcctgctcactgctcggcatcggagcaccattgtaagtctgtaaattcctctcagctgtagcatggttcacaaactcaataaagccataaccttctgaatatccgttctgtttattgcgaataactttagctgctgtagcctgcaaccacaaaggatgaaactttcaatacttgtagaagaaaaacgagagactaaaaacagaaatcaacaggattttcaaaattacctcgccagtaagaccaaagacgttcatgagatagttctcatccatccatggctgcaagtcaccgatccacagggaccggatctcaccagctgatcctggattctgagatccaccaccaccatactgctgctgctgtggttgaccagaagacggtgcagactgctgattccatcctgcaggcggctgaccttgttgttgctgctggtgctgcatcatccacgactgctgctgctggaggtaagcttgttggtcggaaggaatctgccctggccctgttgcagcaccgttggaagctggaggtggctgctgcatcatgacgacgataacctagcaaaaggtacgactgtcgtagatgcaattaaagggttgagctcgaggacgtaagggcaaaagagagagagagagaaagattcgctgtcgctgtttcttttttatagtcaaaagttggttctaatatggcccaatataaaagtttgagctcggcccattataagagcactcgaacaacccggttaagtaagtctagggttgaccaaaaaaatcgatacgaaccggtcgggattggtttgggattgagatgcctgatttcgaactctcagcgtcgccgatatgttttgtcctgttaaaccctaaaactaaaaccccgcgaagagagaagagttctctgtagtgttcttttgatg

SEQ ID NO: 36019 - DNA, 3003 bp, Unknown; identical to SEQ ID NO: 36018
  misc_feature (1)..( 3003): 2750-1469P.txt file - cDNA_ID_3091991; gDNA_ID_2926190; Annot_ID_200958

SEQ ID NO: 36020 - DNA, 3003 bp, Unknown
  misc_feature (1)..( 3003): 2750-1469P.txt file - cDNA_ID_3091995; gDNA_ID_1620620; Annot_ID_162270
tacatgaaaagattcagctaagtgtgatcatgtaaaatgaaactaacagaggttatttagatgatcaaaacgaatattaagactcttgtagaatccatttgtagagtaatatattctgatgtgcttctttctactatccagtgaaggagaaaagatgggtcaagtttagacgagaggaggacccaacctctattcctggtaactcttctttaaaacataaaatgggttgttatatacgaccatatattcatttacttgagtgatgtcagatctgaaataagcacatctataagatatatggcatgtatacacgaatctagttacatttttgtttgatcaatgttgtagttgaatggatttgttggctgaatgggcagcgaaaaagggctcctactcctgaggtaagataaactcctttttaaccagaattatttgtggtcagcatagtgttcttaccatggaagtttttcattgcatacagactggctatgcttggcctttgatattggtgtttgttattggttcaggaaatgattgaacttgaagcaaggcgtgagcgtgtaaagcttaatgttgctcgtaggtgtttcagcttataaatacattttctaaacttatatccttttaaacgtcttaaaattattatttccttgtgtcattgatccttactgcaaacagtttatgactttgaggacttgattttatgaacttcgaagttgtgaatgaacaaagtcaagaattatttctgtttctgtgttagcaagtcaagaaatccgtatgcaaattttccatttaatatgtcgctcaagttcaaggcaaaacatttatcgtttttcttttgcctttatttccttgtcaagttctcaagaaggaagaggaggagaagaaagccagagtaggcaccggacgcaaaatcaccattggtaattaacattagagcccagaaaatttgtttcatttatgaattggtagcttaatgttcggtctccttgtgtaaaggtaaagttgatggtccagatttgacaagctttgttcgccaatttccaccagattcaaaaggtattacattttctctgccaatagattaattgagtcaccatagatgctgatgactaacttcttaggaatcccttgtgtaaatttgatagagattatgatggatatgcgtttatatttttgtggtgtttgacccatgaaatggtgtccattggctgatgattataatagttttgtgaaagaaacatcttttgaatgttccccatataaccattatgattgcggtagcttaaaagggcaacaaaattgttctcatgcaccattatatatcgtttaagtcatttgttgattcaagggctgaggttactacagttgctagatttcttataaccttaaaagagattatggttcgaccataaagtcgtggaagtaagactgacagttaagtttatttcctttttttgttaatgctttaaggtggtgaaccagaggaagctagtgaagaagcagataaatcaaggtgagtcatcatgattcataatatctccgcactaatcatatatgtgttaaatcttcttacattctattttttcctggatgcaaagcacaacatctttcagaagactaacataaccacatgttctcacattgctttacagggccaaggaacatgaacccgagatagtttctgcagaaccacccgaaccaaagtaagtctagccaacttgacattgttaatcctaaagttcagattctagctcacggatacgaaacatgactcgttctttctgatagttacagactgctactatgctgaaactgttctctatgaacataagttatgtattgtgtttggtatgctttaaattaaactaatgttaatgttgatgttgatgatgatgcaggacaacagagccatcaggatctggatcatcatttaggcccgggacatggcagccaccatcctaaacacatctctcttcacgcagatgacaaaccaacatactattcaattattttgtttgttgtactctacacaaccgattggtttgagccttacagatgagccataagaccagagagcttttcaagaccctaaaattgtgtcctttcacgctgtcattgaggacttagaagagtcaaaatgagaagccatcttcttatactttgttttgtttagggtgtttgtctcttggcataatgcttgagacttttagcctgccttgtccttcatagctgaagaggagcctagctaccttttgtttctcttcgttgacttgaataaaacagtttgattgaataacagttattcattttcatgtcatgatggtagtggatataagaaaaaacaaatacatagaataattattttaatgtttcagaggagaaatcctacttggcttgtgccagactcataacccaatcaaaacttcgtattaccaaaataagtgtagttctaaattttattctggtttaggctgtagttataaattactcattttagtttgtgaatataaaattactttctgcaaaagaaaatattctcatctttcgacgaaaagccaattattcgaatgttctcacgttggtctgtagctgtaaactttatagtttatataataaggtgttctactgttcttatataatttgcaagaacaaataatattaaatgcaaataaaaaatagtcaacggtccaaagtggatcataagccgtccgttcggtcgtctgaacttcatccaacggttaaaagaaatatacctgacgtggccttgggccattgtatattagtagtgagtgtgcccttggaaggttctgtaaaatgttttattcgcctctatcagaagcttgacgaaatctcttctccgtctctctctctctttccctcgtccattccacgatcttcttccaatctcaaatctcccattttctagtgtttcattttgatccttcttccttcctctggagatttctcaaatctcttcaactattttgatttgccgccatg

SEQ ID NO: 36021 - DNA, 3003 bp, Unknown; identical to SEQ ID NO: 36020
  misc_feature (1)..( 3003): 2750-1469P.txt file - cDNA_ID_3091995; gDNA_ID_2926190; Annot_ID_200954

SEQ ID NO: 36022 - DNA, 3003 bp, Unknown
  misc_feature (1)..( 3003): 2750-1469P.txt file - cDNA_ID_3091999; gDNA_ID_1620620; Annot_ID_162258
atttatttggcagtctctacgactacgatcgtacgtccctccttccatcaccgtttgttttatttattgtttcttttctttttttactttaaacaaccatttatcatgttttaagacctcgacatgtaattcgaattagtattgcattaagatttaaagagttacggcggtggatcggtggtagtcagtgcaagtaacggatcataattgcggttgaccaagcctctttcactggcctctttgtaaccatgaaagctgagatgctattggtacaccactaagtcccaaattcccaataatcgtgcgtcagtaaacatcaatttcgagaggacaagtatcaaaatgcgatatctgctgttacaaatattcaactcagttacaaagcccttaacaatgtattgatttctaattttctataaagtaactttgtgaatacacctaagtttatcaatgaagaataaaattgtttaaaataatcgacaaaataacattatacatgaattttacaacaagtgtttgagcatagtagctaagttgttttcttggggtactctcttggtccgaaaatggtggaaccaaccctcacattggtgcttcccatctcaatctgcagaaacatagtcaaagatcatcttccacatatatgtggttcctcggatgaaagaaagaacacattcaaatgattttcgatattgagttgattgcattttcgatattagaagagagacaaagatattaccgctagctcgaagtcaccagacatgcccatggacagttcaaattgatcctcagccattccaagtgccttgcatacatcagctctacagtttgaaagtgtctgtcccggtttatggggaaaagaataaaccttggtaagtaaaacttgtaggaataacccgagaacacgtaaaacaagtatccaatcaagtagtagaataccctgaagttctctggggtagacgtataatcaggcatcccaatagtcattaatccggagaataccagatttggacagtgatgtttcacatgtcttgctagctctacaacgctagaaggttcgattccagatttagctgcatccataatcaatcagtcagccaactgaagaggctggacaaggaaatcagcatagaggtaaaatactcacaaacttctccgcttgtgttcacttggaccaaaacctttagtggatgtctcccaagatttgaaacagctcgatctagatgatttgctacctgtgaaatcaatcccaagtgattgtataaccaaaataacctcctagtaaagtgaattgtgcaagttaaacgccacaacaacctctaatcgctagttataataccttttctccatccacaccatgaaccattgccaaatttgggactccagctgcaaacattggattaaacgactttcactttcactaaacccctaattcaatattaaagatggggataaaagtcagactcaatagcgttttggctttgttgctctgtaaatgccccacgaaatgccactctatatcttccggaagctgtatatcaatcaaacaaagtgaaggagaagctccattagcatcatcaaaagcacaaaatatatcacattcccagaaaatggagagacacatagtagttagtgattgaaggataaacattcggattttgaaatgaaatcgattatctagtgaagataacaaggattggagagaggaacctgtggagctttatcgatgatttcttgaacgtaattctcgccgaagcaacggtgacctgcgtcgtagatttggcggataagtgagacgggtttagtcttggagactggaaggaccctgacccgctcggcatctcttcctacttgctccgccgccttacgagctctaagaatcacagagcggagagcacttgcgacggttgcctccaccgcaggagctgccatcgccaatcgccactaacgcctgtcgtcaatttgggcttcttcgggagtaatgtttttgtcacgtaaattagtttatggcctttaattggataattcacggtccacacgttcaatactaattgcgattatttatctcttcacttttaatcaaaatttccaaggcagagacacatgtaagggttgatgtatatagtcatcaattcacgagattattggaatctttattgcataaacaatatcaaaattgtgtttttatatataccctttcaaaacgttatgggattcaaaattacacccacacccaccacttattgattggacataacatcattcaatgtaaaattacacccacctcttattcatgttttaattttcacttctgtatatatttttcgaatttcatgtattctgtttgtacttttttgggtcttatgttaagcccatttgtgggtttgtaaaagtctttgacaatatccaataaatcagtgaaaaaaaaaagaaaaaaaaaattattatcactgtaaacttcaaatcaattcaacttgtgctttacatgggtcttcgctggaccaatatgttttgtgggcctttcaagcccaacaatagttatctaccctagctcaaaaagagttatcttattctcattctctctctctctgccgcagctatcaatttactggagaagagatggtgggatcagaggttttggaggaatgtggagaaaaaataagcaagaaagagtcaaagaagcgagccgctaaactggagaagttgctccgtaaacaggaacgagaagaagccacatcatcatctctttctctggaggaggaggatgaatcgtgttccagcaactacggtgacgtgactactaacgagttgcagtcggctgttgagggaaaagagctcactgatgtgagcaacttggttgaagagattgtggggtcagaggtttcgatcagaggtcgactgcacaagaatcgcttagtcggtaccaaattgtttgtgatcttgagggaaagtggattcacggttcaatgcgtggtggaggagaccagagttggtgcaaacatg

SEQ ID NO: 36023 - DNA, 3003 bp, Unknown; identical to SEQ ID NO: 36022
  misc_feature (1)..( 3003): 2750-1469P.txt file - cDNA_ID_3091999; gDNA_ID_2926190; Annot_ID_200944

SEQ ID NO: 36024 - DNA, 3000 bp, Unknown; identical to SEQ ID NO: 4642
  misc_feature (1)..( 3000): 2750-1469P.txt file - cDNA_ID_3092020; gDNA_ID_1971690; Annot_ID_175073

SEQ ID NO: 36025 - DNA, 3000 bp, Unknown; identical to SEQ ID NO: 4642
  misc_feature (1)..( 3000): 2750-1469P.txt file - cDNA_ID_3092020; gDNA_ID_2926191; Annot_ID_201073

SEQ ID NO: 36026 - DNA, 3000 bp, Unknown; identical to SEQ ID NO: 4680
  misc_feature (1)..( 3000): 2750-1469P.txt file - cDNA_ID_3092028; gDNA_ID_1620721; Annot_ID_165830

SEQ ID NO: 36027 - DNA, 3000 bp, Unknown; identical to SEQ ID NO: 4680
  misc_feature (1)..( 3000): 2750-1469P.txt file - cDNA_ID_3092028; gDNA_ID_2926191; Annot_ID_201062

SEQ ID NO: 36028 - DNA, 3000 bp, Unknown; identical to SEQ ID NO: 4673
  misc_feature (1)..( 3000): 2750-1469P.txt file - cDNA_ID_3092031; gDNA_ID_1620721; Annot_ID_49194

SEQ ID NO: 36029 - DNA, 3000 bp, Unknown; identical to SEQ ID NO: 4689
  misc_feature (1)..( 3000): 2750-1469P.txt file - cDNA_ID_3092031; gDNA_ID_1620721; Annot_ID_165817

SEQ ID NO: 36030 - DNA, 3000 bp, Unknown; identical to SEQ ID NO: 4673
  misc_feature (1)..( 3000): 2750-1469P.txt file - cDNA_ID_3092031; gDNA_ID_2926191; Annot_ID_141044

SEQ ID NO: 36031 - DNA, 3000 bp, Unknown; identical to SEQ ID NO: 4689
  misc_feature (1)..( 3000): 2750-1469P.txt file - cDNA_ID_3092031; gDNA_ID_2926191; Annot_ID_201050

SEQ ID NO: 36032 - DNA, 3000 bp, Unknown; identical to SEQ ID NO: 3808
  misc_feature (1)..( 3000): 2750-1469P.txt file - cDNA_ID_3092039; gDNA_ID_1620666; Annot_ID_163947

SEQ ID NO: 36033 - DNA, 3000 bp, Unknown; identical to SEQ ID NO: 3808
  misc_feature (1)..( 3000): 2750-1469P.txt file - cDNA_ID_3092039; gDNA_ID_2926191; Annot_ID_201031

SEQ ID NO: 36034 - DNA, 3000 bp, Unknown; identical to SEQ ID NO: 6338
  misc_feature (1)..( 3000): 2750-1469P.txt file - cDNA_ID_3092070; gDNA_ID_2926192; Annot_ID_201173

SEQ ID NO: 36035 - DNA, 3003 bp, Unknown; identical to SEQ ID NO: 17816
  misc_feature (1)..( 3003): 2750-1469P.txt file - cDNA_ID_3092078; gDNA_ID_1621089; Annot_ID_170628

SEQ ID NO: 36036 - DNA, 3003 bp, Unknown; identical to SEQ ID NO: 17816
  misc_feature (1)..( 3003): 2750-1469P.txt file - cDNA_ID_3092078; gDNA_ID_2926192; Annot_ID_201169

SEQ ID NO: 36037 - DNA, 3003 bp, Unknown; identical to SEQ ID NO: 32013
  misc_feature (1)..( 3003): 2750-1469P.txt file - cDNA_ID_3092085; gDNA_ID_2926192; Annot_ID_201165

SEQ ID NO: 36038 - DNA, 3000 bp, Unknown; identical to SEQ ID NO: 6330
  misc_feature (1)..( 3000): 2750-1469P.txt file - cDNA_ID_3092089; gDNA_ID_2926192; Annot_ID_201161

SEQ ID NO: 36039 - DNA, 3000 bp, Unknown; identical to SEQ ID NO: 6344
  misc_feature (1)..( 3000): 2750-1469P.txt file - cDNA_ID_3092093; gDNA_ID_1621089; Annot_ID_170619

SEQ ID NO: 36040 - DNA, 3000 bp, Unknown; identical to SEQ ID NO: 6344
  misc_feature (1)..( 3000): 2750-1469P.txt file - cDNA_ID_3092093; gDNA_ID_2926192; Annot_ID_201160

SEQ ID NO: 36041 - DNA, 3003 bp, Unknown
  misc_feature (1)..( 3003): 2750-1469P.txt file - cDNA_ID_3092098; gDNA_ID_1971693; Annot_ID_175093
tcaaaaaagtgttttagagtataactagactcataaagtagtacatcgactcctgttctgttacaaccaaaattcatatcttaaggatcacataactgaaacctgcatccacaaatacgaggcaaacatagtgtttccttcatcatacatactagactacctataaatcagagatcaaactatgaaatccgcggattcattcagagtctttctcgcacgccaatacactccattggctgtctctgatgttcccagctgcaataaacatcagaaagattgtcagttagcatacttgacactaagtcatagtattggttttggtcagggtattaagaatccactttacctttgtctccaatgagtagtaattcttccacagctccacgtcttgaccgtaacttgcaacagcagaatcatacagcttccgggcattactgagaccatctttatcacctactgatatgaggttggtctctatttcaatgcaacctttgtatagaacaagactgggaccaggaagagccaagaacctgcagttttacggtaacagtggtgagaataaagtccatgtgtgactcaagggactggaggagtagtgactcacctcttgtatatcttcctcgcactgtgggccccttttgtttcaagaacaaatttcaccactgtggaagcaagagaaaacacatggtcgctcccatggcttttggttgctgataggatggacatctctacaagtttgtccaaataagttcgctgatgagcaaagaaattaaaagcctgcaatacaataagcattttattagtgtagtcttaacaaactagtgtattgtctagaaaatatattagtcacataccattagccacaagctctcagattctgagatcggtactttcctcaaagcatttgaaaggagctcaaagactgtctgaaaatctgctttactaggagatgagttctctgaaagtgatcttatttcaatggaaactcttgaaagccacaacttagctgatccagcaaatttttcagagcagagcttttctgctagcttctgagcttcatgagtcttttccagtttcaagtacagagaaacatattcatcagcaagctcttcagtcaaacagccagtttcatcagccttttggtacacgtttatgatatgtgaaatgatcggattagacaaagaggagatttcattctcgtcgccgtttgactgtacaatagcctccatcagaaaatttatataaatctcaaacatagaacttgacgtaacagtttgcaagccttcttcaaaaacctgcattcaggggacaagatttaagacctatcagatattgtactttctagtttctactactaagccgaaacagattgtggtaaagcaagttagtatagtcctaaagaaaagcccccccataaccaatgttccacctgtcctctccgacattattaaactaggcaatttgacttcaggttcaaaccaaaaagagtgagcgtaaaatcaagactaaagatttgatctatgttaaggaaatgcagcacaactatggccgccacattctttaacagatttcagcatttaataaatttctaacccctagtcataagttaagatttgtttacctgaatagccttttgcatttgaggatttgcaaactctaggcctgcctcattgctaatacaaccactcatttcatgtcttgcaagccaattccagtattcaggttcattgcaaaaatcacgcttcaggtcacttagaatggtattgcgcatttcatctgaatgcgctaagtctgttgcctctagaatctccaaaaaacgcttcctcaagtcaaaactagatggaatagcctcaacggctccactatagatggtctgaagaacattggaccctttctcttttaagaaatcaactttctcagtcacatcctcaacatcttcgacaatagagtcctcgtcattctcttctttttcatttccttctttctcatctagcgacataaataactctttgttctcatctttccattgctcatcctcaacggttttcgtgtcacgcaccaaacttcctttatcttcaccaagggcaactttacgagctttcagcttatttagaaaagtaagttccattcgcagatactcaacccacaggtcttcagagtttgaacacactctcagcccattcagcataagagcacgagctgctgtaacattcaagtttctatcaaattcccaagatgcagcatatatccacactccagccacttttggatgaaaccttattgcttgagccaatgcctacacatgtttcagataatataaacgcaattaaacatcgacatatacccaccaaagacaaatcattaacaaagcaaccagcaaatttcaaatcttttacctttttcattcttccatgcctcttctgtttacaaaactcgagatacctaaaccacaaattgatatcacctttatacctcatcgtcgccaatctataaatctcaacaatcctagccacaccggcgaaatcagatactgatttcttctttctcttcttagtcacacgcgccaccgatttcctccgtagctgacggagctcatcgagcttaacctcatagtcaatataggctatgaaatcttctttgagtgggcttggacgcttgagccggtactcaaacttacgccgctgcttcacgatctcagctatctcagcacgagtgaagatttctcttcgttctagatcatcaagctcgtcaaccatccgctcgaggcggtattgaactacgtcggccatggctgctgcttctcgattctcggcggggactgataacggtagggcaaacgcttaatgcttcttcttctttcttcagttattatataatgggccgtaagagtaagaagctattgggcctacgtctaattttatcacggcccaatgttaaaactcttgctatgagctatttgttgttgttctgggggaaaagctttagaagttgaagacgacgatg

SEQ ID NO: 36042 - DNA, 3003 bp, Unknown; identical to SEQ ID NO: 36041
  misc_feature (1)..( 3003): 2750-1469P.txt file - cDNA_ID_3092098; gDNA_ID_2926192; Annot_ID_141100

SEQ ID NO: 36043 - DNA, 3003 bp, Unknown; identical to SEQ ID NO: 36041
  misc_feature (1)..( 3003): 2750-1469P.txt file - cDNA_ID_3092098; gDNA_ID_2926192; Annot_ID_201145

SEQ ID NO: 36044 - DNA, 3000 bp, Unknown; identical to SEQ ID NO: 8296
  misc_feature (1)..( 3000): 2750-1469P.txt file - cDNA_ID_3092101; gDNA_ID_1971693; Annot_ID_175092

SEQ ID NO: 36045 - DNA, 3000 bp, Unknown; identical to SEQ ID NO: 8296
  misc_feature (1)..( 3000): 2750-1469P.txt file - cDNA_ID_3092101; gDNA_ID_2926192; Annot_ID_141099

SEQ ID NO: 36046 - DNA, 3000 bp, Unknown; identical to SEQ ID NO: 8296
  misc_feature (1)..( 3000): 2750-1469P.txt file - cDNA_ID_3092101; gDNA_ID_2926192; Annot_ID_201144

SEQ ID NO: 36047 - DNA, 3003 bp, Unknown
  misc_feature (1)..( 3003): 2750-1469P.txt file - cDNA_ID_3092108; gDNA_ID_1971693; Annot_ID_175089
ctgattctgtctcctccctaaatcatcattcatcgcagcgacatgttagattgttgaatatatgcttgtgtttatgaaaatggcagcataatgatcattacctaagagtattgataacagaatgagaggtgaaaatctggattgcagagaggtaaggaacatagtattggaccaatgtttcgcccgtttccgatacaatggggacacctgcaccgtaagcactccactcgtcgaaacaatcccaaaaatctcccaacctgaaatactcgacgctctggctctccaacggataccatagaggattaaggttcttgatctgtgtctgccaaaaaacacacagtttcagatcctaaattcagagaattgttttaagaaaaagaaaaaggcgtaaacctttgggagggaataggcaggcacaatcggtgtagtgcagcgtaagaatcggtctaggttagattcactgtcaaaaaccatcattatccaacaaagaaccaaacttcgacccagaaaaaaaaaaaaaagagagaggagagagtattgcgggattctctttccctgacgtttcaaagagcttagttttcggacaaaagtgttagctttattagacgagcatttgagactttcacggcaatgtcagaaacagggaaagattgaacgaaaagggacaaactttttaaagaaaactccaacggaactctgttttgagcaatgagaaaaaaaacaagtaaaattgtatctactttgagataaaagaaagtaaggaaataggtttatataatcaaccaaactccatgagacccattcttctaaggcaggagattattggtagattcacctgtctttctcacaactctccaccttctccatttattttcattttcatttaataaaatatagtttcgtttctctaactttgtcggatgagattgagttttgtttgtttgggtttagtataaaacgttatggcttcttaatatcttcattttgcatagttcgtgaacaacacaacaaaacagagctattattcctaagtcttagatgatgacatctcccaatacaaagtctccttcttttggatacatcttgaaagaagagaaactaggtcgatcacatataacaagatttcaagagaaactgggtcaatgacttttttgtttacatattataattcatatggtttaaaagaatcattaacataaaaggacatgtgtgacaggatcagtcggcaatgttgtaatccaagttaaactaaatatctactatagaagtttgacacattcaaatagtacgacgacatggggataataaaagtacggaaacactctttgacttttatggatttcttacaaatttctatcagacaactgtagaatatgccgctagtcacgtaaatgtaattattaaaacattatcaaaagattgatcggagaagaaaactcaagaaatggtcaaatatgttttaccaacttcgtaaagaataaagagaaagtaaaagaaatcaaactctttcaaagtggaagccgtcgtctctcgctgacttcttcttcatcggtttttctgttacttgtatgtgaagccaaataaacctgcagaattcacggtttgaatatgagaagaaagtaggattttaaataataaaagaaaagtgagagagaagacaaagacctcgttgcacaaaagcccatcacaaccaaaattactaattagacatgtgtggcaaatgttatgactgatcatcatgcaataattcaccgccaataccatagatgctaccagactttgtaggctctctctctttagtaaataaagcactttgtttatgttcgtttaatgtacccataattagctttaactatttcactctactctatatattacacacactatctcttccatcttccctccacaaaccacacattcaagctcttaccttttatcctcaactaacacaacaatggcttatactctgcaaaatctgacagccacaattgttctggtaagcctgattcttggatgtacagaggaagtaaccggaatgcgttacattcccatttcccccactcccagtgagagcaaacattcagactttcctgtaaacatggtgcctcaaccatctagtctcattcctggttttggaaggttcttgctacctcccacacctaagctgccattccttccttacaaagatccccttgctgttgccccagccacttcaaatggaactcctagtaataaagcccgcagtccgagttcaggagaagatgaagttccaccagtgccacaaccatgacctgtcaacaaataagcttttgctagatgcagaagggtattcaattctggttcacataacaagtatactagtcatttcatcatagtcatatatcttcatgatctctctctatatatacttaagaggatattgaataaattccagagcttttgcttacatactatctaaaaataatatttccaaataaaatgtaatgactcacattgctgcaaatgtattgagtcacaaaagagtagaaatatgtagaaactcttcaattgaatcattattgccatgattgagtcaaaagagaaactctctttacaaagtctgaaattttgtcaagatatgtaaaatctcaaagtttcaaagtaatctcagcattagcatttagcattaacaaaaccaacgacaactacgatgtattaacaaatcaaatttggaaacttctaaaacaatgcgatgataatggacaaagagatgtcttggaaaagtctattggaattgaagtttctgtctatccatagcgaattggaaaaaacgatcaccatgaccaaaaaccaaatcgatgaaggttcgttcaaacacccaataccttgaagatgatataacaaagaaagcagaaaaatataaagaggaaaagataatcaacgaacacgaagaagttcgtggatccatggtttcggtttttcatcttcgtcttcttcttgtcctctgactcgtcctcatcaatg

SEQ ID NO: 36048 - DNA, 3003 bp, Unknown; identical to SEQ ID NO: 36047
  misc_feature (1)..( 3003): 2750-1469P.txt file - cDNA_ID_3092108; gDNA_ID_2926192; Annot_ID_201141

SEQ ID NO: 36049 - DNA, 3000 bp, Unknown; identical to SEQ ID NO: 4337
  misc_feature (1)..( 3000): 2750-1469P.txt file - cDNA_ID_3092127; gDNA_ID_2926192; Annot_ID_201131

SEQ ID NO: 36050 - DNA, 3003 bp, Unknown
  misc_feature (1)..( 3003): 2750-1469P.txt file - cDNA_ID_3092135; gDNA_ID_1620700; Annot_ID_165035
atttcgttacattcggagacgatagacggaaaaacagggacattggctatagaatcgttcgtggtggatgtgccggaaggtaacacaaaggaggagacatgcttcttcgtggaggctttgattcaatgcaatctcaattctttagcagatgttaccgagcgtctacaagcagaatctatggagaagaagatatgagatgtgacttgagaatcttttcattcggaaaagaaggaaaaagaccaaagaagagaaataactcttcccttttatagcaatgtctatgttttttcttcttctatttccattttctgaatgtttgtatattattggaagtttgtaacgaaatgatttcgaatagctgtcaaacgagaaatataaattcaaatttgtaagtgtttatatgaaatgcttttttatttttaacatttccacatgaaaatataaataacatatcatgacacatgcaaaatcatatttatgaaagttttttcaactctctccattttttcgacatatcagcattagatagagtgacacttatcacatcaacatatgaattacatttcttatttaatttaatgtatttaagaatttataatcatgcattaattctttctaaattttttgacatgtttgaacttattaattaaataatttcaatttaattaggtacaaagtatatcaaactcacataaataacttatttaaattaaattatataaatcgtataaacttatgtataaacataaaattaatagaattttaatgaacttttagatttgattaaagtataaaaattaaataatatgatataagaatttatttcatgttttcatatactaatatatatatatatatatatatatataaaagattaataacaattgatattagttaaatttacggtttagtttaaggtaaacccaagatgctctcatctggaattctgttatgatctgtacgtcctcaaagttccagagatgttgagaaagatcaaacatcagcagcgtcagaggctttttctctggagaggtgatgttgaatggctctatgcgctgctcggagagcaaaagagtcttgaagaagactctagcaaatccatattggcatctaagcttgatctttgtgttcctgttatgaaacacagaatctagactgagactgaagttggatacctcagctttgggatggagaataccggaactcttggccggagtaagaggatggaaagcatgctgaagatgagcaagagcgttccaagaaagactatgacgaagaaaacaaatcagaaatatactaagtatgagttgtttcaaagaacgtagtaatggtttataataatattaacaatagaataaaataaatagtaatggtttaagaaaatattaataatagtgagcaaaagctaagcaaaatataagcaaaacataataacatagtcaaaataatatggaaatgacaagtatataaattatatgttaaaagttaagaaattgacttggaggtttgtgttgggattttcccttaacttaaataaaggttttaaatgtgaacaaaaaaagtttgaagttttagttgggaaaatgttttgatttggaggtttgttttggaattttttcacttacctaaaaagattttggttattattaacataaaattctactaataacaattgatatgcttcttcgtgttaaaaacaaaaaaaaaacaattgatatgcttcttctttttttgtgcacccaataaatatgaattaaataagcatttttaatagatttatctcttgatagggtatccatctaaacaaatacaaaaaagaatacatttaaccaaaatgcttatctaatgtatatttaaatgtaaaactttattgtatttgttaatttagcaaaagataaaatgtctaattgctaaatcatatttacaaaatataatatctgttaattaaatcatgattcagttgtttgggctgttaattttgttttaatccgtctttgggcttgacccttctgtatttgcctattgggctttatgaatgttatgaatgaaaatgaatagtcacaaaacaaaagaaaaaaaacagaatttgagtcggtacacaactgttaacgaggtgtacttggtggaatcatagacacgtgtcttgacactcttaaggcctcttcaccaccaaattacttccctaacaaaagaattattattattgtgaagccccaaaagatcgaacattctaattcaatggcctacttgctgaccaagcaaaaaggaccggctccgttttcacctaattccgagcttcacaacgtgccttccattggttgaatattcaactggtttaaccaaaccgaagttacacatacgatttgagtcggtacacaaatattacgagacgtactttgtggacagtttgacacgtgtatcgccactctttatccctcttcaccagtcaccactcaccaccaacttaaaaataaaataaaaagagcatatattgtggagccccttacatgatcgaaaattctcgttcaaaagcattcgttaagaccgtgtgttgtgtgtcgttttttgtcgacgaaaattagaccggctctgtttttattggctcgtttcgattgaaagcgtggctataattggtttaaccaaaccgaagtcgacgtctcggtttgttcggttaagattaagccttgtagaacattccaaaacgccgcgtcaaagcttttagggtttgattctgctgtgtggctacccactcaagtctccagtgttcctttgtggctctggtttgccctattcttctcttccccctctctctctctctctctctcttgttttctttttccctcttctccaaggaatctggaaaaaattaaaccttttttctaaatccctggaaatcagaaaacttcctattgagaaaccatagattcgatccaagcctttgattgtatcaaaatctctgcttcaccaagaatttgggttgatacagaagaaaaaagttaaatg

SEQ ID NO: 36051 - DNA, 3003 bp, Unknown; identical to SEQ ID NO: 36050
  misc_feature (1)..( 3003): 2750-1469P.txt file - cDNA_ID_3092135; gDNA_ID_2926192; Annot_ID_201116

SEQ ID NO: 36052 - DNA, 3003 bp, Unknown
  misc_feature (1)..( 3003): 2750-1469P.txt file - cDNA_ID_3092139; gDNA_ID_2926192; Annot_ID_201114
attgatagtgggtaataatgttgaatatttgtcatttgttaaaatgaaaacatgggtattttagttatttttatctaaatgaaaatgtgaatgaactacaaaatgatcaaacaaataaagatccatttaaatgcatcatttagattaaattacaaataacgaaacaaacatcattcaaatgtatcattcaaatgaatcatgtaagtggatcatttgaatgaaaatgataaatgatgaaacaaacagggcctaagccaattttgtgttctaatataatcttgttatgtcttcaagattacaatcctgcccttttggtttatttcaagacagttgttgataagttaaatatctacttccttaagaaaacttcatctgtgttttttttgcttattgatctgttcatgagtcatgactatgaatatagtttcgttttctaaccctttcgattcctagctgatttctctttaatttgtttttgtttacttatgtattcatatcaaaagcatgcacattattattattatatttttgcgcattatttatgtgagaatgaaaacttattgtagaatctccggtgaggtttagctctggtgggtggaatattcttgttgtggtacggacttatgtttttagtgtaagttagatttgatcaaaactggtcacatggtccttgtccatactccattgttctcaatgattcataagagacaacaacagtagacgacgacacgttttcttcttttatgtgttatgctttagttagttagatccatgcatctacaacaataccttccaaaattattgcagctataatagaaatatcaaaacgtggatgagaatatttgcactaagcttttcagaattctactacactaaaccatggaaaattagtttctcctacatgctaaattcatctaaagtattttctcgagtccatccacaagagtattcgagcttggaagcaagagttaaaagaggttattgtggttgtacaaagtgggacacctttcctgattggcgccgccatgccccttggcaatgaacaatcaataaaggtatcgcaaaagccaaaggttcaaattttcaagctacacttctgagattaatggcagacaaaaaatatatttatagcttagatagttatacgttatatatagcattgtatatagacgtagccaatttgataaaaaccaatgcattcatgacccaacatattgggactcaagactatataaagccaaatacaaaacaaaacaaaacaaaaagaagtccacttgcgtataaaatatattcaatttcaataaatataaatgcaaacacaaacttagatgtataaactatagccgaagtgaaaatattcggcaactttagcaaatgaacaatttcttacagaaaataaatggtcatcatcaaatttggaccacccatggatttatatgtcaattttcatttccatattcatgtaacaacactaccgattgttggtccccaactttgtgttatttcaaattactttttatacgtacgtgtcacaagtaactatgagtaaatccaaaacaaaaaagttgagacaagaacataagaatatataattcgatgaaactgaagagttaaacataagaaagaaaagcataagatcatacgaataaattttgagaatcataatttgatatatatactcaaggaccatctgtatttattcacttttgggtattatgttaagttctcggtaatcaaatacaaaatttcctctcacgcacgtacacttgtagtttcaattcccactgatacaaaagcttccctcaaagatggagtaaggaaattgaagtaaaacaaacaatttggactaatgaaattttataaaacgattcaagttggaaaatacaaggaattaacaaaacgtgttttggacgtcaaaatttagacaagagtagtcaagaatccaactatggaactaaaccatcctcactgttaaatctagactctagtgattagcattcaacaaaaacaaattatacttttcgtacggaacatattctgaaactattcacatgtcagttttgtcatttcctcaaaactcatattcattttttttttaaatggacatcacgggacctgagttcctggccataaaggctaaaaagcagatccaagaattgattgattatatgaatttagttacaaagtacaaccagattgtattctatgaacatattaattgtttccactattcatggattcatgatagagaacaatatcactcagaactagttaatgtcgcgatttacaaaaatcccacagcaccataacctcgcaatcgcatgacgtaatggaaaatgtgagagagagtcacaagaacataggacctacactaaacatgtgtagtgtctacactctacagtcacctactatacaagttgctaaatactactacgtacgacttgtttagttagaactgcaaaaaattaaacttgtttgtcctctaatcccaacagattttgtttttatatactgattaaccactgctttgttacaacaacttacaacttgaaaggaacgttacatgaaataactcttctcattcatgaatcatcttctctacataagaaaaagttgtgcataagaaatatctacactgaaaaaatggcagtgggggttacatttttgatttctctaattctttatttacatttatttctattttcatgttaaacatttatttcaatgccaaaataataaagaaagtaaaatctataaatgggattcagtgcaccaataattcttacacataaaaaaatatcagtatcaggcctctcaacatcacaatagggcaagaggaggggccaaagtacacaactttctcctcagggtatgctccaaattcccaacttggcctctctttttcatcttttgggtttttatgttcactcttctctgcttcattcctctttctacttccaggaaataaaaacttctaatcaaagagcaagagattaagaaatg

SEQ ID NO: 36053 - DNA, 3003 bp, Unknown; identical to SEQ ID NO: 19422
  misc_feature (1)..( 3003): 2750-1469P.txt file - cDNA_ID_3092161; gDNA_ID_2926193; Annot_ID_201251

SEQ ID NO: 36054 - DNA, 3000 bp, Unknown; identical to SEQ ID NO: 3177
  misc_feature (1)..( 3000): 2750-1469P.txt file - cDNA_ID_3092165; gDNA_ID_1620630; Annot_ID_162641

SEQ ID NO: 36055 - DNA, 3003 bp, Unknown; identical to SEQ ID NO: 18892
  misc_feature (1)..( 3003): 2750-1469P.txt file - cDNA_ID_3092165; gDNA_ID_2926193; Annot_ID_201247

SEQ ID NO: 36056 - DNA, 3003 bp, Unknown
  misc_feature (1)..( 3003): 2750-1469P.txt file - cDNA_ID_3092174; gDNA_ID_2926193; Annot_ID_201242
aacacacaatgacttaccaaaagtacacgcggcccatcctcgtctttatgttccaagtgcgactgtttgtttatttgtaagcatttttcttataataataaaacagctctatcttcgttaatatcaacctttcttagaagcttttcactggagataaatgtgaggaaaaaatcccctacgttataagccaagtataagctattctgattggcttaacacctcctacgtcaaaactcaaaaagaaacacttagtagtattatatgaaaaaagaagagtgaattgcagctgcctcaaaagtaatatttactttattataagatttagtatgaacttatctacatgtattttgtttgaaagaaaagtaaacaaaaaaaaaacaatagaaaaagagaaagacgcaacatgactttttttttgtattgatattgtagagaggatggcgtaagaagaagtctgtttgtttcctaaggttaatctaatcattatatatttggaatgttttgtttcttacagagatatcttagcacaaaattctgaaaaaataatcagaagactgtggaaaaataaattcaacgaatgtgaccaaccactacaaaacaaaacaacattataaaatctaggtttcgaactcgcaaatcaaccaaatattatgcaggtcttttctactctgtgggtaaaccgacagaaacagcgacgacgtttgttttatttcttttaaactgttcacatttgtttattgttttcctcctgttgaaagttaacaattcaaaaatttccagtacatgtgtttctgttctcttctcttctcaaaattttttgtttctttttgtctcaagctatgaacttccatactttgaatcttctacttctctttcttcctcttacttgatcttcctatagcatacttccatcatgtaagttcctttttgtatttttatttctcttacttgctaaagttttatcttcacattttttgatgattagggttttggtttgagattaggggtgaagatgatatagtggagctcttatggaacggccaagtcgttcgaaccagccaaccacaaagaccttcctcgggtaaaccttctcctactccacccattctgcgtggtagcggaagcggcagcggagaagaaaatgctccccttccacttccacttctacaacctccacgtcccctgcatcatcagaatctcttcattcgggaagaagaaatgtcttcttggcttcactattcttacactggtgtcacgtccacaccggctactcatccgcaaagttctgtttccctgccaccaccaccacccattgctccgtacatttccgttctttttcctttcattctcttactctttgcaatttgacgagtctgatattttagggtttggattttggtttgaaattaggagtgaagatgatgtggtggaactcttatggaaaagcggccaagtcgttcaaagcatccagacacagagacccattcctcctcccattttccgcggcagcggaagtgggggaggtgaagaaactgttctgcctctgcctcccctgcatccgtctcatcaaaatatcttcatccaggaagacgaaatggcctcttggctttaccatcccctccgtcaagattatttttcctctggcgtcgcctctacttcagctactcgcccgcaaagttccgcctctctagcaccaacaccaccaccacccagtgttccctacggtcagattcccgttgagagaaggacagagaattttatgaacttcttgaggctaagagggaacatattttccggcggtagagttgaagctggtccggtggttatagaatcgacgcagataggctcaagcgcgaccccgtcgtcttcagccgctgaatcctgtgtaataccagcgactcacggcaccgagagtagagcggcggccattaccggagtatcccgtacttttgcagttcctggtcttggtcggaggggaaaggaggtggcaaccgagacggccggaacatcatattcaggggtaaacaaggccgaaacagagcgggttcaaatacaaccggagagggagacgaaaattaccgaagataagaagagagaagaaaccattgcagaaatccaagtgagtcacagctaccataggttcacctgttgacacgtgcagtgtagcagtcaaggcttaattttatcttgtttcttggcgtacagggaactgaagaagctcatggttcaacgtctaggaagaggtcacgagctgcagatatgcataacctctccgaaagggttcttatattttactttctaggttttaataatggactctttgtttcgtctctccattaaaacgtagtttgtataattgtttaacagagacggagggaaaggatcaacgagaggatgaaaactctgcaagaactccttcctcgctgcagaaaggtctctctcagttatttataacctgtggctgttaaacataaaaaaagttagattctgatgacatctgtttctattctgatcagactgataaagtttcaatgcttgaagatgttatcgagtacgtgaaatcgctacagctgcaaatacaggcatgtactcaaaaactgaatgtgtgttaaagcaaaacacaaccggaaattaagtgctgtggaatagttgaacatggttatttgagtgctatggaatggttatactctttgtttatcaaccagcgtctctgcattttaaacaaccaattttttagatttgatttctgcagattcatcttggaagggttttaaagtgtcatggaagataaatgcaaatcttataagtcatgttcttgaggtcttactcttctgtattgcttcacacgtttacaggattatgttgaagaatctacagcttataactgagattttaatatatgaatcaatgttgttatgccagatgatgtcgatgggacatggtatgatgccaccgatgatgcatgaggggaatacgcaacagttcatgccccacatggccatg

SEQ ID NO: 36057 - DNA, 3000 bp, Unknown; identical to SEQ ID NO: 3182
  misc_feature (1)..( 3000): 2750-1469P.txt file - cDNA_ID_3092186; gDNA_ID_1620630; Annot_ID_162655

SEQ ID NO: 36058 - DNA, 3003 bp, Unknown; identical to SEQ ID NO: 18886
  misc_feature (1)..( 3003): 2750-1469P.txt file - cDNA_ID_3092186; gDNA_ID_2926193; Annot_ID_201234

SEQ ID NO: 36059 - DNA, 3003 bp, Unknown
  misc_feature (1)..( 3003): 2750-1469P.txt file - cDNA_ID_3092191; gDNA_ID_2926193; Annot_ID_201230
ctgtatgttacttacttaattttagattttatagtgctatatccttaaataatttatgaaaataggttacttttgcaattcacccattattattttcgtattagaaatagaaatcgtctacttattgtgtcgaatttgtttttaacctttaaataaaataatgggcctctaaaataaagacaattagggggctaggttgttgagcccaggaccgattctagtactactagactagttgttacaaaattagttttattataggatataattttttatatattttaaattcttaaataattaatctttcaattttttgaaaagaaaagtactaactcactcgtattaaatagctgaaaattttgaagatgagacacgtccgaatgagacacaagtacaaaggacatgattcatcatcatcccatgcataaaaaagacgacaatcaaaaaagcaaagtaaaaaacaaacactcacacgggagctggaaagagatataaatggccaaaattttaagaatatatcaaaataaaacgtggagaaagggattaaaaaagctatgtaaagatataattgcattgtaccaaaaaagaagaagatataattgcacacatacgtcatattgtttatcaaaactcaaaccaatattctttaaaaaaaaaaaaaaactcacaccaatcttatatcctaaatcattcgtgttgcgagaaatcttacattcagcttttaaattcttcattgattcttgacatgtatttctatatttggtgaaacaaatataagttgttttaagttggtctacgaagtttgtgctcgcaagagagaggatatttgcaaatttaagctgtgattttgtaggaaaatgattgtattgggggatattttgcaaattgcaatggtatgtatcaagttagagacaaaaatcacaaaagtgggctacaatatgactttgagtattaatgtcggtatcttcgagaaccatatgattcccttatctagtcagatactgcactatttatatccattcagattatgccacgtgatggtcaaactggatgttcagtcaaacctttgactcagtggatccaatatacacatgcatgtcacttaaattatgatagaaagataaatttattaccatatctataaggttagattctcttttgttgaaacaaaatttcctagctttttagtaaaattttcagtcaactaataataacatttcaaactatggcaagattagcattataaagaaggaactaaacctaataataatacttattaaatggtgaaattttggtttgtattctccaaaattctgaaaatttcatagccattattggagtcatctgcttttccttttttgttcttcatttttttttcctagtcaatagagatattttctctttcttactgcatcgatccatatcttgactgaataaatacgtcaaaagaaagcattaacgattacacactctcatacttatctcctcttaggtttctcatttctctcgtctctttggaaaataaaaattgttgatcagaaataaaggagaaaagaataaatggcagatcaaaatccaagaatcatcgtcgagcaaaacccatctcaagctcgtcttgacgaactaaagttcaagtcatggcccaagtaagatcgactcttgtttttaatccttacttgtgggtgagagatccatttggtaaagttgcatgagatagatttagaaaattgagttttggttttctttgttgttcaaggtggggatgttcaccagggaagtaccatttgaaatatgaagcagaagagatatgttacattttgaggggcaaagttaaggtttaccctaaaccaccaccatcatcatcgtcggatgcagaagttgaatggtgtgtagagtttggggcaggtgatattgtcacttttccaaagggactttcttgtacttgggatgtatctctctctgttgacaagcactacattttcctctcttcttaatttttgtaaaagttttttttattattctttattttttgtatttctaacattgtgtttcttattagttgttgtaattggtgttctgtttttttttttttagtaagaaatatagatgtgtttgcatttataatcgcataatgaaacaatgttcttcaccaatcaagcttgagcaaacctcatcaattcgaataatcctgagatgaatcttcaagaaaatataaaaattatactcattaatcctataaaaagtggggcatatacaaaagccttcaccactagaaccccaacccttttttctagattgaaattcaaattcatatgagttgttcaaatgtttggaaattaagaaacggtaaacgttggattctctttagtcaacaagaggtgatcttctttacttgtccatttacgcttctattatactactactaaatttcctttctttaagatccgctgaccagtcaactttccatcttgtttatctttaactagggtaagcagagattttaagatcaatattggaagagaaatttaatagaaagatgcatactgtaaaaatttcacacgttcaaatgttatttactcctttgttaaatcaatgctggttagcattttcaaaagccaatcgtcaacataaatgtagcattaagtccactatcataagtcataactgtttaacatgttaccattcaaaaccaacaacatgtcacataacatcatcaaaagatatgtgatcatcatgtgagatacactttggacacaaatttgacaaaagccagaagaaaaaccagttaaatgctttcaataaggaaaaaaagaaaaaagaaaaacgttccaaaaccaaaaccttctaactcatcgaaaagatttcggtccaaaccgattgaactggccggtttatgaatttaaaaacaccgtccaatcgaataacatctggattttacacacacacacacactctctcacactcgttgaccaaaaaaaaaactctctctttcactgagaaatg

SEQ ID NO: 36060 - DNA, 3003 bp, Unknown; identical to SEQ ID NO: 32411
  misc_feature (1)..( 3003): 2750-1469P.txt file - cDNA_ID_3092195; gDNA_ID_2926193; Annot_ID_141146

SEQ ID NO: 36061 - DNA, 3003 bp, Unknown; identical to SEQ ID NO: 32411
  misc_feature (1)..( 3003): 2750-1469P.txt file - cDNA_ID_3092195; gDNA_ID_2926193; Annot_ID_201226

SEQ ID NO: 36062 - DNA, 3000 bp, Unknown; identical to SEQ ID NO: 8303
  misc_feature (1)..( 3000): 2750-1469P.txt file - cDNA_ID_3092203; gDNA_ID_1971713; Annot_ID_175141

SEQ ID NO: 36063 - DNA, 3000 bp, Unknown; identical to SEQ ID NO: 8303
  misc_feature (1)..( 3000): 2750-1469P.txt file - cDNA_ID_3092203; gDNA_ID_2926193; Annot_ID_141143

SEQ ID NO: 36064 - DNA, 3000 bp, Unknown; identical to SEQ ID NO: 8303
  misc_feature (1)..( 3000): 2750-1469P.txt file - cDNA_ID_3092203; gDNA_ID_2926193; Annot_ID_201223

SEQ ID NO: 36065 - DNA, 3000 bp, Unknown; identical to SEQ ID NO: 8306
  misc_feature (1)..( 3000): 2750-1469P.txt file - cDNA_ID_3092211; gDNA_ID_1971713; Annot_ID_175138

SEQ ID NO: 36066 - DNA, 94 bp, Unknown; identical to SEQ ID NO: 445
  misc_feature (1)..( 94): 2750-1469P.txt file - cDNA_ID_3092211; gDNA_ID_1591038; Annot_ID_150434

SEQ ID NO: 36067 - DNA, 3000 bp, Unknown; identical to SEQ ID NO: 8306
  misc_feature (1)..( 3000): 2750-1469P.txt file - cDNA_ID_3092211; gDNA_ID_2926193; Annot_ID_201220

SEQ ID NO: 36068 - DNA, 3000 bp, Unknown; identical to SEQ ID NO: 8302
  misc_feature (1)..( 3000): 2750-1469P.txt file - cDNA_ID_3092222; gDNA_ID_1971713; Annot_ID_175134

SEQ ID NO: 36069 - DNA, 3000 bp, Unknown; identical to SEQ ID NO: 8302
  misc_feature (1)..( 3000): 2750-1469P.txt file - cDNA_ID_3092222; gDNA_ID_2926193; Annot_ID_201216

SEQ ID NO: 36070 - DNA, 3003 bp, Unknown; identical to SEQ ID NO: 32011
  misc_feature (1)..( 3003): 2750-1469P.txt file - cDNA_ID_3092237; gDNA_ID_2926193; Annot_ID_201211

SEQ ID NO: 36071 - DNA, 3000 bp, Unknown; identical to SEQ ID NO: 29060
  misc_feature (1)..( 3000): 2750-1469P.txt file - cDNA_ID_3092260; gDNA_ID_2926194; Annot_ID_201313

SEQ ID NO: 36072 - DNA, 3000 bp, Unknown
  misc_feature (1)..( 3000): 2750-1469P.txt file - cDNA_ID_3092264; gDNA_ID_2926194; Annot_ID_201312
cgcaattatagaaggaagagatgtttctctgacattgaaatcttgcaggatttgcacgtttggtttcaccgtatcatccaattcaaacccgagtatgtgaggccgcttctctatcaacctagctgcagccagtctcggaataccaagaacctcgagatactccacgagaggcttaattatccgagctacccgcattcccaaaatctcagggtaccgtgttaaaatacccccaatctccctcctagctacacctataccaaccaaataagcgactgatgtgctcatagtcccttccagcttaaaccccaaaacttctggatacctctcaagcacccgaggtacatcactcggtttaatatccagtccttgaagatacttaaccaccggtgcaagatctataacaacgctagagtgaagaacctgcgggtatcttctaagaaactcagtgaaagtcgatttcctgacgcctagtttcccgagataatcaagaaccggaaccatgttcttcttcacgctacaaccaagaacaagagggtaattgttgatatcttcaatggtaagccctaacttgtgaagaaactcgacacgctctttcatcacatcagctgttacagggagttcaaggccatcaagctcatcaggaacaatcccaatcccacgcaagaactcataaaccttagcacgattagcagctttctccttattcatatctaacaaactaggacgactatacaaagacttagaatctcttcccttatccttatctctatccctatcccttcccgaagaagaagaagaacgagaagacctttctcttctcggtgaatccaaagaacgtgaagaaaatctccgatttgcaatagcgcattgaacagttagaccaattccagtcccaggtctcttcttgtggttgcataagttgccataagtggaatcagagagtgaacgagatctaacggcaaaaaaagatggtggctcaaagtgaactagcaaaaacccaggctttgtgaagccattacagaacctaatcttcattctttacctgcacaaaaacggaacaacactaaaatcgacgattatcaacgagaaaatcataccaattcggactaacccagacaattttacagtacaattagctcagaaaactccgaaaaaataccatcattcatgttcatgttaacatcaacgaaccaaaaaaccataacctaactagaagcaaaccacagaaactatggaataaggagaattggaccagcgtgtgattgaaatctcaccggagctgaggaaagatatcggagaagacgagggttttagaggagcgggtaaggttttttcctcatcacacaacaaagtcactctctttctccattgaaatgatttatccgaattattgacgttctcccccttatttcttatatttcccattattgccctatactatctgaaattatcacattaaaccaatacgtatatgattactttggatgtgatataaattaataaaaaaactatatatcatcaaaactttctcttaatatttctaaaattaattaattccctccttttatcttcaacattggattatcgaaaatgaaaaatagtattttctgactcttttttatagtatcgggtttaattcagaaatatataaagctttggggtctgtttcgaagtatctttactcttttaacagttctgagacttctaaagagaggaaaattagttcgtcgaagcatcgagaaaatgatcgtactttctgttggttccgcttcttcatctccgatcgtcgtcgtcttttccgtcgcgcttcttctgttctacttctctgaaacttctctaggagctccttgtcccatcaatggtgcgtttcgcctgttttcatccctactcgccattagattgtatctagttatattgtgaatgcagatttcatcttgtttatctatgtatcagtgatagaatctaaggtcttagttagctgtgaaatcgtatgtcctggtagaatcagatggaccaaaatgtgctgaacttgtgattgattttaactctaaattaggtttatggaggtgtttcagaatgcttcatagtgaatttggttgctgatatggtacagattcgctgcaatttcatcgatctgtagcttattagaggatccaaaatttgtttagaaatgcttacatagcttaaatacttagaaattgtgatgttaatactggttcttgactcttgaatggtgattctaggcttgccaatcgtgaggaatattagtgaccttcctcaggataactatggaagaccaggtctttcccacatgactgttgctggctccgtattgcatggaatgaaagaggtaatgttcaaagctgatagaggtttaaaactctttccattggtatccgctcggctcttatctgtgttttttcatggttggatgttcaggttgaaatatggcttcagacatttgctccaggttcagagacaccaattcacaggcactcctgtgaagaggtttttgttgtcctaaagggcagtggtactctgtatctcgctgaaacacatggaaatttccctgggaaaccaatcgaatttccaatctttgccaacagtacaattcatattccgatcaatgatgctcatcaggtatctctttctacctcccacatcgtttcagatgacttggctctttccttgattcttagagtttgaaatcctagattgttagagtttcccctttaattgtaatcttgattgagggcaaaagaaactccatgtaaggctgatgataaacaatccaatttcgtatgcaacagatgttagttgagcaaaaacatactattatgtttaagattgcttgagagtgttagaggtgccgcaggtcctatgtcacatgtagagacaattattagaaaactgaccttttcgctaacgttgtgtatattcttatgaatcagtgaaagatgacgttttcttctgctaaaataacttttgtgttatcttatg

SEQ ID NO: 36073 - DNA, 3000 bp, Unknown; identical to SEQ ID NO: 5105
  misc_feature (1)..( 3000): 2750-1469P.txt file - cDNA_ID_3092270; gDNA_ID_2926194; Annot_ID_201287

SEQ ID NO: 36074 - DNA, 3003 bp, Unknown
  misc_feature (1)..( 3003): 2750-1469P.txt file - cDNA_ID_3092280; gDNA_ID_2926183; Annot_ID_200442
tattgtaatatagcctacatagtggtgatttgtggtattggtgacactatgttaaggtcaaaaagaaatagagagtaaattccatatatatgaaaattgaaaatgactgtttaaatttacatatggcgcgaaaaaatgatctagttcgttaattatttttagaagctttttgtggtaaatttagatttttaaaaaactccatatattttttttttataatttaggcttgtctattgtaaatttgtaatatagcttagtgatttatttgtttagcttctggtgacattttataaatttttaatgaccagtataatatagtatttttttataaattaaaatataatctaatgttttatgtcaacttcgttgttcattgaataaatcaaactttgaagaataattaaataacaatgtttgcaaaaactgttacgttttttcatgtaaacattagtggacgttatacaatagatatttaaattataaaaactattcaaagaatattgtaaagaaataaaacagaaatgtgtaagaaaaaatgtttattttattgtacgtaataaaaaaagagaatatacttgtgtgggtggacctaaatgcaaataggcaaagtaccgacaaaaaaagaagaatcagaaagtgaaaaagagagcgagcgatgaacagtatcttctccattgacgatttctccgatcctttctgggaaactcctccgattcctctcaatcccgactcttctaagcctgttacggcggatgaagttagccagagtcaaccggaatggactttcgagatgtttctcgaagagatttcttcgtcggcggtgagctctgagccacttggtaacaacaacaacgcgatcgtcggtgtttcttcggcgcaatctcttccttctgtttccggacagaatgatttcgaggatgatagtcgatttcgtgatcgcgattcgggaaatttggattgtgctgctcccatgacgacgaagacggtgattgttgattccgatgattatcgtcgtgttcttaagaacaagcttgagactgagtgcgctactgttgtttctcttcgggtgtgttgttaatcttctatttttcttatctatatgtgtaatttgtgcgttttgatctaaatctgaagctctgatgttctcttcttaggttgggtctgtgaagcctgaagattcgactagttctccagaaactcaacttcaaccagttcaatccagtcctcttactcaaggtaagagtctcttcttagtttcaccaggatagatgagcgatgataaacctgcagattcgtttctctgttctgtgtttgttaatttagatgcctaggttaaggaattagaaatagaaaatggtacttttgttggatcaagcgcctagttttatccgtcaagtttcaatctttttgtgactgactttctcattgaaattaaactgctttctggaagaacaataagcttgggattgagatgagttctggtggttagttcaatatatgggaaatcattatttcagcgctcgtctttctctttcagatatctcttctgagtcttagacatagtaagttttaatcgtggtaggttctttgatgaccccaggagaacttggtgttacttcttccttaccagctgaggtgaaaaaaactggtgtatcaatgaagcaggttactagtggatcgtcgagagaatattctgatgacgaggaccttgatgaagagaatgaaaccaccggttccttgaagccagaggacgttaaaaaatctagaaggtaatcattactttttctccaatttcttgtcgtttgaagattacatttatagagccttgttcttccttttaatatttgtaggatgctgtcaaatcgtgagtcagctaggcgatctagaaggagaaagcaggagcaaacaagtgacctcgaaacacaggttttgtgttgtatcctctcaacacctcatttttgtgttgaaggatattaatgagacctaatttgtattttgataggttaatgatctaaaaggtgagcattcatcacttcttaaacaactgagcaacatgaatcacaagtatgacgaggctgctgttggcaatagaatactaaaggctgacattgagacattaagagctaaggtaagaagacttaagtattatcctcctctcctttttctgaactaccctttttttgtatacagttttagtaactcccatgttatgttaaggtgaaaatggcggaagaaaccgtgaagagagtaacaggaatgaatccgatgcttctcggaagatcaagtggacataacaacaacaacagaatgccaataactggtaacaacaggatggattcttctagcattattccagcttatcaaccacactcaaacctaaaccatatgtcaaaccaaaacatcgggatcccaaccattctacctccaagactcggaaacaatttcgctgctcctccatcccaaaccagctctcccttgcagagaattagaaatgggcaaaatcaccatgttactccaagcgccaacccgtatggctggaataccgaacctcagaacgattcagcatggtaagctaaaacatggctctttcttttaagaccattgaacaatttaaaaccatttgaagtactatgatccctgtttatacatatcagattcctgtctcccctttttttgctcattttacaggccgaaaaaatgcgtggactgatcaaacaagaagcgggtttcgcactatattaatgtctatgcatctgtaatttgtaagtgttattaagttacgaatcatgagaaaacatcttgtgaaaatacagtctcatggcttatatatatatataagctctgtcttataacattacaagattcttatttgagaatcgtctttctatttatagctaataacagagtgtatatctgtttttatccaattttaaaaaagatagctcacatggctttactaatttcccctatcattaaattccgacaacctcggcgatttccatg

SEQ ID NO: 36075 - DNA, 2137 bp, Unknown
  misc_feature (1)..( 2137): 2750-1469P.txt file - cDNA_ID_3092280; gDNA_ID_2926194; Annot_ID_201269
tttcttcggcgcaatctcttccttctgtttccggacagaatgatttcgaggatgatagtcgatttcgtgatcgcgattcgggaaatttggattgtgctgctcccatgacgacgaagacggtgattgttgattccgatgattatcgtcgtgttcttaagaacaagcttgagactgagtgcgctactgttgtttctcttcgggtgtgttgttaatcttctatttttcttatctatatgtgtaatttgtgcgttttgatctaaatctgaagctctgatgttctcttcttaggttgggtctgtgaagcctgaagattcgactagttctccagaaactcaacttcaaccagttcaatccagtcctcttactcaaggtaagagtctcttcttagtttcaccaggatagatgagcgatgataaacctgcagattcgtttctctgttctgtgtttgttaatttagatgcctaggttaaggaattagaaatagaaaatggtacttttgttggatcaagcgcctagttttatccgtcaagtttcaatctttttgtgactgactttctcattgaaattaaactgctttctggaagaacaataagcttgggattgagatgagttctggtggttagttcaatatatgggaaatcattatttcagcgctcgtctttctctttcagatatctcttctgagtcttagacatagtaagttttaatcgtggtaggttctttgatgaccccaggagaacttggtgttacttcttccttaccagctgaggtgaaaaaaactggtgtatcaatgaagcaggttactagtggatcgtcgagagaatattctgatgacgaggaccttgatgaagagaatgaaaccaccggttccttgaagccagaggacgttaaaaaatctagaaggtaatcattactttttctccaatttcttgtcgtttgaagattacatttatagagccttgttcttccttttaatatttgtaggatgctgtcaaatcgtgagtcagctaggcgatctagaaggagaaagcaggagcaaacaagtgacctcgaaacacaggttttgtgttgtatcctctcaacacctcatttttgtgttgaaggatattaatgagacctaatttgtattttgataggttaatgatctaaaaggtgagcattcatcacttcttaaacaactgagcaacatgaatcacaagtatgacgaggctgctgttggcaatagaatactaaaggctgacattgagacattaagagctaaggtaagaagacttaagtattatcctcctctcctttttctgaactaccctttttttgtatacagttttagtaactcccatgttatgttaaggtgaaaatggcggaagaaaccgtgaagagagtaacaggaatgaatccgatgcttctcggaagatcaagtggacataacaacaacaacagaatgccaataactggtaacaacaggatggattcttctagcattattccagcttatcaaccacactcaaacctaaaccatatgtcaaaccaaaacatcgggatcccaaccattctacctccaagactcggaaacaatttcgctgctcctccatcccaaaccagctctcccttgcagagaattagaaatgggcaaaatcaccatgttactccaagcgccaacccgtatggctggaataccgaacctcagaacgattcagcatggtaagctaaaacatggctctttcttttaagaccattgaacaatttaaaaccatttgaagtactatgatccctgtttatacatatcagattcctgtctcccctttttttgctcattttacaggccgaaaaaatgcgtggactgatcaaacaagaagcgggtttcgcactatattaatgtctatgcatctgtaatttgtaagtgttattaagttacgaatcatgagaaaacatcttgtgaaaatacagtctcatggcttatatatatatataagctctgtcttataacattacaagattcttatttgagaatcgtctttctatttatagctaataacagagtgtatatctgtttttatccaattttaaaaaagatagctcacatggctttactaatttcccctatcattaaattccgacaacctcggcgatttccatg

SEQ ID NO: 36076 - DNA, 3003 bp, Unknown; identical to SEQ ID NO: 31700
  misc_feature (1)..( 3003): 2750-1469P.txt file - cDNA_ID_3092317; gDNA_ID_2926195; Annot_ID_141254

SEQ ID NO: 36077 - DNA, 3003 bp, Unknown; identical to SEQ ID NO: 31700
  misc_feature (1)..( 3003): 2750-1469P.txt file - cDNA_ID_3092317; gDNA_ID_2926195; Annot_ID_201402

SEQ ID NO: 36078 - DNA, 3003 bp, Unknown; identical to SEQ ID NO: 31701
  misc_feature (1)..( 3003): 2750-1469P.txt file - cDNA_ID_3092325; gDNA_ID_2926195; Annot_ID_201398

SEQ ID NO: 36079 - DNA, 3003 bp, Unknown; identical to SEQ ID NO: 28955
  misc_feature (1)..( 3003): 2750-1469P.txt file - cDNA_ID_3092340; gDNA_ID_1971748; Annot_ID_175237

SEQ ID NO: 36080 - DNA, 3003 bp, Unknown; identical to SEQ ID NO: 28955
  misc_feature (1)..( 3003): 2750-1469P.txt file - cDNA_ID_3092340; gDNA_ID_2926195; Annot_ID_201387

SEQ ID NO: 36081 - DNA, 3003 bp, Unknown; identical to SEQ ID NO: 21946
  misc_feature (1)..( 3003): 2750-1469P.txt file - cDNA_ID_3092348; gDNA_ID_2926195; Annot_ID_141237

SEQ ID NO: 36082 - DNA, 3003 bp, Unknown; identical to SEQ ID NO: 21946
  misc_feature (1)..( 3003): 2750-1469P.txt file - cDNA_ID_3092348; gDNA_ID_2926195; Annot_ID_201382

SEQ ID NO: 36083 - DNA, 3003 bp, Unknown
  misc_feature (1)..( 3003): 2750-1469P.txt file - cDNA_ID_3092376; gDNA_ID_1620665; Annot_ID_48036
cgaaacagattacaaacagtaatctagaagatatgagcttaatccctgagtttctctatccagaactacagaaatgatcttaagaaggttctaattatgatcagatccaccaaccacattacagttaatgcattcaaactcaacaaaatcttcatatgcagtacaaataaacaatcaaacctaacactcgcgaaattcagtaaaatcagcaccgaacgaggaagaggaaagacttacgacttcaggctccaattgagaaatgattcgaactccatccttgttaacacgtagatctccatccttaaacgtaccgctttgagtcctacagagagaaccaaaacctttcctccttcaaaaacaaaaccagagacatttccacacacaaatacatctatctatccacagatccatggagaaagagagatcgagaaacatacaggaatttggtgatggattgctcgccagcaacaggaattgcgagcttgagattattgctgaatccacctttcttcatcgtcttcgtctacttcgttcttcgcttcttcctttttgttgtttcctcgtcattatatattaagtaaaacacagttttaagcataattcatgtacttttcagccagaaattggaatttggaaataaaacagccattaattaatattagtcaagcacatgttcacgacgttgaccaacgacttagagactttcccatttactacttctttttcccggttttctttgaccgaaaagttttaatccacattttaaccggaaacaaaccggttaattcagtgattcttcgttctttagcttttggtttttaaacactcccaaaatcaccactacaacaaaacgctaacgcagaatgccaaactaacgtttgatatttatagaaagttttcaatatttcaaatattgtttgatcaaatacaataaacacatataacaaacagtaaaatctttacttatgtttctcggtttcatgtttgaagataacaaggttttcttcaacaaggaatatacaaataagcatacacccctatatttgttttactcatgtatacattcaattacacatcgaaattatcacacaaagaaaaattgtttcgaattgattaatctatctatcagtatacttcatgtctagtctctataaccaacaagaacatgctattcttcaacattgtctatatattataagccctatatacattatatagtcacagactcagagaggctccacaaacgatttccccaaacataatcctatcacaaattgcggggggcaagagctactagaggcaatgatcatgaggttcgttcatatctccatcatgttgaaggagaatttcgaaagaagcttaggaatttgcgacatgatcggcccataagtctgcaacgcataaatgaaacatcacaacacataattaaatacagcttgattgactgaccctgttagttttaccaggaacatcgattaaaagttcacgatgagttaagggcaatgcaagtaagatagtacataccttttcattttcatggagttgacacaatggaacagcgaggagtttgaagttcttaggcacaacaaactgttgatgtaccggtaatctcacaagaaaaagctttgtgcattcctacacaaaagatgaggatagagcagagcttttagtataagcgcaaatcttcaaaagtctcaactttttcttacaatgaaagtgaaactaactaaccaacctttgggtgtttaatattaggtggcaagaaaggatacatcaatgtctcaaagttgggtctccaccacatcccaatacattctcctacctacaacaatgttgtaattagagagaccattcttaagccagaaacaatcagatacaaaagcactttaacaagaagccatagttcctacctcataacccgaaacacccacattttcgttaaccgatagctttgatgctagtttccgttttagaccttcaatatctagaagattaaggagaaacatgactttagcgtttagaattgagacagcgatatttatgcataaagatgcaaggaaacagcatactaaacctgattctccaggtctcaaacgaccaccaggaagcttgaaaatggagtttctatattgaagaagcaaaacatgaggatgcttgaacaactcaacctgatgtgtcccaacattagattttaatcaatcctttcaaaccaattttccctgtaaaacttttcaaaatccctaatttggctaccaactataaaattaccagaagaacagcttcaacgcaagttctcaatccatgagcagcataacttcaaaagaaacaaaaaagaaactttagctatagattaaaacaataagaaaaaaaccagatgatctaaatcacatcaaaactcgatttacttggatttcaatctgatgactcgatcagagataatctcgtccttgacgcgaagagcttcttttgaaccgaagtagtagctgctaagcgggtataaatcaaccatcaagtcatgaacgacatcgtttcgtctcgtcgtgttgtcactgatctcctccatatctaacgctcgagcttcttcacccattttctgcccgtaaaattcaaagacgagagctaaaagcgatctcaatcgattaaaattaaataacagagagaccacgagagcagagaagacgcaagaagaagagtgaagaaaggtgtcgtagtcggatcactgagacgtggcggctccagagagtacttctccgcaattagctgacgacggcgggagagtgaggaagaagatattaatgggcctgttacgatattaatgggcctttagtagtaaacaagaatacggaacgatgttaaacactctattgtttccaactactaaaaacgacgcgagtttctattttataactaaaaaacgagaatcaaagtctctgtttcaaatttgggtcttttgcttcttcttgctcacttgaggaaacacagtaaaaacctaaaaagagaatg

SEQ ID NO: 36084 - DNA, 3003 bp, Unknown; identical to SEQ ID NO: 36083
  misc_feature (1)..( 3003): 2750-1469P.txt file - cDNA_ID_3092376; gDNA_ID_1620665; Annot_ID_163897

SEQ ID NO: 36085 - DNA, 3003 bp, Unknown; identical to SEQ ID NO: 36083
  misc_feature (1)..( 3003): 2750-1469P.txt file - cDNA_ID_3092376; gDNA_ID_2926196; Annot_ID_141297

SEQ ID NO: 36086 - DNA, 3003 bp, Unknown; identical to SEQ ID NO: 36083
  misc_feature (1)..( 3003): 2750-1469P.txt file - cDNA_ID_3092376; gDNA_ID_2926196; Annot_ID_201482

SEQ ID NO: 36087 - DNA, 3000 bp, Unknown
  misc_feature (1)..( 3000): 2750-1469P.txt file - cDNA_ID_3092394; gDNA_ID_2926196; Annot_ID_201489
aatttaaaacaaaatcataacaataattgaatattctcacacggtggttgttctctttagtacccaagtagaattgttttggtcaaaatccatactaatctttgaaacctattaaaaattcgagtattttgtaatctaaacgttttactgtggctaaaaaaaattctagcaattcttttattgatggttgtattcgttttctagtctagatagtagatacacatcatcaacgattcttcttctactcgaacaaatcacgaatcttcttctactcgaaaaaaacttataacacttctttggttaaaaatgaagattttttgttgactttatttcacatatgtttaaatagttaatcttcttccggttcacgaatcttcttctactcgaaaaagtattctcctatgatggaaatttgataactgcggctaataaacaattttgatttccggtttagttttactttgtaagaagacatatttgattaaattttggaaattgttggacccataccatcaagacttgttggcagtagataaggtttgatattcaaatctcaaaatcattgtcttatgtcttttctgtgcccgaaaagccgaactcacatagtgtccctccatttcttttacttttcaatgtggcagtataacattcgaatttacgaaatgtttatatacttatgtttcaactttcacgtacaattacccttcacaaatcacaatcagtacctttcacaaatcatagtcaccaatcaccaatcaagatcacttcaggtctttcattcgactcagaccggattcatagttttgacggttcatatgattacaacgattgaaagttgtacattttatgttttagaacagtttatggatcattgattggtgctagctagtttaactacgtagtgcttctttttatcataaataaaaaatacgttgcccttctcattcttgctattgcgtgatcttcaaatcatttataaacaatctgttgaatataagattaaacaaaaaatattttttatttttattaaaattatggtataatcaagttgtcaatgactattgacgtacatacatacacacacacacatgatacataaaatggtgataaaatagaatcacaaaacataaataaatattttgccgagagctctttagccaggttgttaccacctttggtctattctcgggcgtgtgtttgtggatttaattaaagtatagtaaaggatttaggtccagcaaataatataaaagatcaacatttcacacatcatttacaataaagtaactgcagaatcacaagattattaatattttccgttattaacgttaattttgtcggatcgacttttttcatgtttttcttcttgttcgagagtccgaattggacatagaatcaaacccattttgaacaaaatgaaactaggtttcacttatgctttagtaagtttctttcattccaaagtaaagctaactaattaggcaaattactagagaaaatgcatatacacatacacacgatctattttgaatcattaaaaagaatggtttgaatttggtaatttgtttggggattttcgtttttagaccacatgggtgcaatattcaacaacgataagtaacgagattactggtcctagttaatcggcccaatatgatagaacatgtcccttcgtggctttgatttgttgggctctgaacgaaacaaacttcattcatatagactatagactgatcttaacaggcccacgagtaattaacttaggttcttaactgttgacttttttcttgttctagttttgctttgttgaaaacggcatggttaggctttcttgaaaacgacattttttttgggccgagaaatttgcaattagttacggattttgaactgtactaaactgtagcataatatcattgatccaatatatgacatgagagatctccatatacattttttcccgaagtaaataatatcataatttggtgtaccaacttaggaaattgactaatagcctcacttatggattactcaaacccttagacttataattgactagtcttaaaaataagtaatttaggacgacgacctaaaaaagagagtagtttttgagtctttatatataaagatatgataagagtaaggatgtcacattcacgagcaagtgtatgtgctttcctagaaatttcttccacatgtctacatggtacgacatgccatttgattccaaattctatcattattgatatagatggctctataagaatatgaagcaaacattatttgattagtttcctctactttataattccaaacaagaaaatagtcgaccatataacatcgttttttttttaaaagagagagaatcatttatatatttgatcaacagagaattacatttctaaaacgcaaaaaaaaagaaaatatttaagttttttttttttgcaaaacaaccacatatctgcaaattcaccggatcatcagctctattactggtcatgataactaattctttatattttcgataatgaacgtggaagttggaacgatggatttatgagttgtccacaccgttcgttatgtgcatgcattcaatgcttctcagagccatattccgatagcgagaattttaacatcattattgagtagtgtgttatatttcacactatttatgcaagatttttcgctcaacatcaaacataataacccaatcaaacataatttcttgattaaagttgagctttgttgataccaagtcaattactcattcatataataacccaatcaatcattcttcctttattgtacccaattaacgactacaaaactggtcctacaacatcgtaaaataccaaacaaaatcgtgaaaaaaacagatggaacaacgtgattttctttttcccaaattctacattaaaaatgtctaggccgcaaaactgcaaatctttgctttgtagctattttctcgatatatttcaacataaaatcataaaaggaaaaatg

SEQ ID NO: 36088 - DNA, 3000 bp, Unknown; identical to SEQ ID NO: 28958
  misc_feature (1)..( 3000): 2750-1469P.txt file - cDNA_ID_3092401; gDNA_ID_1971748; Annot_ID_175260

SEQ ID NO: 36089 - DNA, 3000 bp, Unknown; identical to SEQ ID NO: 28958
  misc_feature (1)..( 3000): 2750-1469P.txt file - cDNA_ID_3092401; gDNA_ID_2926196; Annot_ID_201437

SEQ ID NO: 36090 - DNA, 3000 bp, Unknown; identical to SEQ ID NO: 8334
  misc_feature (1)..( 3000): 2750-1469P.txt file - cDNA_ID_3092405; gDNA_ID_2926196; Annot_ID_201434

SEQ ID NO: 36091 - DNA, 1494 bp, Unknown
  misc_feature (1)..( 1494): 2750-1469P.txt file - cDNA_ID_3092426; gDNA_ID_2926197; Annot_ID_141350
tcgataacgattccctacgatggctcaatctcccgcgagccatcaccgtctccaccgccgccaaaagcgaacacgaagaatctaccgacgaagattctctctaacttcctcataggtctaatcatgatccctgtagctataaccgcttttatctttatcctcacgtctctcggtttcaccttcttcttcgctttctactggtttcttcaacgaaactatcgccaccgtctccgccgccatcgccgtcacgaatactcagatgggttatctccaagatgcgtgaagaggcttcctcaattcaagtattgtgagcctagttcagagtacggaggcgatgattgtgttgtttgtatcgatggatttagacaaggacagtggtgtcggaagctgcctcgatgtggacatgtgtttcaccgaaagtgtgtggacttgtggttgattaaagtctcgacttgtccgatttgtagggatagggtttatagatttgaagaaggaagaagatggagaccacaaggtgaaattttttgatcggtggttttataattagatttgaaagtgtgtttagtttgttatcatatttagcagcaattttggttttcatcaatagtcatgtacagtgtcttttttttttttttacacggcttcacaattgaaagcttgtttcttcaccgtttgatgaatttgatccaataagagaatgatgggtttctgtagaatttaacttagtttgaggtttgattatcatgccaattattaaattcaatctagtcaattactgatagaaatgttgtccatttgtcactttaaacatgttgcttatgttaccttaatgatttctcataatttcacttgagattcagtggttaatcatcaatgtttctgtttcaatttgtccatgatgaagtataagttctaagtaaagcttggttcatgtgattttaatttacctacttcacctccaaagttatgtcaactatgttttcaagtgtgtgattcaaaagtttatattgaacataaaaataaaggaggctaaagaatcgttttctgattggaatgtgagattgtgactcacacggagaaagtgattgtgattggatctgactataagactaaagaagtgtttttgtgaagtaacaagtaacattgtctaattagtgttttgtattgtaaactaataatgactttgattaacgaaataatgtcactttagtcaaatgtgttgactttcttgtcttataccgatggctcaagtattcccaagaaaaaaaaacaaatatccctccgatttctgactcgtcccgtgactcagtgattctcctcttccaatcctctccggaagaactaaacaaaaacacgatctttctcagatttagagagagtaagagtgagagagtgtcagagacacgaatcaaagaaatgatttttaaaagcttctgttaattctaatttgcatagatttgtttactcgagcttgagcttgagcttcttctaatg

SEQ ID NO: 36092 - DNA, 1494 bp, Unknown; identical to SEQ ID NO: 36091
  misc_feature (1)..( 1494): 2750-1469P.txt file - cDNA_ID_3092426; gDNA_ID_2926197; Annot_ID_201566

SEQ ID NO: 36093 - DNA, 3000 bp, Unknown; identical to SEQ ID NO: 7068
  misc_feature (1)..( 3000): 2750-1469P.txt file - cDNA_ID_3092430; gDNA_ID_1621125; Annot_ID_172271

SEQ ID NO: 36094 - DNA, 3003 bp, Unknown; identical to SEQ ID NO: 28960
  misc_feature (1)..( 3003): 2750-1469P.txt file - cDNA_ID_3092430; gDNA_ID_2926197; Annot_ID_201561

SEQ ID NO: 36095 - DNA, 3000 bp, Unknown; identical to SEQ ID NO: 24280
  misc_feature (1)..( 3000): 2750-1469P.txt file - cDNA_ID_3092434; gDNA_ID_2926197; Annot_ID_201559

SEQ ID NO: 36096 - DNA, 3000 bp, Unknown
  misc_feature (1)..( 3000): 2750-1469P.txt file - cDNA_ID_3092437; gDNA_ID_1971791; Annot_ID_58041
cgcctgaactccgactagctttcctccacttcttgacacgtatccgccacgtgttctcttctcacatctacttcgacataacggagattgacggcgtcaacaccaacgagctctacaacgccgttcagctttacctcagctcttccgtcaccgtcaacgacgcagtttctagcagcaacaacaacacacgtctcagcttgacacgtgttcctaactcaagctccgttactttcggcctctccaacaacgacagaatcaccgacgtatttaacggcgtcactatcctctgggaacacgtcgttgtacaacgtcaagtacagagcttttcgtggagaccaatgccggaagagaaacgagggtttacgttacagatcaacaaaagagacaaagcccttgtcctagattcttaccttgattacattgtcggaaaatcagaggagattcgtcggagaaacgaggagagactgctttacacgaactcaagaggtgtttcgctcgacgcgaggagccatccatgggattctgtaagattcaagcatccaagcacgttcgatactctggctatggatcctgagaagaagaagcgaatcatggaggatctaagggagtttgcgaacggacaagggttttatcagaaaacgggaagagcttggaaacgaggttacttgttgtatggaccacctggaactggcaaatcgagtttgattgctgcaatggcgaattaccttggttacgatatttacgatcttgaactcactgaggttcagaacaactctgaattgaggaagctgttgatgaagactagctctaagtctatcattgtcatcgaagacattgattgttctatcagtttgacgaaacgaggaaagaacaaaaagaagaatgggagctatgaatatgatccaggtttgacaaacgggtcgggtttggaggaaccgggaagctcggtgactctgtcggggctattgaacttcacagatgggctttggtcttgttgtgggagtgagaagatatttgtgttcacgacaaatcatatagagaagttagattctgctctgatgagaagtgggaggatggatatgcatgttcacatgggtttttgtaagtttccggctttgaagattctgttgaagaattatctgaggcttgaggaagaagatatggatagtgttgttttgaaggagatggaagaatgtgtggaggaagcagagattactccggctgatgttagtgaagtgttgattaggaataggagtgatgcggagaaggcggtgagggagattgtgagtgtgttgaaggagagagttgtgaagagaaggaagagtgttggattgaagaagaagaaacaggaaggtcaagaagaagaagaagaagcagaggaagaacaagagaagagagctttggatagtcctaatagaagaaacagagaggtttgtgggtttcgagaggaggaagaagaagaagatgagaaggagaagtgaatgataagagactgtttatcctaggatcatcatctaatggtggttcttgtgtgtttttaattatccgttttgtttagtcaaaattattataatatatgattagttaccatataatataacgttatccattttggtttactcttaagtcaaaagtaggcactgtccaaagttaaccttctgagatttgctacatgagagttgagactaaactggcttttgtatctactaatgctgcagaaattgccactttgttgttgtatatgttgtctcaaattttcgtgtcggttacgtttgttttgaagagataaaagagaattggcgtttggactttgggtgttgtaaattggttagtgtcacacccttttttatacaggttatatgtgaaacctgtaaatttcaaaatttatagttcaagaaaacaatttactcgagaagtgacatttaaagaatcatcacatcaaacacttgacttcaaactagaagtgacctgaaaaatccatccgttctttttttttttctaaatataatattgaccgctgatttttgacatattgtagtagtgaagcccaatcctacccaaagagatttgcatcagaaaaaagttgttttatattatgggcccaatctttttgatcaaaaaaaatatatatatatattatgggcccaatctctagaatctaccaccggttaatgtctaaataagaacaaaaacaggtcttggtaactaattaaaactgaaaacaccaaaatcaaggttgggatttgttgaagaaggtggtatttcaccatatcacaacaactaattaattaaatttatttaacaaaacatgtctctccaaaactgaaaacaccaaaacatgttttcattttatgaatttcaatttaactagttaaaattttgatatcacatgcgctacacatgccacctcaatttgtcctgctcctactgtctattactaaactaaaagttaaaattagcgttgagtttttattgaatttatttactcattagcatttgacttgtatagagagtattaaaataaagaataataataataatataatgcggttggcgaacaattgatgttgcggcaaaccggtaggcccaacaacaacacggacattcttgatgtttttctttgacaagcggtaatctcctgcagctaagaccatcttactttaaattatttcccaattacaataaaacacgtgtgaaatatggtcaatttagttcagagaggcctctttattaaaatcttccattaacgtttaaagtgaagaaagcaaagaaatatcgaagaatttaaggaataaaaaataaaaacagaaagctggaggaagaaaaaataaaaattccttctttcctcctgaaggcaaaaaaggaagagaagagaagagaagagaaggaagcagaatctaattttggattataatcggagagagaatctattccgacgaatcttttcgggttgattttttggtctttaatttgaagggtttaggtgtggtttcgaagatg

SEQ ID NO: 36097 - DNA, 3000 bp, Unknown; identical to SEQ ID NO: 36096
  misc_feature (1)..( 3000): 2750-1469P.txt file - cDNA_ID_3092437; gDNA_ID_2926197; Annot_ID_141338

SEQ ID NO: 36098 - DNA, 3000 bp, Unknown; identical to SEQ ID NO: 31745
  misc_feature (1)..( 3000): 2750-1469P.txt file - cDNA_ID_3092437; gDNA_ID_2926197; Annot_ID_201556

SEQ ID NO: 36099 - DNA, 3003 bp, Unknown
  misc_feature (1)..( 3003): 2750-1469P.txt file - cDNA_ID_3092444; gDNA_ID_1971791; Annot_ID_175556
gaatttaaataattatattttattttaaaaaaaagaaattcccaatgattgtcaaagctttgataggccacagtatcttgcctattcacggcggctccgaccatcagtttccacggtgccggcggctatatacgatagtcgttgtgaagaaaaaggtccttttcgtcaaatcattttacattggagccgaaagtgtgtactttactttggtcggtttttgatattttatcattactttattctgaaaataaaattaagtttgatgtattcatttcttgagactttaaagacaatagtagaatatatattctccttgttataaatatgattgggtgacatggtacgaccgcgatataaattctatatatatcatcaactctgatattaagaaaaattacgataaaacgaaaggatataaaaaaatagtcaaactttagcgatataacaaaaattattgattgtacaaagttttgtattgctgtcatattagaccgtaaaattttatgacgatcccaattcccaaccctaaactaacaccacaattattgagcacattcaaatgctgtcatttttattactcgtacgtacacatgaataaggtggaaatgtcatatttgggaaaacaccataaaacaatatgtatgtcgttcactttggtctcatataaacgctagccaaatcatacagaggtaatggtaatgtttttttatcgacggcaacgaaagtttatgctaatatgtttataaattacttttattgattaatatgattatctctgtatagttgtggacgtgtgtatataactgaccgtctaattaaagaaaaatttatcacatcacgtacctaaaagacgttcttcattaatccataattgctttagtgtataactaatcatctatttagaagttttttgttttacttttcctattgttaatgtttgaaagattagaatatatttataagaagaaatttataactttttagcaaaaaaaaaaaaaaaaaacttataacttatgaagtctttggtatgtatattaaatttgacctgatcacaagtaatgcacgtatattcacgatttgaggtacgaagcagatgaaaattgtactatttaacaaaattactaaactataccaattaccagacacataaaatctagataaagtggtcctaatttctgagaaagaatattcctgtgttcgttctttctatctctttccttttctgttgttacatttcccacacacaaaaaaaaaaaaaatctatttactgatctatgttaaataaaaatcaaaaggaaattgttttatgatttttattactttatattaatttaattgatgtaataaattattaaattaattcttggaaaattaatcaaattaacttaaatcaaacaaaatttagttaaactaataaacactttaaaataaaaagtttaatttgattaatttagtcagttatttattaaactaataaacactttaaaacaaatttagttaaactaataaacacttcagttaattattaaatatttatgagaattctaaaagattaatccttatgaaacagaggaaatatattttaagatagaaaagagatattaagaaatctcaaattaaaatacaactcatatttgacacccataagcaaaagatattataatactaaactacttatcaaagatatttcagtttattgatatgatcagaatttggtcaatttttctgtcaacaaagattggtctaaattaatgacctaaggaagcgaattaattcattaagaagactttttttctttctcaaaacttatgaaaattaacccacttctaattaatcatcaaaaagcttgaaattatttgtaaacgaagactagaaagagagaggggaaaaaggtatgacaaacagccttaaagttaaaggtaatagtaccttttgtttgttcttctttttttgcaaacaattttttcccttatttaattacgtttataaaccttaattcagattccttaaatacattgttaggactccataattagtaacggcattaggagcataaacaaaaattatgataaaagttttgatattatggaaataaccaaatatcttacctgtaaataaaataaagagatgtgaccaaatttaattgtggatttaattacattatctaacccttgaagaaactcaatgttttttgtgggattgttgtcctaaacctgaggttacatgtaatcaaaacattaatgggatttgaagtaaataaattagatttgcgccaaaaaaacaaaatctccattgattacagtgttttaatatggtcagataaaaccacagaagtggtaacgacataaaaaatcaccaccaaacataaaaccgtaagaaaagtttcgatttttattttctgcgatccaaaggtctagtgatgaattgaatttggtttttgtttttataattgaagaatgaagaaataaacagttgatgggttcttcgcttcttctcttgttgggttagtgataagcacgcctggcttctcatcattccctccaacctttctctctctaaaagacttcaattgttttatcagcttctctctctaaataaagctctcaattcaattctctctctttcacttttttttcctctgcttgcttcttctgttcatctttttgcttcgtcaaaattttgaccaaagttttgtacttttttgttgctgcaatttttgtgattagattggatctgggcttggagctgaatagcggatttgtataaggtaattgcttgaaacgtaccgaattgattcgtttttttgtttctctgagatttttcaatatctgggtcttagagtttggctgatctgattggttctctgagattttcatgtagataagtttgttttaaaagccaaagccttagtttttaattagtgagatagatttatgtagagagcatcaatgatcaatccttgagctttatcttgggttttgttatgttgtttattgaaaaatg

SEQ ID NO: 36100 - DNA, 3003 bp, Unknown; identical to SEQ ID NO: 36099
  misc_feature (1)..( 3003): 2750-1469P.txt file - cDNA_ID_3092444; gDNA_ID_2926197; Annot_ID_201546

SEQ ID NO: 36101 - DNA, 3000 bp, Unknown; identical to SEQ ID NO: 32027
  misc_feature (1)..( 3000): 2750-1469P.txt file - cDNA_ID_3092509; gDNA_ID_2926198; Annot_ID_201650

SEQ ID NO: 36102 - DNA, 3003 bp, Unknown
  misc_feature (1)..( 3003): 2750-1469P.txt file - cDNA_ID_3092513; gDNA_ID_1621091; Annot_ID_170726
acacaaactattaggagcacaagatgaaggatacaagtcgtcaatcttatgtttcagtggtcatcaataataacacaaactattaggagcaaacaaaacaatttatttaaatctcttttgaatatgttttagctcaaatcaataaataaaggcgccgagaaaaaaacagagctcatttgcacaacaatcagtatagtccaaagcttaagcaagtgaggacatgtgttctagctttcctcttgagcaggagcagaaacaggaggagtaggttcaagcattcttacagaacgaggaagcataaactcagcaaacacagggtagtgagatgaaggatacaagtcgtcaatcttatcatttacgatctcgcacattacaggaactatagatctacctctgtaaagtatccaatccgtgtgtagatcttgcgtctgtcggtcccagcagaggcataacgctctgaatatcagcttcaggaactcgaccgttccctgcttgtcacctgaacaaaggcccaacatgttatgatctagaagctttggagataaatgatttttatagctcatgagagggtggaatgtttcacacctttgaaatcatggtatgttcttatgagagcgacgttttttcttactcgggcacttggccatgcgtctctcatatctcctaccacaccatgctctctgcaagttgaatgatgcccaaaagccattcatcagcagtcaaataagtaaatatgctttgatttgaaactagttgatcagtgtgtgaagaatggtttagccattcttgcattaactaggagccctgaaagaaaactctaggagattggtaaaaagcacaaaacttgtgaatgtgatattaaggtacctagatctgcccaacagaaaccgccctgttgttgattccttctgtgtgttgaatcctccacagtacacaaccggcaaagtgggaggtaatgatgctatgtgttgccatgtgagtaaagcacttcgcctacgggcacgagggctgatttcatccaagtttgtgttgactatctgaaacgaaaaaccaggcggctccgctcctttaagttggaatgtgtaggcagcttgtcaaagaaaaccaaaatactgatatataggacaaaaacaccaaaatcataaactaatctaattatagtttaactaaaatgaacccaactagtaaaaaggatatagcccatgtcgctatacaaggaactgcggaaccccatgccgtgcttccagggaccgagggagactctgacaaccaaaaagttccaccctctagcagctctaccttcaattagtataaagtatagtatcaagcagcgtattaattatttagagcgtagttatgtattgtcttatcaaccgaattaatactttttccttgttgaagaagatggtgcagtgttcatcattagcatccccaggtcctgttcttgatatgccaaattgatcataggctgcaagcaaagagtactaccatctatttaagttcaaagaaacaatgcaaactgaagtattattaaggcatgtgaaactagaagctaagctccatggttcacagtaacaaaaaccagataaacaataccaccatcatttcaaagaaagcacctgtaaatgtgagaatatcatgcattccattgccataaaacagatgcattaagtgcactagactccggcttttgtagcctaaaaacactaacttgaacttgatgcaaaaaaggatacggattgacaaattggctatcagatttaagcaataccaacatatactaaaaatagaattaaatctagtagatcacaaatagatttacatagtagattgagaacaagaagagtggtctacgattgataacaagattcacactagtctgtgaacttaagaagaagcagactgctgtatacaaacagggttcaattagacctaactcacaccatttaagtagagattagacttccataaatcaaagagaattcaattatacctggcaacccctgctgaagataatccaactgcgacttcacacctaaccaatgtaaacatgataacaaaagatcaaaacgaaaatcctatctctgttcaatatttcagaaggcaagaaaaagcacaagaatcaatctccagcattcaggaaaaagaagccttcttggagaaccaatataaagaaggaagcaagatctaacaagcattgaatcaccaatacgaagaaggaatcaaagatctaacaagcattgatccattgtggctaaagattattaccttgttgggtacagagaacaatgggggagtaactagtgatgacagtgagacacaaatctttccttttgagccatgaattagggctttcttcaggtagatcatcgtgaagattgaatgacatcacactcaaagacacactcattgttttgtctcctttcttcttcttcttcttcctctagttttctctcttctttctttatggtttggtaagacgaataaaaacaaaggtctctctcacatcagcagcagctcatcgtcgtcgtgacctacatgattttcaataataagtcaaaagcttatcaatttttatgtgaaaaaacagctcaggattcgaagaaagaaaatcaatcaacataatttattatattatattattgaggaatccaatacgaaccttgttgtttcagactcttatcaacaacaacagtggagaaaatgagtcttggacatttgacgacttttgctggaaaatctgtgaaagtcatgccctttgatcaccaaaagtctcttaaagccatttcctgatacatgtataaatcagcaacttcagaaacaaatcaaatcggaaacgggggaagaagaagaagaagagtaactaatcggaggagggaccggtgaagtcacggtggagggaccggtggagtcacggtggactaatcgtcggctttttggtctctctctagatttttttaaggtttaaaattaatttcagacaagcttcgaacccgagacatg

SEQ ID NO: 36103 - DNA, 3000 bp, Unknown
  misc_feature (1)..( 3000): 2750-1469P.txt file - cDNA_ID_3092513; gDNA_ID_2926198; Annot_ID_201648
caaactattaggagcacaagatgaaggatacaagtcgtcaatcttatgtttcagtggtcatcaataataacacaaactattaggagcaaacaaaacaatttatttaaatctcttttgaatatgttttagctcaaatcaataaataaaggcgccgagaaaaaaacagagctcatttgcacaacaatcagtatagtccaaagcttaagcaagtgaggacatgtgttctagctttcctcttgagcaggagcagaaacaggaggagtaggttcaagcattcttacagaacgaggaagcataaactcagcaaacacagggtagtgagatgaaggatacaagtcgtcaatcttatcatttacgatctcgcacattacaggaactatagatctacctctgtaaagtatccaatccgtgtgtagatcttgcgtctgtcggtcccagcagaggcataacgctctgaatatcagcttcaggaactcgaccgttccctgcttgtcacctgaacaaaggcccaacatgttatgatctagaagctttggagataaatgatttttatagctcatgagagggtggaatgtttcacacctttgaaatcatggtatgttcttatgagagcgacgttttttcttactcgggcacttggccatgcgtctctcatatctcctaccacaccatgctctctgcaagttgaatgatgcccaaaagccattcatcagcagtcaaataagtaaatatgctttgatttgaaactagttgatcagtgtgtgaagaatggtttagccattcttgcattaactaggagccctgaaagaaaactctaggagattggtaaaaagcacaaaacttgtgaatgtgatattaaggtacctagatctgcccaacagaaaccgccctgttgttgattccttctgtgtgttgaatcctccacagtacacaaccggcaaagtgggaggtaatgatgctatgtgttgccatgtgagtaaagcacttcgcctacgggcacgagggctgatttcatccaagtttgtgttgactatctgaaacgaaaaaccaggcggctccgctcctttaagttggaatgtgtaggcagcttgtcaaagaaaaccaaaatactgatatataggacaaaaacaccaaaatcataaactaatctaattatagtttaactaaaatgaacccaactagtaaaaaggatatagcccatgtcgctatacaaggaactgcggaaccccatgccgtgcttccagggaccgagggagactctgacaaccaaaaagttccaccctctagcagctctaccttcaattagtataaagtatagtatcaagcagcgtattaattatttagagcgtagttatgtattgtcttatcaaccgaattaatactttttccttgttgaagaagatggtgcagtgttcatcattagcatccccaggtcctgttcttgatatgccaaattgatcataggctgcaagcaaagagtactaccatctatttaagttcaaagaaacaatgcaaactgaagtattattaaggcatgtgaaactagaagctaagctccatggttcacagtaacaaaaaccagataaacaataccaccatcatttcaaagaaagcacctgtaaatgtgagaatatcatgcattccattgccataaaacagatgcattaagtgcactagactccggcttttgtagcctaaaaacactaacttgaacttgatgcaaaaaaggatacggattgacaaattggctatcagatttaagcaataccaacatatactaaaaatagaattaaatctagtagatcacaaatagatttacatagtagattgagaacaagaagagtggtctacgattgataacaagattcacactagtctgtgaacttaagaagaagcagactgctgtatacaaacagggttcaattagacctaactcacaccatttaagtagagattagacttccataaatcaaagagaattcaattatacctggcaacccctgctgaagataatccaactgcgacttcacacctaaccaatgtaaacatgataacaaaagatcaaaacgaaaatcctatctctgttcaatatttcagaaggcaagaaaaagcacaagaatcaatctccagcattcaggaaaaagaagccttcttggagaaccaatataaagaaggaagcaagatctaacaagcattgaatcaccaatacgaagaaggaatcaaagatctaacaagcattgatccattgtggctaaagattattaccttgttgggtacagagaacaatgggggagtaactagtgatgacagtgagacacaaatctttccttttgagccatgaattagggctttcttcaggtagatcatcgtgaagattgaatgacatcacactcaaagacacactcattgttttgtctcctttcttcttcttcttcttcctctagttttctctcttctttctttatggtttggtaagacgaataaaaacaaaggtctctctcacatcagcagcagctcatcgtcgtcgtgacctacatgattttcaataataagtcaaaagcttatcaatttttatgtgaaaaaacagctcaggattcgaagaaagaaaatcaatcaacataatttattatattatattattgaggaatccaatacgaaccttgttgtttcagactcttatcaacaacaacagtggagaaaatgagtcttggacatttgacgacttttgctggaaaatctgtgaaagtcatgccctttgatcaccaaaagtctcttaaagccatttcctgatacatgtataaatcagcaacttcagaaacaaatcaaatcggaaacgggggaagaagaagaagaagagtaactaatcggaggagggaccggtgaagtcacggtggagggaccggtggagtcacggtggactaatcgtcggctttttggtctctctctagatttttttaaggtttaaaattaatttcagacaagcttcgaacccgagacatg

SEQ ID NO: 36104 - DNA, 3003 bp, Unknown; identical to SEQ ID NO: 17832
  misc_feature (1)..( 3003): 2750-1469P.txt file - cDNA_ID_3092528; gDNA_ID_2926198; Annot_ID_201635

SEQ ID NO: 36105 - DNA, 3003 bp, Unknown; identical to SEQ ID NO: 21540
  misc_feature (1)..( 3003): 2750-1469P.txt file - cDNA_ID_3092532; gDNA_ID_2926198; Annot_ID_201632

SEQ ID NO: 36106 - DNA, 3000 bp, Unknown; identical to SEQ ID NO: 8391
  misc_feature (1)..( 3000): 2750-1469P.txt file - cDNA_ID_3092540; gDNA_ID_2926198; Annot_ID_201626

SEQ ID NO: 36107 - DNA, 3003 bp, Unknown
  misc_feature (1)..( 3003): 2750-1469P.txt file - cDNA_ID_3092550; gDNA_ID_1621125; Annot_ID_172235
cctctcggcggcgtaagatagagagcgttctgtacaatgcctgatccgaatctctgtgagacctccttcactccgatcaacaacagatcggagaaatgaatcgactttatcctcaaactcgggagtccaccagttgatcgactcagggaacgacagaaaccgagtttcgaggtcgaagatggtgtttagtgtcgggtcatagcatgcgttcatccagttcttgctgaccagcatcggtccaatccatctttgttcctggcttagccgtgagaagatgtcaagaagacattctcgagtcaactcagaccagtcagggtagagtcccgatcccatctccacctttccttccccgccgttgacttccataggattgaagaacgcttcgtcgttttgagtacgaatagacttgaaatgttgagacttttttttatcgtcaatggaataaatgtagtcaatggaaacaaaaatgctgagactttttcagcttctataatcaagcatgctctttacctattacaaaacagagcttttttttattggtcattagtaacctttccaattttgatatccagtttatattaatgttctgtcagtttgaagttggagcaaaacggttctgctcctcgactttgattaagagaatgagtaagaacatccaacaacaaatgagattccctaattaccaaattggattaaaaggataatgtagtcacttatgacaagagttattattcaaaggttttcctatgttggacatatggaagtaatgactttctaagtcatcaaatcaaatcttatatctatatacttgtataagcatatgtgcatattgggacgacaaatcattatctcaaatcctatttcatactaaacaccctaaacacttaaagccactggatcttgccatgtaaccttcctcttcactgctctatttaactctttctccacatctccgcaaatgggtaactttctttcaacatgtagatcactgatcctgttatcaagcattgcattcttcattgcttccgcgaccatatgttcaccattcacttccggctcctcttcttctctctacaaccaaaacacaaatcaaactaataaagttctatagactctaccaaaaggaagacactaaaataacacaagttgtttggctttaccgagatctggtttaggtcaaagccagggactttgtcagtgccagaagtgtttccctctccgttaaggtcaggaagtgaaacggggaatgtcaaaacatcgcttcctctgctcctttttcgcttcttatccaagtcacaacttgcaacattattagccaatgcttccttctcattgcaaattgtattcttcagtttcaaatcaaaacatggtacagatgctctcacaccagactgcttctttctttcgccacttggtttccttgggacctctaaacccccggattctgacaatctcaacatctctggagaggtttcaagagtttgatcttgcttcaagtgctcgtatctacgtctcaagaacctatcgtttgatcatcaaaaactcaataagctaatgaatgtacaaaagcttggatcatgtaagttaatacacgctaaacacgtaaattgacaagaagatcagagatcatacctaacttctgacttgagggtcaatctcttttgtttaatcatctccaatctctttctctttatctctaattcctgagaaaacgagataaggaaacaaatttcaaaactttacttcttccctatgacttcacttagaatcaagcgaacaattccaaacccaaagtcatgacaaaacatcatgatcacccaaaccagcagatccagaggaaatcgaaacaaataagaaacccagaaatttcaaacttaaaaccctaacgaaaaagcaattaccttttccaactccagaacctgcacaaaggttaatctgatcatgggatcgccaccggaagcagaggaaacgaaattagtcttcttcatcggatccgttcagtgaatttaggaatcgcagattggaaagacagcaagcaagcgagaaagagggaggtgtgaaggagaaagaaggaagcgaaggtaaaggggatgattaggttttaatggtgagagtcttattccatgtatgaaaccctctgaccaaaagacttaagaaaccacataattgattgattttcctttgggtgcccattacaaacaaaattgatattgaaaaaattaaaaattttggattttccttttctcttctttttgtgtgtgagaagtctatgagacaagtagcagaaaactaggactagtgatcaaagatggtaaagagaggaaagaaagaaagaaaaagttttgattttttctcatttctttctttctttttcacttattatttctatgtgtgtccttttggaagttgcagaaggggtattgaaatgctgaccacttaacccaaaaaaaaggttcttccttttattgtgtttgttgatgattgggttcatgtctttgtgaggtgggtttgataaattgtaaagaatttgaattaaaaagcacatctgggttattgaagagatgaaagagttaatattgttggatatgtatgtaaagaaattggggtatagagagaaagagagcaaaaaaaaataagagtttggttgagacaaacagtgaaacaggagaagaagcaactatggagatttgacaagagagatgattggtgactggtgtgtataatgtgtgtatatatgatgtacttttatttattcttttagtcaaatacatgtttttgcataattctcaatttctcatattattattggacccaaatcctgtgaaaataatctcttctttgggctttttctcatataagcatcaattttaaaagcccattaaacccaattaagggatcctcaagcttttccacgtggcacaatcttattagtctttaagaaacatatctcgttctttctgtttatcttgtcgaagcacacttctctgtttcaggagaacaatg

SEQ ID NO: 36108 - DNA, 3000 bp, Unknown; identical to SEQ ID NO: 28977
  misc_feature (1)..( 3000): 2750-1469P.txt file - cDNA_ID_3092550; gDNA_ID_2926198; Annot_ID_201615

SEQ ID NO: 36109 - DNA, 3000 bp, Unknown
  misc_feature (1)..( 3000): 2750-1469P.txt file - cDNA_ID_3092560; gDNA_ID_2926198; Annot_ID_201610
gacatcgtttttgcttttaagaaaattgtaaaaggtcaaagattacataaatagatagtccgttacgttacatttttaaaattacgtgttttcctagttcctactatcggaccattctttgtgtaatcgtttgacacattttcaagtttatagaaattaaagtcatttatattcaaaaacagattagtcttttattttataagatgtaaaagaaaaaattggaaagatttagaaagaattagtatcttgaatattatggactagttatttttttttcttcaaaaggatgaaaacaaaaaattacgatcaactcatagtcatagtggttcaatagttaaattttctttttgtgattttaaacatcgttgagtactttaaaaacttttcaacatttcctatttgtaaattggaaaattatatatattcttaagtttcaatgtttttcccaaactgactactttaccttacgtttatatgatgatcagaagttcagaactactattcgaatattattttaaaaatatttaagaaaattatagcagaaatatgtgtgataatttattagttaactaaacacatatcaagagttagtttattttgaaacaattaataataaatctaataattcatttagctttaaacagtaaattattttggaaatcaaatctatatttaacgtagacaactcatagcaatttattaagaaatcaatccaaattaaagatttttttaattttaaactgaaacatattgtttttgtaataaaaagtaaacaaaaacggacattaatttagcaaatcagagagagattactcttgaatactcggttaggaaatcccaaacctagctccgaacccccaagaaacaagatttagctccaaaccacaatgactatataaacaccacatcaccatctcatattttattcacagagaaaacaaaaacaaacgagagacaaaactcaatccaaaacaaaacaaaagccaagttttttgtagtaagtaaaaaatccaaattatgggaatcatagttccagttttgacccttgtcttcctcttgtttgctaaagtgagccatggtgcctccaatcctagggtgattctagttggtggatctgtgggatcatggaaggttcctgattctcctaacaacactctcaatcactgggccgagaacaaccgtttcaaagtcggcgacttcatcggtactcgatatatatctctctctatctctttacttctgatatatttatatgctttgattctcttgtgatcatatgttcataaaaatttatatgcatggttgaatatttgatatatatttgttgtgcatgtgaaatagtgtggaagtacgacatgaaagtagattcggtactacaagtgacaaaagaagattacgagagctgtaacacagcaaatcccttgaagcaatacaatgatggaaacactaaggttgcgcttgacaaatctggcccttacttcttcattagtggtgctcctggtaactgcgctaaaggcgaaaagattacccttgttgttttggctgaacgcaaatccggtggtggcagcagcagcggtgacgctcctaaggtttctcctgttagtcctacggctcaaactccagctccagctcccggtccagctgcagcccataacgctgcggtggggttgaaggttgcaagcggttggttcttgaccgcagtcgtggttggtttggctatggcttagagcttagaggggtttggtcgagagaatgtagtttttattgagttcactttttagcaagatttagttttatttttccagattgttgacgtttcttttgttcccttagtttttcattataaaagatctctctttctgttttttgttatgtgtttgggatattatattcactcttaaagcttataatctatagtttgttcttgccattttgaatctaaaatttcaaaacctcaacaaggcaactacttgccgaccatcgatgaactgatcggattaatcaaccaaagtttaacaattttcattttttctatgagatatgttgactcaataattaatacaaagagattcagtcgactctatcttaatggtaataggattcatttgtagaaactaaatatatttatttaccaaaatgaccattgtgaaagtggtaattaaaaaacaaaactatatatggtgtccaagagattcttctatctctaaaataaaagagaatatatatgctacgttatggaaactacattttgaaatctgccttgcatgtactgattgatattctaagattgttcttgattttgttggtaacgccattgtgcgtggtaataaataagacgaggccaagtggataatgtgctaatctaattccattacttacacatatagtacatctttgacttttaagtaatctatcgttactaattaataattatgataattaaattacccgtttcacttatatcatggcaacgtttctgaagaaaactatactacacatttacgctaacagccgtataggagattaaattctaagaattgtacgttcaaagtctgaattaattcagagaattttgtttttgttttcaaaatttaaaagttggtatatattgatgaaattagttcaatgtagaagaaaacagtggtgaatggattttgcgatgaaaggaaaaaatggatttagtgattaatttaattcaacgtataaaaatgcttaagtttgataatgggtcactaaaagaccattagttcaaatgggccattgttcaacgacttcaaaggccttgtacaatagtttgctggcttcacttacaaaaacggcatgcaatctacgtcacaaactagaaaatgcaatccgccgctttttcaaagtaaaacgacacacagttgatgtttagaaagtgaaaacagtagagcagggaacccctgagagataagcctgaagatgacacaaattacatgagcaaatcccacgcatgtttttgctccagattccgccatg

SEQ ID NO: 36110 - DNA, 3000 bp, Unknown; identical to SEQ ID NO: 28969
  misc_feature (1)..( 3000): 2750-1469P.txt file - cDNA_ID_3092568; gDNA_ID_2926198; Annot_ID_201603

SEQ ID NO: 36111 - DNA, 3003 bp, Unknown
  misc_feature (1)..( 3003): 2750-1469P.txt file - cDNA_ID_3092632; gDNA_ID_1971819; Annot_ID_176091
ccacaaatagagcctataatttaccgggatctctttcttttccgaaccctcgcctccttcttaaatggcttcagtctacagaaactgggttgcaacgcagagctaatagttgatgaatttggagaaaagcttttggaggagcttgactacaccttggtatctcatatgcttctcaatttcactctatgcgttgttctgtattgatagctcaaatgatgtgtcttaagttcttgcctacaggaagccagaaacattgaagactttctggagaacttcaaagatgaccccacagtcaaaattcctggagtatacaagaatctttgtggtccgcgggttctggtaatggagtggattgatggtattcggtgcactgacccacaggtatgactttcaaaaagggggacaactcaaaataaattcccctataccctcctaaaaagtcaaaattaaagtacattctgatactgactcttactaaatgtactcaggccatcaaggatgcagggattgatttaaatggattcttgactgttggcgtaagtgctgctctaaggcagctgttggaatttggattgttccatggagatccacatcctggaaatatctttgcaatgcaagatgggcgtatcgcttatgtggacttcggtaatgttgctgtactgagtcaggtaatttgagtttaatggttccaaggtatctagtatagctagcttatgtcccttcctatagtgattttcacatctatatatagagacttgttattcatagtccaaactaaatctttttttttctcagcaaaacaagcaaattttgattgatgctgttgttcatgcggttaatgaggactatggggagatggcaaatgatttcactaggcttgggttcttggccaaggataccgatgtttctcctatcgttccagctttagaagccatctggcagaactctgcagggaaaggacttgcagatttcaatttccgaagtgttacaggtacttgatatattgcattcctcaagcaagtttgttttgtttactgagcaccccatgcacatttgaagaaacggtgtcacgtttttggtgcaggacaattcaacaagcttgtgtacgactttcccatccgtatcccagagcggttctctcttgttattcgttctctgcttacgcaggagggtatatgtttcacactgaagcctgattttaaatttctagaggtgaagtctcgtttagtattttgattctttcttttcaaagttaggattagctgacatataaatcctgaagtgagcagatactagctatatgttcacttatatttcccttcccacactaaaagtgaacattttatctaggttgcttatccatatgtagcaaaacggctcctaacggatccaaatcctgcacttcgggaacgcttgatacaggttaaattgataattctgatttagtttcataaatgctatgttgaattgttatccgcatcagatgaaatcaaagctcttgttgccaccgcatgtcaggttctattcaaagatggtgttttccaatggaaaaggctagaaaaccttttatcacttgcaaaggaaaacgtcgccaagatgagtagcaatcctaatctacgagtaaagcgtgtgtaagtaaccaagttctatataagcattgctcccaaaatctcactcgttcaccctgtgaagcttgaattctaaatccgtatttgactcatgaaactttcagggagagtaagcttgacttgacagataccattaaggacggagctcgtcttttcctccttgacgaaggcatccgcaggaaacttattcttgcactcacagaggactcgaagcttcatgtagaagaggttcatacatcagacgtcaccagatttatatctatagcacttatcatcgccattgatgactctctaaagcaataaatttacatttgttctttcagcttgtggacgtatacagattggttgaagacgaagtagatattcccacactggccatgcaagtcgtgcaaggtaatagaacggaaaaacccccattttgcttcctttcttttttgtcttctcttcatctatcattcaaataataaagcttttgcatcaatagaagccttatggagagactatcacagatatgcattcctaacataactaagcctgaatcgatagctgaccatcaattctcttatgatccagtaaacataggaatcttggggcattgattgtaaattaacaagtagttttgtatgactgaagaatgtggttccttttgttttgaatgcagatttaccgaatgttttccgagattttgtgttgtcatggagcaactcagtattatccgacagatgatgaatcagcttctcacttactttttttggctctttttgaagaggaaagaggtaatatatattacagggagtagatggagaagaaaagcgtagattaatatatagtttaatcttcgatgcatacatgttattaacttatacaccaatccatacatgtaattatataaaagcacacacaaacttcacttcacttgttacccagtttgagtcttggtctcttggacgttgtctactgtagttggatatctaaacacattaatcgacgtcatcaaatcaaagttgtagtgttctcacaacacaactgattcacaatctggactcgaatgaattgaatcgttttgcgtctcttgggtcttggcctcgccctcgaatactggaaactaaactgaaccaaatgatattgagttatgcaattacacaaaaggtcccctcaattatccagtgtcattttctgctttcttgagctgtttggtttacaaaaatttaggtaggaatcggcataagattaaatcttatttgacagaaaattccattatcgccaaaaatttcaatcaataggcgccaaacatttcaatcaataggcgccaaaattggagaagtaaagggaaaaacacaaacgtaacaaggattcgagctctctctagacgatg

SEQ ID NO: 36112 - DNA, 3003 bp, Unknown; identical to SEQ ID NO: 36111
  misc_feature (1)..( 3003): 2750-1469P.txt file - cDNA_ID_3092632; gDNA_ID_1620673; Annot_ID_164148

SEQ ID NO: 36113 - DNA, 3003 bp, Unknown; identical to SEQ ID NO: 36111
  misc_feature (1)..( 3003): 2750-1469P.txt file - cDNA_ID_3092632; gDNA_ID_2926199; Annot_ID_201741

SEQ ID NO: 36114 - DNA, 3003 bp, Unknown; identical to SEQ ID NO: 36111
  misc_feature (1)..( 3003): 2750-1469P.txt file - cDNA_ID_3092632; gDNA_ID_2926200; Annot_ID_201762

SEQ ID NO: 36115 - DNA, 3003 bp, Unknown; identical to SEQ ID NO: 31787
  misc_feature (1)..( 3003): 2750-1469P.txt file - cDNA_ID_3092639; gDNA_ID_2926199; Annot_ID_201735

SEQ ID NO: 36116 - DNA, 3003 bp, Unknown; identical to SEQ ID NO: 19761
  misc_feature (1)..( 3003): 2750-1469P.txt file - cDNA_ID_3092651; gDNA_ID_1971819; Annot_ID_176075

SEQ ID NO: 36117 - DNA, 3003 bp, Unknown; identical to SEQ ID NO: 19761
  misc_feature (1)..( 3003): 2750-1469P.txt file - cDNA_ID_3092651; gDNA_ID_2926199; Annot_ID_201727

SEQ ID NO: 36118 - DNA, 3000 bp, Unknown; identical to SEQ ID NO: 8577
  misc_feature (1)..( 3000): 2750-1469P.txt file - cDNA_ID_3092659; gDNA_ID_1971819; Annot_ID_176070

SEQ ID NO: 36119 - DNA, 3000 bp, Unknown; identical to SEQ ID NO: 8577
  misc_feature (1)..( 3000): 2750-1469P.txt file - cDNA_ID_3092659; gDNA_ID_2926199; Annot_ID_201722

SEQ ID NO: 36120 - DNA, 3003 bp, Unknown; identical to SEQ ID NO: 28984
  misc_feature (1)..( 3003): 2750-1469P.txt file - cDNA_ID_3092668; gDNA_ID_1971712; Annot_ID_175122

SEQ ID NO: 36121 - DNA, 3003 bp, Unknown; identical to SEQ ID NO: 28984
  misc_feature (1)..( 3003): 2750-1469P.txt file - cDNA_ID_3092668; gDNA_ID_2926199; Annot_ID_201713

SEQ ID NO: 36122 - DNA, 3003 bp, Unknown
  misc_feature (1)..( 3003): 2750-1469P.txt file - cDNA_ID_3092672; gDNA_ID_1971712; Annot_ID_175120
gaacagagtcggaaaaatcgaactgtaaaagaaaaacactcaccgagacgacgaatgaatctggagatttgtggcttcagagagataagagaaatcggaagatatggttagttaggttgcttagttttgattttggtttaattcgatccacttgcactgataattcggggatgagccctaaaaagtctccgagtgttgttgttgttttgggctcttcaagattctgttgaccaaaaaataaaagattccatatttatcttcttccacatgtattcatcatcttatttttctttataaaaaaatctacgtaatagagattttcaactgatttacttcctcatattattttttattctgaatatagatattactataatttacaaaataaaaatatatcttgatcgtataattatttggtataaaatattatcttcccacgtaggtatataatttaccaaaaataagtttaagatggatttaccaagaatccaatattattacttgcgatactttatatgggaagtagaataattggatatgatattggaatttctttttggaaagtacatattgaaaatgttcattatcgtatgaagcagaacttaaagactggctgggatagttagtacttttgagaaatgggattatcgaatctttgaagataatctgatgttgtatgttccaaagagtctgtcgagttttgtatgcggaagctttcactgttgtaacactttgcaacacttgttctttataaaatggtaacacttatggggatatttaaaaaaacaaagatagcaacatgtttagcttttataaaaatgtattatttgaacgataccagggaatcaggatgctagatgcattatccggtcggtgaacgatcgtgacacccaagcaacaaatatacaagaccaaaattggccacgctctctcctctacccctccagctttacttgtccttatcacttccctttatcatctgaattaatttcatctcattgatgcttctctatgtataatgatccaacacaaataaatcaatcaaatcaaaccaaccgatcactttctctttttcactcataatcattccaagcatgattttaaaatgggcttttgttgtctctcataaaaggtgatagctattcgcctcttccactttcttcttagattgttgtagtataagtttaaacctacgactacgagtggataaaatggttttggtttgacttattaggtttaatcgagtacgacaagtggacttgtgacacttgtccaaccgatacttcttatcttgtgtttttgtgttttctcgtcttctagatcacgttttggcatattgaatttattatataagaataagattcgattgttgaatttttaataagtatggctttgttatattacacgtaagaattgaaaacattacttgatcaaagaaataaaagattttatgtgtggtgactgataatgttgttgaggaagatcagagtcattaatgcagactcagtgaccagtggacaatcttgtataaagaaagacattacagagttatattcaaaaacgtggaaaagtatgcattaccttcttgagatggaaatcttaacaaaaacaagcttttaaaattgagtgcatgtccaagtcatttttagatttggtgtttagtgcttcaatatttcacaatatccaaaaaactcataaaaagatttcagagatagaccaagaaaagttatttgagtctctaagaagggattgaccattattcttaattatactatttgatgtttcaactcacttccaatatgaaagtcttaaacataatcatattatagatattaacctgtgaataaaatgccaatcatccaactctcaaaaatataaatgggccgagaatgggctcacacagtaagggagagtaacgagagaggcttgaaggagaataaatgttacttcaccaaccggacctgccgacctctttcattctctgtttgactcactattccttcacacaaaaaagggaacatttaagtttttttacattttcattcaactttaattctgagagcatcaggtaacactgctccacaatctttcaaagattcctcctttttttgttgttctctctttttatttggcttacacgtccgcttgacctcacccacatgcccctgcctcacatcaaaccatctttatttcgtaatagctaaatcttagacaggcaaaatctatcaaattttagaaagtactattcaaaattaatactctctcatgttactaccatacttgctgattataataactgtaaactataacaaagatggtaaacccaaatctatatttatgattgattaattattttaaagtatatattgatgattttttctttataaattatcatgattgccgtatcgtataattaatagatttgagtggtattgtgaagagctactacagctaaggaagtagacaacacctaacgtagtaaattaaaacattaacgtttctcttttagtccctttttttttgttaatcgttttcataatattctgctaattaaatttcgattgggggtaccaatcaaaaagcaaacaccgcctttcaggtcactgggacagacaataaaaaaacctttttcgtttatgttccatgtctgaaattaaaacattttcaagtctcgtgtatttcagattctccatcttagttcttgtaacctctccctcttcttctccaaattccacctgagagaagagaacttattccacccaaaaagcaataatatatagtaccgtactttgattttttcgataatctgttgattgaagttaagccaaaactcagctctgttcttattcttcttcaaacccaagtttcccacttcactgattctttcatcttagctcgttttaaccacaaagttcagttcttttttggtgtgtttctttttcgttattggcttttgccttttttgggtatagggtgtttacgatttatctctcggttccgatg

SEQ ID NO: 36123 - DNA, 3003 bp, Unknown; identical to SEQ ID NO: 36122
  misc_feature (1)..( 3003): 2750-1469P.txt file - cDNA_ID_3092672; gDNA_ID_2926199; Annot_ID_141425

SEQ ID NO: 36124 - DNA, 3003 bp, Unknown; identical to SEQ ID NO: 36122
  misc_feature (1)..( 3003): 2750-1469P.txt file - cDNA_ID_3092672; gDNA_ID_2926199; Annot_ID_201711

SEQ ID NO: 36125 - DNA, 3000 bp, Unknown; identical to SEQ ID NO: 8301
  misc_feature (1)..( 3000): 2750-1469P.txt file - cDNA_ID_3092676; gDNA_ID_1971712; Annot_ID_175118

SEQ ID NO: 36126 - DNA, 3000 bp, Unknown; identical to SEQ ID NO: 8301
  misc_feature (1)..( 3000): 2750-1469P.txt file - cDNA_ID_3092676; gDNA_ID_2926199; Annot_ID_201709

SEQ ID NO: 36127 - DNA, 3003 bp, Unknown
  misc_feature (1)..( 3003): 2750-1469P.txt file - cDNA_ID_3092680; gDNA_ID_2926199; Annot_ID_201708
tctagtagagaaacatgagcaacgaaagtacaaattgctctttcttcttgaatctcttcatgctgttacttttgctgattttttattctgcagatgcttgtcaaagggaatgtggaggaatctctatcccataccctttcggaatcggaaaagattgctgtctcgagaagtattacgaaatcgaatgtcgtaacacaacttcaagaaagcttgttcctttactttcttttattaacaaagaagttgtgagtatctctcttccgagtgcagatagtcattttgcttatgaagtatctgatcaagaacgtcatgaatcatttggcttagttcgtgtcaagttcccgattacatccgccggatgtttcaacgatggaaaagagtctggaggcggatcaaaaatgaacttcacgggtagccctttcttcattgacagatcaaacagcctcatagcggctggttgcaacagcaaagtgtctttgatgtatataaagccaaaaatggtaggatgcgagttgagttgcaatacaagcaaagactcatatagcaatagcatcccttttgtcgaagcggggtgctcaagcaacgttttaccctattctcaggaccaaggttgtccagaagagatagcagaagaaacaggatgcaatggtatcggatgttgccaggcaagtctacctaacgagcctcaacaagttattggtatcagaacagagaataatgatggaaactcgacaacaaaagtagagtgtacagtctcggccttcttaacagatgagatctacgctttgccgaaggcgaccaaaacagaacacttacttgctaagagatatgctacggttagtctaggatgggtaatccagacgagtaatagatctttcctggactccttggccttggcctgcaaagacagagaagattaccgcaatactactaacttggaaagaaagtgtacatgcggcagaatcactatatctgagacaagttatgcaaactgtggatgcacctatggttacacaggtaacccatatgttttgaacggatgcaaaggtcagtatatgttccttccttattctctcttctctctttttgtgtgcacgcatcttttgagattttacaaatcatccctagatgttataattataagtttttctttcatcatttgattataatatgtcatctttcaaatatagatattgatgaatgtaaagtcaaattcgaatactgtggaaagacagaaacttgtgtgaattttgaaggaggctatcgctgcgtgcgcgataaaactaaagcgataatgataggtaggtcactgatttatcttccaagttgagtcacaaacatgtagaacttttaaaaagaaagtgatgatcaacctgtaatattcttgtgcggttttgcaggcgcgggtacgggttttggggtcttagtcctagttggtggattatggtggttgagaaagtttctaataaagagaaggatcacaaagagaaagaaaaagttcttcaaacgtaacggaggactactattgctacaagaattaaataccagagaaggctatgtcgaaaagactagagtcttcaactcgagagagctagagaaagccaccgagaacttcagcgaaaacagagttcttggacatggtggtcaaggtactgtgtacaaaggtatgcttgtagatggtagaaccgttgcagtaaagaaatccaaagttatagatgaagacaaactccaagagttcatcaacgaggtcgtgattctctcccaaataaaccatagacacgtcgtcaaactcttgggatgttgtcttgagacagaagttcctatgttggtttacgagtttatcatcaatggtaacctctttaagcatatccatgaagaagaatctgatgattacactatgttatggggaatgcgtctacgcatagctgtggatattgcaggagctctttcttatcttcattcttctgcatcttctccaatctatcatagagatatcaagtcaacaaatatattactagacgaaaagtaccgagccaaggtggctgattttggaacgtcaagatcagtaaccatagatcaaactcattggacaacggttatttcaggtacagttgggtatgtggatccggagtactaccagtcaagccaatatactgaaaagagtgatgtttatagctttggagtgattttagctgaacttatcactggagataagcctgtcataatggtacaaaacactcaagagatagttgcccttgcagagcatttcagagttgccatgaaagagaagagacttacagatatcatagatgctagaataagaaatgactgcaaaccggaacaagtaatggcagtagcaaaggtggcaatgaagtgtttgagctcgaaaggaaaaaaacgtccgaatatgagagaagtttttacagagttggagaggatttgtacttctccggaagattcacaggtgcataaccggattgacgaagaagaagaagaagaagaagaggaggaagaagttgtgacgacaataaacagaggcgattcttggagcattagtgttactgctccagccttaagtattgtggcttcatctccttcttcagatgttgaaccattgtttcctcgtctcacatggtgactgacacttaatttgatgtttcttcttacaacgtttgtgtaatatatttgtaacatctatatatcttgttactttagtcttgagttttgtattaaggaacctgttatgtttgtttttgtaaattaattgtgagtgatgatgacacgtggaagagcattaacgttatgtgtcttcttcagagcacatcaaatcaatggcggataagagttttatgtgtcactgacggagagaaatcacgtctcttctgtccacgaagatgatcgtgcaagaccgaagcgataagtctcttgcagaaccaacttttaagatttaaggttgcttgtcccttttttggctccttaattcttggattgatagagaaaatg

SEQ ID NO: 36128 - DNA, 1862 bp, Unknown
  misc_feature (1)..( 1862): 2750-1469P.txt file - cDNA_ID_3092684; gDNA_ID_1971712; Annot_ID_175115
gatagtgagtgactatgttttcgaagattgttgtccatattttgggataatagcaattatgaatagaaagttggaatcttagtctgacatggcagttggaattcattgtatttaatgccaacagagacatgcatctatgcctgtatatagcaatagaaatacataaagtggttttcttaagtatgtctcgtaggcgtggcatagccatgcaacgaaagagagatcaatgtttgccgacttgaagaggttaactactgcatgtagagctggtgctaacagaattgttttgatgcagagatatgacccggacccagctgcaaaggcagctgccgcaactgtcctggcatccaaattgggtgccgattcaggcttgaaagtatatttaggagatgaatcccaactcgatccatcctcgggcaagagcaatgacatggaggttaaccaatcacgtgggttgaggaatcgaaggcaaccaaatacaagaccccacggttctgggagcacttcaacacatcattctgatgatgagtctcaccattctggaacaagcgagagatttccaggcaccacagagcaaaaccagcagatgttggttgagcattacagccctcagggatatgctgctcatgatggcagttggatctcacgcattgcggctctacttgtgggcgaagatcccacacaatcatatgcgctcatttgtggaaactgtcgtatgcacaatggtgaatgaatgtttaagcaaatcctttacctgaatctttcaactatatacttatttctaacataattttgcaatatgctttgtaaatgcaggacttgctcggaaagaggattttgcttacattacatactattgccctcactgtaatgctctgaacaaaccgaagcattcagaggagaatgtacttcttcctgctatttccgcttcaccaatcacagactctctgccactgattgagaccagcgaagtggttaatagcagcagctcgagtagtgaacgtggaagtagccccactccagaaataaaagaggaagctgcaattactgagaccgggacaccgagctgaggaagatccagtgagctaagaagaaggcttagtcgtgttggtgctacagagaagagattttgtgtgtgcatgtgtgtttgtggatgcgagtactcattcaggtaatcttatgctatggattgctaatatatgaaggtgcttacagttttgattctggtttgtttctatacaacaagacaatagggttttggtgggtaaatatgcgattctactgtcgtaaacgacgattgttatacgttttgggggtttgaattctaattatcttttaccattacagattgtctctgtttctgttaaatgtattcactcttggatgatggatcattcccttttcgattttagcactacgagcctacacctttcttattaatcttcttcaatattcaatttattggatagcgtttttttatacctaactctgctttttcattgtttttttttttgttgtattttactagttcatgatatgaatatgacttttgcgatagtagatttttaaaattatctttagtaaattaattaccaaaattgtttgcaaaacacgtgatgatctacactttaaagactttgaaatatattttaaactggtaaaaaagatgctttccgccataaagttgatctcatcaagaaacacaaagagaggtagcaattaaaatattcaaagatgaagagcattattagcacgagcaactcttttcctctgtctccacttacaaaggaacaaaacttgatctgctttatagtaaagaacaaaactcaggaagttcaaatttgcttgggcagagaaccatg

SEQ ID NO: 36129 - DNA, 3003 bp, Unknown; identical to SEQ ID NO: 28980
  misc_feature (1)..( 3003): 2750-1469P.txt file - cDNA_ID_3092684; gDNA_ID_2926199; Annot_ID_201706

SEQ ID NO: 36130 - DNA, 3000 bp, Unknown; identical to SEQ ID NO: 6392
  misc_feature (1)..( 3000): 2750-1469P.txt file - cDNA_ID_3092689; gDNA_ID_1621091; Annot_ID_170701

SEQ ID NO: 36131 - DNA, 22 bp, Unknown
  misc_feature (1)..( 22): 2750-1469P.txt file - cDNA_ID_3092689; gDNA_ID_1564156; Annot_ID_148954
ctcgggcaagagcaatgacatg

SEQ ID NO: 36132 - DNA, 3003 bp, Unknown
  misc_feature (1)..( 3003): 2750-1469P.txt file - cDNA_ID_3092689; gDNA_ID_2926199; Annot_ID_201704
caaatcccataatcacttatattgatagtgaatatatcagtaagaaagatactgcatggtagtttatgctaatatcctcctgaaagaaagagataaacagcactgatgagctcaaggttctgatgaaaccacaaaaatacattacattaccttcaggcttcagaaattgcaggcttcacttatggtatctctttcagatccatatttagcgtagtagcacatcaacaaaacatcacttagaaaaggctcagatcagtttgagaaatggatccgtagcaaagcagagcacatcatatactcgtgaaatgatcacactggcatccctcagagataggtccaagcaataacaaaaagcatggattagaatctgtggccatgtaaaattaacaatcttctaaatcaagttcagcaaatatttacgaactattccttacttgagttgttggaacattctgcatcagtgatgctgcttttgaaatgcagaaagagaacagtgcttagatagaatcttcatataggactccacgattttccttggtaatcttcaatctgtaattcaggttcaattttactgaatccgtagcatttgttcagtttccgtctttgcataaccctccttacttcttctgcagcatggtagttaccagattctgtgtgaatcttgctaagcaatacataattggctggattatcgggttcagatttcattagctcgtttgcaataatttttcctgcaacatcaagcctgccatgagtctcgcaagcagatagcagagaactccatattctggcacttggtttcattggcatatttattgtgacctcaaaggcatcgtcaatcttcccaaacctgccaagaagattgatatagcaagcataatgctccaatgtgactggcatgtggtatttcccagcttgtgtgaatatggtttgagcttcttctaccaggccagcatggttgcaagccgataaaattgcaagaaacgccatatcatctacttcatgtccaccttttatcatccctttaaagatttctaaagcttctgaaccatgtccatgaagaccgtatgcgttaatcattgagctccatgacacaagatctttctcagtaagttcataaaatacttcacgcgctgcagaaagactgccacactttgcatacatatctatgagggcgtttcccaataagatatgtgacatgaagccacatttcaggatttgagaatggactgtagatgcaaaactcaacaatgtcgaattggtacaagctgagacaattgccaatagagtaaccgagttggcttcaattccttcttttctcatttgatttaacagattcataacttcagagcaatctccagtctccgcatagccgctaatcattgaactccacattacaacatctctcacttttgatgtttcgaaaagaaccctagagagacttacattaccacatctgcagtacatggtcataaaagcagctgttaaccgctcgtcagcatggcatccatgacgaaaagaaaatccatgaatctccttcaccagacttgagccataattcaattctacacatgcaggtaaaacagacaacagtgtgacacgattgggcctcaagttttctctctgcattgctcgaaacaaatcaacgcccatttcataattctgatttgcaacacaaccggagatcatggcagtccatgagacctcattcttcacctccatctgatcaaacacatggaaagccgccgcatgatcatcaaactttaagtacatatcaaccaaagccgttgataatagaactgattcctgcatcctctcatcaacaagaacaagagcatgaaacattcttgctaccttactgctgcttcccatgcgagtgcagagagccaatagagatgcaaccagctcggacttgggaataaaaccataaaaatacatctccttaatcaacttcatcgcttcatacaacaacccatcctggcaacaactattgatgatggaacaatagctaactgtatctctgtgaagcatttcatcgaataccttacgtacagcatattttctcgagaatttcgcatacatagagatgagagaattggaaacaactgtatcacaatctgcacctgctttgagacaaaggcaatgaagctgtgcgccaagtaagaaaggctcttgttgaaaagcgcaagctttgatgacagaaggaagaatagctgtgaagccattggtccctaaagaatgaatctttagcttgtacagtctcaatgcttcatcgtagaattggtccgacaccaaacccttcagcttattgccgagctccaagtttaagcgggaagacaacgcccttgacattataacacgacggcctagtttaacccatctcatcggacgggtaataatgacgtgcccactatgactgtattatctttgagaaatagtttgtgtttgattcagtaaacaaaaagcacccatggcctaatggataaggcgcttgacttctaatcaagcgattgtgggttcgagtcccactgggtgtgtatttaataaatacaatttaatctttttcaaccttattatattcaattttttgtttgttaatattcaatttaaagcccaataaagttggaagatggtgggctagtaatgggtcgaggtttttgaatacagaagcacgtggagatcacgtgcgttgacgtcaaggtgtggctgtaccggtggatctcgaattcctcccctttggcttctcgaaggagaagaaaagtgtcggagagaaagaagaagccaatcatcatcgccagttgttcttctcttcgagatattcaaatcctccgtctctagagaatttcatatcaagagaatcaggcaagtgggcgattctctgatcccgagtcaaaccatttctggcttctcaagtctcctcaggttctgatgaatagattgtttgattttgcagtggtttctgtagtttgtggtggtggtggttggaaggtaagataggatatg

SEQ ID NO: 36133 - DNA, 3000 bp, Unknown; identical to SEQ ID NO: 6385
  misc_feature (1)..( 3000): 2750-1469P.txt file - cDNA_ID_3092693; gDNA_ID_1621091; Annot_ID_170703

SEQ ID NO: 36134 - DNA, 3003 bp, Unknown; identical to SEQ ID NO: 17846
  misc_feature (1)..( 3003): 2750-1469P.txt file - cDNA_ID_3092693; gDNA_ID_2926199; Annot_ID_201702

SEQ ID NO: 36135 - DNA, 3003 bp, Unknown
  misc_feature (1)..( 3003): 2750-1469P.txt file - cDNA_ID_3092697; gDNA_ID_1621091; Annot_ID_170704
agcaaaattttcagagtagtgttttacagttttatgcacaagtacagggactgtggaaactgaaaagtaagggtattgaaagcagaaagaacttttgtgttgaactatggagcaagtggtgatgaaatggagaggcacgcgatgtttaccaacagcacgtggcaatgtagaaactgcgattgtgccagcgtagtagagtcctcgagagttgcatccgcggggatcgactaataaggtaaaagccaatttatttgtcaagcatacgtttcttaaaggagaggcaccgcaaaaagaaagtaaaaaggagaggaagaacttacgatttatttaaagtcagatgaccgttttttcccccaagttgagacacgcgtacgaaccaccgcagtttctgaagataccattcgatcaatccaaagctagcaaaagttctaatcttgttgtccatatgttaaccagaaaagcaaagcattaagtttgatcgacatcacttgctggaaacatttggaaccggagcttcttgtcgtattcctgtaatccgaggaaccaagcctaacaacattgaaatggaaagaatgaatcaaactggagaaaagggaaagaggggaaagaaaggtaaaatggtctgcagatcttctgatatcagaaacattaactaggatcatatattctcagttacataattatatacttaactgcacaatgcactagaagtctagaacataatcttgtactacagttgtagaatcttctattatcacctagatgaactgcaaagggatcatttgatgatcgtcatacttagcacatgaatctccatcagcaaactggttaaatgtggaaactgcaaagagacaggtactcatctaagtaaatatcaggtagttatggaaatttctctacagagcaaacgcatttaatacaaaacatccagatttgaactcatcagactactgtaattgctacctttctctctttaacgcaatggcttggccttcaattacagcaaatgactaaatgcagcacgcacaagaatatgcttattggaaaatttcgtatacaaactgattggtatgcctcttctaggtgctcgaagaacggaatcctgtgagttactatttggtttcccagctactacgactcttcactaccaaagaggcccaaaagtgggaagaatgtattcagaaactaacaatgtcttaaacccttcttccaaaacccttaagtcacaaatctttacagaacaaaagagaagtaaatagaccaatctcatataaacatcaacaagaagcagacaatgtcacaaaacatccaataaaaccttctatgtagataagatcattatgttcaaaacttaacaagaatgctatagagattgcaaggattttgttctaccaataccaccttccttttagcactccaatcgtttaaaagactcagcttacagaatattaggatctgaaactgtttgcttttcgatctgaagctggaaagcttcagagaattcctttagtaaagactcgtgaactatatcgatcaacctcaaatcatcaaccattccgtgttctccatcttcaagcaagccctttatgtttccaactttccggtctctaatcccacatggaactatccagttgaatggtgttagatctgtagtgacattaagagctaaaccatgatatgttatccatttcgacacacgaatacctatcgccgccactttttggttgcctatatataccatttgcaaacaaaaagaaatcaatctcggaatatatattagatcacttacaaaatcatccatttgaaatatgagacataccaacccaaactccagttaaaccgtcaagacgagaagctttaatggagaaagttgaggaaagcacacggatgacaatctcttcaagcatcctgaggtaccaatgaagatccatctcgtgatttcgaagattgattataggatacataactagctacattttcaaacattcctataatcagcttgaagagctcattagaaaacacacagaaacttccaatgcattgttgacattattacctgaccagggccatggtaagtgacttcgccaccacgttcagttcgataaacattgaaaggagcatcctttatatcgaaattgagataatcctctgtactagcagttcccattgtgtaaacaggagagtgttgtaacaaaatcactgtatcagcgcagtcttggtttctatcaatcaatgtctttttctcctcgacaatgctcttctgccatgaccaagctttcttgtatggaaccaatttgtcgtaaagatcaaaacacaggcacctgcaaaattgatagtgattgcacggaaggtgttcgttaaaatgcctcaaacagaaaatagagagcacaaaaaaggaaactttactttctggggatttcatgattcccggagtttaagatcttgacagatctaactaatctgtttctcttcgcgttagtacgatggtgatgatgaattcccgaaactagagtttctactccattcagcaactccataactctgtactaaagaagaaagtggaatttacttaaaatttatttctgtaaatatacagtcattcaatttttagccaatcaaaaacgacggaaacaacaattttgactctacaaaataatatgtaaatgtaattaattatttgaaaccaaaaaagcaatctttatggataacagatattttacaagcttaatttgaagaagaagataacaaaacaaaaaaaagagcgtggctttatctatcatctggtatccactatccacaactggggtcagcttctggttctctctctcggtaactttctgagctgaagaaccctaattcttatcttcaccggattccgggtatagggctttgtaaagttgttgaatttacaaagaaagatatgctggtttgtctgggttttgtagaagaatctgtgttgttgctttgagattaaagtccgaacaatgttgggtttgattcatg

SEQ ID NO: 36136 - DNA, 3000 bp, Unknown
  misc_feature (1)..( 3000): 2750-1469P.txt file - cDNA_ID_3092697; gDNA_ID_2926199; Annot_ID_201701
aaaattttcagagtagtgttttacagttttatgcacaagtacagggactgtggaaactgaaaagtaagggtattgaaagcagaaagaacttttgtgttgaactatggagcaagtggtgatgaaatggagaggcacgcgatgtttaccaacagcacgtggcaatgtagaaactgcgattgtgccagcgtagtagagtcctcgagagttgcatccgcggggatcgactaataaggtaaaagccaatttatttgtcaagcatacgtttcttaaaggagaggcaccgcaaaaagaaagtaaaaaggagaggaagaacttacgatttatttaaagtcagatgaccgttttttcccccaagttgagacacgcgtacgaaccaccgcagtttctgaagataccattcgatcaatccaaagctagcaaaagttctaatcttgttgtccatatgttaaccagaaaagcaaagcattaagtttgatcgacatcacttgctggaaacatttggaaccggagcttcttgtcgtattcctgtaatccgaggaaccaagcctaacaacattgaaatggaaagaatgaatcaaactggagaaaagggaaagaggggaaagaaaggtaaaatggtctgcagatcttctgatatcagaaacattaactaggatcatatattctcagttacataattatatacttaactgcacaatgcactagaagtctagaacataatcttgtactacagttgtagaatcttctattatcacctagatgaactgcaaagggatcatttgatgatcgtcatacttagcacatgaatctccatcagcaaactggttaaatgtggaaactgcaaagagacaggtactcatctaagtaaatatcaggtagttatggaaatttctctacagagcaaacgcatttaatacaaaacatccagatttgaactcatcagactactgtaattgctacctttctctctttaacgcaatggcttggccttcaattacagcaaatgactaaatgcagcacgcacaagaatatgcttattggaaaatttcgtatacaaactgattggtatgcctcttctaggtgctcgaagaacggaatcctgtgagttactatttggtttcccagctactacgactcttcactaccaaagaggcccaaaagtgggaagaatgtattcagaaactaacaatgtcttaaacccttcttccaaaacccttaagtcacaaatctttacagaacaaaagagaagtaaatagaccaatctcatataaacatcaacaagaagcagacaatgtcacaaaacatccaataaaaccttctatgtagataagatcattatgttcaaaacttaacaagaatgctatagagattgcaaggattttgttctaccaataccaccttccttttagcactccaatcgtttaaaagactcagcttacagaatattaggatctgaaactgtttgcttttcgatctgaagctggaaagcttcagagaattcctttagtaaagactcgtgaactatatcgatcaacctcaaatcatcaaccattccgtgttctccatcttcaagcaagccctttatgtttccaactttccggtctctaatcccacatggaactatccagttgaatggtgttagatctgtagtgacattaagagctaaaccatgatatgttatccatttcgacacacgaatacctatcgccgccactttttggttgcctatatataccatttgcaaacaaaaagaaatcaatctcggaatatatattagatcacttacaaaatcatccatttgaaatatgagacataccaacccaaactccagttaaaccgtcaagacgagaagctttaatggagaaagttgaggaaagcacacggatgacaatctcttcaagcatcctgaggtaccaatgaagatccatctcgtgatttcgaagattgattataggatacataactagctacattttcaaacattcctataatcagcttgaagagctcattagaaaacacacagaaacttccaatgcattgttgacattattacctgaccagggccatggtaagtgacttcgccaccacgttcagttcgataaacattgaaaggagcatcctttatatcgaaattgagataatcctctgtactagcagttcccattgtgtaaacaggagagtgttgtaacaaaatcactgtatcagcgcagtcttggtttctatcaatcaatgtctttttctcctcgacaatgctcttctgccatgaccaagctttcttgtatggaaccaatttgtcgtaaagatcaaaacacaggcacctgcaaaattgatagtgattgcacggaaggtgttcgttaaaatgcctcaaacagaaaatagagagcacaaaaaaggaaactttactttctggggatttcatgattcccggagtttaagatcttgacagatctaactaatctgtttctcttcgcgttagtacgatggtgatgatgaattcccgaaactagagtttctactccattcagcaactccataactctgtactaaagaagaaagtggaatttacttaaaatttatttctgtaaatatacagtcattcaatttttagccaatcaaaaacgacggaaacaacaattttgactctacaaaataatatgtaaatgtaattaattatttgaaaccaaaaaagcaatctttatggataacagatattttacaagcttaatttgaagaagaagataacaaaacaaaaaaaagagcgtggctttatctatcatctggtatccactatccacaactggggtcagcttctggttctctctctcggtaactttctgagctgaagaaccctaattcttatcttcaccggattccgggtatagggctttgtaaagttgttgaatttacaaagaaagatatgctggtttgtctgggttttgtagaagaatctgtgttgttgctttgagattaaagtccgaacaatgttgggtttgattcatg

SEQ ID NO: 36137 - DNA, 3003 bp, Unknown; identical to SEQ ID NO: 17843
  misc_feature (1)..( 3003): 2750-1469P.txt file - cDNA_ID_3092701; gDNA_ID_1621091; Annot_ID_170706

SEQ ID NO: 36138 - DNA, 3000 bp, Unknown; identical to SEQ ID NO: 17844
  misc_feature (1)..( 3000): 2750-1469P.txt file - cDNA_ID_3092701; gDNA_ID_2926199; Annot_ID_201699

SEQ ID NO: 36139 - DNA, 3003 bp, Unknown; identical to SEQ ID NO: 17842
  misc_feature (1)..( 3003): 2750-1469P.txt file - cDNA_ID_3092705; gDNA_ID_2926199; Annot_ID_201698

SEQ ID NO: 36140 - DNA, 3003 bp, Unknown
  misc_feature (1)..( 3003): 2750-1469P.txt file - cDNA_ID_3092712; gDNA_ID_2926199; Annot_ID_201696
atgatcggaagtttgctcaaaagaatggggaagattgctcttgatatggagtctgttcaggtttgcgtcattcccttttctgattaaaccttagcgtttgcaggttttagtaactatatgtatatatatttgcttgtgatatgcagatgagagttatgttcaacgtctataaatcttttgcctcacaattgaatcaagaagaatgtcgcttatatgcctacaaaattctgcttccgttgtacaaagtctgcgaaggatatacgggaaaaatcgtcacaggtattataagtttttgtatgtttttccctctgcatattcggctatctgtgtcacaaatgtgacaaaacattatatgattattatcagatgagttgaaacagctagcagaagaggtacgagacagtataagggacaagagtttaggcaacaaaatgtttgtggaagtatacagtgaaataagaaacagtttgagaacgaaaagagacaagagaaagcgagaagagaagctaatggcagtggtaaatccggagagaaacgccaagaggaaactgaggttggcttcaaagaataaagcaaacaagaaaaggagaatgacgagcatgaaattgtctagatgggcttgctcttgaagtaacccttgtatgaaattttgttaatctcatagtagaagcaatcagagataataaatcacttatgagtctacgtttcaatttgaatgttctcaatcttttttattccattttatctaaatgacgacgaaagagatttaaaagcgaaagcaactgcaaacttatcgtgacaaatttgggtaactagtcatcatcatcaagctaatgttgcagtctcttactaccactaaaataagaagacaaaacattaaaattaaaaccaatcatttgttttcttgagtttctgtgaactcaaaaaaaaaatcaaatcctttttgagtttcaatctctgagagtttctatgaaacaatcgtcatggggttgcacaatcttcatccaattatctctatgtctcatcatctatgtgtctctgcattcgggtcacccattcttcttctctagtgacgacggtgacaatgccacacctctagatcttcatttcatctccgttgccggcggtttcaggcctcttaaccaccaaactcgccttctccgattggtttgtttccaatcttcttacgttttggttggaacatgaaaaattggtttcaatttatctagttatcgaattcattggtttcatggttaaagtttggttatttatagtatttctagcttccccaggattcataatttgtgtttctgtttgatcgttgaagatggagaaagttgcagaaacttacaaggccaaatttgttgtgagctcaagtgaacaaggagaagaagatccattcctgcaaaatgtaatcttccattttgggttacttggattgacaaaaaagttctgaatctctttacttcagaaagttagcatgagtaatgagtgtattgatctttttgcaggcgactcgactgtcttcttcactgaaacttccatggtatcttgatcctgtggaatggatccttttagttaacttaagttccgttgatgtaacaaggagactaatcactttgttgtgtattaggtacactagaatgaaaggatctggatatttcagagagcacatcaaaatgccttttggtggatccttggatgttgttttcgtagacactggctcactcaagcaggtaggatcagtttgtatctgtgagtttgatagaaatgtattgttaggcttttcttctgattttgttgtttcattatgtatgattaattgaaactgaaggaagtgcttggtggagcagtgaatgcctatatgatcagtcaattgaaagggttgacaaggattctaaaagcagtagacggagactggtaagttggcttttttcagcgatagattgtcttgatctctcatcaacttgtataaaataccgtctctgtcgttatttggtgaccaagtttgctttctgctctccaaaatcagtccttataatctgtgccatgtgcttgatattacaggcgtattgtggttggatcagacccgttactcgcctatactctaactaaggaaccagaggaacctaagagagtggcaaggacatttcatcaaatcatgaccaaatatggagtggtaagacattgaatatcttgcattgccgagaaatttgatggaacgaatcaagtatatgattgatctgagaggaaaaactttgatgaatacaagaacttatatataagcgaaaaaggctgcacaaggggaggcagcaacgagagcttgacttgcattacggttcctaatcaacaagagaaccaaggtccaacgaataatagtaagaggtaacaagatctcttatcatgacattataatcataaactatgaaagctcaatcttaatgactgagagaagatgcatttttttttgtcagagaaagggaagatgggtttcttcttcacagagttagcttctcagagtttgtaagtcccctagtttctttcttgtgttaagatatgtttatcaagaccaagaaaaacataagaaaaaagggaaataacgtcttctttattttaccatatacaggttacttatactatcaactcatcaggagaagtcattgacacaaaattagttaagcagaaaggcaaagagaccatctaaggtttcattactccattgctgtgaagcgcacaaacattttgtattcttcgcttaatgaccgaaataccctttgagtggtctgagtctcagttgaatcgtcagagggtaaaactggaaatttgattctataagtttcacccaaaaaaaaggaatgacctttagggttttgtattggatttggtctctctcatcattagtttaagtatgaggttctgctcccggaggattttttcttccggtggaagcggagccgatgatttcaaatctctcttgacgaaccactttttaaagtggtgatg

SEQ ID NO: 36141 - DNA, 3003 bp, Unknown
  misc_feature (1)..( 3003): 2750-1469P.txt file - cDNA_ID_3092716; gDNA_ID_2926199; Annot_ID_201694
aagttggtggaggagtgtcgtcgagaacggatgagggccaaggagtggaggagaagatgtggtggaggaaatcatcgtggtcgaatgttgcaggagattgaagatgtggagaaggagatgatgaaggagttagaagagacgaggagttcatggcttctgttttttttttttttggtggggagtgagaatgaaaatgaatgttgttgaaatgtcttttgaggtttaaggctttatggtgtttaaaagagggatggagattgtaatatttgagatttgaagggtttgactttgacatgttaaatacgtttaccaaatttaccattttttttatcatccttgcaaattaattatttcgtgttattttcataatttcttgatttttttaatcactaaaagaattcgatcactgaagtcatgatttcttcaattttataatcctttgttgataatatacttttcacaattttgtagtaactacaaaaagtaagtgaaacatatatttctaaaaatatcatagtcgatcgaatgacaggcttaaagtaataaaactaacttaaaattcggttgtactaaaaaaaaaaaaaaaaaaaaaaaattcggttgtactaacttcactcaaatgatttacgtatgtttaattatctttttttttttatttaagacagaatgtggttctaataccgtatattattaaatttctatatatataacataggtttttctattaatcatttttgaaaactcatgtttaagataattgtataagattttcattcggtaacattaaaattggtttatttgaatgctgaataaaattctttggatttatgttaaggatgccaactacaaaaataaaataaaatacaaatctctattgttgatcttttttattaaaatcagtcggagttttaaacttgtcccggcaactacgtaccacgagataaatatttgctagtccaaaaatgcaatagtctacaagataacaccagagccaacactttttcttgtgacaactattttagacatataatatttagacatgcagtataaatgcatacaattatactctattcatttgggtacattcattcattcatcaacggttcatgataatgttctcttcatatattactgtttacaatttgtccccaagattacaaacatgctatccctttagacgatactcgtgttcgataagaataagatcactttttatagattattcttgttttgttttctgattaatatgataccgatcgatgaaattgttgttttaaccgatctgattaacatttgggaaagaggatcctctcaaacgagaacataacataacagaacatcgtcatcatcatcatgtcatgttaccatgtattttttatacttgttaaatattttttggtctaataaattcatcatttaccttaaaaattcttttttaccatcgtatacagtttttcagctgtttgatagtatttgattaagattaatattaaattgacaaagataagtaaagaacattattatgcaatatgcatgattaagcacatgggacattctgagttttgcacaaactcacaagaggtagagatcggctttaatacacttcccatttattaattacaaatgttggtaagcattgatgtactacacaacagaaagagagatctatcatctcatgtattagtattatcaagagaatgcaataattatttttgtttttacttaataatcataatgtataccaaaataattaactaagggggtgtaaaataagttacgaatgataatttaaattccatatagaaaaaataaacagatagtaaagacaaaaatgctactatgttaaataaactattggtcccatctagtatactgatacattagttttatttcatattatcagtagttttttctattgtttatataaaacaatacgtttacaataggaaggcaggaaaataaaccatatggtgcacaaccattgtagactcaatcctgacaaaacccaataaatttgaggaactccctcaaaaattacggctttgttcaaattgaaaaactggctcttacgatcttagtttggtacacaatcacgtctgatttcccaagttctacttattcacctataatgaactataaatataatctgtaaatatcaaaaggtgggcttaactaggccttgggaaaatattgaattatttaaccttgtatgaatctgacaaactctgattaaagtcttggttcttactctattagtctaatacaaataaataaacatatcttatttccttaaatgtaatttcattctcttaaattatactaaaaaaactctacttgagaaacatgaaagcttaatttggcttgctgtgattgtagatgaagctgagtgctggacgtgctcgaaatgctattttaatttgagagaagaagatgttgatgagttaacgcgcgtctcaatattttgttggccagtgttacgattttcgaatgttaagattgggctaaaaagggaaataaaaatgtctaaaattatggatctcggttatggaaaaccagaaatatacgtcaaaacccgaacattcggttcgattaaacgataaaccaggataaaacctaaccgggtcgttaaacccaaccgcctccttgtttgagaacaaaaaagaagcttaaaccctttcttcctccgccgcgttctcaagctcaagctcaatctcaattctcaagctcaagccttttcgatttttctctttaaagacgcaattttgctttcgcaaccctctgtgtgatttcgtttccaaacgtaagctctacttttgttgtttaatttccaaggctttagcaattaagcaattaagcaattagattgatatacatagttgctcttagaagcttctctttttttttttttagcctggatttaattgtaaagtttggggattttggaatcgaaattgactgttttggagattgatgtgtttaggaaacacggctctctgaatcatg

SEQ ID NO: 36142 - DNA, 3000 bp, Unknown
  misc_feature (1)..( 3000): 2750-1469P.txt file - cDNA_ID_3092728; gDNA_ID_2926199; Annot_ID_201684
cgcatggtgattgatttgttctgtttcaaacattcaggaactactaccgatgcacttcagcgggatgtccagttcgtaaacacattgagacagcagtcgagaacacaaaagcagtaataatcacatacaaaggagtacacaaccacgacatgccggtgcctaagaaacgccatggtcctccaagctcaatgctcgtagctgcagccgctccaacatcaatgagaaccaggacagacgatcaggtgaacattccgacttcaagccagtgctcggtggggcgagaaagtgagaagcagagtaaagaagcattggacgttggtggagagaaagtgatggaatcagctaggactttgttgagcattggattcgaaatcaagcaatgctgattatatgtagtttatgagttttatagagttcatcgactcaattttcgcctccttgttcttgttatataataataataaaaaaccccatgaagattaccaactaaatacgttaacattcgtctgtgtaatgatggtatatgtttattgtgatattaaatcgctaattttagtgaatagcctctggttcgtctagagggtcttctgaaacttgaaagggactaaaagacgagaacaaaaaccctttctctctactctgtgtaaaccctagtgtgttcgtgctctccgatggcgagtcttcgatgctttcgtgagctgagccgccgcgctacgactgttttctccatcaaccagacgcgatcgatctcttcatttcatgggattgagttttccgggaccagcatttctcatgggaccgtaattccgaatcgatctctcactaggaatttgccatggtacagtcattggtatcgctctcaagatcgttgtttctcttcgaacacaaaggatactgatgaagatgaagaaagcagtgaaggagaggatgatgatgaggaggagggggaagactttgaggattcggcggatatggaagtagaaagggaatattcaccggcggagaaagtggaagaggcggaggagatagggtacaaggtgatgggtcctcttaaaccttcggagagacttttcaaaccctatgaaccagtgtttgccattgttcaggtctcgtctctgtgctatctcaattaatcctttagtttcatttctcactctcactgatgctgagtggttatttttatcctgtagattggttcgcatcagtttaaagttagcaatggggactccattttcaccgagaagttgaaattctgtgacatcaatgataaggtatgctagcttcaagctcttcttcgttaatctttgctattcttctctcaaagggctagactttaccgtatctctcgtaagaaggacgaacctttgcatttgtgtttatgatttatgattgttgctaaaacctttctctttatgtccctttgcagttggaactaaccaaggttcttctattgggctcggcaagccagacgattattggtaggcctattttgccagatgcgacagttcatgctgtagttgaagagcatgtaagtgtctcattgacttgcttggtgttttataatactagtgaagctgtgcttaagaataatttacaattgaaaagaggatagatgagagtttgcttgctgaatccggtgactgagagaaactaaatcaaactgtctgctgattagtttgtgaaagtcttgcaagtcattagattagtgttcatctatctctacatcatctgaatgtcttgatttaagatgggcttggaatgtagaaggatctactcatgtaccagcattactcaactagtttttccttgatgcgtgacaggctttggatgaaaaagtgctcattttcaaaaagaaacgaagaaagaattataggagaacgagaggacatcgacaggtatactttataactccttgtttagatagacagtgtgtttatttcatctttgccttcttctagttctttccactgtgttatgattgttgtttttgaccattcaacacttgtgtccaggaattgacgaagttgagaataaccgatatacaaggaattgaaaaaccagaaccgaagatcgtccataagccttcgaaagaagctgttacagaacagacgaaggctgagctagttgcttagagataaaatttgcttctttcttttttgctgatgccgatacatttgaagtaagttaaattatcacttgctgttcactaagaactagattttaaagtcgttgaaatgatgaaaaggccttcttggtagttagtggtaagtaactaggctcctgagatatgaaatgtgatttgcctttcactgtcttgttctccttgctcttcattttgtatttaaactggctcatgcttgtgggagctgtttgttgcttctgtttcagaaataaagatttgcggaaacatctctctccttatcttctctatgctttgtactttgtactgtactactgtggtttggttatggtttaatttacttcttcatgcaagtctcggtcacagatatgaaactggtggtaaattggtaataactgcaagtcacattacactcaaaatctcgattttttccactatgactctttagatcaggtgattattattgtaactatatatggcaaccacttcctcatcaacaaatgattcacagaattgatagtacttggaactgatttataatttcttttatcaacatcggaaaatcgtgtaagaatgccttgaaatatttgaatgtttgtaaatagtatcaaaaccattgtttgtataaatatgtataaagaacttaaacaaaagcaatttggagccaaagagaattataaagctacacgagtacgtaagtccatggttaagatcgggtcgggtggggacgggttggataaaagcaaacaatgagtcaagtaaaagaagaatcatcgtcaacaagagagagagagagataagcacaaacgcggcttttcttctccttataaataagagaagctcagtgcgttactcaaatg

SEQ ID NO: 36143 - DNA, 3000 bp, Unknown; identical to SEQ ID NO: 3074
  misc_feature (1)..( 3000): 2750-1469P.txt file - cDNA_ID_3092745; gDNA_ID_1620623; Annot_ID_162400

SEQ ID NO: 36144 - DNA, 3000 bp, Unknown; identical to SEQ ID NO: 3074
  misc_feature (1)..( 3000): 2750-1469P.txt file - cDNA_ID_3092745; gDNA_ID_2926200; Annot_ID_201817

SEQ ID NO: 36145 - DNA, 3003 bp, Unknown; identical to SEQ ID NO: 18785
  misc_feature (1)..( 3003): 2750-1469P.txt file - cDNA_ID_3092751; gDNA_ID_1620623; Annot_ID_162397

SEQ ID NO: 36146 - DNA, 3003 bp, Unknown; identical to SEQ ID NO: 18785
  misc_feature (1)..( 3003): 2750-1469P.txt file - cDNA_ID_3092751; gDNA_ID_2926200; Annot_ID_201814

SEQ ID NO: 36147 - DNA, 3000 bp, Unknown; identical to SEQ ID NO: 3070
  misc_feature (1)..( 3000): 2750-1469P.txt file - cDNA_ID_3092755; gDNA_ID_1620623; Annot_ID_162389

SEQ ID NO: 36148 - DNA, 3000 bp, Unknown; identical to SEQ ID NO: 3070
  misc_feature (1)..( 3000): 2750-1469P.txt file - cDNA_ID_3092755; gDNA_ID_2926200; Annot_ID_201807

SEQ ID NO: 36149 - DNA, 3003 bp, Unknown; identical to SEQ ID NO: 19522
  misc_feature (1)..( 3003): 2750-1469P.txt file - cDNA_ID_3092760; gDNA_ID_2926200; Annot_ID_201790

SEQ ID NO: 36150 - DNA, 636 bp, Unknown; identical to SEQ ID NO: 3864
  misc_feature (1)..( 636): 2750-1469P.txt file - cDNA_ID_3092768; gDNA_ID_1620671; Annot_ID_164125

SEQ ID NO: 36151 - DNA, 3003 bp, Unknown; identical to SEQ ID NO: 15927
  misc_feature (1)..( 3003): 2750-1469P.txt file - cDNA_ID_3092768; gDNA_ID_2926200; Annot_ID_201781

SEQ ID NO: 36152 - DNA, 3003 bp, Unknown; identical to SEQ ID NO: 18751
  misc_feature (1)..( 3003): 2750-1469P.txt file - cDNA_ID_3092804; gDNA_ID_1620621; Annot_ID_162311

SEQ ID NO: 36153 - DNA, 3000 bp, Unknown; identical to SEQ ID NO: 18752
  misc_feature (1)..( 3000): 2750-1469P.txt file - cDNA_ID_3092804; gDNA_ID_2926201; Annot_ID_201882

SEQ ID NO: 36154 - DNA, 3000 bp, Unknown
  misc_feature (1)..( 3000): 2750-1469P.txt file - cDNA_ID_3092808; gDNA_ID_1620621; Annot_ID_162320
aatacatatgtaagttcttgggagatgattggttagttcaatactagtgtagttcgctggtaaaatggtccgattaattgatactctcactatgttactgcagtttctttcagctattcagattctgacagtcaagatgtccggatgaatatcaatattactggaatcaatacctatgggggaactcttaactccactgctgacaactccactgctgacatgaccctaaatcaaatgaggtgaaattttttatcctattgtgaggtctagattgttttatcttgcataacctgcttaaaattatttcatgattgtagtgacaacacgagttcagcttgcaaaatggttcataccctagttcagttgatgaagactttggacagaatgcccgaagaagtaatgcatttgttacctatcagaggttttcagtttacatcagtttccatattgccaattacagactttgttacttttttgcttctgtccagcgcaccattttgatgaagcttctttactacgaatatgtggtatgctttgctttcttttcgaataatcttatctcactttcctctactctgaaaattgattgcccataagaaaggctgacagctcttatttgaacctttttgcagccaccagattaccagccacctttcttcagaggctgttcagaagaagaagaagctcagtatgtatggccaaagattcctctgagaatggaaattggtaatgttaacagccaacatcacgtgttaactgtaaaggtaatctgattggaagaataggctgctactctttatacagacatgtttctctcgtctttatgatgtccatccattgtggatgatctatgcaggtcaagagcgtgcttgatccttatgatccttgtgaggatgaaaatgataacatgcaagatgatgagaggagtaaaggacctgattctctccatgatgaccagccttgtaaggttttcactaagccgagtaaactcatcttaacagagaacaaagacgctgaccatggagaggttaatgaaggtaaattattagacaaatattaaagcaaaattcgattcattgaatacagaaaagcttcttctaattacacctatctgtgaaatacttcaagatgtcaaacaggatcaggttgaacatcagctagcaaaggtgaaggatacaaaaggaagacctgcctcaattgtaagtgaacaaacagacaaaccataatttttctatttggttatatgctgaaacaaaactaaacatttttcttgtcattggttcaggtgcaaaatcctattctgcagtctcatgaatatgacattcgaaggcttaaagcccgtttacaaagactcgagcgtcatatatctgttccggattctcctcaggagggaatccggaagtggtttgctgctgtttcctcgcaactattctacaaagttatggaagcttgtacacgaagaaaaccaattttgggtgatgcaatactgtcgtcaaccgttaaagtgcaaaatttcaatgcaaaaatttgtagtaaattgttgaagaagcctgcatcgatatacagaaagaaacacttcacactgaacagtgcttccttaagaatttcaggcttggcaggaagcatatttgcgtgggctgttggtttctgtctcttttctgctcagattggacatgtcttcgttcagcctaagaccagaagttctgagtcaaagccaaaagtcaccatggaagaactaggtacgtaaaaaatagatgttgatttggtttatttctgtgtatattatgaatcggagcatgtgtatgttataaaatggttgttgatttggacatttcttcatggaagaagagaagttgacccctccaagttctgaaccgaagtcggcccctccaagttctgaaccgaagtcggcccctccaagttctgaaccactaggtacgtaaaagaatgttttttgtctctctctttgttgatttggtttatttctgtgaatatctatgaatcggagcatgtgtatgttattgcctagttgaatttctggagttgatgatggtaaagagagacaaaaaaagtggcagagaagtcaaataaatcaaaggagaaatctccaacggaggagtcttcttcaaccaccccaaaaccagagaaattggctgttatcagaaggatccttcctgagatatttgctcaacgatgtggtcaaagaaacagtagctttgaggcatttgctcaacgtcggacgacatatgattattacaacatcaggtaattagaaaatcatgattattcattttgtcttatatcttataatagtcactaataaatatctgatttttacaaaatatttttatggtgaaagaaacatctgatggtagcaatgagggcctacaaccaacttcttcaagaatctggtggagctagttgtgtcatgtttcatgacactcctatttttataaatctttcgcgtagtacctatgtcgcaaataaaagattttggttaaccgctaaaagttgaaaagaattgatcaccaaaagcttgtaattcgaatattcggttatgatctgtatctttgctaactcacttgttacctaattgtagttcgaattcgagttctatgtgctcttgttgtcacctgttgtctgtgcaataatgggatcccaacatccccgaggatggccttgtcgttatcaatgggccagatgacagtaaagcgaggttcagtacaaagtgatcatttccgaatcgattcgtatttcgaacgtatctgacacgtgtcaaatcgccgcgtctgtacgcgcgcgtgaagctcaggaaccgaagcgtctcgtaggtttaatgatgacctcgtaggtttgtcgcccaatcgcctctatttatattagattaaaccctcgggaaatcattttccgccgcttgcaagaagaatctaaggtagctctcgctctctcctctgcgaattattttgtactctcgattctttatcgatttttccggcaatg

SEQ ID NO: 36155 - DNA, 3003 bp, Unknown
  misc_feature (1)..( 3003): 2750-1469P.txt file - cDNA_ID_3092808; gDNA_ID_2926201; Annot_ID_201875
aggaatacatatgtaagttcttgggagatgattggttagttcaatactagtgtagttcgctggtaaaatggtccgattaattgatactctcactatgttactgcagtttctttcagctattcagattctgacagtcaagatgtccggatgaatatcaatattactggaatcaatacctatgggggaactcttaactccactgctgacaactccactgctgacatgaccctaaatcaaatgaggtgaaattttttatcctattgtgaggtctagattgttttatcttgcataacctgcttaaaattatttcatgattgtagtgacaacacgagttcagcttgcaaaatggttcataccctagttcagttgatgaagactttggacagaatgcccgaagaagtaatgcatttgttacctatcagaggttttcagtttacatcagtttccatattgccaattacagactttgttacttttttgcttctgtccagcgcaccattttgatgaagcttctttactacgaatatgtggtatgctttgctttcttttcgaataatcttatctcactttcctctactctgaaaattgattgcccataagaaaggctgacagctcttatttgaacctttttgcagccaccagattaccagccacctttcttcagaggctgttcagaagaagaagaagctcagtatgtatggccaaagattcctctgagaatggaaattggtaatgttaacagccaacatcacgtgttaactgtaaaggtaatctgattggaagaataggctgctactctttatacagacatgtttctctcgtctttatgatgtccatccattgtggatgatctatgcaggtcaagagcgtgcttgatccttatgatccttgtgaggatgaaaatgataacatgcaagatgatgagaggagtaaaggacctgattctctccatgatgaccagccttgtaaggttttcactaagccgagtaaactcatcttaacagagaacaaagacgctgaccatggagaggttaatgaaggtaaattattagacaaatattaaagcaaaattcgattcattgaatacagaaaagcttcttctaattacacctatctgtgaaatacttcaagatgtcaaacaggatcaggttgaacatcagctagcaaaggtgaaggatacaaaaggaagacctgcctcaattgtaagtgaacaaacagacaaaccataatttttctatttggttatatgctgaaacaaaactaaacatttttcttgtcattggttcaggtgcaaaatcctattctgcagtctcatgaatatgacattcgaaggcttaaagcccgtttacaaagactcgagcgtcatatatctgttccggattctcctcaggagggaatccggaagtggtttgctgctgtttcctcgcaactattctacaaagttatggaagcttgtacacgaagaaaaccaattttgggtgatgcaatactgtcgtcaaccgttaaagtgcaaaatttcaatgcaaaaatttgtagtaaattgttgaagaagcctgcatcgatatacagaaagaaacacttcacactgaacagtgcttccttaagaatttcaggcttggcaggaagcatatttgcgtgggctgttggtttctgtctcttttctgctcagattggacatgtcttcgttcagcctaagaccagaagttctgagtcaaagccaaaagtcaccatggaagaactaggtacgtaaaaaatagatgttgatttggtttatttctgtgtatattatgaatcggagcatgtgtatgttataaaatggttgttgatttggacatttcttcatggaagaagagaagttgacccctccaagttctgaaccgaagtcggcccctccaagttctgaaccgaagtcggcccctccaagttctgaaccactaggtacgtaaaagaatgttttttgtctctctctttgttgatttggtttatttctgtgaatatctatgaatcggagcatgtgtatgttattgcctagttgaatttctggagttgatgatggtaaagagagacaaaaaaagtggcagagaagtcaaataaatcaaaggagaaatctccaacggaggagtcttcttcaaccaccccaaaaccagagaaattggctgttatcagaaggatccttcctgagatatttgctcaacgatgtggtcaaagaaacagtagctttgaggcatttgctcaacgtcggacgacatatgattattacaacatcaggtaattagaaaatcatgattattcattttgtcttatatcttataatagtcactaataaatatctgatttttacaaaatatttttatggtgaaagaaacatctgatggtagcaatgagggcctacaaccaacttcttcaagaatctggtggagctagttgtgtcatgtttcatgacactcctatttttataaatctttcgcgtagtacctatgtcgcaaataaaagattttggttaaccgctaaaagttgaaaagaattgatcaccaaaagcttgtaattcgaatattcggttatgatctgtatctttgctaactcacttgttacctaattgtagttcgaattcgagttctatgtgctcttgttgtcacctgttgtctgtgcaataatgggatcccaacatccccgaggatggccttgtcgttatcaatgggccagatgacagtaaagcgaggttcagtacaaagtgatcatttccgaatcgattcgtatttcgaacgtatctgacacgtgtcaaatcgccgcgtctgtacgcgcgcgtgaagctcaggaaccgaagcgtctcgtaggtttaatgatgacctcgtaggtttgtcgcccaatcgcctctatttatattagattaaaccctcgggaaatcattttccgccgcttgcaagaagaatctaaggtagctctcgctctctcctctgcgaattattttgtactctcgattctttatcgatttttccggcaatg

SEQ ID NO: 36156 - DNA, 3003 bp, Unknown; identical to SEQ ID NO: 18741
  misc_feature (1)..( 3003): 2750-1469P.txt file - cDNA_ID_3092812; gDNA_ID_1620621; Annot_ID_162322

SEQ ID NO: 36157 - DNA, 3000 bp, Unknown; identical to SEQ ID NO: 18742
  misc_feature (1)..( 3000): 2750-1469P.txt file - cDNA_ID_3092812; gDNA_ID_2926201; Annot_ID_201873

SEQ ID NO: 36158 - DNA, 44 bp, Unknown; identical to SEQ ID NO: 3024
  misc_feature (1)..( 44): 2750-1469P.txt file - cDNA_ID_3092820; gDNA_ID_1620621; Annot_ID_47047

SEQ ID NO: 36159 - DNA, 44 bp, Unknown; identical to SEQ ID NO: 3024
  misc_feature (1)..( 44): 2750-1469P.txt file - cDNA_ID_3092820; gDNA_ID_1620621; Annot_ID_162325

SEQ ID NO: 36160 - DNA, 3000 bp, Unknown; identical to SEQ ID NO: 3056
  misc_feature (1)..( 3000): 2750-1469P.txt file - cDNA_ID_3092820; gDNA_ID_1620622; Annot_ID_162339

SEQ ID NO: 36161 - DNA, 3003 bp, Unknown
  misc_feature (1)..( 3003): 2750-1469P.txt file - cDNA_ID_3092820; gDNA_ID_2926201; Annot_ID_201870
actgtagaatttttagtaagcgtgatgtagccgtcttttcttttcttctttttctgtaacgatatttaaaccgtaaagtcgacgctttttattttttttggttcaaccaaacattttagtattttgatcatatatggatataaattccatccttttagttagtaaacatggtgttgataaaaacaaaattttatatttgaaatgctgctattatataaataaaaggttaaatccacctactataatttatttagctattattaggtggcatgacaagatgtcaagttggtgaatgaggtgcgtctggccttaactagagatgatacccatattttattttcggacgacaatttatgacacttgttgtatcttgttctcctatctttcttttctaatatttacattcgatttatgatcaacaaatggcttcaattgtaaaatgacaagaatttgtagggtcaacgacgtacaagatcattcaactgccgacttcagaagttggtgtggatatacgagagaggaagtcacataaacaaagaacatgaagattcaaagagttgtatgaacatatcagacaaagcaagcctgttcacttttccactatgtatgtaatttatagaacatgatgtcaacaaagattcacacacttcgcaaagcaatgagcttttacattgctctataaataagtatactttttcatatacgtgagttggaaacataagctttttaagccacatgaaaatgctcaggaaaacacaaggtttacaatcagatgaggagataaaaagtcgtggcaacgcgcagaatcgggatggattccttaagagacagatgcacttaaatgcaagatggtagagtaggtccgtggcagagaaaggccactgcaatgtatatgatcaccagtagtagtagtattaagaggaccctgcaagagacaaaaagggttaggaattaggaactatgttcgattcttaaaaaattctcacttgacattacaaatgtggaacttggggtgattaaagtactttttgctatagttaaatgtgttcttaggccaaaaactagttttagtatacagtcttgcaatcataatactgaaaattgtttactaaggttttaggaaacatacgtgagcttgcagtttctccaccagacgttgcttctaaaacgacgagcttgctttctgaaccggaatgtattcccctgcatattggcggttttatcgacaagaagctccaaacgttcacctctatctaggactttgtcaatgttttctatcatgacaccccgcacctatccaaaaccaaaaagaaaaaccaggatgtattgtcaaacagtgaagccaagactcagaaccatgtctctaaacaacttcacaatccgactgaacttgtaagacaaactcatcaaacctgattcatttcacccttaatacgattaatcctatcggcattaggatcattagagtaatagtcaatctgctgactgagaactctagagaattcctcattcattgcataagctagtgctgtatgaacagccctgccataagtccgtacgaatctctggtgaatatcctccaaaaaggcaaaaggaattctccctgacataaaaaagttttgacttttgagttagaaagacattcacatctctctaatgcacagcttctcggatataattgtgttgatgttatgtccaaaaaaatcaaattcattcacatcacaatataagaccaaaggtctcgaattcaataacagagcgatcgttcagagcaaaaaaggattagacttttgaattccactgtcaccaaagttggaaacttcctcaaaattagccatagaagtaaaagaaaggggaggacgtacttccggcggtttcttcggccatacagagaacggtgaggccatcggtgcgtttaacgtggaagacgtaacgatcctgagagtaggagacgttgctgtcgttgtctccagggaccttctcgaggatctgtttggcgatggtgctcgcattcgtagaggtggcggtgaactcagaaagaaccaccgtgccacgagccacgagggcgtacagaatcgccatctccgtcgtcgatccccctgccgaatcaacaaaactcgtgtaaggtcaacgaagaagaaggttttcccgcggaaaccgagccagccagacgaatcgctggatcaatcaatcagagagagagagagagagagagagaaccaattggcttctttttctctctgcatataattgaatctctttctctctctctcctcttggagtttagctggagctggagaccttttcgcctccgctgattacaaatatttaatttcggatagctacgttgatttatttttaaaatactgtattattataaggatcaaaatgaaattttgtcaaaatatcacgggcaaaactaagttagttctttttgttttgtcggaactaatttagttctaataagtaaaaaatataaatatgaaaagaaaacaatttgcttcagtttcgaaaatattgtaccgtgaattgttttataaggattattaatggttaacgctaaattagtttgatatcaaacttataagaaatacaaagaaaacaaacaaattctatcagtttcaaacaaatagagaaatctgagcaaaaagatcgaataattgtaatttatccgtggaagaagatgtgattttaaagtgtaaatttttacgaatatgaaggataaaatgtagggatgtgttcaaatcatcattaaatcagtttttttttttttagtgtggtagtgacgtaccaaacaaaaccaaaaagcggtctatttccttctggtttgaaacgatttgggtcaaaattgggtttcgagtttgaataagatatgagtgaataatatactaactttagccaaagacaaaaaaaaaaaaggaaaattaaaggcagaaaaatgaaaatgacatccaatgagctgagcctaaaccaaacatagccagagataagccttacaaaatg

SEQ ID NO: 36162 - DNA, 3003 bp, Unknown
  misc_feature (1)..( 3003): 2750-1469P.txt file - cDNA_ID_3092858; gDNA_ID_2926202; Annot_ID_201945
actcacacagggcacatcaatttctgcaacctgggtcagtgaataggtttacacatgctatgatgtggaaaggtggaaaagattggaccttggagttccctgataggggccagtggttcctttttaaagagatgcatgaagagtgctacaatagaaatactcgggctgctttagttagaaatattcctattcctggcatccgcatgatagaaagggataattttgatggaacagaaactgaatttattcgcagttcttctaaatattttcggcagactgaaactgatgttgagatggcattagatccttcacgtgttatgtatgacatggacagcgatgatgagcagtgccttttgagaattcgtgagtgttcgagtgctgagaatagtggctcttgtgagatcactgaggacatgtttgagaaggcaatggacatgtttgagaaggcttcatttgtaaagcagcgtgataactttaccttaatcgaaattcaagaattgacggctggagttggatccttggaagcaatggaaacaatatatgagctttggagaacaaagaggcagaggaagggaatgccattgatcaggcatcttcaggtacaatctctgatgccttttcatcttttattatttatttggttttcatgtttttcttgagatttaaaaatctgcatgactaggctcaacatagatctttttggaatcgggggaaatgcagaattgtggacaataaggctatgtctagtagtaggtattacttagtgttcttttcaggatattgaatgatgtgggtgttttatgcaaatggaacgtctattagggggaaaattgcatctttttgcattccagtttgttgtgcacgaagatgtctggaagtccataactgtagcatcttctatagtctgttgattttactccttgttgattagtcttacttgctagctcaacaataatgtagttactctgctgcaatatttttaattttgcctaacgtaaacacttgttttctacccttgcaattcagccacctctatgggaaaaatatcaaagggagctcaaagactgggagttggttatgagcaaagcaaacactccaaattcctgtgggtcgcagaagaaacagtcacctactgagaagccagcgatgtttgctttctgttttaagcctcgaggtttggaagtcaaacacaggggaacaaaacacaggtcacagaagaaactctcagtttatgctcaacatagttctgctttgggagattatgatggctgtaattcatcaggtaactcgtttttacctgcttgatattctataaatcctctattgactctgatttttcaaaatgaagtctgtgtttaatccaacttttccatttctctagcaggaagaagacctgttggttttgtctctggcgacgagaggtttttatattcaaatcaaagctatgagcactcgaatgaattttctgtacatccaggaacatattcccctcgtgacctaggcatgggatatttctcgagcggtggaaatggatatcataggaatcaccaaaacaagtcgcaaagaatcaatgggaagaggaatacgagtgaacgatgggatgcaggctattctgaatgccccagttccaatcttgtctgttactccaacggatctcagcgtcctgatgtggaaggaatacggaatagtacagacattgatgagtacaaattgcgagatgcagctggtgctgcaaggcgagcatgcgctttggcgaagctcaagcgggaaagagcagagagtttgaggtacaaagcagatctagcgatccagaaagctgcagctgctctcatgtgtgcagaggcagttaaagcttcttccgaggacctaggcaacaacaatggggtagaaagctcaagcgaaggatgagtcaatagataccactcttgttaagtctgggtattgtcacctcttgagcaaaagaagagatagtgattcgacatgtcctgttcaacacacgagctggtcttgacacgaattaaaaaacgacccagatgagctccactgtacagaaatttgcctccctctgctttaagtaagctatattttgatgcagcaataacaccgaactgggactctgaaacttgatctcatgtacccatcggctgggaatgttcttagtaggttaagaagagagacaaaaattgaggagatggtaaaaaaaaaaaaaaaaaaaaagagagaaaaaagaaaagaggagattgtaagtaatttggtttattaggcttcttttggtagagagatttagtttgagcaaaaaaaagattattctactgcaagtattttgcggtgctcttcttctccatatttcttctctgccttcttttcaattttagtcaagatcataaagtttgaaaaatattgaaacgaagtcaaacttgcaacacttgccatgtagtcatataattacaaaaattagttacaaatcacatttgtcaatactcttccaaaaatttagtattctcttataatttgtaaaacattgggaaaaatgagagagaagaaaaggtggtgagagaaattccaacggcgggaaatctttgaagttagcagttttgtcggaagatgtctcattcgtttgctggcttcatgatctctctgttacttatttcctaaatttgtcatatcttggacaacctcctgagagaagttctttctcatcattctttccaccccaaattctcttcttcgactggttcctcttctttttgtaaggtttttctcttctctttttttttttgtttgtttgaacattttagagcatcaggggcttgaagcttaaaatttcccatgtttctcgcatgtaacgtaagattaaggatttaaagatgcacgagaataacctcaatgtttttggcttaagatagtaatttcttctcaggtaaatgatgacattgctctttgataggatttctcatttgagatattgtttttcttcatgagagaggcatttttccaagaatg

SEQ ID NO: 36163 - DNA, 1270 bp, Unknown; identical to SEQ ID NO: 8310
  misc_feature (1)..( 1270): 2750-1469P.txt file - cDNA_ID_3092878; gDNA_ID_1971714; Annot_ID_175157

SEQ ID NO: 36164 - DNA, 3000 bp, Unknown; identical to SEQ ID NO: 29003
  misc_feature (1)..( 3000): 2750-1469P.txt file - cDNA_ID_3092878; gDNA_ID_2926203; Annot_ID_201985

SEQ ID NO: 36165 - DNA, 3003 bp, Unknown; identical to SEQ ID NO: 29002
  misc_feature (1)..( 3003): 2750-1469P.txt file - cDNA_ID_3092887; gDNA_ID_1971714; Annot_ID_175154

SEQ ID NO: 36166 - DNA, 3003 bp, Unknown; identical to SEQ ID NO: 29002
  misc_feature (1)..( 3003): 2750-1469P.txt file - cDNA_ID_3092887; gDNA_ID_2926203; Annot_ID_201982

SEQ ID NO: 36167 - DNA, 3000 bp, Unknown; identical to SEQ ID NO: 29001
  misc_feature (1)..( 3000): 2750-1469P.txt file - cDNA_ID_3092891; gDNA_ID_1971714; Annot_ID_175153

SEQ ID NO: 36168 - DNA, 3000 bp, Unknown; identical to SEQ ID NO: 29001
  misc_feature (1)..( 3000): 2750-1469P.txt file - cDNA_ID_3092891; gDNA_ID_2926203; Annot_ID_201981

SEQ ID NO: 36169 - DNA, 3003 bp, Unknown; identical to SEQ ID NO: 29000
  misc_feature (1)..( 3003): 2750-1469P.txt file - cDNA_ID_3092894; gDNA_ID_1971714; Annot_ID_175152

SEQ ID NO: 36170 - DNA, 3003 bp, Unknown; identical to SEQ ID NO: 29000
  misc_feature (1)..( 3003): 2750-1469P.txt file - cDNA_ID_3092894; gDNA_ID_2926203; Annot_ID_201980

SEQ ID NO: 36171 - DNA, 3000 bp, Unknown; identical to SEQ ID NO: 8311
  misc_feature (1)..( 3000): 2750-1469P.txt file - cDNA_ID_3092896; gDNA_ID_2926203; Annot_ID_201979

SEQ ID NO: 36172 - DNA, 3003 bp, Unknown; identical to SEQ ID NO: 28998
  misc_feature (1)..( 3003): 2750-1469P.txt file - cDNA_ID_3092900; gDNA_ID_1971714; Annot_ID_175150

SEQ ID NO: 36173 - DNA, 3003 bp, Unknown; identical to SEQ ID NO: 28998
  misc_feature (1)..( 3003): 2750-1469P.txt file - cDNA_ID_3092900; gDNA_ID_2926203; Annot_ID_201978

SEQ ID NO: 36174 - DNA, 3003 bp, Unknown
  misc_feature (1)..( 3003): 2750-1469P.txt file - cDNA_ID_3092904; gDNA_ID_2926203; Annot_ID_201976
tttgtatatatgactttaaagattgcttacctaaagtttttactcatgcatagatcgacatgagctagttttggggaatacttttagtgctgtgccaggcgcaaaggctccaaacaaggaggttccaccagaggttctcactcctcccttgttggttactttgttatctgttaaatagttttccaattgtatccggatagtgttctacttctccttgtagaaaatctcaagtttttgttactcttgctattctcttggatgttgatttgtaaagcatgtcgttttattgtaggaatttaacagaagagtgtccgaagggttccaagctactccattttggcatcaaggtcacatttgcgatgatggccggtaattatatgattctatgcacaacaagaattcactatattataaatattggatattgagtatttttgttgaaaatttctgtgtttaaatctgacttgacttgttttgtcagtactgactatgcggaaactgtgaaatctgctcgttgggagtatagtactcgtcccgtttacggttggggtgatgttggggccaaacagaagtcaactgcaggctggcctgcagcttttcctgtatttgagcctcattggcagatatgcatggcaggaggcctttccacaggtgtgagctttgcttgattgacttaaagttaataaatagacggttaagtttacttgcctagtactaacagaaaattaagaaagaaaccaccctctttctatcagcagaaactgctattgtagttcttattttttctcttgtatttgcagggtggatagaatggggcggtgaaaggtttgagtttcgggatgcaccttcttattcagagaagaattggggtggaggcttcccaagaaaatggttttgggtaaaacatttcatccttttgctacatttcttgttgcagactttagttagctagtggacctgtgtatacacccacatgtagtatacttgtttgatagctttatttgtcaatgtctctttacaggtccagtgtaatgtctttgaaggggcaactggagaagttgctttaaccgcaggtggcgggttgaggcaattgcctggattgactgagacctatgaaaatgctgcactggtatgcacttataagatcttcttaagcaatgacagtgagtattagaaggcagatagtttacaaaagctctgggcccttgtaaatctgcaggtttgtgtacactatgatggaaaaatgtacgagtttgttccttggaatggtgttgttagatgggaaatgtctccctggggttattggtatataactgcagagaacgaaaaccatgtggtaaatttgttttactagtttcattcagttttacttttgacatcatatcattcccttatggctagattccaacacccgatgaatgtcttgtgacaggtggaactagaggcaagaacaaatgaagcgggtacacctctgcgtgctcctaccacagaagttgggctagctacggcttgcagagatagttgttacggtgaattgaagttgcagatatgggaacggctatatgatggaagtaaaggcaaggtatgtatgctaatgtgatccaatccctgtagttaaaagtcttaacaaatcctaaggcagtgaaagaagattatgaacgtttgttatggttaacaatgatgcaggtgatattagagacaaagagctcaatggcagcagtggagataggaggaggaccgtggtttgggacatggaaaggagatacgagcaacacgcccgagctactaaaacaggctcttcaggtcccattggatcttgaaagcgccttaggtttggtccctttcttcaagccaccgggtctgtaacattgatgagtgttttgtttgttgatagagacccatgtgatgaatgaagccttagtcatgtcattgctagcttcactattatgtatgtatgattttagttcgttcggtccttgtggtaaatgatacgggccagtgtaaagtctagttcaataaaagccttgagtcgcataatttcaatttcaaattgcatcagaatttcatttttactttttaggtatttcttctattttattttttgtttctccactcattgttcctaggtagaaaccacgatctataatggattggtaatgatataggttcgaattgttggatattgtataactatgagtgggaggcaaaaaggagaaaagaagaagttccttaatatcggctcactttgtcttagcatcattacaaatgcactctctctggctcccacaatcttacttttattcttcctcacataaataaacccttctttccgttacactcatatatatgtataaacattttctcacttctaaaatataaaaacatttggtaattttgttttcctaataaagagttaagatctatatatgaacttaaagcagcattttttttccaacaaagcttcaatttaggcaataattaggacacaaatggcaaaaccatcattttgttttatatatatttaaacccgcgaaacccattcgaggcagtcgaaagaaaacaaagaaaaaagcaaagtaaatcgttaacatattttttttttttctacttgtgagttgtgagcttctatctctgttttattatttatcatgttatgtttttaaacttattaatacatgagttaaagttttgggagtagaatgatcttaatagagttgatgatgttagtgatcatgaattatctcctaagctaagaaagactttttgtagcattttagttaaaataaaaagtttctatatcataaatatacaataaaacctttattaaagaagataaaacttgaccaaactgtattttataatgtttctttatgtattagttattaacaaaacaaaaaacgtaaattactttgaagtgtacgaaaaaataaaagaggaatcaattttcatatatagccaaagtcacatagtgattcttctccaatcaaatctctatcaacaatg

SEQ ID NO: 36175 - DNA, 3003 bp, Unknown; identical to SEQ ID NO: 28997
  misc_feature (1)..( 3003): 2750-1469P.txt file - cDNA_ID_3092908; gDNA_ID_2926203; Annot_ID_201972

SEQ ID NO: 36176 - DNA, 3003 bp, Unknown
  misc_feature (1)..( 3003): 2750-1469P.txt file - cDNA_ID_3092928; gDNA_ID_1620704; Annot_ID_165183
tagttgtttatttgataagggtatctcccatagctagttaaaaatgttatttaatatattcgttttggtaccatatgctacaataatcatattatgcagagatcatcgaataacatcacataaggtaagaaagttcatgtaaaaagaaaatgcactaataatcattcacaaacttagcagtagattagcgatcgaaaattgatgtcaccaaatttaacaatctttaaaatgacatcttttaattaacgacgttcattcggagacaaaatgaatttcatcaaaaatgagtcactaaactatttttcaaccactccactaaaaaagttaaacctcattcaaaaactgccacgaaacattcccaccaacaaaagataacaaataatatagactccctcgccttgttgcttcccactacaaaagtaacaagaaaaattgttacaatactaagcatagtattaacgttatgctatatatacaaatctctcgtcggaccaaatattcgcattcatagatttcattacaaattaacgaactattcacagaaagaaataaaacgagatgggaagtggcatgataaggacattggttattctagcaatagctttattcatgatcggttccgacaacgtccacgtggcaaaagcccaggtctgtggagctaacttgtcgggactgatgaacgaatgtcaacgctacgtcagcaacgccggaccaaattctcagccgccgtctcggtcttgttgtgctctaatccgtcccattgacgtaccttgtgcttgccgctacgtttcaagggatgttacgaactatattgatatggacaaagtggtttacgttgctcgttcttgcggcaagaagattccctccggttataaatgtggaagtaagtatctttcttgcttttcttattatagtttcgtaattgttaagcatataataatttggatttgaatctgttataggttacaccattccggcggcttaaaaaggaacgaaaccaacagaatttggatttgctataaaaattaataaaacgtattagtatctgaataatgatgatgatggatgttatcaggattttaggtcttgtagtataagcaaaatggggttgatggtcggaagatataattaatgaaaatatgtttgtgtttttttattttgaacacctaaagtaaacatctgaactagcaaaacgagcaattaaacatctgaccacataaataatccattttttatctctattttaacctcgtagttagataattaatttatgaccaaaaagaaagtaaataactaaaatgagaaaatgaaaaccacgagctcccaaatttcctgcggcttctttagcctcttgtttcgtttatgtaccactttctcgactccacactttataaaccaaatcctccacgaaactccaaacacattgtccaaagatcaatacacactgttttaagaagaatttgaaaagaaaaagaaaaaaagaagatgaatgccggaaagcaagcttcgtgggcggtggcgacggcgatcgcagccgtggaagtgctaaaagaccaaggcgttgctcggtggaactaccttttccgcttactccacaaagaagcaatggctcgcgtccgtaccattacagtcccatctcgtccctctcctcctacgtcttcatcttcggctacttccatcagatccaaacctttgtccaccacaccctttgagacatcctttgagaaagctatgggtcttagctgctttggtcccaccaccgttagattctagatctctatgtactgtgttgtatgtacgcaaatcagaatgtgcatgcgtctatgacttgtttttgtttacccatcacatcattagctaggtccactaaatgttgtacttgttggagtcattattctaacattttgttttcaatattgaaataaatctggttttatatagacataactaaaacaaaccggagtgtttaagccggtttatatttataccacaaagaatcttaatccgctaaatttacatcaccgaaggatggacccttgtgagtcacacaattggtgtgcaaattagaagaaaaacatcaattcattttttattacatggaaacaattttagaattttttttgctatgatacaatgttaccaacccatcattatttgatttatgataataaatttcattatgtaaattttacacatgacctagtgtataaaatagacatactagctggaccataatcagacgaacttaatatcggttaatacactaccggttcattaagcatttagacaaaaaaaaaaaagaagaagaagtccatatacatgcatatatacgaaagtcacatcagaagatcagacatacaagtacaacgactagtcagtggacgcagtttgttgtgtggtgggacaaggtgagaatatgcccacagatatcgctattgctctctttaaccattttggtccaaaacactttgccaacttttttaataaagactgatacaaattttagattgatacaacttaacattaaaaccacccaaataaaacttcgtaatatagataagcatcattgtaccacaaccacacaccaagccaataagtcaacaactactcctaacccttttaaacctaatcaatacaatttaatattagaccgactacgtgatggtgcatatgcttctttttaccaaaacatatatattcaagcaacaattaatacatatttcgattctcaatttaatcaactgaagaaatttcggtcacttgttttaatttttttttgtaaagcttataatttttattttgtaccaacatttaaaaatcaattattttggtgaaattaggatgatagataccgtcaacctacttttgttgaccaaacttgattctaaagaaagaaagcaaaagagagagaacaaaaacgaagacaactctcatcttcttttctctttctttttcctctttctccattgcttgttgattgatgatcttgaagcaaggatcatg

SEQ ID NO: 36177 - DNA, 3003 bp, Unknown; identical to SEQ ID NO: 36176
  misc_feature (1)..( 3003): 2750-1469P.txt file - cDNA_ID_3092928; gDNA_ID_2926204; Annot_ID_202076

SEQ ID NO: 36178 - DNA, 3000 bp, Unknown; identical to SEQ ID NO: 3289
  misc_feature (1)..( 3000): 2750-1469P.txt file - cDNA_ID_3092933; gDNA_ID_1620636; Annot_ID_162916

SEQ ID NO: 36179 - DNA, 3000 bp, Unknown; identical to SEQ ID NO: 3289
  misc_feature (1)..( 3000): 2750-1469P.txt file - cDNA_ID_3092933; gDNA_ID_2926204; Annot_ID_202066

SEQ ID NO: 36180 - DNA, 3003 bp, Unknown; identical to SEQ ID NO: 17199
  misc_feature (1)..( 3003): 2750-1469P.txt file - cDNA_ID_3092942; gDNA_ID_1620636; Annot_ID_162905

SEQ ID NO: 36181 - DNA, 3003 bp, Unknown; identical to SEQ ID NO: 17199
  misc_feature (1)..( 3003): 2750-1469P.txt file - cDNA_ID_3092942; gDNA_ID_2926204; Annot_ID_202055

SEQ ID NO: 36182 - DNA, 3000 bp, Unknown; identical to SEQ ID NO: 3274
  misc_feature (1)..( 3000): 2750-1469P.txt file - cDNA_ID_3092946; gDNA_ID_1620636; Annot_ID_162904

SEQ ID NO: 36183 - DNA, 3000 bp, Unknown; identical to SEQ ID NO: 3274
  misc_feature (1)..( 3000): 2750-1469P.txt file - cDNA_ID_3092946; gDNA_ID_2926204; Annot_ID_202054

SEQ ID NO: 36184 - DNA, 3003 bp, Unknown
  misc_feature (1)..( 3003): 2750-1469P.txt file - cDNA_ID_3092950; gDNA_ID_2926204; Annot_ID_202052
aacaatctcatctccttttctttttcttacttcaacttgttttttttaaggcagtaacaattagtaaggatgaaaataatcacattatcattaagctgagatgtcaaagcgattatgatgagaggaaaagaaaatgaaaataagtattggtaagacatcttagttttaataatcgtatatcaaccaaatttgatcaataattagcttaaaccaacatatcattttagaggcctcaacctcctttgaataattaggctgatactacattctaatgacagatgaataacgtacatctccactttttaaaacaaacaagattatgttatttgatttaggtatccgtatatgccaaatatatttttctggatgtaagaaccacgagtaacatgttgatgatgtgtttaagtggtaaaaggagaggagaaaactaaattttgggactgtgttgagctctttgggcaattgataatattgcaaaatctcaaaagaggctgttttttttttatcaagtaaaaatacacacattgtgtctattatggttttactctttgatcaaatcctgcatgtgttgtgcataacttcttcccggtggaatgaatattacatcttcccaacctgaattcttctcgctcatctacattgattcaattcagatttttattagactaccaggttttcatactttaaggtttctttaaacaaagaagaagcgtgagtacctccattttcctcaacacatcttccagactcccaacctgcaaaacaaaaagattagttccatggtgaagataagaaaactcttaacaaaaccaatgctgtgaaattactttatatattgatctctgatatgcaactttgataacgataaaccttggaattcattttaactcagatatatgaaggcatgtacaatctgaattccgctctttctaaagttttctaagacttttccctttccctcgctgttcctttgaaaacatggtgttatatgtttgcagaacatgtaatcacaaaaaatgctagaaattacatatgatgccaacacagctactagctactcccacttgttagtaaaccatgtctttagatcaaggtgtttgtttctatcttacgtggcctatcgaagattcaaatacatagaaggtaggtatgaatcattaccataatttgttgatctcctcttgatgctctcgtatatttagaaagttccctctctatatcttcctgaaagtggtcacgcagaacaggaaagtaagagttatcttcctctgttttggcttatgagagatctattagtattctttaacgtgggagaagaaactaaccaaccttactgaaatatacagggcagtaacgtctattttttttcctcacaacaagaagctcagactgtagaggccaataacaacagatagatatcaagagaaaacaaagcaaaaacaccaaaacataaggaatccatattggtataatagaaaaacacagaaaatgagtatatcaatttacctgaaaaaccggaactccatcaaacccattcttatttcctgaggatttgagctgagacgcaagaaaatatagcttatggataagattgaaatgccaaataaatgctatagacacatataattaaaagtctgtttagcatgagccaacctctaacgcattctttatttggattggatctggcaagaagcgaaaggaaatcccttcaacttttagcaagtacacctgtaaacaacatcatcttaacttctgggaatgtagctaccacgattacgcaaataacatcaaaaagttccctaaacgtagttataacttataagttccaagccattagagggattataatcatgccatcgttgcattctttcttgtgacgatgttgtcaacattgctacgtgcacaagaacacaatctcccgttcattcaaactgccaacaggtgttcctattaccgtataatataaacaactaaaatgaggccagacatgaacaagtctacttagaatttgagctcctgaaatttgtttgtttcatttgatttaaccaatggcttcttccacattgatctaatgcagtgatcataaggaaagggaactacctggtccagagtaatgggaacaaccttcgcattggttttcaattctcttctccgaagtcgcgcctaaaggagtatattagagaattatgagctcagaaacttcacatttttttaaaaaagttcggaggagaaaaatacaacaaaaagcgaaacctgagcaagaaaagcttcagcatcctcttgtcgaaaacagagcaaaccgatagacttgcctccggtaggatccgagataagaacgaattcgttattggtgttactgactgtaaacaccgacgtcccagcgagagctttagcgacaagagatggactcaacgtcgtcgtcggggttccagacttggattgtgagacggaggcgaaaggcggcggagtaggaagagagaaacgtcgagtagctagggtttcggcgaatcgtttcgtgtcttcgattcgggcggagaggtcggagctgaagcgggtacactggtggtgaatgaaagaagagaaggagaggaaaggattgggtttcactgatgactccatttttggatttgcagagagaagaaagaagtagaagaagaagaagcaatttttgatactatgaagagagtgaagaaaaaggcttcagagcaattcgtttgggcttttttatttgggctttattggacttgattggttttagtttacgtttaatatggcccttgatcaaaagtttggtgacaaagcatttattaactttctaaactcaacttccacaccattctaaacacatgacatgacttacaaaaagcttttgtcactcaaaattcatgtcgatgacatttttttcctccaaatttctcctccttataaaatacttactagatcaagcaaacaacacactaaagaaaacaaaattgttaaaactctcgttaactgaaaaatatg

SEQ ID NO: 36185 - DNA, 3000 bp, Unknown
  misc_feature (1)..( 3000): 2750-1469P.txt file - cDNA_ID_3092958; gDNA_ID_1620636; Annot_ID_162894
attaatttgcaggcttggctctttgtacgcaagccactatgatatatttgtgacacagcatgatgttctgcgagacctagctcttcatttaagcaatgcagggaaagtaaacagaagaaagcggttgctgatgccgaaaagagagttagatcttccaggagattgggaaaggaacaatgatgagcattacattgcccagattgtctctattcatactggcaagtgcttttctacactgcaaatattcttggttctctcatgtaataatcaccaggatcataatgttggtatggattttttattttgttttttgcaggggaaatgaatgaaatgcaatggtttgacatggagttccccaaggcagagattctaatattgaacttctcttcagacaagtatgttcttccgccttttatcagtaagatgagccggcttaaggtcctagtgattatcaacaacggcatgtctcccgcggttctccatgacttttcaatatttgctcatttgtcgaaactaagaagtctctggctagagagggttcacgtccctcaactctccaactcaaccacccccttgaaaaatctccacaagatgtctttgattctgtgcaagatcaataaaagttttgatcaaaccggacttgacgtggcagatatcttcccaaaattgggcgatctgacaatagatcactgtgatgatctcgtggcactaccttcaagcatttgcggactgacctcccttagctgcttaagcataacaaattgtccacgcctcggtgaattgcccaagaacctcagtaagctacaagctctcgaaatcttaaggctatatgcttgccctgagctaaagacattacctggagaaatatgtgagcttcctgggcttaagtatctcgacatctcacaatgtgtcagcctgagttgtcttccagaggaaataggaaagctaaagaagcttgagaagatcgacatgagagaatgttgcttctcggatagaccgagctctgctgtttcactgaagtctctgcgccatgtaatctgcgataccgacgttgcatttatgtgggaagaagttgagaaggctgttccagggttaaagatcgaagctgctgagaaatgcttcagcctagactggcttgacgaataaagtgtaaactcattgtttagagtctggtaagttaaatggcttgtatagagaactctttctactctgttttctaatttctaagttcaataaaggataacttttcataacaaacttctactctctcttttctacatgaaagtttagaaactgaaaagatttgtgaaacaaagctgattctgttccaaattcctcgacaaagatgccaaaataaagaatactaaaagacaagagatagatttctttgttattctgaattgtaacataataaattaggctttgtaatctgagactaataatcatcttgttggcctcctcctacgtatttgactggcagtggcttgataaatgctgtcaaatatccacgtgttttgatcaaatcgaagcttttctaaactgctttgtcttttccttttgccttgtgcaggtttcttaattcggaccaaacttggaacataagagcacacatatgaaccacagtttacgcctgcacgttctccagcctcttcaataatgttaaatgttatgcgatcgaattctctaaaatatccatcctctccaataatgttaaatgttttgcgaccgaactcttcatcaaaccccaaggcgactttcttcttctcctcgtcaatgaagaaacccccatatataaatggaaccattatgttattgttaggttcaatgtcaattctcaagaacttgttccacgacaccatttccgcctcaatcttagtcgtaatccatatctcaagctcatatggatatgaatcgttgtgctgaaataaagccgcaatcttcccttctctaacacaagatgaagtcacatattcatattcattatctataacgttaaccggtagaggcagaagcggaccaaatctctctcttgtaaaatcaaaacagattatatgattgtaaccatctgagttttcttctctagcacaccagtaagtgttccctttgagagagacgccttggacacaagaccaattagacaatatataccaatgtggagtgacatcaagagttgtccataaatcagagtcaaaatcgtagatttcatgccaacaaatgtgcttttcggtgtagcaataatctataaacctcaataatttaaggctacgaccagatttattattctcgtatccaagagcatatctgatattgttcattacgtatggacggtgagaatatctaggtatgatccaccttgtttcctgcctatacggattccaaacaacaatcctagtatcgtctttcaagatgcataacaataaaccctcacagtgaaagacttgagatatcttgacttgttccttaagacaactaagtttacctttaaactctatagatggatcaacgtcatccatgaggacagcgctcatcaaaaaaagattgtaatctatcaacatgatcaccctagattctccttctctcgttgatgtaactttaccaatgtgcatcttcttaaagctctcactattggataaagtattccaacttttgcaagttaatcgcacaactctcatagatgtcatggaaacccttgaaaggatttcttctatcaaatcctttggaagatcggtgatcatcgtcgacgtcgtcattagtttcaaattgcaacaagggtttgactatttacattcaaaaaaacgctttttgttttcctcaagtgtacaccatatataacagttgaagatacaaaagccctaaacaaatctgggccgatagtgggcttcagaatgtagtcggtcttttaatgatattttggtgtcaacccaataactccagtttcatctcaattctcaacatacaagtatctcggtggcaagagcagggagaggaagagagaagatg

SEQ ID NO: 36186 - DNA, 3000 bp, Unknown; identical to SEQ ID NO: 36185
  misc_feature (1)..( 3000): 2750-1469P.txt file - cDNA_ID_3092958; gDNA_ID_2926204; Annot_ID_202044

SEQ ID NO: 36187 - DNA, 3000 bp, Unknown; identical to SEQ ID NO: 3271
  misc_feature (1)..( 3000): 2750-1469P.txt file - cDNA_ID_3092962; gDNA_ID_1620636; Annot_ID_162893

SEQ ID NO: 36188 - DNA, 3000 bp, Unknown; identical to SEQ ID NO: 3271
  misc_feature (1)..( 3000): 2750-1469P.txt file - cDNA_ID_3092962; gDNA_ID_2926204; Annot_ID_202043

SEQ ID NO: 36189 - DNA, 301 bp, Unknown; identical to SEQ ID NO: 3973
  misc_feature (1)..( 301): 2750-1469P.txt file - cDNA_ID_3092966; gDNA_ID_1620677; Annot_ID_164292

SEQ ID NO: 36190 - DNA, 3000 bp, Unknown; identical to SEQ ID NO: 19586
  misc_feature (1)..( 3000): 2750-1469P.txt file - cDNA_ID_3092966; gDNA_ID_2926204; Annot_ID_202042

SEQ ID NO: 36191 - DNA, 3000 bp, Unknown; identical to SEQ ID NO: 3983
  misc_feature (1)..( 3000): 2750-1469P.txt file - cDNA_ID_3092970; gDNA_ID_2926204; Annot_ID_202037

SEQ ID NO: 36192 - DNA, 3003 bp, Unknown; identical to SEQ ID NO: 20920
  misc_feature (1)..( 3003): 2750-1469P.txt file - cDNA_ID_3093003; gDNA_ID_2926205; Annot_ID_202160

SEQ ID NO: 36193 - DNA, 3003 bp, Unknown
  misc_feature (1)..( 3003): 2750-1469P.txt file - cDNA_ID_3093007; gDNA_ID_1620844; Annot_ID_170160
acgagtgatcttattagcctatgagcctcaagacaaaggctttactgatttttgagctttattgaacaggtatgggatgtgttaagcaacgaagaagtggttgacattgtagcttcagctacaagccgggcatcagcggctaggaccttggtgaactcggctgcgcgtgaatggaaactgaagtacccgacttccaaaatggatgattgtgcagtggtatgtttgtttctggatgggaaaatggattctgagtcggattatgatgaacaaggcttctcttcagccacaaatgctgtagaatcagatgatggccaaagatcagaaccatgtctccaaagaaacttcacagttagatcatcatcagatcaagaaaacgagacttatggtaacgtgaatacagagactgatgcagaggatgagaaaacggtaggagatcaaaactggttgggtctacaaggcgtcacacgcgtgaactcacttgtccagcttccgagattctctgaagagaaatcgaagacttgagattagcttttaatgttatttctgaggactgatcttgaagaatgttgtcatttttcgttgttatgcttgagcattgtgcgcagcttgatctgtatttgttttgctggtgtttcgtgtttgatgtatctgtattgcacaatggatttgcctcatcgattctctcttggaatccatgaatcaaatgtgtatatacattgcttttaggtatctctctaaacaaaaaaaaagtatatatgtgcttgtgttcttcatccacctcctgttagagtctatagaatctagaatctacatgctgatatcacctaatcctgtcaagtatttgcaggcacaaattagcttagatgaacactctgaacaaacattcaaacgctcaagactaatttttgaagagagattcttggaaaaaaggaacacttggcaaacctcgcttgagtgagaactggagttcgtttcctctgatgcttgcgcctcagctttttcgttcgagtaacttccagaattcgaaatgaaaatcaggcaaccgatattagcaacacaaaacttctcttcatgatagccacaaagctaatatgtgcaacactttcaaatacattggataaaaaagattgaagttgaagaaggctcacgttgataatatagtgacccatatgagttcaatacaatctacccaaagaagcctttggtctacagggattacaccgtatgtaaccaagtgtgccaatggccagagtttccagcctgcctgcatagacaaaatcatgacataacctttagataaaatcaacagactaactttaagctttatatatgatcacgaagacacagggcaaggagagttaattacagtgagcattggcaaaaatgttgtcttgatttcgctgaaaatgtcagctggagattggaaacgcaagagccctaaaactgtaaagtagatactgttccaaattgcagaccatacggtttgatcaaatgcgacttttgcagggactacccaccattcttgaaaaggaaagagagccttgtacaaagaaaagattttagctttcagcccgttgttaatacaacatatcttgacagagcaaagattgatttttacctcacagaattggtagtaatagtgagacagtgaaccatggagtgtgaatccaacaagacctgatctaagaacacgagttcgatcaaactcaaacagcggttttccttcgtaacactgcataaagttacagccaaaatggtcagagagaactcaaattaagaagctttttagagtatttttagtttcttacttgtgcaatccaatctcctaaagaatacacaattccactaatcgccattttcgccaaaacagggtttgttttgagaatttgttcatacgcaaaccaattatgttcaggtgcatacctaagtatctcgtagagagtccaaccctaagaagaacaacaacaatcgtgatatcaatttcagtataatcccataaaggagcaagctttgcagagatagaagaaccaatcaatcacaagagagataaagaaaaccctaagcttacttgccaatagtcatgatcaatggttaaaagcttagtaaccgcaacggtaccggcggcgagaactatagctgcgttgatacctcgactcatcagccgatctgtatcttctactttatcttctgatagttcttcctctgccttgaaattgtcatttttaacatcgattgcttctctgtcttcaatgatcgatttaacgatcaagtttcttctctctgtaatcaatcgtttctgattcttaaaagggttgattcggggtaatgggcctgcggttttaatccgtgaagaaaccttcccggagacgatgatggtggtgggacaacaacagagagctgccatggacttgcacttctcaaaggaagatactttttctcttctcgttggctctctcacagccaaaggagaggtttttagacttagagaacaaaaaagaagcagcagactttggtgaccaaacggtaggaactgagccgaaccgagtttcggttaaattaaaaccaataaccggtgggttttaatttggttaaaaaccggtttgcacaatctcaaaaccgaagccgaaaacaaaggtcctaccgagatttgaactcgggttactggattcagagtccaatgtcctgaccactagaccataggaccagttgcttcgagtcctaccgttttggtttaagatctagacatgttcaaggactacaccatcgtggtctccgccgatacggcagtctgatcaaaacgattcaagagaatcaggcggaaggttttttctgaaattcataaaatcgggtgatctttgcaatatgcatacgtatatccttggtaaatgtattggctttgtttggttaacgatgttgataggattaggttgtgatcaaattagaaaaaaattgggtcttttctgattttttttggccaattctctgattatgagttttggaatg

SEQ ID NO: 36194 - DNA, 3000 bp, Unknown
  misc_feature (1)..( 3000): 2750-1469P.txt file - cDNA_ID_3093007; gDNA_ID_2926205; Annot_ID_202159
gtgatcttattagcctatgagcctcaagacaaaggctttactgatttttgagctttattgaacaggtatgggatgtgttaagcaacgaagaagtggttgacattgtagcttcagctacaagccgggcatcagcggctaggaccttggtgaactcggctgcgcgtgaatggaaactgaagtacccgacttccaaaatggatgattgtgcagtggtatgtttgtttctggatgggaaaatggattctgagtcggattatgatgaacaaggcttctcttcagccacaaatgctgtagaatcagatgatggccaaagatcagaaccatgtctccaaagaaacttcacagttagatcatcatcagatcaagaaaacgagacttatggtaacgtgaatacagagactgatgcagaggatgagaaaacggtaggagatcaaaactggttgggtctacaaggcgtcacacgcgtgaactcacttgtccagcttccgagattctctgaagagaaatcgaagacttgagattagcttttaatgttatttctgaggactgatcttgaagaatgttgtcatttttcgttgttatgcttgagcattgtgcgcagcttgatctgtatttgttttgctggtgtttcgtgtttgatgtatctgtattgcacaatggatttgcctcatcgattctctcttggaatccatgaatcaaatgtgtatatacattgcttttaggtatctctctaaacaaaaaaaaagtatatatgtgcttgtgttcttcatccacctcctgttagagtctatagaatctagaatctacatgctgatatcacctaatcctgtcaagtatttgcaggcacaaattagcttagatgaacactctgaacaaacattcaaacgctcaagactaatttttgaagagagattcttggaaaaaaggaacacttggcaaacctcgcttgagtgagaactggagttcgtttcctctgatgcttgcgcctcagctttttcgttcgagtaacttccagaattcgaaatgaaaatcaggcaaccgatattagcaacacaaaacttctcttcatgatagccacaaagctaatatgtgcaacactttcaaatacattggataaaaaagattgaagttgaagaaggctcacgttgataatatagtgacccatatgagttcaatacaatctacccaaagaagcctttggtctacagggattacaccgtatgtaaccaagtgtgccaatggccagagtttccagcctgcctgcatagacaaaatcatgacataacctttagataaaatcaacagactaactttaagctttatatatgatcacgaagacacagggcaaggagagttaattacagtgagcattggcaaaaatgttgtcttgatttcgctgaaaatgtcagctggagattggaaacgcaagagccctaaaactgtaaagtagatactgttccaaattgcagaccatacggtttgatcaaatgcgacttttgcagggactacccaccattcttgaaaaggaaagagagccttgtacaaagaaaagattttagctttcagcccgttgttaatacaacatatcttgacagagcaaagattgatttttacctcacagaattggtagtaatagtgagacagtgaaccatggagtgtgaatccaacaagacctgatctaagaacacgagttcgatcaaactcaaacagcggttttccttcgtaacactgcataaagttacagccaaaatggtcagagagaactcaaattaagaagctttttagagtatttttagtttcttacttgtgcaatccaatctcctaaagaatacacaattccactaatcgccattttcgccaaaacagggtttgttttgagaatttgttcatacgcaaaccaattatgttcaggtgcatacctaagtatctcgtagagagtccaaccctaagaagaacaacaacaatcgtgatatcaatttcagtataatcccataaaggagcaagctttgcagagatagaagaaccaatcaatcacaagagagataaagaaaaccctaagcttacttgccaatagtcatgatcaatggttaaaagcttagtaaccgcaacggtaccggcggcgagaactatagctgcgttgatacctcgactcatcagccgatctgtatcttctactttatcttctgatagttcttcctctgccttgaaattgtcatttttaacatcgattgcttctctgtcttcaatgatcgatttaacgatcaagtttcttctctctgtaatcaatcgtttctgattcttaaaagggttgattcggggtaatgggcctgcggttttaatccgtgaagaaaccttcccggagacgatgatggtggtgggacaacaacagagagctgccatggacttgcacttctcaaaggaagatactttttctcttctcgttggctctctcacagccaaaggagaggtttttagacttagagaacaaaaaagaagcagcagactttggtgaccaaacggtaggaactgagccgaaccgagtttcggttaaattaaaaccaataaccggtgggttttaatttggttaaaaaccggtttgcacaatctcaaaaccgaagccgaaaacaaaaggtcctaccgagatttgaactcgggttactggattcagagtccaatgtcctgaccactagaccataggaccagttgcttcgagtcctaccgttttggtttaagatctagacatgttcaaggactacaccatcgtggtctccgccgatacggcagtctgatcaaaacgattcaagagaatcaggcggaaggttttttctgaaattcataaaatcgggtgatctttgcaatatgcatacgtatatccttggtaaatgtattggctttgtttggttaacgatgttgataggattaggttgtgatcaaattagaaaaaaattgggtcttttctgattttttttggccaattctctgattatgagttttggaatg

SEQ ID NO: 36195 - DNA, 3000 bp, Unknown
  misc_feature (1)..( 3000): 2750-1469P.txt file - cDNA_ID_3093019; gDNA_ID_2926205; Annot_ID_202154
tcttatgcatatcgagcagactcaggaatctatacattgaagattgaattgtaaggaagcacttgttcaccagtgaattacggagacaagatgttaagttcttagtcataacaacaaaggggaactaaaacaaagataaacagagtcataaccttaggatgaggcttaagttgattttgcagcaaagacgaggctttttgtgtcttgtggttttggtctctgttcgtataacttttgttcgttgaaatattctactgtaaagtggttatgtttactcgaatccttgaatttgtttgtattcaaaaagtttatagaccttactatgtgtttgtgtttgtgtttgtattccctgcttctatgaattttgtgcttaggattttcacttgaacaattgtaatttactaactagatattgacatgcagtgtacatattattaacttgaaaagtatacatatttttttataacaattattatttgtatatgaataatataatacttgacacataatttttatatatgtaaagcttgaataattcatcttttataattgtatattagtttaatattaaaattcagtattttttcgtggtttggattttttagagataataaagatttaaaccttgcattatctagagattgacctacggtacactccggtttgatatttttgttagaaaattaaagacttttatattaattaatattatttagatataaataacatattcaagaggtataccgaataacaattttaattttggatgtctgatatatcaaagttcttgttcattcgtattcagaatcattttgttctttttatagtatgactctaaacgatttcccatttttttaagtaatgtgggaccttgtacacttactttttttatcgattgagtattatatgtctgttttttaaaatttaaattaaatcaaatatttaaaatctaatattttattaactatatgtattttatatataaagtcaaaataaattatatataaaaacaaatatagtgacagaaaaattatatacttataatattgatatagagagtttaggaaattagccttaatggaatttagttccataaagaaagatttaattgatgataaaaatttaggaaagagttaattcaagtatttaatgcaaattaacgatttgtaagtttttaggcatagaatatttggttgagatagaatttgtaagaccttaaatgttaatagtaaatagtgtagggatttttgccaaaaagtgtaccaaaaatgtatatatagattaaagtcaggtccaataaaccggacttaaccgaaccaaacagattcgatattgtgatttctaattaaatcggacttaacagaactaaacggatcaaaaattttgaatggttaatatttccttcttgcgtataactataaaaccatggcccctttaaaaatatatcaacagcttccagtggctaaccagattcgagggcctgcattagtaagtagatcacatggagactacataacacatatgatcaacatccatcagctaacaagatgaacaatctaatgtcagggccaatgaggcccattcatgatctaatggctactcagcataacttatatcaacatccaatggctaacctaagaatgccgctattcaggaatgccgcaacaggacagccaagatcatttgatttagatggtcagacatatctcaacccacgacaagcactgcctgagctgaatcaacaaatgatgtgacgtgtgcctcagccaacacatcctcaaggatttaaaactagaccatcttcagaacaaggtcaagatcagcagcagcctagatttgattttggtaactgtaaaagaactggtggtgatgactatttagtcaaagatctattcttaagtgtggaacaaggaagatttctcttctggatcttcattatcaactcccaatcaatttcaatacttttcactgaagattaaaaagttcactatagtcttaaagtttctcttttttgaattgcaaatttgtgtaatttcttaaagattatgaaacgttgatgaactattttagtcaagaattattcaaaaggaaaaaaatgaagaataagaagaagaaagaaagagtttctctttttaaacgtttggtttagcaagacaatttagtagagtcaattcaatatattcggtaataatattagtagaacaaatgcacaagtcaataaataaaaacttgttggacaagaaacagaaaggacaaaaacagagtaaatgcctccgactagatcagaagcagactcattgtcgtctccttaatcctcaaaaacaataccatcatcgttatctaatacaaatattagagtattcatttgtatgagtattcttctcccaatgcaccacgtccccatctcgatctcaatctttttgcttctcaagtttttctgcagccggatatccaaaatcatccgcagcctcaagtttagggtttaggataatcagagacaattgatgtttaccgtatctagaaaagttttggttactctatcatgtcaatcgtttatagccaattttactaggtggttctaatgtggtgtggatcaattctcgttagataatgtttcagctttaagcccataagaatgaaatgatgacttgcatgttatgtactaaccaagaagttgaccaaatgttctacttgacgatgatttgagggtacttgtctcagattgtggtttagccctctggttcaggtaaatcaagagcttgatccaatatttttaactaaaacgctgcgtttaaaccctttacaagattacttaatctaaccgttggatcatatcattaacgagagccatcgacggttacgattcttcgactagaggattaagtgatatttgaaccaaatgacacgaacaaacttaccgtgcgtgaatcactgtctctatctttctcttcttcatcagtctctattgatcttgaaacaaataccattgatacaacgatg

SEQ ID NO: 36196 - DNA, 3003 bp, Unknown; identical to SEQ ID NO: 16387
  misc_feature (1)..( 3003): 2750-1469P.txt file - cDNA_ID_3093031; gDNA_ID_2926205; Annot_ID_202123

SEQ ID NO: 36197 - DNA, 3000 bp, Unknown; identical to SEQ ID NO: 20914
  misc_feature (1)..( 3000): 2750-1469P.txt file - cDNA_ID_3093036; gDNA_ID_2926205; Annot_ID_202115

SEQ ID NO: 36198 - DNA, 3003 bp, Unknown; identical to SEQ ID NO: 28641
  misc_feature (1)..( 3003): 2750-1469P.txt file - cDNA_ID_3093074; gDNA_ID_2926206; Annot_ID_202239

SEQ ID NO: 36199 - DNA, 3003 bp, Unknown; identical to SEQ ID NO: 28641
  misc_feature (1)..( 3003): 2750-1469P.txt file - cDNA_ID_3093074; gDNA_ID_2926238; Annot_ID_203949

SEQ ID NO: 36200 - DNA, 3000 bp, Unknown; identical to SEQ ID NO: 33560
  misc_feature (1)..( 3000): 2750-1469P.txt file - cDNA_ID_3093102; gDNA_ID_2926206; Annot_ID_202210

SEQ ID NO: 36201 - DNA, 3000 bp, Unknown; identical to SEQ ID NO: 3245
  misc_feature (1)..( 3000): 2750-1469P.txt file - cDNA_ID_3093106; gDNA_ID_1620634; Annot_ID_162812

SEQ ID NO: 36202 - DNA, 3000 bp, Unknown; identical to SEQ ID NO: 3245
  misc_feature (1)..( 3000): 2750-1469P.txt file - cDNA_ID_3093106; gDNA_ID_2926206; Annot_ID_202209

SEQ ID NO: 36203 - DNA, 3000 bp, Unknown; identical to SEQ ID NO: 3242
  misc_feature (1)..( 3000): 2750-1469P.txt file - cDNA_ID_3093114; gDNA_ID_2926206; Annot_ID_202203

SEQ ID NO: 36204 - DNA, 3000 bp, Unknown
  misc_feature (1)..( 3000): 2750-1469P.txt file - cDNA_ID_3093125; gDNA_ID_2926206; Annot_ID_141728
atctatcttttggttgcgtttacatagtgtttacgttccatgttataattattagctcatattagaaacccagacgtaaacacaaacaaataatcatgtcactatacagaatttacctagtatagaagtccatgatttttgttctttttaccttttaatagaaaagttttgttctttagttttttgggatttaacattcgttttaatatatcttgtagatgttgcagaaaagtgttggtggtaataagatagagcaaacctttccagaaagtacattggattactcacaaggcttctcggctactcagtttcaggtttctctctcttcactatctctctgttaggttctgttgagtacacgtgacttgtctcaagaatctcactatatatgtctttgggtgttgaaacaagcaggacaaaacagcattccaagagcagtgtggttatttgcatatggaaaccagattctaaataaccagttcagtaattttttattattatttctgtagatgttcaactactttgtttattcttactttataaagaatatatcaaatctgactaaaattaactttgaaattcgctggtgaagatcaaactgatgaagagcagcagctattttggacatttgtgaagcttttatggattcaacttgaaatcatttcaagcagtgattaaagtgaaactttaacgtcccagatgtgaaaaataggaaggagttttaagcaaaaagactgatatagaacgaaaaaaaaaaagggttctcaaatctcaactggactgattcttttctctcttttgctttgtaatttcgtcacaaacaagttttccttgtagccgcctttatgtaactcgtggtttacaaattacaacacttcacttccattgcaattttctttcatagtataacaaatttcaatgcctgaataagctttttttttgtgtggggaaaaaaacttccaagaaatatctagcaaaacaaatgatcttaatggttcttttcagagctgctaaattctcaaaagaataattcgaagtagatgacaaagagggcatattcaaaacttataaagaaactaataaaacgtattactttaaatagagcacgaaaacctatatataaccaaaatgctaaccctaaaagtaacacttgaagaatgcgtaacactaacgcaataaaaggggaaaatagaaacttatcaaaatctggttatcggcttgtttttatagtcactcttcatatgcatcagtgtttgagattctgcagattgttgtagcagatcatgtttaaagtccgttatttgtagctcttttgagttactagcgattttggaggtgttaaccggcccaagcatgaataggcctgatggtattctggtccatctgagcttggccgaagttaattgcaaaattaaaattaagtttatattattatgcttttgtctatctcttgactttaattaatcttttaaggttaattggttattggtagttgagggtgtttcagttaaccttaaataaaaaacttaattgacttaaattatagtaaaaaccaaaccaaaccaaatagagatccaaatttaaatgtacataatctaccactttcataatgtaaaaatccaagtgttatcagctgccgcatttgttctgtcttctatatgtcgaatacgagtacataaactacaactttgataatctaattttaggattttaatatgctaggctgttttgcgtttgtcatgagtagggtcgaatcatgccttagccagtcgtactagtatagatggttgtaagttggatttgatgacaactgctttggatttgatgacaagtaactacttaaaagcaatggttaggcagacattaaataggtggtgatctaatgtctaacatctaaaacgttttaattggaatttaaacgagtttagatggtctaattaagcgtttattatgtacataatagaacgtataaaatatcatgattcacagaagtaaatttaaaatgttttaattttagaagtaaatttaaaattcaaactacatcaaaaattcaatagaaatcaacttaaagataaccataaaatcaattcaattgacatcaaataatagaagccatctactttttatgttataaaacttataatgaattttatgtcattataaatcgaaaaactacactgaaatgaacaaaaagtcaaatgacaacagattaatgattatgtaaactgtataatgtcgattaaaaccacataatgccatcaattatttagcacctatcaaataattgtcacggttgtatatatggcgcgcctagaccgccacttaaagcgctatttcaagtattgttacaaacgaagaaggtaggcggtctaatttttaagtctaaaattagatatctttggacgcctcatattacttattgttttactctgtcggatcctatctcacccaaccatacatttgtggcaacagaaattgcctccaaatgcaaaaaaaaaaatcattctttctactgttaatacttcgaaatatacaatttttaaagttaatatgtgtttaaataccattttgatctaaattttgtgttttgtgtttctttctatatatatatgtacgttttccattatatcagaatcgaatcatatctaaccatatatgaattagtctcggtagttgtaatttggaatatttatttcgcttttcaacgttggtaggttcaaaaatacttaagttaagccacgtttaatttaaatacgttcatatttagaatatgtagagttgaaatttataacttaagtatatgttatggaatttgttgacagctattttaaagtagttgggacaaaacaaaaatgtaggtaggtgctcacattaatttcaccttgtaaagcctaaaactataaatcttagtaacacatatgtgatatgtcagttgtactctgttgcattatttctctcactcaaacgtatatacaaacataaattatgtcgacagaaatg

SEQ ID NO: 36205 - DNA, 3000 bp, Unknown; identical to SEQ ID NO: 4409
  misc_feature (1)..( 3000): 2750-1469P.txt file - cDNA_ID_3093125; gDNA_ID_2926206; Annot_ID_202197

SEQ ID NO: 36206 - DNA, 3000 bp, Unknown; identical to SEQ ID NO: 4410
  misc_feature (1)..( 3000): 2750-1469P.txt file - cDNA_ID_3093131; gDNA_ID_1620704; Annot_ID_165198

SEQ ID NO: 36207 - DNA, 3000 bp, Unknown; identical to SEQ ID NO: 4410
  misc_feature (1)..( 3000): 2750-1469P.txt file - cDNA_ID_3093131; gDNA_ID_2926206; Annot_ID_202186

SEQ ID NO: 36208 - DNA, 3000 bp, Unknown; identical to SEQ ID NO: 27874
  misc_feature (1)..( 3000): 2750-1469P.txt file - cDNA_ID_3093168; gDNA_ID_1621108; Annot_ID_171661

SEQ ID NO: 36209 - DNA, 3000 bp, Unknown; identical to SEQ ID NO: 27874
  misc_feature (1)..( 3000): 2750-1469P.txt file - cDNA_ID_3093168; gDNA_ID_2926207; Annot_ID_202318

SEQ ID NO: 36210 - DNA, 3003 bp, Unknown; identical to SEQ ID NO: 18216
  misc_feature (1)..( 3003): 2750-1469P.txt file - cDNA_ID_3093172; gDNA_ID_2926207; Annot_ID_202315

SEQ ID NO: 36211 - DNA, 3 bp, Unknown
  misc_feature (1)..( 3): 2750-1469P.txt file - cDNA_ID_3093183; gDNA_ID_1621108; Annot_ID_171656
tct

SEQ ID NO: 36212 - DNA, 3003 bp, Unknown
  misc_feature (1)..( 3003): 2750-1469P.txt file - cDNA_ID_3093183; gDNA_ID_1620619; Annot_ID_162212
tgtcagcaaaaacgacatcgtttaagctcgacctgttcgtctcgatgtttacgctttgattagttactatttttctgcaattctgtttcttctctgtacatcaccaacaacatttaaattccaatggcgcattttaaatgtcaataataaatcgagatccgtaatttcgaagctacaagcaaaccttcttgtgcttctctaatcattgcgttttccttttaaagagtttctcaaagttttcccttttttttgggcataaaattgtttccttttcctcctatcagtgtgtctgaaaaaaattcaatgtctttatgttctgttcttttctgatctctctgaatctctctctatcgcgacagccatggccgaagacccttctttcctccccaaggtacctttcgttctgtgttctgtgagtggtgttgatctgattagctgatttgttctctagtttcaatcttagctcttagttatttttttgagttatttcatattcttatactctaaatctataaaacttgattctttcagcattataaaataaaaagattctgagattttcttgattttatatagacgaatctgtggtacccatttgacttaaacaaacaaacaagctaattaacacgaggacatataaatgtattgttttttttttttaatgcaggatggttttgtcttgaagcttcctaaaaagtcatcacttgtattgagaatggtcgttctcctctttgtaatggtctgtgctgtgtacatttgctccatttgtcttaagcaaataggagttagtccaaactatggtttcttgaacgttgaagtgtttgagaggccttgtcctgagcctaacatcgaaccgtgggacattccttttgtgcattaccctaaaccaaagacatataacaggtaaagagagatacaaaaagtttgagcctttatcatgttttgagtctaaaagcttgtattgattagtgcttttgtgggttttgaatgttttagggatgaatgttcttgccacccggttaggtactttgcgattctatcgatgcagagatctggtagtggctggtttgagactttgttaaacaatcatactaacataagctccaacggggagatattttctgtgaaagataggagggctaatgtttccaccattttcgagactcttgacaaagtctataatctagactggttgagtagtgcctctaagaacgagtgcacttccgctgttggcttcaagtggatgcttaatcaggtaaagtgattgttattcacggacactgtgacatatctttagtctttcttactcatatgttttcgactcgtctctgtttccatttgagtgcttgaacaaagagattgctatattccatccttatctgttggtcactgttgcttataactaactacttgtgaatttaaagtgataagatcttgttctgttttctagataagagcagcaacgttttcgttttacaaaagatgtgtgttgagaataggacaatttctcaataatgtgtttgcttttgctatatactttgtaaagttgataaacacgttgcagggattggtcttagagaataggacttcttttcttccctcagtgctcttcacttataagggagtttccgagtcaatgtcatttgaaactaacctgttctatttaggtagcttctttctggttgttgatgttcaaaaaagttgcctgaataaaagtttaggttgaaatagtctgtgatttgatgttggaggaacggaagatagctgatgttcccttcttatttgatccataaacctcggttctatgtagcagtaattgaactgataaatgatcacagttattttatctgatgatgaattattaacattgcagggtctaatgaaacatcatgaagaaatagtagaatacttcaaaacccgaggcgtctctgcgattttcctattcagaaaaaacctattgcgccgcatgatatcagtactcgcaaactcttatgacagagatgctaagctactaaacgggactcacaagtctcacacccattcggccaaagaagctgagatattagcaggttacaaaccaatgatcaacacaacacttttaataaatgagctgagacagattcaagaaatgactttgaaagctttgacttacttcaataccactcgacatatccttgtctactacgaagatgttgtcaagaacctcacggtaattattacatatttttttattgaactagttccagttactgattgtttattatcttatatgtgtttttgaatgaagcagagactagacgatgtacaggagtttctaaaggtaccaaaacgtaagttaaagagtaggcaagtgaagattcatggaggttcattgtcaaaacatgtacagaattgggaagaggtcatgaccacacttaaaggaaccaatttcgaaaatttcttacaccaagaattttaatttttttttgtatatatcagaccaaacaaacccttgtaggaaagttttgtttcacttgccttttttcttttttgctgtttgctgtagggtttggcattaattctcttaaatatgaagaagatttaaacaaaatttcgttgaaaattgtttcttcccctgaagagattttttatctaaatttcttaaaagcagaagaatcacaaaattatagtgaaaccgaaagaaaccagagcgatttagtttgatttattttgttcaattcaacatcaataacaccaaaccggtaaaaaccggaaggctaattcgagattgattgatttaaaccggacaaaaccactcaagccgcgtgaccgagtttccaacacattgcagattccagtcccaaaaagaaaagagagttaaaaatgcaaaaacggtgaaggggaagagaagcgaaattgggggattgggaatagcaacgttttgcaaatggtctcttctttgtagctgcaattgcaaagaacactgagagagagagagagtgtgtgtgtgacctttgagagatg

SEQ ID NO: 36213 - DNA, 3003 bp, Unknown; identical to SEQ ID NO: 36212
  misc_feature (1)..( 3003): 2750-1469P.txt file - cDNA_ID_3093183; gDNA_ID_2926207; Annot_ID_202312

SEQ ID NO: 36214 - DNA, 3000 bp, Unknown; identical to SEQ ID NO: 2973
  misc_feature (1)..( 3000): 2750-1469P.txt file - cDNA_ID_3093197; gDNA_ID_1620619; Annot_ID_162198

SEQ ID NO: 36215 - DNA, 3000 bp, Unknown; identical to SEQ ID NO: 2973
  misc_feature (1)..( 3000): 2750-1469P.txt file - cDNA_ID_3093197; gDNA_ID_2926207; Annot_ID_202300

SEQ ID NO: 36216 - DNA, 3003 bp, Unknown
  misc_feature (1)..( 3003): 2750-1469P.txt file - cDNA_ID_3093205; gDNA_ID_1620619; Annot_ID_162190
aagaaagctcatcggtacgctcttttagatataatttgcaactttataaacagcttaaactttactagggatcttcagtttctgtgtcgtatgcttaatcactggaagcctctgactgatggagctcgggtcgctccagactgctaagtcaactggataccctttctgcatatatatacatattcaagagttaaatcacgggaccttctgtattcactaacatagaaacattgcaatatgtcatcgtcttgtaacaaaaagattgtggttatttgcttgctgatgggaaagagacggatttgaataagaacaaagattggagatggtaacaatatctagtaatctgtcctaaaagtgaagaaaactaaccgcagatagagactgaaatgttgcttctctccaacagttttcacgaagaacagttggtgcctcatcttcgccaaacctataatgcattctcgtctctctcaatctcataagcacaccatcaactctcagctattaaaaagcaaatgagtggaagatgaaaatcgaaacgtcaaaacagtcaatgaagatcacatattggtgcgtaatgactttatttttctgactatggattttcctgattgactcacccaaaatcgcaagaggaggaaccatgagcttggcatgactctctgaaaaaacacaaacagacacgcacgcacaggtactgaactcattcaaattgatgttattgtgaaagaatgtgactggaaaaacagactcgaaaatttgatctttaccactttcacagtcagaagtgacactccattgtcagccagttcatcttcatacaaaactacctgaaggagtagagaataagtacatcaaagggcccagaaaaatgtgtgtttgagtttgtatcgataaggtgaccaacctcatcatagaagagaataggttctttaagtgagagagcagccaaatcaatctgatcttcacagttctcccactgaagagtagcttccccctttggattagcttttgcctcaacctgcttcacattaaaaaagcatacagcaatgagcatgaaagtcacacttgattgattatcgtgtgacagacagaaaaagagtgaaaatgagagcaaggcgaaccgtttctttgtctttctcaactacttcacttccacagtatggcgttgtaaacgtgtaatcataatctagtatcacctgctgagacggcttgctgcaagtagatcagagtggtatcagatacaactatcaagcaaagcttccctattgaaaagaataatatcttttgtgatatatttttcagtcaaatcctgaaacttacctcctgaatttccattgtgctgcagcaggaacttcaacaggtggaagcccttcctgcttccaaccagctagtgcgtcaaacgcattaaaatgaatcttagtgttgctacctaagtgtttaaggactaatgcattctcgccaaaaaccatttcaggtaagtgagatgtcttaagctttttttcccacctgtgttacaatcaaacatcacattcgtgaatctcagaagatgctatttacatatttgagataaacagagagctataccaggaaatgtgatgagcagagatcggaacaactaaaatcagtaaccacaaaaactaaaccaaagcaaatacgattttgattttttcacagaatagatcatacactccaccaaaaactaggaaaaactcgaaatcaaggacacaattctgatttccttcgatacgttccactaatacggtgtacacgagctcaaaaacccaaactacactactcagttcatcaaattaacgacgagcacaaatacaaaaccgtaaacacaaatatcacctacaagtaatcacagacaccaacaaattcatcatatatgatcgtatcttatgaggtgagagagatagagattaagtactcttcgacagcgagagaagtgagaatcgtgccgcggagggtttcgatctcccagtcatggatgcgtaaacctcgacgtccgtcgggaagaagctcagccccggaagacttcagaacatctttatcgaccaccgtctccatctgaatcgccggctaatattggcactaccttttctcctccgacgatgtcacttgtgtgaccaaccggactatccaaccaagacatttgacttttgatgggccggcctagtttcattttagtttgaaaaaagaaggtcaatttgattttggtccttaatgggctttaagtttataacgtaggcctttttcataataatgtaatatagctagaatttcatgcttttggaacacactataaaaaaggtcaatattcaatgtttcttttttcattattagtagatttggctaaataaacctctagaggacctagaccaggtttgaaacctgacatggtggaacaccactagcccacttgttctctcaagctcaataatatccatataaatcatcaaaagatgaatcaatcacaaaaattcacaactaatttgcacgatacacctcatgaacaaaatattcgtcgtcattgccactattaacgattcaaagtggtaaaaaaatcaggaagcagtgaaaggtgaaacctcatgaatctctagactctaatgcataaacatatttcattatatatcgtagtagaatactgagacacattgacatatataagtatcaaacagaaattgtataatggtatctttattttattaacacatgtgtgcgtcaatgtgaatcagatagaattagacacactatctttttaatatttaaagttggagccgttttggtcaaaactaatttatgtgcactactcatttatttataggttttttaaaaacacaaaaattgtgaaaaagcttctaagccaggtggcgggttttggtgcaaagtctttgatatgttcggagttgctgcttcgtagagaaaaaacttttctgataacatcggagtaaaaggaaagtaagtcggagtttaatcatcttaagatttgattgaatg

SEQ ID NO: 36217 - DNA, 3003 bp, Unknown; identical to SEQ ID NO: 36216
  misc_feature (1)..( 3003): 2750-1469P.txt file - cDNA_ID_3093205; gDNA_ID_2926207; Annot_ID_202293

SEQ ID NO: 36218 - DNA, 3003 bp, Unknown; identical to SEQ ID NO: 28647
  misc_feature (1)..( 3003): 2750-1469P.txt file - cDNA_ID_3093216; gDNA_ID_2926206; Annot_ID_202244

SEQ ID NO: 36219 - DNA, 733 bp, Unknown
  misc_feature (1)..( 733): 2750-1469P.txt file - cDNA_ID_3093216; gDNA_ID_2926207; Annot_ID_202276
ttctcttggtcgacaattttttgaaatggcgcgacgttgaacaaaaattatacgaacaaagaaagctatttccaggttactgcctttatatttggatgacttgttccaaggggaaactttttttttttttgtctgtcatctgatgatattagaactttcaaaggaaccaagatgattgcaacagctacactgtaatctataaccatcatgccattggacgcatcctagtaaatacataagaaagacactccctttattttggtctccgttcttcagccacaccttataatatcatccacaagataataagtggtgtctagcaaataacaaagcgaagctatatctatatttatttacttattgattgtcgtgaatctatctttaatggtgacatgccatagaattatcactattgtgtggttgtgcttgtaattgtttgtaaaaattttgattttatgaatcaaagattatcaacatctagactttaatagttaaggaaataataatatttaaaaaacgcgtacctaaatctaatgaaaagtcaaaattacggtcaacgccttacgagacgcgtctggttcttgaaagcaagttctgcgttatttcatcatcaatcaaagtcgccattttatttttatttaaagtctcacgtcacggaattatctctctgaattcatcatcttcatcattaccttctttttctcaatctcgattgttttcttccaaattcatg

SEQ ID NO: 36220 - DNA, 3003 bp, Unknown; identical to SEQ ID NO: 28647
  misc_feature (1)..( 3003): 2750-1469P.txt file - cDNA_ID_3093216; gDNA_ID_2926238; Annot_ID_203954

SEQ ID NO: 36221 - DNA, 3003 bp, Unknown
  misc_feature (1)..( 3003): 2750-1469P.txt file - cDNA_ID_3093245; gDNA_ID_2926208; Annot_ID_202411
gagacaaaatcagagtcggtttcctgctttttgattcctctttattaatcagcaaagatcgattccacttctcctctctctctctctctctgttctttaatttagagagaaaaaataagcattcttccttctctgttttcgagcgggaaattctggagatggctatacaagcgcagttgaattacaacgctccgaatgcgaatcaaatcggttttggtgggtccgagttttctttgatcaacaacaatggcgttatcggaatcggtaacgatcagtcttatcttgtcaataatctccagttgcagaaagatttcaaccaacatgctctgtttcatcatcagcatcatcaacaacaacagtctccttctcaaagctttttagctgctcagatggagaaacagaagcaagagatcgatcagttcatcaaaatacaggttcgttatttcgtaatccaaaccaatttttcatcgaaagtttcggtttttaagacgtgggtactgataaagattcaaccttttttgctttgttgataacagaacgagaggttgagatatgtgttgcaagaacagaggaagcgagaaatggagatgattttacggaaaatggagagtaaagctttgcttttgatgagtcagaaggaagaagaaatgtcgaaagcattgaacaagaacatggaactcgaagatctgttgagaaaaatggaaatggagaatcagacgtggcagagaatggctcgtgagaacgaagcaattgtgcaaacgcttaacacaacgctcgaacaggttcgcgagagagccgccacgtgttacgacgctggtgaggcagaggtggaggacgaagggtcgttttgcggcggagaaggagacgggaatagtttgccggcgaagaagatgaagatgagtagttgttgctgcaattgtgggtctaacggagtaacgagagttctgtttctgccgtgtaggcatctctgttgctgcatggattgcgaggaagggcttcttctttgtccgatctgtaatacccccaagaaaagcagaatcgaggccctcattttctagggaaaatcctttcttttctctcaccggaaaaatgcttgcctttgtgttccggtgaacggagagtttttactccgggtagatgacgtggcagggtaatttggtaaaaataggggaggaaaggaaagtgagaatagggaaaggttagaaatagtaaaaggttatctcaagaagtaaattctgattagggttttcattttccctttttgttttttggttctttttccattcaatggagaaaaaaaaggaacccagctggatttgatgaacataattcatattttccttctatctaatgaattttcggatataaagtttgaatgccattctttctatttcaatgataattaacttcttaggatttttaaacacattagtattaaatatcttaatatacattttcctaatgattatatgtataagattttcctatattaaacacttcctaataagcaaaaaactagaaacttttgaccgaaagaataataattctaaactaatatgaaatccaatttaaacatatcttttaaaaaatttcatttataaaaaaatcaattaaatcaaatttaaacatatgtcttttaatttacatagaaagcaaaacaaaaaaagttatattcttttgaacaaaaaaaagaaagcaatgaaaaagtaaaaaaaaagaaaggaagcattatatattaatgggtttgttttgatgtaggaagatggtgaaaagaggtggtagtagaggccgtagacacgcgtattggaggaagctgtaagtattattgggttgctcaacaatcaatatagtacagtgacatgagagcacaatagtaagtaataattccacattaaaaaaatagaaattgaaagagaatcagagtttggcctgccataggatttgagttctcgcactttcctaaacagaaacatgtttcattgaacacttgggcctttcttcttccttcattaaggattctcgatctctgtttcgacagatctgtgctacctaggttttctagatactccctaatacctataaataaacaataagtataaccttattatgtaattagatcgtactactatcaataaacaagattgtagaaaatagtgaaaaaggcaacgcataaagattaattaaatcttatttaagtttcatttgggacaatttaagattattgtcttgttcataggatttatttcatctattagtattacaaacttttttacgcaaacattattatctctatgtatagaatgatttaaacttttaacgtaaacacaaataaacagtcagtcctatgtgctatggatgaggtgattagcattgtagggtgtttcgtgtcatatagctctactagtagagattttgtgtgtcagtgtgtgtttatttacggctttgagtcttcaagacccaattagccttaagaccttagtgattttagactctttgttgaaaagctagaaattgcaaacccaaaccgcctaatgttgctataggttttgatttccgaagtgggtaattaattatgtggattacgtataaacacatggcccggcccattttaccccccaagtgctcggcccaaattgaaagtgggactcactggattgccaactaattttatttaacacgacgtgaagtttggaactaatacgtcaggtattaaaagtacataaacatcatcattactcaatttgctaatggacgaatagagacggaatcaacaaagtaacaaacgacttcaatattttttttatatgttactatgattcgacaaaggattttttttttgttatgaactgaagattattggatttttaatcacaagatgtcaatatcaaaattcaataccatgtctcgattagggatatcaatatcatgatattttaacaactttaactatgtaatttaattcgattatcgtttttgttttaaccttcgtttgatttgtagatg

SEQ ID NO: 36222 - DNA, 3003 bp, Unknown; identical to SEQ ID NO: 21151
  misc_feature (1)..( 3003): 2750-1469P.txt file - cDNA_ID_3093251; gDNA_ID_1620624; Annot_ID_162441

SEQ ID NO: 36223 - DNA, 3003 bp, Unknown; identical to SEQ ID NO: 21151
  misc_feature (1)..( 3003): 2750-1469P.txt file - cDNA_ID_3093251; gDNA_ID_2926208; Annot_ID_202388

SEQ ID NO: 36224 - DNA, 3000 bp, Unknown
  misc_feature (1)..( 3000): 2750-1469P.txt file - cDNA_ID_3093259; gDNA_ID_1620624; Annot_ID_47092
tttgccgagagtaagagagaagagattcacacattctatgggtctaatcattcatcagccaagtcatcacggttgccaagtcttaaagccgtctctcctgctgttacttctgcaactaatagtttattcctggaccacaagaacaatggagtaattgatactcagttcccaggacagagttctggtcaggctactggtacgttgacaatgttgtacttactgtgtcagatttgacacaatcttatgtttgctttctaagaagcttgcattgccaatccattacaatgtttccttaaagttaatttccgtttcaggtgatgtgcaagaagaaaaccttgtggcacacagtaacggtggtgtatcccacattaggaaagatgttaaaggagactggaaatttccaagtgatgggaagcatgtgggtcaccaaattgatgaaagcatgccccagttccctgctcgaaattttgagctacataatagtaatggacgttctccagaaactagtgatgcttacaaccgtttacttagagatggaaggtaataagttttatctggtttgaatcttggctttcctttccttcctcttctgtcactgctaattctttacttggatgttttagtaccaatgagaagttctagattgtttgactttgagagtgttaatatttattataacaggataaaggattgcataagcttgctcgaagatttggaccaaagggatctattggacatggacaaggtacgactgctttcctcagcaatatggatgaaacctttagtattgcttctattgggagtttgtcactgatctgtttttcccaatttcctcacatcagatttatcatgcgagtttctttaaagcctgcaagaagcaaagggctgtcaaggaagcatttcgctttaccaagttgattctaaatccaaccatgagcacattcaatatgttaatgtctgtctgcgcaagctcccaggacatagaaggtgatatttcatatttccagtattaaatcactggtcttattcattttttattctcctagatgttgaattgttacttatgtaggagctcggggagtgttacgtctggtacaagagagcggtatgactgctgattgcaaactttacacaactttaatatcaagttgtgctaaaagtggaaaagttgatgcaatgttcgaggtatagaaaccttcctgtgccggaaagttattttggacaaagatacatatttggctggttctttgaatctctgtcaaaatcatgatgcatgatagatttctggggaaaatcactgatactagtctaatgtttgtctgaatggttctgtatgttattcttggttcccgacagaggaaatgttattattgtctaatcaagcttcaaaatatgactgcactcaaactccatagctctaactctctttctctctgtgtggttatattgtcaggtgttccaccagatgtcaaattctggagtggaagccaatcttcacacatttggtgcacttattgatggctgtgctagagctggacaagtagctaaggcatttggtgcgtatggaattttaaggtctaaggtaagcatgccacaagtttggatgccctcctatcatgtgtttagatttcaaaaaataccctatttcttcatggctacagttttttttttttttaattctgcttatatgttcatttctgctttggaatctcaaatcaattattacattgatgacatgttcgatgcagtagaatgttaagccagaccgggttgtattcaatgccctcatctctgcatgtggtcaatcaggagctgtcgaccgtgcttttgatgtgttagctgaaatgaaggctgagacgcaccctatagaccctgatcatatctcgatcggtgcattgatgaaagcatgctgtaatgctggtcaggtgtgtggctttttttttcctgttacttcttctgttttttgctctttccatctgattgagaataagtttcttgcaggtcgaacgagcaaaagaagtttaccagatgatccataaatatggaatcaggggtactccagaagtgtataccattgctgtgaatagttgcagcaagtctggggactgggattttgcgtgtagcatatacaaggacatgaaagaaaaagacgtgacccctgacgaggtatgtctaacaaattcatttttgagttaaaataagacatatctgctaaaactcatgaaagtcgctgaggcaagtgtttaattacaagaatttatacatacatatttattgaatcttggttttcatcttatgcaggtgttttttagtgcattgattgatgttgcaggacatgcaaaaatgttagacgaggcttttggcattcttcaggatgcaaaatctcaagggatacgtcttggaactatatcatatagctcactgatgggagcttgttgtaacgtatgtgccttttattgctgtagcaggagtttttattattacttacaagttttgagctttctacgtcaaatcattagaatacgtggtggattaaggagaaacagaactttggtgaacatgtagcatcaaaagatccttatttgatcaaagtagtttttgagatgtagtttacattatcttagggttttggaatgttgcgattgcattgactttcttggattaaacttttatggagaaaatactgataatcttattttgttttttacttaggcgaaagattggaagaaagcactggagctctatgaaaaaatcaagtcaatcaaacttagaccaacaatttcaacaatgaatgcccttataactgctttgtgtaagacctccttcaatgctatctttatcttttcccctaaaacaaaagagaaagatgatatagtataagattgaaaagaaaatgtgttatggtattactacacttgcagtatcccatacaaaatatcattagtggtatgactccttaaattatcaacaggtgaaggtaatcaactgcccaaggctatg

SEQ ID NO: 36225 - DNA, 3000 bp, Unknown; identical to SEQ ID NO: 36224
  misc_feature (1)..( 3000): 2750-1469P.txt file - cDNA_ID_3093259; gDNA_ID_2926208; Annot_ID_141831

SEQ ID NO: 36226 - DNA, 3000 bp, Unknown; identical to SEQ ID NO: 3087
  misc_feature (1)..( 3000): 2750-1469P.txt file - cDNA_ID_3093259; gDNA_ID_2926208; Annot_ID_202386

SEQ ID NO: 36227 - DNA, 3003 bp, Unknown; identical to SEQ ID NO: 18198
  misc_feature (1)..( 3003): 2750-1469P.txt file - cDNA_ID_3093263; gDNA_ID_1621108; Annot_ID_171693

SEQ ID NO: 36228 - DNA, 3003 bp, Unknown; identical to SEQ ID NO: 18198
  misc_feature (1)..( 3003): 2750-1469P.txt file - cDNA_ID_3093263; gDNA_ID_2926208; Annot_ID_202374

SEQ ID NO: 36229 - DNA, 3003 bp, Unknown; identical to SEQ ID NO: 33851
  misc_feature (1)..( 3003): 2750-1469P.txt file - cDNA_ID_3093283; gDNA_ID_2926209; Annot_ID_141908

SEQ ID NO: 36230 - DNA, 3003 bp, Unknown; identical to SEQ ID NO: 33851
  misc_feature (1)..( 3003): 2750-1469P.txt file - cDNA_ID_3093283; gDNA_ID_2926209; Annot_ID_202491

SEQ ID NO: 36231 - DNA, 3 bp, Unknown
  misc_feature (1)..( 3): 2750-1469P.txt file - cDNA_ID_3093287; gDNA_ID_1620687; Annot_ID_164638
gaa

SEQ ID NO: 36232 - DNA, 3003 bp, Unknown; identical to SEQ ID NO: 31539
  misc_feature (1)..( 3003): 2750-1469P.txt file - cDNA_ID_3093287; gDNA_ID_2926209; Annot_ID_202480

SEQ ID NO: 36233 - DNA, 3000 bp, Unknown; identical to SEQ ID NO: 19323
  misc_feature (1)..( 3000): 2750-1469P.txt file - cDNA_ID_3093291; gDNA_ID_2926209; Annot_ID_202473

SEQ ID NO: 36234 - DNA, 3003 bp, Unknown
  misc_feature (1)..( 3003): 2750-1469P.txt file - cDNA_ID_3093299; gDNA_ID_1620655; Annot_ID_163622
aacaacgtttagatataaaaaaaacacggatcatttcaaatgggagtcgaggatctgaaggaagtcgacataaacaagttcttaattatataaaaaagtgggcgtcagcttcaagaaacaaagtatcttcccatgtggttcatggtcggctgctaccatatcttcgggacacagcagtgtctgataaggtatcccacacctgcacaagcatgcgtatacatatacgttggttatctcaaaaacagaatttgttatttcttgtaccatcaaaatccctacttacatttagcccctctgagccaccaacagcgagtaagaaggggcagtccgctgagaatgagaccgagaaaacttctccctgtttgatatatcaaagtttggaatggtaaacaaagaaaccagaaacaaacatatggcagcaaaagttcttattcatggctcttacagcatttggcttgtttgtagcaatccatgatggttggttgtttgaaagatcccaaagtttcacactttcatccgcagatcccgtagccaaaagctgcacagctcggatattaaacgactacactatgaatatggtaggagacaagagagaaagagagatatatgtgtgtacattgggggcatgtatgttgtatgatatggaggagacttcactatcatgagcatggataatgaaacttggtgataaatcagaagcacgtgtatcaaagcccttcacagttccatctttgagactcacctaagatggaagaagaaaagttaacgattcacatcagatatctgaatcattcagatgtttgtgttagaagagcaaagaaagcgtaatgcaccacaaaggagtgttcgctgtgaggatcccaagccaatttttcgactttggcctcggtagaccatttcaaacccgagtttgaagggtcccttccatctttctcaaacatatatatatatatatatatatatatataaaagactgatcaacataatgataaaaaaatttcatgtacaagactcaacacataaatggaacaaaacagtcaccaatactacagtacgatcacgagacccactgaggagtacttctggagtataattgttccatgcaaccgcgtgaacctgttagccaaacaacacacaataaataaaccatgagcatgcacagatgctagcttgaaagagcatggaaacagtttcaccttcataccttcttttcgtgatgctccatagtaaccttgcatttccccgtagccacatcccaaaccttcacttttttgtcttcactaccactagcaactatattcctattttcccagttaaaagttaaaaaaaaaagagtctggtaagcaagttctggagattattttcaatcatgaaaccagcgagcttaaacatatgtaccgaaactccttgttccaagcaagatcaattactggaccagtgtgggaatctgatgtctagagtgagagaaagacaactaacatgttacatttggaaaaacagaggagctaaataattttcaaaagttggttgtcacacctgcccggctatccgtcccagttgtacacaaggtagcacctcattcacctgaagcattatataatcagcttacaaatcattatctcatgatggataaaacaaaaggtaaacatcatcaaaaaaacagttaacaagtacatacaaggtcaagatcccatatctctatagaggactccattgtcccgatagctacaaagttccctgcgaacacgaaagcaaaacttgaggaaaatgatcataatctcatccacagctattcttggatacacacaaaccttttccccctcctttgagaggacaatcaagccatgctgtgcacaatggaagctcggatataatcatgtcattgcgaagataaatgttttcggattcctcatatacataaacctcgagatagttgacttcatgtttaatagcagcacagatgatcagtgaatcggttggcctaattgtcaagtcatcgtgatcctctgagtcatagtcaccctaggggatatcaagatcagtatttactattgagtctccacaattagtaagagaaaaattaatggtgtttcttacgtcagtatcctttaggtatggatccatgtcattgcttggataataaaggtgtccctgcccagagctaaacagttcaatctctgagtccaaacgcaagaatgaaggaaactgtacattagcatatatgcaatgaaaatatgcaaatatgtaggaaaaacagaagaaagttatataccatcatcctcttcatcatagttatccatgtcgagttctttcaagaacttgacaacttcatcagcatctgttgaagaagaagaagcaaccttgcttttcccaaaagattttgctacagacttggcatgagtaacttgagcattctgaatttcatcgtccatcttttcttccatacaaggagattcagcagcaacaggcatagcctttgatgcctcttttgggatccatgaaagtgcaactatcgtcattctgcaaaaatcaaaagagatttttacttaataagcgcagctcggttaggaaagcagagaacgccatgaagcaactatgaatgaatcagcaaactagagatgacttttagggtctgtaaacttggcaactaaagagcttacgatccaaaaaggtttcaactttaagaaagagagactccaattcatctatacaagactattgtatatacaatgcactatacaaatgaactatatactatgatagcttactatcagaaacgaaaaccacacaacaacgtaggactcgtcgaagaggagaatccaagaagcttgctctgcttgggaacgcgcggcacaaggaggcaaggaggataaacgagaaacgcttgaaagcaattaaaataagggtttcctcttaacttgccatttttctgttttaaagaaaaatcacttttttattctacagtgtttcattttcatatctcacacgtacgaacgaagaatg

SEQ ID NO: 36235 - DNA, 3000 bp, Unknown
  misc_feature (1)..( 3000): 2750-1469P.txt file - cDNA_ID_3093299; gDNA_ID_2926209; Annot_ID_202468
aacgtttagatataaaaaaaacacggatcatttcaaatgggagtcgaggatctgaaggaagtcgacataaacaagttcttaattatataaaaaagtgggcgtcagcttcaagaaacaaagtatcttcccatgtggttcatggtcggctgctaccatatcttcgggacacagcagtgtctgataaggtatcccacacctgcacaagcatgcgtatacatatacgttggttatctcaaaaacagaatttgttatttcttgtaccatcaaaatccctacttacatttagcccctctgagccaccaacagcgagtaagaaggggcagtccgctgagaatgagaccgagaaaacttctccctgtttgatatatcaaagtttggaatggtaaacaaagaaaccagaaacaaacatatggcagcaaaagttcttattcatggctcttacagcatttggcttgtttgtagcaatccatgatggttggttgtttgaaagatcccaaagtttcacactttcatccgcagatcccgtagccaaaagctgcacagctcggatattaaacgactacactatgaatatggtaggagacaagagagaaagagagatatatgtgtgtacattgggggcatgtatgttgtatgatatggaggagacttcactatcatgagcatggataatgaaacttggtgataaatcagaagcacgtgtatcaaagcccttcacagttccatctttgagactcacctaagatggaagaagaaaagttaacgattcacatcagatatctgaatcattcagatgtttgtgttagaagagcaaagaaagcgtaatgcaccacaaaggagtgttcgctgtgaggatcccaagccaatttttcgactttggcctcggtagaccatttcaaacccgagtttgaagggtcccttccatctttctcaaacatatatatatatatatatatatatatataaaagactgatcaacataatgataaaaaaatttcatgtacaagactcaacacataaatggaacaaaacagtcaccaatactacagtacgatcacgagacccactgaggagtacttctggagtataattgttccatgcaaccgcgtgaacctgttagccaaacaacacacaataaataaaccatgagcatgcacagatgctagcttgaaagagcatggaaacagtttcaccttcataccttcttttcgtgatgctccatagtaaccttgcatttccccgtagccacatcccaaaccttcacttttttgtcttcactaccactagcaactatattcctattttcccagttaaaagttaaaaaaaaaagagtctggtaagcaagttctggagattattttcaatcatgaaaccagcgagcttaaacatatgtaccgaaactccttgttccaagcaagatcaattactggaccagtgtgggaatctgatgtctagagtgagagaaagacaactaacatgttacatttggaaaaacagaggagctaaataattttcaaaagttggttgtcacacctgcccggctatccgtcccagttgtacacaaggtagcacctcattcacctgaagcattatataatcagcttacaaatcattatctcatgatggataaaacaaaaggtaaacatcatcaaaaaaacagttaacaagtacatacaaggtcaagatcccatatctctatagaggactccattgtcccgatagctacaaagttccctgcgaacacgaaagcaaaacttgaggaaaatgatcataatctcatccacagctattcttggatacacacaaaccttttccccctcctttgagaggacaatcaagccatgctgtgcacaatggaagctcggatataatcatgtcattgcgaagataaatgttttcggattcctcatatacataaacctcgagatagttgacttcatgtttaatagcagcacagatgatcagtgaatcggttggcctaattgtcaagtcatcgtgatcctctgagtcatagtcaccctaggggatatcaagatcagtatttactattgagtctccacaattagtaagagaaaaattaatggtgtttcttacgtcagtatcctttaggtatggatccatgtcattgcttggataataaaggtgtccctgcccagagctaaacagttcaatctctgagtccaaacgcaagaatgaaggaaactgtacattagcatatatgcaatgaaaatatgcaaatatgtaggaaaaacagaagaaagttatataccatcatcctcttcatcatagttatccatgtcgagttctttcaagaacttgacaacttcatcagcatctgttgaagaagaagaagcaaccttgcttttcccaaaagattttgctacagacttggcatgagtaacttgagcattctgaatttcatcgtccatcttttcttccatacaaggagattcagcagcaacaggcatagcctttgatgcctcttttgggatccatgaaagtgcaactatcgtcattctgcaaaaatcaaaagagatttttacttaataagcgcagctcggttaggaaagcagagaacgccatgaagcaactatgaatgaatcagcaaactagagatgacttttagggtctgtaaacttggcaactaaagagcttacgatccaaaaaggtttcaactttaagaaagagagactccaattcatctatacaagactattgtatatacaatgcactatacaaatgaactatatactatgatagcttactatcagaaacgaaaaccacacaacaacgtaggactcgtcgaagaggagaatccaagaagcttgctctgcttgggaacgcgcggcacaaggaggcaaggaggataaacgagaaacgcttgaaagcaattaaaataagggtttcctcttaacttgccatttttctgttttaaagaaaaatcacttttttattctacagtgtttcattttcatatctcacacgtacgaacgaagaatg

SEQ ID NO: 36236 - DNA, 3003 bp, Unknown
  misc_feature (1)..( 3003): 2750-1469P.txt file - cDNA_ID_3093303; gDNA_ID_2926209; Annot_ID_202466
tgcagcgtttcaatattttgacaaagatggaagcggtttcataacaattgatgagctacaacaagcgtgtgttgaacatggcatggctgatgttttccttgaagacatcatcaaagaagttgatcaaaacaatgtaagcttatatgatgatctgttccacattcctcgctaggctaatgtcgaggcatcagctgataaaaagtcttatcggttcttatgttggtctgaacaggatggaaagattgattatggtgagtttgtggagatgatgcaaaagggaaatgctggtgttggaagaaggacgatgagaaatagtctaaacattagcatgagagacgcgtagaggttgttttccccggtgtttaatatgttagtgcgatcgtgactgcgaaaatgttcttattcatggaatcaacaacctcaatgctcaccacctagaaggcgatgaaagaagaccaaaccggattcatacctgtggatggttcgagttttgtttaacgactgtgtgattaatcgtcaagtagttttggaggttttttctttacctctttgttgtttgttcattatggccattgttgaagttagtgagctttgttcatcatctgccattgttaaactttgttcacttgtatttgaaaaaaacaaaaatgtctttgtatgttgtgtgatttctaagcatttttactttgaaaatctatttcttcttttctagacgatcacgacccttcatccatatcggactacacaactcgatattgaataaatttatatgagaatagtaccaatggcctatgatgtggaagatgatgagctagcaagtctcaatcatgtaaatgaaagtgctttttctaagtaatctgtatttaaactcaaataaaaccaaaactcaaagctgttccaagcaaattattcattggccacaatctgtaatttggaacattatgcaccaaaaccatttttaatgtattttacatatacaggttttttggtacttctcctatacacatggcatattcatattaacaaaaaatatttattttggtgtcacttttcatattttattagtgtaaaataacctcttcttaagagtaacgtatggcaatttggtcagctttgttatttaaaaattatatgttaattagctaaaatacgatcatttgtacccaaattctcttaatttaaaactagtccgacttgaaagtaaaagtttagtttaaactataatcagaacaataaatatcaatacgccaccgacgatttgctgccaccgacaaatgttttgtcggccacacgcgtctcagttttatggaaccgaactctcgttaatactttgcttttttacataccatttttgttgaaaaccccacaaaatgggaaaataattcggtgaaatattttagatttttagttctacttgtatcatgaaattaagagttcttcgacatagattgttgttatcatcaattatcattatgatcattgtgtatatgaaactatacaacgaaattcagaatcataattagatagaagaatctcatgttgtttttcacattaaaaccaaaaaaaaaaaagaatctcatgttggcgcgtaaaagattaaaacgaaaataacggatttttctatataatttgcatggttattaaaatacaaaaatacaactgcacagccacaaactcgtaaccacaaataaaataaataaattgattaataataatctaggcaaattaattatagcaaaatacaacatcaagtttaaaaaaaaaaagacgaattatacattcattatactccattgcacaaaagtaaaaaaagaacagacaaatcacaaaatctcaaccttatatgaatcattttatcgttgacgcttgtatttgcaagaaagaggaagagaatcttctgaagaaggtcccatgaaattacggatctgagatcggagtttgaagaaaacgtgcattatacttcctctgttttgtgaaccaatcgatttagcttcgtctttgttaagctcaagatctctgatgaatataggttttcttgaaaggatccatgaccaaccccattcccaccattctttcacagagcttcctgcttgttctcccatggcggaaacagatttggatctcgggaatctagctgcgatcgctgctggttggtttgagaggttgagtgatagagaagagagacgacggcggatgagaccaggctcatcgtcggcggtggctgctgcattagggcgttgagaaacggggagggaagtgggtttacgaatctggagagtctccatcattgagctcataacttctttgttcttctttgtgttgagagagattgaagaagaagatgaatgtgaatgtgagagattgattagtgaacacagctctaacacaggctggggttttattccactttatttttgtggggtccatttacttttatgcccccagccaattacattcattttgttgttgctgtttgtttttgtattaaataatttgtattgttatgtttatttgttgatttgtatagttagttgttttgtgtatgaatgaatgcacctataatattggaaatataacaattttatttttagtgaatatagataaacattgttttcaggtagggttccatcacaagtcacaatacaaatttaattaaaaaaattctttgtaattttattttaaaggttattttcccagtacagaaatctgttgaaattgcattggctttgatttttttataataaaaatcagaaaaatgtagcagaatctgtccaatgtccatagccaagcaaatttatgttgacagaaaaaagaacaatcacatacaaaaatccaaaaaagaaaaaagatatcccagacgggcctaatcaggtattagactaaggcccaataaatttcaagcccaaaatcgaaattaagcactttattctttctttttttaatagctatcgagtgtgtatgttcggagaagagatcacagagatctgagagcttgaaacaatg

SEQ ID NO: 36237 - DNA, 3000 bp, Unknown; identical to SEQ ID NO: 28912
  misc_feature (1)..( 3000): 2750-1469P.txt file - cDNA_ID_3093311; gDNA_ID_2926209; Annot_ID_202455

SEQ ID NO: 36238 - DNA, 3000 bp, Unknown; identical to SEQ ID NO: 3911
  misc_feature (1)..( 3000): 2750-1469P.txt file - cDNA_ID_3093332; gDNA_ID_1620674; Annot_ID_48191

SEQ ID NO: 36239 - DNA, 3000 bp, Unknown; identical to SEQ ID NO: 3911
  misc_feature (1)..( 3000): 2750-1469P.txt file - cDNA_ID_3093332; gDNA_ID_1620687; Annot_ID_48492

SEQ ID NO: 36240 - DNA, 3000 bp, Unknown; identical to SEQ ID NO: 3911
  misc_feature (1)..( 3000): 2750-1469P.txt file - cDNA_ID_3093332; gDNA_ID_1620687; Annot_ID_164666

SEQ ID NO: 36241 - DNA, 3000 bp, Unknown; identical to SEQ ID NO: 3911
  misc_feature (1)..( 3000): 2750-1469P.txt file - cDNA_ID_3093332; gDNA_ID_1620674; Annot_ID_164184

SEQ ID NO: 36242 - DNA, 3000 bp, Unknown; identical to SEQ ID NO: 3911
  misc_feature (1)..( 3000): 2750-1469P.txt file - cDNA_ID_3093332; gDNA_ID_2926210; Annot_ID_141922

SEQ ID NO: 36243 - DNA, 3000 bp, Unknown; identical to SEQ ID NO: 3911
  misc_feature (1)..( 3000): 2750-1469P.txt file - cDNA_ID_3093332; gDNA_ID_2926210; Annot_ID_202533

SEQ ID NO: 36244 - DNA, 3000 bp, Unknown; identical to SEQ ID NO: 4483
  misc_feature (1)..( 3000): 2750-1469P.txt file - cDNA_ID_3093338; gDNA_ID_2926210; Annot_ID_202571

SEQ ID NO: 36245 - DNA, 3003 bp, Unknown
  misc_feature (1)..( 3003): 2750-1469P.txt file - cDNA_ID_3093345; gDNA_ID_1620708; Annot_ID_165374
ctcatgattcttgaagaagcaaaacacttttgcatcaacaacaacacaacacaacaaaatctaatattttcaaacctctatggtctgtttaatgcttatgtaccaaggcaatgatattgatatacaaacaacacaacgtccattagcctacttagaactttttttccccttctttctctctttagctgccgttttaactacggttttagcgagtgatgatggcttcatggcactcttggggttaagagcttgtctaatcttgaaaacagtccacgccgttccaaaagcatgccctgctgcgctaagcccttcgtttgtcgcttgtgctgtctttgctccatacctacaagtaacatccaaacattaactatctttttggcatggtatgagcacattctcttgtaaactttttcagttacttacttgtgatcgacgatttcagtagttacatctgaagttgttttcataacgtgtcttcctgctacttcgacagcatcacaaaccttgtctgtcacaaatgggtaaacaaatctttattagtttcaatcatcagaagcctaataaagatagataagagatatacgatatagtcaacttactgaatccatcaagtgttgcaagaaccatttctccaggaagaagcccaaagagtttctgcccagctttgctatttatcactgaactcgagaagaatccagaaactttaacaacaccagagagcacaccattcgccactttctctgtcatttttgtcatcttctttactctgttacatatataactcaaaacctcgataaaaagtttaaaacacaaatatcaaagataagcaaataaaggtcgtaccttttgagacgtttcaaagttccaggactaacttgtctctccttctctgctttggacaacttcttcttcatgaaatcatttccccacatgagtctatccattgtgagatccccacaccataagatccctttaatcaattgaccagaaccagcagcgatcagtttcgctgcaacgccactgtaatcctcaacattcggagccagagtcgtccaataagccgtacactgcttctccaccatctttttcctctttcccttcagctcctccggtgaagtctccttcgccgccgtcaaatccaaaacgttctcttctttctgtttctcctccgctgtgaaactactgtaatcagctaagatcttgtctagcttctcaagcatcggttcttgacctttcgaagccattgttaatccgtagttcaacatctcgttctctgtttcgttgactgaatgatccgatgactcggattctttaacgggtcggagcgagaagaagtaatgagactcatcgactttaacggcgggttcgtctttagtcaacggccattggatctcgtcaccgacgcgagcgaaaaccgcgacggtgatatctccttgaacaagacggagaatctcgagatcgccgcaagcgagctctacgctgtaggatttgtcaatgaggtggaccatcgcgccgtggattgtgagaatcacttcctccgtcgcgagaggaggcgctgaagctgagtcagaggcggtgggatcggggaagatattgttgacaagatcattgacattgattgaaggatagagattattattattagtagaagaggaggaggaagaggacttagggagaggagcaacggtggttgaagtgtcgacggttggataaagcttgggaggagttgcagagcattccattatcgccggtgatttaggaggaggaagacgaagggggaatgaagaagaacaagtgtttggttatttatatgaatttgaaaaagatttggggcagaaatagaaaaagtcagaagattagtgatggaagaaagcgaatctagtttgattaactgttaagtaaccttgctgtcggagtctcggagataggaagacgtgggcgttgcgtgtttcaagaggagcatactttttgactatgaaccgggccggtttaaccttttttttaactattttaggagattttcccgcgctttatccaaatattaaatttgtttatatccaaaatttctttttgttgagtgtatattgtacatttgtttattgttttgccaccttttttagtgtcacactaaacaagaattattcaagtaattaagatgtgtaattgactatgataatggtaatctgtattgactttgttttgccaaatgaaattctatttaacagtaggatcttacctaaaccatggaggaaaactttggtttttttttctattagaaaacataaaaggcaaaaaaaatgattaaaaggtataatcaattatgatgatgaaaattttttcttgtataaaaataagaataagatttaaagggatataacacttatactattttttgtataaaaatatatgtctactaaaaacataatattctgtcacatgttattttctattttgtttaagaagaaatcaattgcataatctcatatcactctatgaagtacaattatttgaaaattaaataatagagttttagatgtcaaaaaaaaaatcaatagagtttttagagtaattaaaactgtataaataagtaagattaagaaaatctatagattttaaaaaaaattgtgcaccaaatctaaagagtgaataagatttatttctaacatacagcttttatcccttgacaattgtcatttgacttttgagttatagcagttgtgttgtcatcttgtgtcacttttaatattaaattacaaaacaagtcctcaattttaaaataattaacatcagtgagatcagaatctaaatgttactgtactttacagttgacaatttaattttcactgtactttgtttgacccccaaaaagtactgtgttaaaaaggcaaaaaaaccaaactaaagttcgccgggaagcgaaatcgtcatcttccctgttttgctgtttagtctgcaagagaaatttcagattccggcggagaaagctataacgattcttcaatg

SEQ ID NO: 36246 - DNA, 3003 bp, Unknown
  misc_feature (1)..( 3003): 2750-1469P.txt file - cDNA_ID_3093345; gDNA_ID_2926210; Annot_ID_202561
tcatgattcttgaagaagcaaaacacttttgcatcaacaacaacacaacacaacaaaatctaatattttcaaacctctatggtctgtttaatgcttatgtaccaaggcaatgatattgatatacaaacaacacaacgtccattagcctacttagaactttttttccccttctttctctctttagctgccgttttaactacggttttagcgagtgatgatggcttcatggcactcttggggttaagagcttgtctaatcttgaaaacagtccacgccgttccaaaagcatgccctgctgcgctaagcccttcgtttgtcgcttgtgctgtctttgctccatacctacaagtaacatccaaacattaactatctttttggcatggtatgagcacattctcttgtaaactttttcagttacttacttgtgatcgacgatttcagtagttacatctgaagttgttttcataacgtgtcttcctgctacttcgacagcatcacaaaccttgtctgtcacaaatgggtaaacaaatctttattagtttcaatcatcagaagcctaataaagatagataagagatatacgatatagtcaacttactgaatccatcaagtgttgcaagaaccatttctccaggaagaagcccaaagagtttctgcccagctttgctatttatcactgaactcgagaagaatccagaaactttaacaacaccagagagcacaccattcgccactttctctgtcatttttgtcatcttctttactctgttacatatataactcaaaacctcgataaaaagtttaaaacacaaatatcaaagataagcaaataaaggtcgtaccttttgagacgtttcaaagttccaggactaacttgtctctccttctctgctttggacaacttcttcttcatgaaatcatttccccacatgagtctatccattgtgagatccccacaccataagatccctttaatcaattgaccagaaccagcagcgatcagtttcgctgcaacgccactgtaatcctcaacattcggagccagagtcgtccaataagccgtacactgcttctccaccatctttttcctctttcccttcagctcctccggtgaagtctccttcgccgccgtcaaatccaaaacgttctcttctttctgtttctcctccgctgtgaaactactgtaatcagctaagatcttgtctagcttctcaagcatcggttcttgacctttcgaagccattgttaatccgtagttcaacatctcgttctctgtttcgttgactgaatgatccgatgactcggattctttaacgggtcggagcgagaagaagtaatgagactcatcgactttaacggcgggttcgtctttagtcaacggccattggatctcgtcaccgacgcgagcgaaaaccgcgacggtgatatctccttgaacaagacggagaatctcgagatcgccgcaagcgagctctacgctgtaggatttgtcaatgaggtggaccatcgcgccgtggattgtgagaatcacttcctccgtcgcgagaggaggcgctgaagctgagtcagaggcggtgggatcggggaagatattgttgacaagatcattgacattgattgaaggatagagattattattattagtagaagaggaggaggaagaggacttagggagaggagcaacggtggttgaagtgtcgacggttggataaagcttgggaggagttgcagagcattccatttatcgccggtgatttaggaggaggaagacgaagggggaatgaagaagaacaagtgtttggttatttatatgaatttgaaaaagatttggggcagaaatagaaaaagtcagaagattagtgatggaagaaagcgaatctagtttgattaactgttaagtaaccttgctgtcggagtctcggagataggaagacgtgggcgttgcgtgtttcaagaggagcatactttttgactatgaaccgggccggtttaaccttttttttaactattttaggagattttcccgcgctttatccaaatattaaatttgtttatatccaaaatttctttttgttgagtgtatattgtacatttgtttattgttttgccaccttttttagtgtcacactaaacaagaattattcaagtaattaagatgtgtaattgactatgataatggtaatctgtattgactttgttttgccaaatgaaattctatttaacagtaggatcttacctaaaccatggaggaaaactttggtttttttttctattagaaaacataaaaggcaaaaaaaatgattaaaaggtataatcaattatgatgatgaaaattttttcttgtataaaaataagaataagatttaaagggatataacacttatactattttttgtataaaaatatatgtctactaaaaacataatattctgtcacatgttattttctattttgtttaagaagaaatcaattgcataatctcatatcactctatgaagtacaattatttgaaaattaaataatagagttttagatgtcaaaaaaaaaatcaatagagtttttagagtaattaaaactgtataaataagtaagattaagaaaatctatagattttaaaaaaaattgtgcaccaaatctaaagagtgaataagatttatttctaacatacagcttttatcccttgacaattgtcatttgacttttgagttatagcagttgtgttgtcatcttgtgtcacttttaatattaaattacaaaacaagtcctcaattttaaaataattaacatcagtgagatcagaatctaaatgttactgtactttacagttgacaatttaattttcactgtactttgtttgacccccaaaaagtactgtgttaaaaaggcaaaaaaaccaaactaaagttcgccgggaagcgaaatcgtcatcttccctgttttgctgtttagtctgcaagagaaatttcagattccggcggagaaagctataacgattcttcaatg

SEQ ID NO: 36247 - DNA, 3000 bp, Unknown; identical to SEQ ID NO: 20102
  misc_feature (1)..( 3000): 2750-1469P.txt file - cDNA_ID_3093347; gDNA_ID_1620708; Annot_ID_165364

SEQ ID NO: 36248 - DNA, 3000 bp, Unknown; identical to SEQ ID NO: 20102
  misc_feature (1)..( 3000): 2750-1469P.txt file - cDNA_ID_3093347; gDNA_ID_1620674; Annot_ID_164205

SEQ ID NO: 36249 - DNA, 3000 bp, Unknown; identical to SEQ ID NO: 20102
  misc_feature (1)..( 3000): 2750-1469P.txt file - cDNA_ID_3093347; gDNA_ID_2926210; Annot_ID_202552

SEQ ID NO: 36250 - DNA, 3000 bp, Unknown; identical to SEQ ID NO: 3925
  misc_feature (1)..( 3000): 2750-1469P.txt file - cDNA_ID_3093351; gDNA_ID_2926210; Annot_ID_202551

SEQ ID NO: 36251 - DNA, 3000 bp, Unknown; identical to SEQ ID NO: 3933
  misc_feature (1)..( 3000): 2750-1469P.txt file - cDNA_ID_3093359; gDNA_ID_2926210; Annot_ID_202538

SEQ ID NO: 36252 - DNA, 3003 bp, Unknown; identical to SEQ ID NO: 18672
  misc_feature (1)..( 3003): 2750-1469P.txt file - cDNA_ID_3093417; gDNA_ID_2926211; Annot_ID_202644

SEQ ID NO: 36253 - DNA, 3003 bp, Unknown
  misc_feature (1)..( 3003): 2750-1469P.txt file - cDNA_ID_3093431; gDNA_ID_1620618; Annot_ID_46964
gcctgagacagaactcattggaaaaactgataaaggacacagagtttcgtttgtcacgaagcctctgtttgataaagcgtgtcttcttgatggtgatgatctgaagaggaatcctggaattggggattttgttgaggttcagatagagaaatcaacgagggcatcgttgtttggggaagctctcgcgattagtaaaatgtccttgtttcacgatgttggtgtcgtcgatgctgttgttgcgtcttgtgcaagttaagttgaacttccgttttctttgtttcgaaagcctttatactttttcttctgtatactttcttcatagttaaaccaaataagttatttacagatgaattttattacttttttgaaaacacaaattgtaactgaaatggatagagaaacatttttgggcatacatgtattcctcccctggttcaacgacatgtttcttcgataaagttgacaaaaaaaaggtagagaaacagtgttgaaaatgtcagcgatgaacagaaagagagatcgtcgtcaatggcgatggttagtgatgatttgactatgacaagtcaataaacactatgctctatgcgatggtaattttatatatatctgttagaaagaaaaaaaaggttcatagctcgaggcatttattaaaaaaaaaaaaaaggtgtaacggcagaaagtagtataaattgaattatttcagtttattttgatggtaatataaatctataaattcaaacaatgttttgttaaatatgtttatacatatatgttaggcagaaagcattccaattaattagttgtggaccgaccttttaattaacatttgtactacctccgctttttatcagagacatatattcgattaattaatttggatattaagtctaaagtttaaagaagggaaagaaaaaaactccaatcacatgtcgtaggaatcacactccccaataataaagttggattagtatttctcaagaacaaagttggtattcacatatctaaatttgtaagatgaaatatacgagtacaaccagaacctaatataatatataggttttggattagtactgtatttctactgatatcgataatcatagtttaataatttagtgtcattggcaaataaaatatttaatacactgattatcataatttatgtgactgacatgtttattataataagatcatggattaatcagtgaacttatgttcatcattgtttccaagtctaaaagcagatctcgatatatatttatatttttcaatgcgcttgatgatatttaattcgacctatagtatcaatcttgggttttactttgtttttaatcatatgctttaccaataagcaatgtttgttcagggaagtggatcctattattgagatttaaacatattgaggcatgcacaagtataataattattcgttattggtgttaagtaactcattttatctgtcaatctataacgaaattatactcatttttttcttctataaatggataaaccaaaaatgaatagaaaataaattaataaataaaaattggttgggggtgagaagtagctatctaatatctaaaaatgagacgagacaaaacggcctaagcgtggcgcaatagccgctcccaatttctgtcccctcatttattcctcactattgttttgaaaattctgttttgttgcaatcttagaattaaatactattaacgtcgacttgaagctacaaattttggaaatttggatccgatgtttataactcatggatcaaataaatgaaagatgcatatgaatctgattttctaatgattttgaaatatgaataatcaaatatttatatatatacatctaataagtaggaaaataatttcataataataatcattgtctaaataatcagacctatataaaaatagaatattatcaagtaaatttatacaaaaatataccattaaaatactctgtatatagaaatatgtgaaactgtatttgatcactgtctatcgttagtcgttccaaaagatcctattgatttaggagtatttagtagtaaatacctttataatgatggacaacttaattaccgtgtgatacagtcaatgaataattaaataagagagcactaaaattaattatgtgtttctattaaaagagaatgttacaataataatcttatttaacaaaaaaaaaaaatattacaagagaatatcattttctattctaaaattagcttatgagaggaattagatatttaattccataaaaattgattttgtagctatatcaaatttcttataaagatggaatgggtaatcagaaaaatatcaatacattgatacatatgtcattatgctgttgaccaaaaaatgtcattatgcttattaagttgttgacatactaaaaattcaagattatactagtaattaactacttaagatgaatttaacgaaaataaaactattttagattttttagcttggtaattaagttgtttttagtgggtttttaagtttaagtatatatgcaatacatatttggattgtatatagtgagatacgggtaaaagtggattttatatcattaattcctctgtttctcccccattgaaaatgacatcaccatggctttaagctctacaaatacaaatatttattctctcactttctctgcctgcatggtttttgagaattgagaaaacccttttaaaattctctatcgatctcatcacaaattttgctatatccacaattcatgtgcttaggcatatagttattcccaagaaaccggtttaactgtttacgtatgcaacctccggcaagcgcaggacttttccggtcgccggaaaatctcccttggccttataattacatggattatttggtcgctggtttcttggttttgacggccggaatacttctccgtccatggctctggttacgtctacgaaactcgaaaacgaaagatggagatgaagaagaagataatgaggagaagaagaagggaatg

SEQ ID NO: 36254 - DNA, 183 bp, Unknown; identical to SEQ ID NO: 3698
  misc_feature (1)..( 183): 2750-1469P.txt file - cDNA_ID_3093431; gDNA_ID_1620656; Annot_ID_47871

SEQ ID NO: 36255 - DNA, 3003 bp, Unknown; identical to SEQ ID NO: 36253
  misc_feature (1)..( 3003): 2750-1469P.txt file - cDNA_ID_3093431; gDNA_ID_1620618; Annot_ID_162151

SEQ ID NO: 36256 - DNA, 3000 bp, Unknown
  misc_feature (1)..( 3000): 2750-1469P.txt file - cDNA_ID_3093431; gDNA_ID_2926211; Annot_ID_141979
tgagacagaactcattggaaaaactgataaaggacacagagtttcgtttgtcacgaagcctctgtttgataaagcgtgtcttcttgatggtgatgatctgaagaggaatcctggaattggggattttgttgaggttcagatagagaaatcaacgagggcatcgttgtttggggaagctctcgcgattagtaaaatgtccttgtttcacgatgttggtgtcgtcgatgctgttgttgcgtcttgtgcaagttaagttgaacttccgttttctttgtttcgaaagcctttatactttttcttctgtatactttcttcatagttaaaccaaataagttatttacagatgaattttattacttttttgaaaacacaaattgtaactgaaatggatagagaaacatttttgggcatacatgtattcctcccctggttcaacgacatgtttcttcgataaagttgacaaaaaaaaggtagagaaacagtgttgaaaatgtcagcgatgaacagaaagagagatcgtcgtcaatggcgatggttagtgatgatttgactatgacaagtcaataaacactatgctctatgcgatggtaattttatatatatctgttagaaagaaaaaaaaggttcatagctcgaggcatttattaaaaaaaaaaaaaaggtgtaacggcagaaagtagtataaattgaattatttcagtttattttgatggtaatataaatctataaattcaaacaatgttttgttaaatatgtttatacatatatgttaggcagaaagcattccaattaattagttgtggaccgaccttttaattaacatttgtactacctccgctttttatcagagacatatattcgattaattaatttggatattaagtctaaagtttaaagaagggaaagaaaaaaactccaatcacatgtcgtaggaatcacactccccaataataaagttggattagtatttctcaagaacaaagttggtattcacatatctaaatttgtaagatgaaatatacgagtacaaccagaacctaatataatatataggttttggattagtactgtatttctactgatatcgataatcatagtttaataatttagtgtcattggcaaataaaatatttaatacactgattatcataatttatgtgactgacatgtttattataataagatcatggattaatcagtgaacttatgttcatcattgtttccaagtctaaaagcagatctcgatatatatttatatttttcaatgcgcttgatgatatttaattcgacctatagtatcaatcttgggttttactttgtttttaatcatatgctttaccaataagcaatgtttgttcagggaagtggatcctattattgagatttaaacatattgaggcatgcacaagtataataattattcgttattggtgttaagtaactcattttatctgtcaatctataacgaaattatactcatttttttcttctataaatggataaaccaaaaatgaatagaaaataaattaataaataaaaattggttgggggtgagaagtagctatctaatatctaaaaatgagacgagacaaaacggcctaagcgtggcgcaatagccgctcccaatttctgtcccctcatttattcctcactattgttttgaaaattctgttttgttgcaatcttagaattaaatactattaacgtcgacttgaagctacaaattttggaaatttggatccgatgtttataactcatggatcaaataaatgaaagatgcatatgaatctgattttctaatgattttgaaatatgaataatcaaatatttatatatatacatctaataagtaggaaaataatttcataataataatcattgtctaaataatcagacctatataaaaatagaatattatcaagtaaatttatacaaaaatataccattaaaatactctgtatatagaaatatgtgaaactgtatttgatcactgtctatcgttagtcgttccaaaagatcctattgatttaggagtatttagtagtaaatacctttataatgatggacaacttaattaccgtgtgatacagtcaatgaataattaaataagagagcactaaaattaattatgtgtttctattaaaagagaatgttacaataataatcttatttaacaaaaaaaaaaaatattacaagagaatatcattttctattctaaaattagcttatgagaggaattagatatttaattccataaaaattgattttgtagctatatcaaatttcttataaagatggaatgggtaatcagaaaaatatcaatacattgatacatatgtcattatgctgttgaccaaaaaatgtcattatgcttattaagttgttgacatactaaaaattcaagattatactagtaattaactacttaagatgaatttaacgaaaataaaactattttagattttttagcttggtaattaagttgtttttagtgggtttttaagtttaagtatatatgcaatacatatttggattgtatatagtgagatacgggtaaaagtggattttatatcattaattcctctgtttctcccccattgaaaatgacatcaccatggctttaagctctacaaatacaaatatttattctctcactttctctgcctgcatggtttttgagaattgagaaaacccttttaaaattctctatcgatctcatcacaaattttgctatatccacaattcatgtgcttaggcatatagttattcccaagaaaccggtttaactgtttacgtatgcaacctccggcaagcgcaggacttttccggtcgccggaaaatctcccttggccttataattacatggattatttggtcgctggtttcttggttttgacggccggaatacttctccgtccatggctctggttacgtctacgaaactcgaaaacgaaagatggagatgaagaagaagataatgaggagaagaagaagggaatg

SEQ ID NO: 36257 - DNA, 3000 bp, Unknown; identical to SEQ ID NO: 36256
  misc_feature (1)..( 3000): 2750-1469P.txt file - cDNA_ID_3093431; gDNA_ID_2926211; Annot_ID_202623

SEQ ID NO: 36258 - DNA, 3003 bp, Unknown; identical to SEQ ID NO: 33690
  misc_feature (1)..( 3003): 2750-1469P.txt file - cDNA_ID_3093443; gDNA_ID_2926211; Annot_ID_202606

SEQ ID NO: 36259 - DNA, 3000 bp, Unknown
  misc_feature (1)..( 3000): 2750-1469P.txt file - cDNA_ID_3093488; gDNA_ID_1620618; Annot_ID_46927
ggctccgctaaaacacaatagagttacaaaccaatttaacattttttgaattttcttgcatagaaactctaaaaaacaaaaccagaagttcgcaagaacatattttttgcttccatgattgcaaaatgaggtatgtgaatagaccgatgagcatatgtcttgatcaacactatcaagtttcaaacaaagaaaaggtaataatacttatcatggtgtgacaaaaacataggagcatcgtttggttttttagcgtttgcaatcatgattagcgcgtcttaaaaactgacgaatgcgtcttattagatatggtttattaatgaaccaaaaaaataggtgcgtactgatatatcttaccggccctattgcaatttttaaaaaaagttagtatatagatcgttagcgttagttcttttgtgaagctacgtacgagatcatagtgaataaaaacatgcatgcaattgagaaaattgtagcaaatagaaagactcagcttgctctttcacgtcttattgggttacgttcctttcaatgaatagctagctaataagcattggtaagttaaaagaattgacctaatcacgtttaccaataaatgagattgcgacaccagtaaataatctgttcacaatttcactaataaacaaatagaagctagtgaccctaaaagtaaaagctttaataaagcatactcgaaatgtttttctcttttcctttttgggtcaacactgaagttgttttatgaaaaaacaattgggacacagcctctctccgtctcgcgcgtcgccatcattgttgaagccaaaaaggccatgcacatctacagaccaatgaatttcagaaatattttgcataattttaaatagaatactaaatatatgatatatggtgctagttttttttttcgttttaaaaaatgctgatattgtattttattgtctgataatatatatctatatatatacatgtaaattttttgtacttaatttaaataaaaactcactatatagtgtgcattcacataaaagatcatttctatatttataatagttaattgttggaattcgttggtttaaaaatccaatagaattccatggatccttctgtagtggattaataggcatgatatcttaaaacagctaagccttaatctttagttgtttaaaataacaattaaagattctcaattactcgattaagacactaatcaccaccacaatctttacgattaaaacattgaacggcaaaacacaacgtggacggtccaaaaatcactcacgtggagtaaaaattagataaactttccataaatataaaaacagtacaatatattgtctctctttgccactttcgaggtccaacctgtctctggttcctctactacatcacataacacgattagagctttaagcacatggttcgcaactaaacagatcttgtcattagctccttagtttaagtttataaatttccataaatagttttcgtaaacgtggcattgctaatttgctatgaacacaagattcgtcaccgatgacagctataaaagaggaggcttttctagattgctcttgggtttggtcctagattcgtggggtttgagtttttaacatattttcaaaagaaaattctcttaattagtcttaatttattgctctaagtttacaatattctttctattttggttcttgcagctttaagcgcgatcttgtattattttcatggtggtccaaactagtacctggcacaacatagaagcatatggtattatttaactaataatgtttttaatcaatcgaagtatacatacattaatttatcggttgatataaaattatatttccttttccagacattaaccaatcagataagatctacattagctctaactaaccacagtataataaataccaaatttttagcatgttcgattcaacattttaaagtacttcttctttaacattaatctaccagtagcgtttgaaatttcaattacttataaccaatagttgaaatttgacttttggtttaactattaactattattctccaaagatatgcttcgcttttcttctaattgtaacattatgattgataattttcatgcaactccttttctctagatcgtaggtaggaggatattaggttaatttgactacgctagagatttaaattagtacgctttcgaacaagtcaaaagacaccatcgggttagccactaagaaagcaatcatcatatacatcaattaattataatactacttatatacctgtactatatacactcatgcataaaaagtaaaaacgattctctctttatcaaatttagattctggatcgttaaaaagtagtaaaaaatgagaaaacttttacaagataaatttgatgagtcaccctcatcatattatagttagaggctaataatttataaataatgtcaaaacaattttctctatgtacatattattacggagcgattacatatatcattcacaactttagtcattttgttaaccctaatataatgtgatatcaaaacggaatattaataacgttatacattacaatttttgtaataaattttgattttaatcactaatcagttacttgttgccattatattgatcggggatcccttattgataggcccaatatgaatgagctcagttatattttgggttttttctcatagcataaatggcccaatgaaagcctattaagtgatcgaaggtcagacgttggactccttgtatgaaaccaacagactaggcccaaattatcaactcaaaattgaccgtaacatatacggcgccgtttttgtagacctgagtgtgataaagtgagctgttaaatcttcacttaaccccatttttaatcacgaaattagagtggtgattaaaaatacaactaaagttgtttcaagtgattgttttcatttatttaaattttaaattaatccaactttatcgttgacggaaaatttgggagagaatattctcgatg

SEQ ID NO: 36260 - DNA, 3000 bp, Unknown; identical to SEQ ID NO: 36259
  misc_feature (1)..( 3000): 2750-1469P.txt file - cDNA_ID_3093488; gDNA_ID_1620618; Annot_ID_162105

SEQ ID NO: 36261 - DNA, 3003 bp, Unknown
  misc_feature (1)..( 3003): 2750-1469P.txt file - cDNA_ID_3093488; gDNA_ID_2926212; Annot_ID_142016
accggctccgctaaaacacaatagagttacaaaccaatttaacattttttgaattttcttgcatagaaactctaaaaaacaaaaccagaagttcgcaagaacatattttttgcttccatgattgcaaaatgaggtatgtgaatagaccgatgagcatatgtcttgatcaacactatcaagtttcaaacaaagaaaaggtaataatacttatcatggtgtgacaaaaacataggagcatcgtttggttttttagcgtttgcaatcatgattagcgcgtcttaaaaactgacgaatgcgtcttattagatatggtttattaatgaaccaaaaaaataggtgcgtactgatatatcttaccggccctattgcaatttttaaaaaaagttagtatatagatcgttagcgttagttcttttgtgaagctacgtacgagatcatagtgaataaaaacatgcatgcaattgagaaaattgtagcaaatagaaagactcagcttgctctttcacgtcttattgggttacgttcctttcaatgaatagctagctaataagcattggtaagttaaaagaattgacctaatcacgtttaccaataaatgagattgcgacaccagtaaataatctgttcacaatttcactaataaacaaatagaagctagtgaccctaaaagtaaaagctttaataaagcatactcgaaatgtttttctcttttcctttttgggtcaacactgaagttgttttatgaaaaaacaattgggacacagcctctctccgtctcgcgcgtcgccatcattgttgaagccaaaaaggccatgcacatctacagaccaatgaatttcagaaatattttgcataattttaaatagaatactaaatatatgatatatggtgctagttttttttttcgttttaaaaaatgctgatattgtattttattgtctgataatatatatctatatatatacatgtaaattttttgtacttaatttaaataaaaactcactatatagtgtgcattcacataaaagatcatttctatatttataatagttaattgttggaattcgttggtttaaaaatccaatagaattccatggatccttctgtagtggattaataggcatgatatcttaaaacagctaagccttaatctttagttgtttaaaataacaattaaagattctcaattactcgattaagacactaatcaccaccacaatctttacgattaaaacattgaacggcaaaacacaacgtggacggtccaaaaatcactcacgtggagtaaaaattagataaactttccataaatataaaaacagtacaatatattgtctctctttgccactttcgaggtccaacctgtctctggttcctctactacatcacataacacgattagagctttaagcacatggttcgcaactaaacagatcttgtcattagctccttagtttaagtttataaatttccataaatagttttcgtaaacgtggcattgctaatttgctatgaacacaagattcgtcaccgatgacagctataaaagaggaggcttttctagattgctcttgggtttggtcctagattcgtggggtttgagtttttaacatattttcaaaagaaaattctcttaattagtcttaatttattgctctaagtttacaatattctttctattttggttcttgcagctttaagcgcgatcttgtattattttcatggtggtccaaactagtacctggcacaacatagaagcatatggtattatttaactaataatgtttttaatcaatcgaagtatacatacattaatttatcggttgatataaaattatatttccttttccagacattaaccaatcagataagatctacattagctctaactaaccacagtataataaataccaaatttttagcatgttcgattcaacattttaaagtacttcttctttaacattaatctaccagtagcgtttgaaatttcaattacttataaccaatagttgaaatttgacttttggtttaactattaactattattctccaaagatatgcttcgcttttcttctaattgtaacattatgattgataattttcatgcaactccttttctctagatcgtaggtaggaggatattaggttaatttgactacgctagagatttaaattagtacgctttcgaacaagtcaaaagacaccatcgggttagccactaagaaagcaatcatcatatacatcaattaattataatactacttatatacctgtactatatacactcatgcataaaaagtaaaaacgattctctctttatcaaatttagattctggatcgttaaaaagtagtaaaaaatgagaaaacttttacaagataaatttgatgagtcaccctcatcatattatagttagaggctaataatttataaataatgtcaaaacaattttctctatgtacatattattacggagcgattacatatatcattcacaactttagtcattttgttaaccctaatataatgtgatatcaaaacggaatattaataacgttatacattacaatttttgtaataaattttgattttaatcactaatcagttacttgttgccattatattgatcggggatcccttattgataggcccaatatgaatgagctcagttatattttgggttttttctcatagcataaatggcccaatgaaagcctattaagtgatcgaaggtcagacgttggactccttgtatgaaaccaacagactaggcccaaattatcaactcaaaattgaccgtaacatatacggcgccgtttttgtagacctgagtgtgataaagtgagctgttaaatcttcacttaaccccatttttaatcacgaaattagagtggtgattaaaaatacaactaaagttgtttcaagtgattgttttcatttatttaaattttaaattaatccaactttatcgttgacggaaaatttgggagagaatattctcgatg

SEQ ID NO: 36262 - DNA, 3003 bp, Unknown; identical to SEQ ID NO: 36261
  misc_feature (1)..( 3003): 2750-1469P.txt file - cDNA_ID_3093488; gDNA_ID_2926212; Annot_ID_202676

SEQ ID NO: 36263 - DNA, 3003 bp, Unknown; identical to SEQ ID NO: 17777
  misc_feature (1)..( 3003): 2750-1469P.txt file - cDNA_ID_3093499; gDNA_ID_2926212; Annot_ID_202717

SEQ ID NO: 36264 - DNA, 3003 bp, Unknown
  misc_feature (1)..( 3003): 2750-1469P.txt file - cDNA_ID_3093515; gDNA_ID_2926212; Annot_ID_202706
agttcccgtatgtgtcacccacgcggaagcagctcatggttgatctcatgtcgacggtggagaatcgcctccaatcacaactccttccctgtaacctccctccagatgtacgaaacttcaataaccctaacggttccgccgaagcatctcttcatatcagatccggcgacaaatcttctccggtacttgcgacgattaactctgtttttcagttatgagatcgaaattgactgttttgcatgcttgttttagagctcaattgcttgattttaagtagaaacagacttcaatttcgatgtaaatcataaccctaaaaaaaaactttttagagaatcttaaagtttgttttgttttgcagattgattttgttataggaagttggatacattgcaagatcccaacaggagtatctttgaatataacaagcatctctggattcttaaactcatcaacaaaagctccaaactttgtggtcgaactaatacagagcagttccaagtcgcttgtgctaatccttgacctcccacatcgtaaagatcttgttcttaacccggattatctcaaggagtattaccaagacactgctcttgattctcatcgacaatctctccttaagctacctgaagttaacccttatgtgtctccttctctctttgtccgttctgctttctctcctactgcttcgatgcttaagattgatgcggaggaagaggataagttggaggagatattgagagatcatgttagtccagctgctaaggaggttctcgaggtttggttggagcggtgtgtgaaggaagaagaagagaagattgtggttggggaagaagagagaatggagttggagagaagagataaaagctttagaaggaagagcatagaggacgatttggatttgcagtttccgagaatgtttggtgaagaagtttcctcccgtgttgtacacgctattaaagaagctttcggtgttctctagattatgtaactatatatatacatcagttaatgttcattgtactaaacatttactttcatcaatgtcacaagaacgcaagatgaccatcaaacaagtcctgttttctcctaagaacgtctttgttgtgaatcatctctgaatcggattccttctgattcattttaatactatgggattgtaaatttatcaatcaagtttctaatttatctgtaaaaaaaagtcttgaattattgtttttctcatggattttaaagtttttttttcactattttacatggatgttttgttaaatttctcgttctctagatcatgtcattttacattagcaaaaccaatataatatatagattaatattaacgaaggaacataaacgtgcaaaactaaaagttttaaagctaaatcgctttcaaaagagttagtaaccagacaaaaaagagacagatcatcggcaactaatctcgtcatcgcatgcatcataaaccaaattaactaaatcatccatttaatccatttgttcttatcagatcatccttttccttcctacacaagaaatggttagtgttttcttttctcgattgtctcttagtttagattctttatccgactactttgttcatcggttttgtttttctttttgtcttccggaaggcgaattacatgtcggaagcagcacagctcagaagaggtctaaagcctaaagggaagacttatgggttgaccaatcagaagagacgagagatcagagagatctttgatcttttcgacatagacggttcaggtaaactattaaaccgattctttatccgatttacaaagttattgctcacatgatttagtgcatcatttcatatgtaggtagcatcgatgctagcgagctcaacgttgctatgaggtcaacggcaatttttctttctttttcaaagttattttcttcaagttctagttaagtatagtactaaaaaattatcagctgattacaggtctcttggatttgagatgaataatcaggtttgtttgttttccttccttttttcttctttgttttaatttcatggtttagatcattgtacgtagaaccaacttgtatttagtttggtcatgttcattgttgcagcaaataaacgaattgatggcagaagtagataaaaaccaaagtggagccatagatttcgacgaatttgtgcatatgatgacaaccaaattcggagaacgagactccatagacgaattgtctaaggcgtttaagatcattgaccacgacaataatgtgaataaatctaaacctgtcattatttcattctttttaatattatctttttttgtttggattgatttcattgtgtttgactggacaacttttggaatgttttaggggaagatttcacctcgtgatataaagatgattgctaaagaattgggagaaaatttcacagataatgatatagaagaaatgatcgaagaagcagaccgtgacagtaagcaaaaacacataataattttgcgttttatctataatcggtccctcaagttcatgtttttgccttaacctacgcagaagatggagaagttaacttggaggagttcatgaagatgatgaagagaacctcttacggctaagtataaatcaattagtaatggttgtgaataatatttgttaatcaccttgatttataataataaagaagtttgatttgtggcttggtcgaataaaaatgtattgttgtataaaaataataatgtaattcacatccattattttgaatatgtaaatgtccttgaacgaacatttgttttatcattttttatgtataaatgtctttgaccaaaaaataaattatgtaaaatatgaaccagaaacgatgttgtttagatctgatacttacatataaccaaacgacgacgttgctagagtaataaatctcaaaagactggaaacgactgcgtataagtccgtgacctggttaccggagcgtaacttctccggcgaattggacaattttgagaaagacggattatggactccatg

SEQ ID NO: 36265 - DNA, 3000 bp, Unknown
  misc_feature (1)..( 3000): 2750-1469P.txt file - cDNA_ID_3093519; gDNA_ID_1621088; Annot_ID_170580
cagtttctctacactttcttcttctccaactctacctctgtttttatatatatactcttgagatatttattttcttaagaagaaaaaaagttaatagtttgttgtaaacaagtgtatttatgtaattaatgcacgtgattatataagtatatggatttatctaaaaaaatattttaccaatttataagaatttgctcttggccaagagaagaaatagcggtccataaaggaaacgtgggtggtgtgagaagattcttgttgttgcccactgtagaataacaaaaaaaaaatcattaattaaaaataaactatagcagtatagcactataaaaatataaaattaagtaatttgattactaaattgtactttgataagatagtgtttcttaaatatgatttttagctataaaagatagagatatattgttatcctgtaaatttaatgaatatttaaagatgtatatttataattgtttgatgtttttctattttattgatttgataaattagatttgtagttgtacacgtttgtttcaagatctaccatgtgattcgcgtttttcttagtagcgtaaaaatcggatggaagattctgtcaaatttttctttgagattctttttccctaccgtgtgaagtagtatttatatggctgtgaatattggttattatttattgatggggtgatggtgatgcgtgattttctcttgtagaaacagtgttgattttagaaaacaattgtgaaaatctcacccacacatgtcattaaaaaacatgtgcatgcatgctcaaaatctctactcattgctgaattatttgttgcaaataatatcttgattttggttttagtttagaccattttcaagtttagtgttctccggatatagaataaacttagattgatttcccttgagaatttgttatacgtaagataaggaatattcatgaaactcataaatgtttctaaatcttttggttgttagagaaactaataacatacgtacggatctcaatatatcacttctatggcaagaaatctgattaacaataattagcaaacctataacactttgtatgataagtccacatcggtaattatagcttgataaaaatttaaaagacatttaatcaaagtaccagaaatcccacaatgccttgtagttaaagactttgtgacttgccaacaatgttaatcgaactctcacagtttttatttattttaaatccatatatgcttaaagtagtcctacaatgatctgaattaaaacaaaaagaaatgacccaaatttatacttaattattacaaattttggtaagacaaaatggtgtgaactctgaagtggtcgccacaaaataaaataaaataaaaaacataaaatggcgtgtgaataaaagaaagactcgtagacgattgaaacatgtcaaatttattcacacggacgttatataaactttgacgtaaccaattgaaatttccaccataaggagtagtgaagtatggtcaatgattaaacgataacaacaattgcatggcgacttctctctctcttttattacttaaaaattgaccgtttaccattattagatgcaccaaccttcattttcattatgattagtatgagttgtttatatgcacaaaaacttataaatgaaggataattgacatatagtcatatagattaatagaggaatgtaaaaaagcacaataaatccttcttttttaactaacaattgtgaaaactatatataacatgtggaagtagttattagagtgaaatggttaaaactattttctaaaaatacgaacgttacttagaatttaaattttgatcaaaggcttcacgtggtaaacacaagagtaatacataaggttaattaagatgaatgttgaaagaaactaacaaatacaaaaagtaaaaataatatatagaataagttaagttattggagtgaatgacaaaataaaataaaaatacatgggacaaagataaacaaaattaatctagggggaaaagaagttacgaacagtaattagaatttcaaatcttcttctcagatttcacgtggtaaacaaaagaagaataaacaagacaaaattgaataatttaataaagaataaaaaatataaaattatattattatggaagtgaatgataaattaagaagttacgaacattaattcgaatttcaaattttattcaggcttcacgtggtaaagtaaacacaagatgaataatttaatgagataaaataaatgggaaaaaggtcatttaaatcaccatttcgccatttgtggtgatttaaatcataaactttgttttttgtgattaaaatgatgtgttgacttcaaataaaattaataactttagttgacaaagccaaattagtcacatccgtacccacaacttcttcatcgacactaactttttcgtgcaagtcatcaagatttccgtcttcatcttcaccgtcttcctcgccagcagcttcgtatccaatttcatcacaatctttatctcaatcttcgtattattcagttaacgttatgactaatttggctttgtcaacgaaagttactgattttatttgaagtcaacacctaattgatgattttaatcataaaaagcaaagttcatgataaatcaccacgaatggcaaagtggtgatttaaatgacatttttcctcctaaaataaacagaatagaatatatgatatacttacagctattgtttgctagtatccaaataaaaaatttgtacacaatcaatttatattcactatgtattttggttttaaaactccatataccttaagctatatgatttagttttatgtttgttaaaaagattcaagcccattatgagggctgagttgttatattataaggcctaattaaacccaattaagataagcccattgattcttatggcccattgattcttatgggcttaccggcaaaaaacatgaatgttcaacacgtgtcaccaatcgcggagctacaatg

SEQ ID NO: 36266 - DNA, 3003 bp, Unknown
  misc_feature (1)..( 3003): 2750-1469P.txt file - cDNA_ID_3093519; gDNA_ID_2926212; Annot_ID_202700
aaacagtttctctacactttcttcttctccaactctacctctgtttttatatatatactcttgagatatttattttcttaagaagaaaaaaagttaatagtttgttgtaaacaagtgtatttatgtaattaatgcacgtgattatataagtatatggatttatctaaaaaaatattttaccaatttataagaatttgctcttggccaagagaagaaatagcggtccataaaggaaacgtgggtggtgtgagaagattcttgttgttgcccactgtagaataacaaaaaaaaaatcattaattaaaaataaactatagcagtatagcactataaaaatataaaattaagtaatttgattactaaattgtactttgataagatagtgtttcttaaatatgatttttagctataaaagatagagatatattgttatcctgtaaatttaatgaatatttaaagatgtatatttataattgtttgatgtttttctattttattgatttgataaattagatttgtagttgtacacgtttgtttcaagatctaccatgtgattcgcgtttttcttagtagcgtaaaaatcggatggaagattctgtcaaatttttctttgagattctttttccctaccgtgtgaagtagtatttatatggctgtgaatattggttattatttattgatggggtgatggtgatgcgtgattttctcttgtagaaacagtgttgattttagaaaacaattgtgaaaatctcacccacacatgtcattaaaaaacatgtgcatgcatgctcaaaatctctactcattgctgaattatttgttgcaaataatatcttgattttggttttagtttagaccattttcaagtttagtgttctccggatatagaataaacttagattgatttcccttgagaatttgttatacgtaagataaggaatattcatgaaactcataaatgtttctaaatcttttggttgttagagaaactaataacatacgtacggatctcaatatatcacttctatggcaagaaatctgattaacaataattagcaaacctataacactttgtatgataagtccacatcggtaattatagcttgataaaaatttaaaagacatttaatcaaagtaccagaaatcccacaatgccttgtagttaaagactttgtgacttgccaacaatgttaatcgaactctcacagtttttatttattttaaatccatatatgcttaaagtagtcctacaatgatctgaattaaaacaaaaagaaatgacccaaatttatacttaattattacaaattttggtaagacaaaatggtgtgaactctgaagtggtcgccacaaaataaaataaaataaaaaacataaaatggcgtgtgaataaaagaaagactcgtagacgattgaaacatgtcaaatttattcacacggacgttatataaactttgacgtaaccaattgaaatttccaccataaggagtagtgaagtatggtcaatgattaaacgataacaacaattgcatggcgacttctctctctcttttattacttaaaaattgaccgtttaccattattagatgcaccaaccttcattttcattatgattagtatgagttgtttatatgcacaaaaacttataaatgaaggataattgacatatagtcatatagattaatagaggaatgtaaaaaagcacaataaatccttcttttttaactaacaattgtgaaaactatatataacatgtggaagtagttattagagtgaaatggttaaaactattttctaaaaatacgaacgttacttagaatttaaattttgatcaaaggcttcacgtggtaaacacaagagtaatacataaggttaattaagatgaatgttgaaagaaactaacaaatacaaaaagtaaaaataatatatagaataagttaagttattggagtgaatgacaaaataaaataaaaatacatgggacaaagataaacaaaattaatctagggggaaaagaagttacgaacagtaattagaatttcaaatcttcttctcagatttcacgtggtaaacaaaagaagaataaacaagacaaaattgaataatttaataaagaataaaaaatataaaattatattattatggaagtgaatgataaattaagaagttacgaacattaattcgaatttcaaattttattcaggcttcacgtggtaaagtaaacacaagatgaataatttaatgagataaaataaatgggaaaaaggtcatttaaatcaccatttcgccatttgtggtgatttaaatcataaactttgttttttgtgattaaaatgatgtgttgacttcaaataaaattaataactttagttgacaaagccaaattagtcacatccgtacccacaacttcttcatcgacactaactttttcgtgcaagtcatcaagatttccgtcttcatcttcaccgtcttcctcgccagcagcttcgtatccaatttcatcacaatctttatctcaatcttcgtattattcagttaacgttatgactaatttggctttgtcaacgaaagttactgattttatttgaagtcaacacctaattgatgattttaatcataaaaagcaaagttcatgataaatcaccacgaatggcaaagtggtgatttaaatgacatttttcctcctaaaataaacagaatagaatatatgatatacttacagctattgtttgctagtatccaaataaaaaatttgtacacaatcaatttatattcactatgtattttggttttaaaactccatataccttaagctatatgatttagttttatgtttgttaaaaagattcaagcccattatgagggctgagttgttatattataaggcctaattaaacccaattaagataagcccattgattcttatggcccattgattcttatgggcttaccggcaaaaaacatgaatgttcaacacgtgtcaccaatcgcggagctacaatg

SEQ ID NO: 36267 - DNA, 3003 bp, Unknown; identical to SEQ ID NO: 17754
  misc_feature (1)..( 3003): 2750-1469P.txt file - cDNA_ID_3093523; gDNA_ID_1621088; Annot_ID_170582

SEQ ID NO: 36268 - DNA, 3000 bp, Unknown; identical to SEQ ID NO: 17755
  misc_feature (1)..( 3000): 2750-1469P.txt file - cDNA_ID_3093523; gDNA_ID_2926212; Annot_ID_202699

SEQ ID NO: 36269 - DNA, 3000 bp, Unknown; identical to SEQ ID NO: 6292
  misc_feature (1)..( 3000): 2750-1469P.txt file - cDNA_ID_3093527; gDNA_ID_1621088; Annot_ID_170583

SEQ ID NO: 36270 - DNA, 3003 bp, Unknown; identical to SEQ ID NO: 16916
  misc_feature (1)..( 3003): 2750-1469P.txt file - cDNA_ID_3093527; gDNA_ID_2926212; Annot_ID_202698

SEQ ID NO: 36271 - DNA, 3003 bp, Unknown
  misc_feature (1)..( 3003): 2750-1469P.txt file - cDNA_ID_3093548; gDNA_ID_2926212; Annot_ID_202680
ttgttgttgtttaggtcccaacaaaagtgaacaaaaaagacaggccacatggtgggggtccattatcctccccgctcgtggaggtttcctttttatatcacctaactcaacacaacaaactcttaaactaatcacaataattaagaaaccaaactaaaattaaactctggtctatggaaagctaagtggatatcatattactacatccgcaaagatattaactctttacaaaccgattttttcctgtgatcaattaagatattatatatctctaagaacattatcatcatcacagtgataaattaagtataaacggagaatgtaacggtatgtttaaggttcgacccttttcgaccttcctcgaccatgcgagctccggctccaatgtactgtacaatgctgaagattttctctgttatggtccacaaggagactgatctgatcttttaccaccattttcaaactgatttcatgtttcgatttaccggtttttcagcatctggctttagtgccaccgagagtgagttcgagatcttctacgccaacttcatgaatcatttcgccttcccacggcttaactgttccattctcaaactcaaactctgcccctctcccattcattccggacattccccagtctgaccttttcatatcaatggccatagaagtttgctgaacaaggttaaatgttggtgaagtaggagcagtagattggaaattgatccaccttcctgaatcctcgatcgaatcctcctcggactcatcacattccggtattgtaggtggcgtttggtgaccagcacgacgagtctagatggagcagagatagcgaaaagcggatgtctcaaaacgtgtaaagacccgccatttggtaattgctctgaagtaagtttccgcttcgaaccacgagaagtaggagatgacaacggaggagtcacaggcgcactgttggatattctaagaggtggaaggttagcaggaatcgaagaagcgatgttgtgtaggaacggaagaagaaggtatgaagaagggtttccgtcatagcgagatggactcgggaaggatgatgagactggacttccgtggtacgaaggtgcaggacttggaaaagctgatgattgtggacttggttggattgatgaatttgtgctgaagtttgtaggagttcctgaaatatctgatgctggtggctaaacccctgtttccacaagaatcaaccattttagtgaccaagactagactaaatcaaaaccacatgatgatgcaaccgtcaaagtcaatgttttagtcaagactcaagaagcaaaagagatttccccaaaatttctcaataatcaaacttacatgatctatagaattagatgatccaaagcagaaaccatcgaattcataatcagttctaatcactacgaagaccagatttcaatccaaatagggggaaattgaaaattcaacccaatcgaacagtgaaaagtgaaatccaaatcgcaagatctcaagagtctctaacaattcgattgaattaaaacacaacaatcgcacagattcatcgattgaattatgagtaattgagagaagctcagattccgatctaaaaattgaaatccggaattttcagttttaccttgcgataagtggtgccatcgtcttcgacgatccaaccagcttcgagacagagagctttaagaacctcgttgttatcgcagtgcttaggaagcttatagttaccttgagctctaagaccagagtaaatcttagcagtgatggctcttcttcttctttctctcttcttattgttctctctctctttccacgtcggagtacgtcccgacgatgatcctcctcctcctcctcctcctccggcggccattgaagagctctgaatctctgaatctatctctaagtctttgtcagactggcgcacgagggatagagagagagagacgaagctttctttttagtttttttgtttttttttttgttttgggtgtgtgtgtgagtctgaagcggattggctgtaactttcattcattaagtataaataaattcaaatattcatttgtctccacacgtgtggtctgtttctacacgtgtgatcgatttatttctggaagtcagcttccacgtgtcctatttatgtaacgcacgagctgtggtcccttccccgttgtttccctcccgtccactgttcaatgaattcggatctttccttcttcttttttttcgtattttctttaatttaaatttgtatcttaaaaacaaaaacaaaaagcgttgtaagaattaagaatcagtataaaaactggatatactaacgattttgcattgttttttatgacgacatattgcacattttcatattgtaacgcattaatacaactcacaaaagctttacaccaaatttgatgttatttcttggagttgtcaaaacgtaattcgaaactgatctcattttcctaacataatttttaacctagtatagcatctaaagagttttaaaacggtcatattggattttagaaaatgacgaacaaattattccaaaaattacatgtttatttgattttcccaaattcattgatgtgaattaaaaaaatgtatccacataattagggaagctagctaaaacattttttagtaatattaaaaaggatggaaataagataacaaacagcaatttggctattgtggtcggagcacgtgcggttccagttaggcgtgagcaaagccaggaagcagaatcacccagctggactcatgccattattatttttttagccaactaattaatatagtactttaacaaatcctatttacatatttgttaaattttcacaaccttaaattaataaaagtaatttcataaaatgtcatttgttattattgcagacaatcaaatgaaacaaaaaaaagttcctaataattgtgtttattattttattttattaaaccacgtcttctcatttatagtcacaaatccaaaaactactaaagtttaaaatg

SEQ ID NO: 36272 - DNA, 3000 bp, Unknown; identical to SEQ ID NO: 3373
  misc_feature (1)..( 3000): 2750-1469P.txt file - cDNA_ID_3093580; gDNA_ID_1620643; Annot_ID_163112

SEQ ID NO: 36273 - DNA, 3000 bp, Unknown; identical to SEQ ID NO: 3373
  misc_feature (1)..( 3000): 2750-1469P.txt file - cDNA_ID_3093580; gDNA_ID_2926213; Annot_ID_202790

SEQ ID NO: 36274 - DNA, 3003 bp, Unknown; identical to SEQ ID NO: 17794
  misc_feature (1)..( 3003): 2750-1469P.txt file - cDNA_ID_3093606; gDNA_ID_1621088; Annot_ID_170541

SEQ ID NO: 36275 - DNA, 3000 bp, Unknown; identical to SEQ ID NO: 17795
  misc_feature (1)..( 3000): 2750-1469P.txt file - cDNA_ID_3093606; gDNA_ID_2926213; Annot_ID_202752

SEQ ID NO: 36276 - DNA, 3000 bp, Unknown; identical to SEQ ID NO: 3473
  misc_feature (1)..( 3000): 2750-1469P.txt file - cDNA_ID_3093650; gDNA_ID_2926214; Annot_ID_202845

SEQ ID NO: 36277 - DNA, 3003 bp, Unknown
  misc_feature (1)..( 3003): 2750-1469P.txt file - cDNA_ID_3093654; gDNA_ID_2926214; Annot_ID_202837
aacctattttcaagacgatttctgacaaataccaattttatggatgaaagttacatcacacacgtacgtatgcatctacttacatatatgtgaactttatgtatgaaaatatttgctggtttatttgagagacaaagatacgtttgatacataaatccattagccgatagacaaaaattcagccgctttgctgtcgtttcttcgaacgtcgccgttttcattcacattggattttgggttgtacttttttttattataaaaatgattaattttattagtgaccaccggtgattttctgtgtcctagtacttgtttcagtagagttctttttggtatttattagtgatacatattttttaaattttaatataacagcaagaaaaatcataaccaaatctgtactactttgaattgatatagtactgaaactataattcctattcaaatataatccttattttccaacgggaaattttcagagaaacagtaaaacctgggccatggtaaaaaaaaatacacattatactgtacatggagaatgatatgatatatgtaaagagtaaaacctagaaaatgtaatattaccaaatgatgatagtctagcaatcaaatcatcaagatatctacttaaagccagtgatcaatttctacttaaagcattgtcttcgttttaagtcagatttaacattaggaatataaacttgtcgaaattaatatgggattggacaaagcctattcataaagaaaactgaagagtgtgagagttgatgggattgaacatatggaaagagaggaagggaggtgacaaaacaaaagaagagaagatgtgtctttgtgtggggtttactaatttcacaaatcaagcaaagcaaacagtcttgattctctacactgttcttcctttgaatgactttactattgttttgttttcatttcatttattacttaataatgcaacccatatatagttgaataataatttttaaaaatacatatttggaatttggtggagactcaagtgtcaatcaaagtcggtacactgccaccatgctactgcttgaactaatcttctcaatgacaacgccgctccgaatattttatacaatatcttctatatgattcactatatatctaacttatatactacaatacacattatgctaatatccaaaggttcgatggaaaatactgttgtatttatacaagactcattccaaaaacatatcataacattctcagtagttgaattccaaaaattaaggtttgcatctagtctgcgatctgctaaagagtctcaaaatcgtagttaaaatgagtggtttgtcgtaaattcgtcttgattttggtattttgaagatggagcattttaccattgtgaatcctttaccaaaacttcttagttacgaatactttgggtttgtgataaaattttgtgcccttcaaatattttaatatatgtgtagttgtgtataccaacagatctcaaaacactattatttcgctataaaaagtttttgaaattgggaaaaatgcattttgtttggagactattaattgcacattgtatcacgatcgagaaaaccattaaaagcaaagtgacaaaatgaaaagactcaaaaagatgaaacaacaaagaaggaagaaaaatgagagttccaaagcaaaaatactttggccattccgatctctttttgtttctgcgtctcaccgtttacttaactgttttcgatcccttccctgttgcatcacttccttggaacaagtattaagaccaaagaaaataaaaaaggttaagagatttatgcatattggagagaaatcgttaaagcacagagttgacaaggtacagtcacgtggaagcattttggacatatcgataataatctctttctctgtttcaatgatcttattcgacgtcaattgctccatacctcattcattgttcttgtacgacacaggcctttgttcataataatatactatatggtatatggttaatatatactatcttatttcgtaactcaaaaagaaatatgattaatcgtcaaccatatcacctcgttacataaaagctagtggttttgctttttctaaaaaaccatcgtgttactatatcgtatctagtattttacaagatctatagtttaaatactgatattttctgaaaaacaaaaaaaattgaaatttgtatacttatatactatagaagaatgcagagaatagttattttcaaagagttgaggacaaaacttacggggacaaaaaagtggatcgaggagattccagtggtccaatattgattttggatagtggatatgaatatgcgcacgcaatagccaatacatctcaaaaagtcatttttttgtcaacatctcaaatgttttatgcaccaatattcaaatgaattctcgactctacgttgttagtggatacatctgcggttaattacaaatgtaacatacacgcataccatggaaatatatatatacacatatggaatttatggtataaccaccaccatgacatttgtaccattataccataaaaatcatgaaatcgtgtccaacaatatgatcattttagattggactatctacaattatatgtatgaaacgtacgtggtactcgatgagtacgtacatggtttaaagcttacacgggatgggaattttgaaaaagctatgatgggctcttaaattcgttgaaagcttacaatagatgaaacaaagaaaacctgcatacatcaagtacgtactataattacactaaggaatgaaaagaaatcatcaaggctttcatgaagtatccgtatcaataatttgtttaggttacagaaattgactacaactaatttttatttttacggttccatgcaaattaatccattttaaacaaatcctccattgttttgtataatgttggagattagtaggattagtcggataatatggcataaacataatatgatgctaaattctaaagaaacgatatgaataaataatg

SEQ ID NO: 36278 - DNA, 3003 bp, Unknown; identical to SEQ ID NO: 20253
  misc_feature (1)..( 3003): 2750-1469P.txt file - cDNA_ID_3093661; gDNA_ID_1620720; Annot_ID_165769

SEQ ID NO: 36279 - DNA, 3003 bp, Unknown; identical to SEQ ID NO: 20253
  misc_feature (1)..( 3003): 2750-1469P.txt file - cDNA_ID_3093661; gDNA_ID_2926214; Annot_ID_202830

SEQ ID NO: 36280 - DNA, 3000 bp, Unknown; identical to SEQ ID NO: 33630
  misc_feature (1)..( 3000): 2750-1469P.txt file - cDNA_ID_3093698; gDNA_ID_2926215; Annot_ID_202946

SEQ ID NO: 36281 - DNA, 3000 bp, Unknown; identical to SEQ ID NO: 19257
  misc_feature (1)..( 3000): 2750-1469P.txt file - cDNA_ID_3093728; gDNA_ID_1620652; Annot_ID_163495

SEQ ID NO: 36282 - DNA, 3000 bp, Unknown; identical to SEQ ID NO: 19257
  misc_feature (1)..( 3000): 2750-1469P.txt file - cDNA_ID_3093728; gDNA_ID_2926215; Annot_ID_202915

SEQ ID NO: 36283 - DNA, 3000 bp, Unknown; identical to SEQ ID NO: 3576
  misc_feature (1)..( 3000): 2750-1469P.txt file - cDNA_ID_3093733; gDNA_ID_2926215; Annot_ID_202913

SEQ ID NO: 36284 - DNA, 3003 bp, Unknown; identical to SEQ ID NO: 19267
  misc_feature (1)..( 3003): 2750-1469P.txt file - cDNA_ID_3093739; gDNA_ID_1620652; Annot_ID_163483

SEQ ID NO: 36285 - DNA, 3003 bp, Unknown; identical to SEQ ID NO: 19267
  misc_feature (1)..( 3003): 2750-1469P.txt file - cDNA_ID_3093739; gDNA_ID_2926215; Annot_ID_202904

SEQ ID NO: 36286 - DNA, 3000 bp, Unknown; identical to SEQ ID NO: 19167
  misc_feature (1)..( 3000): 2750-1469P.txt file - cDNA_ID_3093742; gDNA_ID_2926215; Annot_ID_202900

SEQ ID NO: 36287 - DNA, 3003 bp, Unknown
  misc_feature (1)..( 3003): 2750-1469P.txt file - cDNA_ID_3093746; gDNA_ID_1620648; Annot_ID_163356
tcgtatttgtaagaatttataaacaaaaagcaatgattaaaacatttacaatgacattatgacaatgaattcgaatgtacttttcaagtcactcgtaaaagaatataaattttttaagagataacataagacttttaaatcgataagtgaataacatagagtttgtcattttaatacaaatcactgccgataattagactgaaatggaagaaaatcagacggagacaatgatgtccttaaggggaagaagagtgaaatgaggtagcggtttgaggtggatgagaacatgtgtatacgatgatgactcttgtttgatgggacaaccgtgagtcgacttatccagcgtcccatctctatagacaaacacattttcgtcctcttccatgcgacgccactttctgttgttatctttggcacgttgcagcggcattcccctgcatcatcaacattcattatccatctagatgtaaatgagaaagtgggcatatatccacgtgtgtacctgacatggaagagatcagagacatcaagaaagaaggtcagtgcgtcaataaaagcctggtaggtggtgatatggaggccgtcgatgtggggatagggcagcctgggcctggtggtggtggtggtgggagaagagaggaaaacgtactctttgaatcctcctcctgctccggtggcctgagcgacgaagcccatggtggacatgattggttcaagctcctcgtgcgtcataacaggcttgaaggttctcgtgtgccacaaggccagtttcctcatactgcactcctccatcatctctctcgagatccacaagtgagtgagtgtagggattatggttacaattagtttggtttttctttcttttgcccttgttatttcatttattcaccaaactgccattcctttctgccacgtggccttcttcatcccatttgtgagcaattcaatttagtaatccatttgctgctctgtagtggaagtagttgttgttgttgttgcagaagaatccgaatccaattcaatgagtcttcttcgtcttctcctcgttgttgttgttcttcatctttctgcggtggccggcgacgacgccatcgtctccagattccaggagtacctccgaatcaacacggttcagcccaacccggaatactacaaagccgttgactttataatatctcaggcgaaaccactgtccctcgaatctcagacgatcgaatttgtaaaaggaaagccgcttctcctcctcaaatgggttggctccgacccaaccctacctgcctttctcctcaactcccacaccgatgtcgttcccttcgaggactccaagtggactcaccatccgctccaagctcacatggaccaccatggcgacatctatgccaggggttcccaggacatgaagtgcgtcgggatgcagtacctcgaggccatacgcaagctccaggcttctggcttcaagccactccgatccgtctatctctccttcgtccccgatgaagagattggcggccacgatggcgcagagaagtttgctgaatcccaattattcaagagcttgaacatcgcaatcgtgctcgacgaaggtaaacactcttctggatttgattcttgattataacagccaagcatcatcttatacaacaaagtgaatcaggcctgccatcgcctactgagagttacagagtattctatggagagaggagtccctggtggctggtgattaaggctaaaggtccacctggccacggtgccaagctctatgacaactctgccatggagaatctgctcaaaagcattgagagtattcgcagattcagagcttctcagttcgatcttctcaaagctggtgggatagctgaaggcgatgttgtctctgtgaacatggccttcctcaaggctggcacaccttctccaactgtaactacttttttcttcattcatattatgtatgattccaaagttgatgtctttatctgagaatctggctctttctttatcctcaagggtttcgtaatgaatctgcaaccatctgaggcagaagctggtttcgacattcgtgttccacccagcgttgatgctgaagcactcgaaagacgtttagtggaggaatgggctccagcagcacgaaacatgtcctttgaggtaatttcttggccacctgtatctctttctcaatgaatttgaagaaactgtccagtcttgaagccaagtagcaacacaaagtcccctttttttatgaacaaagtctactcgacaactttaactaattaagatgttagctggggcagttcaagcagaagcttacggggaagcaattccttacagcagcagatgattcaaatccttggtgggggctcttggaaaatgctgttaaggaagccggaggtaggaccagtaagcctgagattttccctgcatcaacggatgctcgctactttcgcaaggctggcgtgcctgcctttgggttctctcccatatcaaacaccccgagtctgcttcatgaccacaatgaggtacatacatgttgatactcactttgctcattgttggaggatcatcattcatgttgtttatctgtgttgcagtatttgggtaaagctgagtacttgaaaggcattgaggtgtatgtttcaatcatcaaagcttatgcatcatatgaaagcaaaagtggttcacgagatgagttatgagggtctcaacacagcccattcaagtcttcctttcgcaaatttgtacaatcaataagatctgaatccatcctgtgtttgttgtggtaaatcagagacatcttgttcttgttgtgagacagttggcattggcaaattgtattattcattcctgctttttcaatgcttcttcttttttctccttgtgtttcctcgtcgttgatgggccgtacaaattaggcccattagcatgatccagtacgaaatccatttaatgtaaacccaaccagtcctcctatctcttcgttcgtgactctctctgctctgctcccaaatg

SEQ ID NO: 36288 - DNA, 3003 bp, Unknown; identical to SEQ ID NO: 36287
  misc_feature (1)..( 3003): 2750-1469P.txt file - cDNA_ID_3093746; gDNA_ID_2926215; Annot_ID_202898

SEQ ID NO: 36289 - DNA, 3003 bp, Unknown
  misc_feature (1)..( 3003): 2750-1469P.txt file - cDNA_ID_3093752; gDNA_ID_2926215; Annot_ID_202897
ttgaatctagcaatgttatagtctctaattttgccttgctccagaataatgatctaactccgtctctcactactgtattttctcctgttttcaggtagtgacggatctctaccgaatccatcagcagtcattgttggcatcgcacgttactgttatactggagatactctcatcaatctcatcacatgcccaccagttaaattctgatttgatattgcagaagaaagtgaggagagcgtgctctatcctggagctctctgaacctcccatgcttcatttcgaaaatgacacgtttcagaactacctggacattcttcaagccatagtgacaaataatccaggagtgtcgttggagctaaacgtagagtctcagctgatgacagtgtgtatgcaaatactgaagatgtacctgaaatgcactttgtttcagggtgatgagttggaagaaaccaggcagcccaaaaactggattctacccatgggagcagcctcgaaggaagaagcagcagcgagatctcccctagtggttgcagtgctgaaggctctgagggaactgaaaagagattcattcaagaggtatgcaccgaatttcttcccattgttggtggagcttgtgcggagcgagcacagctcttcacaagtcccacaagtcttaagcacagtgttccatacatgtatgggtgcaatgatggatgaataatagggtggttataagtgggttttgacattcgagcacctgaaggatattgattaacaagcagacacaaatcactcttttcttcttttgttttttcttctcgacggagatgcgagatttacaggttttgtgctgttgattgatagtgctgatataaagtaattgattactgtttgtagaaactaagaaaagaatggtgagattaggagggtcattgcattttgtctgcaatgcctattttcttccttccagtcgtgatcaatgtgcataatatactctcacacagctaaatgcggtccaagtaaggattgtgaaggatatattatataaaaagaaaaaagaaaagagaagacaaagatgagccactcgtggaaagtcatttatacctccttgaaatgaagtgatgatatctaatgactccaaagtcataataaagtcaccgaaagtgaatcatgatttgaagaagataaaggagtcaggagtggaactgctttccttggtatgtcattccgaagcgccaatacggaggagccacatcataagaggcaatggttttgccgcctttgagagtaacctcgaaagagagagactgtccgatgagatcgagagaggagtgccagttctgtccccagtttctggccattgggatccaagccgttgtgtggcccttcactttcacaccaaccacttccccgtcgaggcccacattgcttatcaacacctggaaaaagtgggagctcccgctcaagctgaatctcaacccgcctctccgcccacacttgaccctcctatactgtataggtatcatctcagctctggtttctgcgatccctgtgaaggcggcatgagatagttccaagtgttcctttgggaagttgcaccaacctccgtaatcggaggagagtcccgaattgggaggacagaaatcggtggcggtgaccaccacggaggggctgccttgaagacaccaacggatgtggttcacgcaccgcacttctagacaagctccgcagctgcttcccctgttgaacagcttcccgctcaggcctgcgctgtagccggcaaagctgctctgcctcagatctccatacccacaagcgcctcctatcagaaccaattagtctagttagtcctgatgaaagaagaaagaaaaataggggggagagagagaaaagagaaccagtagcgacggaggaggagccgtctctgtctctagaaagcgtggctgtggctatcttccagtcatcttcggcagtggcttgaaagaggcggcagagaatgaagaagaggcacaatgcgagttgctgaagcccagaatccatgaacaagaagtgttgttgggatcctcacagtcagtcacaggtggcagacaaaagtgatgcgtttgagagagttttgggggttccttttgatcatcaggctccgcttttcaagacttgtggggatgcgacaaaagattgctctgacatgttttgactttgacagtccgtttcagaccaattataataaaaaaacaaaaaagggaacaactatacgttttccaggcccatctcattcggaggcccactttcaatacgacacagaatcaagacaagagacgcaagacgaacttcttgagcccttttgttaattcaatgggccctcactaagaagcccataataaaataaaataagttctattttcaaacattgtactattactttttgtaccggccgtgtttattcaattctcgtatttgtaagaatttataaacaaaaagcaatgattaaaacatttacaatgacattatgacaatgaattcgaatgtacttttcaagtcactcgtaaaagaatataaattttttaagagataacataagacttttaaatcgataagtgaataacatagagtttgtcattttaatacaaatcactgccgataattagactgaaatggaagaaaatcagacggagacaatgatgtccttaaggggaagaagagtgaaatgaggtagcggtttgaggtggatgagaacatgtgtatacgatgatgactcttgtttgatgggacaaccgtgagtcgacttatccagcgtcccatctctatagacaaacacattttcgtcctcttccatgcgacgccactttctgttgttatctttggcacgttgcagcggcattcccctgcatcatcaacattcattatccatctagatgtaaatgagaaagtgggcatatatccacgtgtgtacctgacatggaagagatcagagacatcaagaaagaaggtcagtgcgtcaataaaagcctggtaggtggtgatatg

SEQ ID NO: 36290 - DNA, 3003 bp, Unknown; identical to SEQ ID NO: 19170
  misc_feature (1)..( 3003): 2750-1469P.txt file - cDNA_ID_3093756; gDNA_ID_2926215; Annot_ID_202895

SEQ ID NO: 36291 - DNA, 3003 bp, Unknown; identical to SEQ ID NO: 33624
  misc_feature (1)..( 3003): 2750-1469P.txt file - cDNA_ID_3093767; gDNA_ID_2926215; Annot_ID_202891

SEQ ID NO: 36292 - DNA, 3000 bp, Unknown; identical to SEQ ID NO: 3493
  misc_feature (1)..( 3000): 2750-1469P.txt file - cDNA_ID_3093771; gDNA_ID_2926215; Annot_ID_202887

SEQ ID NO: 36293 - DNA, 3000 bp, Unknown; identical to SEQ ID NO: 31934
  misc_feature (1)..( 3000): 2750-1469P.txt file - cDNA_ID_3093780; gDNA_ID_2926216; Annot_ID_203021

SEQ ID NO: 36294 - DNA, 3003 bp, Unknown; identical to SEQ ID NO: 23836
  misc_feature (1)..( 3003): 2750-1469P.txt file - cDNA_ID_3093815; gDNA_ID_2926216; Annot_ID_203001

SEQ ID NO: 36295 - DNA, 3000 bp, Unknown; identical to SEQ ID NO: 4815
  misc_feature (1)..( 3000): 2750-1469P.txt file - cDNA_ID_3093846; gDNA_ID_1620734; Annot_ID_49445

SEQ ID NO: 36296 - DNA, 3000 bp, Unknown; identical to SEQ ID NO: 4815
  misc_feature (1)..( 3000): 2750-1469P.txt file - cDNA_ID_3093846; gDNA_ID_1620734; Annot_ID_166199

SEQ ID NO: 36297 - DNA, 3000 bp, Unknown; identical to SEQ ID NO: 4815
  misc_feature (1)..( 3000): 2750-1469P.txt file - cDNA_ID_3093846; gDNA_ID_2926217; Annot_ID_142247

SEQ ID NO: 36298 - DNA, 3000 bp, Unknown; identical to SEQ ID NO: 4815
  misc_feature (1)..( 3000): 2750-1469P.txt file - cDNA_ID_3093846; gDNA_ID_2926217; Annot_ID_203028

SEQ ID NO: 36299 - DNA, 3000 bp, Unknown; identical to SEQ ID NO: 4556
  misc_feature (1)..( 3000): 2750-1469P.txt file - cDNA_ID_3093877; gDNA_ID_2926217; Annot_ID_203082

SEQ ID NO: 36300 - DNA, 3003 bp, Unknown; identical to SEQ ID NO: 19091
  misc_feature (1)..( 3003): 2750-1469P.txt file - cDNA_ID_3093898; gDNA_ID_1620644; Annot_ID_163162

SEQ ID NO: 36301 - DNA, 3003 bp, Unknown; identical to SEQ ID NO: 19091
  misc_feature (1)..( 3003): 2750-1469P.txt file - cDNA_ID_3093898; gDNA_ID_2926217; Annot_ID_203060

SEQ ID NO: 36302 - DNA, 3000 bp, Unknown; identical to SEQ ID NO: 3388
  misc_feature (1)..( 3000): 2750-1469P.txt file - cDNA_ID_3093904; gDNA_ID_1620644; Annot_ID_163161

SEQ ID NO: 36303 - DNA, 3000 bp, Unknown; identical to SEQ ID NO: 3388
  misc_feature (1)..( 3000): 2750-1469P.txt file - cDNA_ID_3093904; gDNA_ID_2926217; Annot_ID_203059

SEQ ID NO: 36304 - DNA, 3003 bp, Unknown; identical to SEQ ID NO: 19095
  misc_feature (1)..( 3003): 2750-1469P.txt file - cDNA_ID_3093915; gDNA_ID_2926217; Annot_ID_203056

SEQ ID NO: 36305 - DNA, 3003 bp, Unknown; identical to SEQ ID NO: 19099
  misc_feature (1)..( 3003): 2750-1469P.txt file - cDNA_ID_3093930; gDNA_ID_1620644; Annot_ID_163149

SEQ ID NO: 36306 - DNA, 3003 bp, Unknown; identical to SEQ ID NO: 19099
  misc_feature (1)..( 3003): 2750-1469P.txt file - cDNA_ID_3093930; gDNA_ID_2926217; Annot_ID_203047

SEQ ID NO: 36307 - DNA, 3003 bp, Unknown; identical to SEQ ID NO: 16295
  misc_feature (1)..( 3003): 2750-1469P.txt file - cDNA_ID_3093937; gDNA_ID_2926217; Annot_ID_203043

SEQ ID NO: 36308 - DNA, 3003 bp, Unknown
  misc_feature (1)..( 3003): 2750-1469P.txt file - cDNA_ID_3093998; gDNA_ID_1971813; Annot_ID_175833
atagtcaccaaagataaggtacgatccctcgtgttatgattattgaaacgacaacgacaaataaccaatatataggacacataatatgatgctttctagtttatattcatatatatgttctctccttagtgtatgaatgaaaacatagctagataaaaatcaagcttcacctaattagtgtattcccccaaatttctcaattctcactaatggctttggtcagcttacttgaaatctccattgctttcttttgtttccttatctttcgaattttcctgatcagcaagaaaccacaccgttcatttctcacaaactggccgctcctgggcatgcttccgggtttacttaccgtgctccctcgagtttacgactttataaccgaggttcttgaggacggcaacttaaactatcttttcataggcccttttttagggggcatcgacatgttgttcaccgttgatcctgctaatatccatcacatcatgagctcaaactttgcgaattacccgaaaggaaccgaattcaagaagttatttgacgttttgggagatgggattttcaacgcggattcagatttgtggaaggatctaaggaaatcttctcaaagcatgatgaatcatcccgattttcaaaggttttcattagctacaagcttgagtaagctagagaaagggcttgtgccacttcttgatcatgttgctaaagagaaactcgtcgtggacttacaagatgttttccaaagattcacgtttgacactacctttgttttagcaaccgggtatgatccaggttgtctctcggtggaaatgccggaaatcgagtttgcaagagccttagacgatgcagaggaagctattttctacagacatttcaagccggaggtggtgtggaagatgcaaagattgattggggttggagctgagttgaagctgaaaagagctcacgcgattttcgatcgtgtttgctctaagtgcatagcttctaagagagatgagatcagccaagggattgattcttcttcttctaaagatttgttgatgtcttctataaatgttgacacgactaagtacaagttgttgaatccaagtgatgacagattccttagagacacaatcttgtccttcatgttagctggtagagacacaacaggctcagcgctcacttggttcttctggcttctatgcaataaccaagaagccatgaccaagattcgtcaagaaatcaacacaaatctatttccaagaaacaagaccgacgacggttctgtttcttatgattctgattcattcaatccccaagaggtaaagaagttggtgtatttacacggcgcggtttgtgaagccctcaggctctatccacctgttccctttaaccacaagtctcctgctaaacccgacgtgcttccaagcggccacaaagtcaaggccaattcgaggattttgttctgtctttactcattagggagaatgaaatcggtttggggagaagatgcaatggaatttaaaccggagagatggatttctgagagtggaagatcggtacatgagccatcttataagttcctatcgtttaacgccggtccaagaacttgtttggggaaagaagtggctatgacgcaaatgaagacagtggctgtgaaaatcatacaaaattatgacattaatgtcgttgaagggcacaagatcaagccagctccttcggttattctccacatgaagcatggtcttaaagtcactgtctctaaaagatgtttgtcttgaatgttttaactagaatgtagaaactgtggcagttgacgaagatgatttctatgatatgaagacatctcaaatcatgcatcctgaaatataatgttattgttaaacataatttctaaaatttaagtaaaatatataaatgttggtaagaaaattaataatttcctttttattttaagtgtagagttaaatcctatactcaagttataaatacaaattagccgaaaacattaatgttttttgcacgttatatagatcttctttttttttttttgtgtgtgtggaaatgcacgttatatagatcatgttgaaaattttagaaagataaaaaaagctgactaatgatatcttctctaaatgttcattattttttttttggtatgacagatgtaaaatcttcctttgttatggtatattttatgaatattagtcaatgcagttaaccaattcattgcagattccaaaaaaatctgaaaaacagtagaagaagagatatttgtctcaattaataccgttagatcaataaaattgattgtattctataaaagaataatcttaaacgagatatatacatacgatttagacaaatatattgaccttttaaagtaactaatcatatatatccataataaccagattgaaataaaaactattaatagtatttttttccttccaaacaacacaaattcttgcagatgttttagaggtatcatgattatttggaaatctttataaaagataagctaaccggatatgtattttgtggttatattctaaattcatgtaaatttatgttaaaacaaataactaattttgttttttttggtcaaaaaacaaataactaattaagtaagaatatatcacatgcattggtttccaacggatgattagactcattacaaagctacaataaccaaacaaacaaaagaggacataatcccaaagaaagtaagatcttattccatttataattattcagatgatagagacacatcaccgatacctcaaagacgcacacatgaaatgctttatatatccaacataagagtaaaatcaagtatcatcaacaagctgcaatttggtgtatctcaaaaggagaaaaatacattttaatttatctctaatggttttcataagcttgtttgaaatctccattgctttcttttgttttctcctcttccgacatttcttgatcaacaagaaaactcaccgcttgtgtcccacaaactggccattctttggtatg

SEQ ID NO: 36309 - DNA, 3003 bp, Unknown; identical to SEQ ID NO: 36308
  misc_feature (1)..( 3003): 2750-1469P.txt file - cDNA_ID_3093998; gDNA_ID_2926218; Annot_ID_203137

SEQ ID NO: 36310 - DNA, 3000 bp, Unknown; identical to SEQ ID NO: 19358
  misc_feature (1)..( 3000): 2750-1469P.txt file - cDNA_ID_3094003; gDNA_ID_1971813; Annot_ID_175830

SEQ ID NO: 36311 - DNA, 3000 bp, Unknown; identical to SEQ ID NO: 19358
  misc_feature (1)..( 3000): 2750-1469P.txt file - cDNA_ID_3094003; gDNA_ID_2926218; Annot_ID_203134

SEQ ID NO: 36312 - DNA, 3003 bp, Unknown
  misc_feature (1)..( 3003): 2750-1469P.txt file - cDNA_ID_3094008; gDNA_ID_1971813; Annot_ID_175829
gcacatattaattaattcctccctctaatgcattagtactttcattatccatttagaagactttttttgtttctgtttcaaaaaaccagttaactaaaatttaatttatatgcatggttaaacggtcaacaaaattattttacattcactcgtgttgattttctagtcggtaaaaactaaaaaggaacctcgtcaataatagtaacatcagttagtcgttacatcatgagtaagtatcgtaattggcgccgtacgtttgttgattaaccatacaaaaaaaaagaatgataattatgtgatttcttatacactaactaacattcagtaattaaatctttgtttataccacagcgatataaattatgtgaatgataattatgtgatttcttatgttttgaatccgtaataattaaccgaacatgtttgataatcatatttaacaaaatctttgtttataccacagcgatataaattaaatgattagggacggtactaatattacagttgaatatgtattatagtttgtaagagatttgatgtgcatgtgtttatttatagtttgtacattcattttcccttgagcgtaaggacagcgtcactatgacatcacatcggtccgtgagaatgatagtataacgaatatgcacgtaactcgtaatgacataggtttctttttaaaccgttgatgttcgtgtgtgtttagtatcatatgatttacatttggccaaaacgacggaaattggaatttactaaaaaaaattggggaaaaagttttttttttataagtaataatatgaatctgtttaatgggccttcagaagtggggaagagattggagtgtgggttggcgaatgtaatcatttcgtttttattatatttttactttgtttttgttcgtatatgtatttgaaattttacattattcgttttcacatccatcacctttcttcctctcgctttacacagtttcaataattacattttcagtgatctctgtacaattgctagtttcattttaagctttatgtctaactaggaccgtaactacgactagttttgtccggttcgttcggactgttcccatagatttgagtaaccggcaaatcggataggattgacaaacaaaacttgtggtttgtttacgaaatctagaatcagcaatttggtgcctagacgagttgaaaataaaacagtaataatgagttacttagaaccgtaaacaattcagtttagcgagtgaagctggaggaatgagtccattgtctacacatgtatctaatctaatactaaaaaacattgatctcgttgactttctaacaaacaaaaaaatcggaacacaacatacttataaagttgacttttgggttaatcacaactaatgaaacccaccaaaaagggaataatagaatctttatcgtacaaatttacaacacatatatatgtgcataacaatttataaagatttagtttaatataagggacagctaaggaaagaaaagaagatttttaaaaggaagaagatttttttctgaaagaaatataagagcggggcatgaagataaatgatgacaccatgcggggactctgcgtctgttaagagttataatttgacaacattatattgatccgaccatccaaagctgtcttgtaatgtccttcctctgtcactttatgcgacttctctcaatgcctctcttatttcttctctacgcctatctctttgcatatagttttcttttgtcatatccgtaaaaaaactacagattttttttcgggttcatttaagtccaaaaatatatgttgatggttctacataactctcattgttcctttttaagtaataagtaccttcttatatttatttatttgctctaattaagcaagtaacttcaaattaaaacattaggtaccaacaattatggtcttgagggtaaaaaagacgataaaaaagcctcagtgacaaatgtcaaaacatgggaaaagaattgtaacactaattaatccacaatcaagtgaaactgaaaaccctaacatggagggaccaacaaatgattggacataactgcaccaatcaaaaacttaattctgagtttattttggcataatttagtttggtgatacgcaactgggtcccattttaatatgacataatttagagtaaattatactatgaataaaaaaaagaccttaccataaaagtcattcgttattattacttatgtttgccattacaagtttatatccatttcctttattttcccggaaatattttttcaacgaccaagcagagaagttacgttacagtattatacaaagaacatttacacacattacccaaggaaggtgcaggctcgggccacttatgggccattgaacttgtacaaatatttatttagcccatgtaagaaatatcgaggagatattttgtttacataaagcccagaaagcccaattagtttggttgataattttttataacaaaaaaaacaaaattccacgtaagcacagaaacagacgactgacacggtggtccgtgaaggcgtgaaccgaatcatcgacggaggaaaccaccaatgatttctccatctcacgtcgtcaaatgtttcatcatcatcttcatcatctttcgtacgacttctttttttttttttttggtttttttttcccttcccaatcgaagtagcgatgccttcgcgatagctctctgcttcatctcgccactcatctcaacctcttgatttgggtctctcttgctcttgctcttgctcttgatctctctcaaggtattttattgttctctgaattgtttccctggatcgaatttgttctagggttttaaggttatagctcgaaatcgccgttgctcgctgttttagcatctccttttcacgttactgtgttcgttggtgctgtgattggtgttgagttgggttataagttcgttgttcttattgaattttgatatgtgcttttgcttgtgtatagtgttaagcaaataggatg

SEQ ID NO: 36313 - DNA, 3003 bp, Unknown; identical to SEQ ID NO: 36312
  misc_feature (1)..( 3003): 2750-1469P.txt file - cDNA_ID_3094008; gDNA_ID_2926218; Annot_ID_203133

SEQ ID NO: 36314 - DNA, 3000 bp, Unknown; identical to SEQ ID NO: 4554
  misc_feature (1)..( 3000): 2750-1469P.txt file - cDNA_ID_3094034; gDNA_ID_2926218; Annot_ID_203112

SEQ ID NO: 36315 - DNA, 3000 bp, Unknown; identical to SEQ ID NO: 8928
  misc_feature (1)..( 3000): 2750-1469P.txt file - cDNA_ID_3094084; gDNA_ID_1971923; Annot_ID_177220

SEQ ID NO: 36316 - DNA, 3000 bp, Unknown; identical to SEQ ID NO: 8928
  misc_feature (1)..( 3000): 2750-1469P.txt file - cDNA_ID_3094084; gDNA_ID_2926219; Annot_ID_203228

SEQ ID NO: 36317 - DNA, 3003 bp, Unknown
  misc_feature (1)..( 3003): 2750-1469P.txt file - cDNA_ID_3094100; gDNA_ID_1971923; Annot_ID_58554
atggtgttgagttgtttagtttagtttcaaaggcatcactctttgatgtaagctagactaagagtagtttgtttgaaaagagtatttgtattctgatgttgtgaggatttgttgcaaggtaatgtgtaaagactatcttcaagaaaggaaagaacttgtggaagctctgcataagggtagaagattcgccaatcttccaaagataacacaggtgatctctctctctctctctcagttcatacaaatctatataaatttaaagattatcattgtttgaatcctggtaacattgatatgcagccgacattgatgatatggggagaggaagatcaagtatttccagttgaattagctcatagattgaaaaggttttctaatttcattatcacatttttccataatcatcatcatttttttctaaatgaattgtcttgtgttgttgtttcagatatttaggggaagacagagcacaattggtgttactgaagaagacaggacatgcgattaatgaagagaaaccaaaagagatgtacaaacacatgaaatcttttctttgcactgacgcaatgattcctcagaatcaccagatcaatgctaagagactcatgttagcaaacttgatatccccagatcagcagatcaacaagtgatgttactgcagaaaaaaaaaaagtgttgttagaagacataatagttaatcatgtttttagcttgtccctaaatgtgatttgtatcgttattgttaaagaaagacattgcttctaatagttggaattaagaatacttttatttcaagaaagtaataatcatgttcttgaagcttgccttttctttctcataaggttgtcaattttatttaatctcgtagtactaaaatgatatatatatatatatatatatatatatattttttttttttctcatttgatcaaataaaattatattgggttgctttaattttcagccctatactagttgaaatctcaacattccaccctaaacttttaggcacttgaaaaaccaccataaataattttaatctcgataaaactacatgtactttcggatttgttcttaaaactacgcctccaattgaaccgaccagttaaccgataattatacatccggtttgacttacccataatttaaccgaaactaatccgattttgactctattttagcctaattttgacccacacaaaatgtaaataaattgtcttattaagaagtaaaagtatttttattaatttgtatttgtgataaataattaaaaatattaaattattacttaattttagcaaaacttaatatgacaaaatataccccaaattatattttgagctacattttgttataaaattttgataatatacaaacatatacattttccttttggcaatcatttatatttttttataaatctaaagctatgtcttttttaaaacaaaaatattcatttttcttgaaattataatatatgacctttgaactctatatgtaatgaaattcaaaatatatgccaaatttatttttatagatatccgtaaacaccacaatcaaagtatatattatggtatttataaatttatttttctttatagattcagttttctttttatatattcaagatgagttatatatgtatatatatatatatatatttatatgattatggtgtttttaaaaagaaaatgacctttgaattattaaatttagagtatataccaaatacatttatatatataacaccattgtatttataaaaagaatttgttgtctattttgttatattattttgcggtatattttgtttattaccaaaatatatactaaaattttattatgtaattttgtgtggtatattttgttattttattattttggtaaaattaattaatttatttttaattttttataaaaataaatgaaaataaataaaatgtatttttcttctaaagaatatattttttgggtataaattgggttaaaatagagtcaaaatcggattagttttggtcaaaccggatgtataattatcggttaactggttggttcaattggaggcgtagttttaagaacaaatccgaaagtacatgtagttttatcgagattaaaattgtttatggtagtttttcaagtggctaaaagtttcgggtggaatgttgagattctaactagtatagggctgaaaatttaggcaacccaattatatttactaaaactactaataaatgataacgaaaaacaaattgtaaaaatagtttaatttaaggggtaaagttggaagttggaagagtgagagagagttgtcttgtttcatttgagtctactcgttttttcttatctatcgcaaaactctcccgtcgtcaccattcgattacggtatgattcagcttctctcgtttgattagagtcatccatagaatgttgtttttctatgttttccttcacttgtcttgatttttcctctaactaaatggtggtggctccaagctcgtgtttttacagatttgttcactcgaatttctttagaaagctgtgatttttttctgcttagtggttgaagaattcgtatgtttcgtaatgggtgcaagcttatttgcggtgaaagtgaaactctttttgtctcgggtcgaaatttcatgaaaattgcatataatcttcttaggtttttaaagctttcaactttcggtttgtttgttgaagaaattgggttttgttagctgaatctagttcttgtgttgcagggagtgtaatggctcttatacaatttggaagttcatgtgttgctcaatgggggattcttcgtcctcggtttgctgttaaagctttttatccaagcagattggagtctcaccaagacaagtatgattgttgtagaattttaatgctttgttgagttatattattatctgaaaggctaattgaattgtttttcttttgttaaccttttgcagttgcatcagccaaataaattgtctgggagcttcaaggtcgagtatg

SEQ ID NO: 36318 - DNA, 3003 bp, Unknown
  misc_feature (1)..( 3003): 2750-1469P.txt file - cDNA_ID_3094100; gDNA_ID_1971923; Annot_ID_177207
catgtaagtcttcaccttttttcactcttactatttctatttttctatgatgattgatgcttgtgaaatgttaataatgggaatctttcatatataggctcgtttattgttgattagggatggaatgaaataatcttccgatgaagcttagtatcaataagtttagtccttttgtgtattctttcatttaaatgggcccaccacatacttttgagttttacagacaaaatgtttgtgtgattattatggtgttgagttgtttagtttagtttcaaaggcatcactctttgatgtaagctagactaagagtagtttgtttgaaaagagtatttgtattctgatgttgtgaggatttgttgcaaggtaatgtgtaaagactatcttcaagaaaggaaagaacttgtggaagctctgcataagggtagaagattcgccaatcttccaaagataacacaggtgatctctctctctctctctcagttcatacaaatctatataaatttaaagattatcattgtttgaatcctggtaacattgatatgcagccgacattgatgatatggggagaggaagatcaagtatttccagttgaattagctcatagattgaaaaggttttctaatttcattatcacatttttccataatcatcatcatttttttctaaatgaattgtcttgtgttgttgtttcagatatttaggggaagacagagcacaattggtgttactgaagaagacaggacatgcgattaatgaagagaaaccaaaagagatgtacaaacacatgaaatcttttctttgcactgacgcaatgattcctcagaatcaccagatcaatgctaagagactcatgttagcaaacttgatatccccagatcagcagatcaacaagtgatgttactgcagaaaaaaaaaaagtgttgttagaagacataatagttaatcatgtttttagcttgtccctaaatgtgatttgtatcgttattgttaaagaaagacattgcttctaatagttggaattaagaatacttttatttcaagaaagtaataatcatgttcttgaagcttgccttttctttctcataaggttgtcaattttatttaatctcgtagtactaaaatgatatatatatatatatatatatatatatattttttttttttctcatttgatcaaataaaattatattgggttgctttaattttcagccctatactagttgaaatctcaacattccaccctaaacttttaggcacttgaaaaaccaccataaataattttaatctcgataaaactacatgtactttcggatttgttcttaaaactacgcctccaattgaaccgaccagttaaccgataattatacatccggtttgacttacccataatttaaccgaaactaatccgattttgactctattttagcctaattttgacccacacaaaatgtaaataaattgtcttattaagaagtaaaagtatttttattaatttgtatttgtgataaataattaaaaatattaaattattacttaattttagcaaaacttaatatgacaaaatataccccaaattatattttgagctacattttgttataaaattttgataatatacaaacatatacattttccttttggcaatcatttatatttttttataaatctaaagctatgtcttttttaaaacaaaaatattcatttttcttgaaattataatatatgacctttgaactctatatgtaatgaaattcaaaatatatgccaaatttatttttatagatatccgtaaacaccacaatcaaagtatatattatggtatttataaatttatttttctttatagattcagttttctttttatatattcaagatgagttatatatgtatatatatatatatatatttatatgattatggtgtttttaaaaagaaaatgacctttgaattattaaatttagagtatataccaaatacatttatatatataacaccattgtatttataaaaagaatttgttgtctattttgttatattattttgcggtatattttgtttattaccaaaatatatactaaaattttattatgtaattttgtgtggtatattttgttattttattattttggtaaaattaattaatttatttttaattttttataaaaataaatgaaaataaataaaatgtatttttcttctaaagaatatattttttgggtataaattgggttaaaatagagtcaaaatcggattagttttggtcaaaccggatgtataattatcggttaactggttggttcaattggaggcgtagttttaagaacaaatccgaaagtacatgtagttttatcgagattaaaattgtttatggtagtttttcaagtggctaaaagtttcgggtggaatgttgagattctaactagtatagggctgaaaatttaggcaacccaattatatttactaaaactactaataaatgataacgaaaaacaaattgtaaaaatagtttaatttaaggggtaaagttggaagttggaagagtgagagagagttgtcttgtttcatttgagtctactcgttttttcttatctatcgcaaaactctcccgtcgtcaccattcgattacggtatgattcagcttctctcgtttgattagagtcatccatagaatgttgtttttctatgttttccttcacttgtcttgatttttcctctaactaaatggtggtggctccaagctcgtgtttttacagatttgttcactcgaatttctttagaaagctgtgatttttttctgcttagtggttgaagaattcgtatgtttcgtaatgggtgcaagcttatttgcggtgaaagtgaaactctttttgtctcgggtcgaaatttcatgaaaattgcatataatcttcttaggtttttaaagctttcaactttcggtttgtttgttgaagaaattgggttttgttagctgaatctagttcttgtgttgcagggagtgtaatg

SEQ ID NO: 36319 - DNA, 3003 bp, Unknown; identical to SEQ ID NO: 36317
  misc_feature (1)..( 3003): 2750-1469P.txt file - cDNA_ID_3094100; gDNA_ID_2926219; Annot_ID_142366

SEQ ID NO: 36320 - DNA, 3003 bp, Unknown; identical to SEQ ID NO: 36318
  misc_feature (1)..( 3003): 2750-1469P.txt file - cDNA_ID_3094100; gDNA_ID_2926219; Annot_ID_203217

SEQ ID NO: 36321 - DNA, 3003 bp, Unknown
  misc_feature (1)..( 3003): 2750-1469P.txt file - cDNA_ID_3094105; gDNA_ID_1971923; Annot_ID_177206
tttgtttttactgttaatataaagctctgtttcggttttctggtgaccaacaaacataaaatggtttgttatttaattacaaaaaggcccattagagaaatattgcaatgttgcgtcgtctcttgaaacccaatcttgttgttactctacgcaaactctcttcttcttccgcaagctacgtcgatcgtcatattagtgtgattctctgcgatcagagcttgagcttagagtctctgcgcaaacacaacgctcttatcatcaccggaggactctcggaaaacatcttcgtcgcatcgaagctaatttcatcttacgcttcttacgggaaacccaatttgtcttccagagtcttccatttggttactcgaagagatatctttctttggaattctattatcaaagcacatttctccaatggggattatgctcgatccttgtgtttcttcttctcaatgctcttgtctggccaatcccctgatcatttcactgctcccatggttgtttctgcttgtgcggagcttttgtggtttcatgttgggactttcgttcacgggcttgttttgaaacatggaggttttgatagaaacactgctgtgggagcttcctttgtgtatttctactcaaagtgtgggtttttacaagatgcgtgtcttgtgttcgacgaaatgcctgacagagatgttgttgcttggactgccattatatctgggcatgtgcagaacggcgagagcgagggaggtttgggttatctttgcaagatgcatagtgctggttctgatgttgataagccgaatcccagaacattggaatgcggattccaagcttgttctaatctgggagctttgaaagaaggaagatgtcttcatggatttgcggtgaaaaatggtttagcttcttccaagtttgtccagtcttccatgttttcattctattcgaaatctgggaatccatccgaggcttatctttctttccgtgaacttggggatgaagatatgttttcatggacttcgattatagcgtcactggcgagatcaggtgacatggaggaaagttttgatatgttctgggaaatgcagaacaagggaatgcacccagatggggttgtcattagctgtttgattaatgaactaggtaagatgatgcttgtccctcagggtaaagcctttcacgggttcgtcataagacattgtttctctttagacagtacagtttgcaattccttgttatcgatgtactgcaaattcgagcttctgtctgtggctgagaagcttttctgtaggataagcgaagaaggaaacaaagaagcttggaatacaatgcttaaaggctatggtaaaatgaaatgtcacgtaaagtgtatcgagttatttagaaaaattcagaatcttggaattgaaatcgactctgccagcgcaacctctgtcatatcttcttgttcccacataggagcggtgctactagggaagtcgttgcattgctatgttgtcaaaactagcctggatcttaccatctcagtggtcaattccctcattgatttgtatggaaaaatgggagacttgactgtagcttggaggatgttttgtgaagcagatactaacgttatcacttggaacgcaatgattgcgtcttatgttcactgtgagcaatccgaaaaagccattgcattgttcgatagaatggtttctgagaatttcaaacccagctcaataactttggtgactctgcttatggcttgtgtcaatactggctctctggagagaggacagatgattcatcggtacatcactgaaacagagcacgagatgaatctttctctttcagctgctctcattgacatgtacgcgaaatgtggccaccttgaaaagtcacgagaactgtttgatgctggaaatcagaaggatgccgtttgttggaatgtgatgatatcaggttatggaatgcacggagatgttgaatcggccatagcactttttgatcaaatggaagagtctgatgttaaaccaaccggacctacatttcttgcgcttctatcggcttgcacgcacgctggtttagtagaacaagggaaaaaactatttctcaagatgcatcagtacgatgtgaaacccaacttaaagcattactcttgtcttgtggatcttctttccaggtctggtaatttggaggaagctgaaagcacagtcatgtctatgccattctcaccagacggggtcatatggggaacattgttgagctcatgcatgacccatggggagtttgagatgggaattcgaatggcagaacgtgcggttgctagtgatccgcagaacgatgggtattatataatgcttgcgaacatgtacagtgctgcaggtaagtgggaagaagcggaaagggcacgagagatgatgagggaaagcggagttggtaagagagctggtcatagtgtagtctaataatctttgatacaatgaatatccttgtgattcatctgtttgaaacacatgttcaatggacaatgatgcatagattagaagattaattagctcaccaaataagtaaaattacgagtcgattacgaccactttaattttggttacacacattgatcatgacttgttttgaagaagaaacaatttacgtaaagaataaacaaaaatgggagcagacacgtttcctttcccttggaatattttacatagatttgcattcactgtatcagaaaaaaaaaaaaaatatatatatatatatatatattttacattagtaattttatactatttgtctctatcacatacaactttattattttttaattcttgtgggaataaaatttcaaaggcaggaacgggaagtccaccaaaaaggtgttattgtaaggaatcaaaacatgtcacgtaatcactaagaattatattgtaattatttttaatccaattcttattaattaccttttttttattaaggtcacttgtacttgtctctgtctctgcaagtctcatcagaagaggaagagaatcaatg

SEQ ID NO: 36322 - DNA, 3003 bp, Unknown; identical to SEQ ID NO: 36321
  misc_feature (1)..( 3003): 2750-1469P.txt file - cDNA_ID_3094105; gDNA_ID_2926219; Annot_ID_203216

SEQ ID NO: 36323 - DNA, 3003 bp, Unknown
  misc_feature (1)..( 3003): 2750-1469P.txt file - cDNA_ID_3094132; gDNA_ID_2926220; Annot_ID_142404
ttttttttccttcctttttaacttttaatataaaatggcaacgaaacaaaagaagaaaatgtatgaagtatgaactatcaagcaacggaaagatggttttcgttttaatttacttacgagtttaggaccattaaattatttaatcaaacctaataataagttgtacttgtaccgaaataaacggttccaatttcgaataaactataaatggaaagtaaaaattccataaattccatatagacaccatcgtctccaacctttttcttcttctccgtaacctaaaactctgtctaattataaatccaaccaaaacaaaaaaaaagtccatcatcttcttcttatgtcttcaatgcataagaaaggtacaagcagagacgtaaatagccaagcatttacaaaactaacgaaagtagaaactattccagatccagacatttacgacataacctacgtagatatctctccctccgaaggctcctcttcaccattatccaaatcaccatggtccgttcaagtcgatccatccgccgtagattctccgtatcattcggtgaaagttacgacggatacaaccaaagaaaaatcaaccaaccactctcctaatattctcttggggtcacttgttcgcgaagaaggtcatatctattcattagctacatcaggagatttactctacacaggatctgattccaagaacattagggtttggaaaaaccatgttgagttctcgagttttaaatcgaatagtggattggttaaagccattgttcttgctggagataaaatctttaccggtcatcaagatggtaagatccgtgtgtggaaagctgcatctaaagaatcaaacgttcatcgtcgtgtaggtacaatgcctaaccttctcgattatataagaaactccattgttccttcttcttacttcaacttcacgcgacgtaatcgtagcagtgctgcgttagggtttcgtcatttagacgcgatttcttgtcttgcgttaagcgaagataaacggttgttgtactctggttcttgggataaaacgtttaaggtttggagagtttcggatttgcggtgtgtggaatctgtgaacgctcatgaagatgcggtaaacgctgtcgtttccggttttgacggtttggtttttaccggttcagctgatggaacggttaaggtttggagaagagaagatcaagcgaaggatacgaaacatttcttctctgagacgttattgaaacaagactgtgccgttacggcgatcgctgtagatcaaagcgcgacgttagtttattgtggttcgtctgacggaaccgttaatttttgggaacgtgagaataatatgaaaaacggcggcgttttgaaaggtcataaactcgccgtgctttgtcttgtcgcggcggggaatttgatgtttagtggttctgctgatttagggatacgtgtgtggaggagaccagaaggtggaggtgagcatgtttgtctttcggttttgaccggacatgctggtccggtgaagtgtttggcggtggagagagatcaagaatcggtttccggtgagagacggtggattgtgtatagtgggagtttagatagatcggtgaagatgtggcgtgtgtcggagagttcaccgccgatggtgaatcaagagtttaagttgccggatcagtttggtggtggtggtggtggtggtccggcggagttaacggtggctcctagcttctcggctcaagggaggattagtccacaaaaatagttgtttgttttttgtatgtaaccaacatcgaactattcaaacgtgtatgtaattgtaatttcttctgttaaaagagattttgatccaacaagattcaagcatttttcatttcgtggagttccggttcaccttaaccgggaatctgacaaaacattacttacttccatcaaaactgtaaaatttcagtcagtgaaatgattattcaaatattcatgttcagaaactctaatgatcataagacaagaatgatctcataatctgaatttttcaattgcatgtattagctagagaacaaaaaatcggtactgatttgaaggcctaaaaagtctatgttgtttagaacgttcaaatatcttaccatgggaatgaaagtggacacgagtcatgtgatcatccttttggcaccattgttttgtcttctaatcgaacacgtagtgtcattttcatatcttcaatcgtatattttgttactactagtcaagtttcttcttatataagaaaatgggacatgatggattatgatttaagtgttccaacggtaggtaatgaagttaattcgactttttttaatcattttaataatgagatgtttggtgcgtcatacataaaacacaacatcaggtctcatcattaggcccttttttagtaatattcaatgttttcttttacattttcatatcacggatccaagtaattaagaaaacaaaaaacaaaaaacgaacctaatttatatacacatttcaacatattaatagttggtagtagtaggagataaattgatatctagttaaataatcttataagttttgagataattggtcggcgttacgactgtattatatacttctttttacccggttagtattttcctaatgagaaaaaataaataaatcgattcatgaaataaaataattttgaaggatgatgacatgatgtaatagagttaagagtagataccatgaaacaagggtattttattttcaaactttctaaaccataaagcacaacacaacagtattggtgtcctaactttatctgtcttctaataaatattaaatagaagaaataaaatcgaaacatgttgaccataaaaaaggttttgtttgttaaacaacccggtttcaaatctaacacatgaggttgcttctcatacgttcttaactagtagcagcagagttatctatataaactcttctttgtcatagaacaataaaaaccaaaaatcaattttcagaaaccatttcgtgacaatg

SEQ ID NO: 36324 - DNA, 3003 bp, Unknown; identical to SEQ ID NO: 36323
  misc_feature (1)..( 3003): 2750-1469P.txt file - cDNA_ID_3094132; gDNA_ID_2926220; Annot_ID_203282

SEQ ID NO: 36325 - DNA, 3000 bp, Unknown; identical to SEQ ID NO: 28803
  misc_feature (1)..( 3000): 2750-1469P.txt file - cDNA_ID_3094141; gDNA_ID_2926220; Annot_ID_203280

SEQ ID NO: 36326 - DNA, 3000 bp, Unknown
  misc_feature (1)..( 3000): 2750-1469P.txt file - cDNA_ID_3094150; gDNA_ID_2926220; Annot_ID_203278
gcatccatgtttgatgatttttcatcgtcctctcttgatgccttttttgatccttctcgtggcttggtgaacgtccctggtttgacagtgggtaagcaatgagcattcgtggtatcattaccttaaattttggcttccatatgtattaaatctcaattaaggtggaaatataatttgcttctatctgttgtaggcaccttcaaactcctcagcaaacttattgacaacaaaggattgtcagggacaagacgttactttggtgatcttgggaaaactgtaagtatcatatagtatatggctgatgaattttctagctttttccattcaacctcttatgcaaataccatgttgcagctaagaacagcaggatccaatgtcgtctttgttgctctcactgaaatctccgattctgttctgaggggtgcagaaatgaaaggtgttgatggactggtgaggactcatctacttattatccggtaggttgaatttaattaccactatcgtctttcttataatctccctctcttctctcaggttagcggtttccaccatggaatccttaaactggcaatggaaccgtctgtgataggaacagctttgatggaaggtggccctgatagaacaattaagcttgatcgtaaccccggtattgatgaggtgatattttatgccttgtcttctactttcaatttaaatattttcatttttatagagtataaaagagaactgagaaaactctatgcgtagagctttttctaatgtccatctacgtgtatgctcaaattcactcctttgcagttatacatcgaaggataccttcaagctatgttggatacaatgtataggcaagagtatctcagagtcaaagtcattgacgatcaggtaaataatatttctcgaacttagttttgctttgccattccaataaaagaaaacgtaaaccgattcattatgtttccaagagatgattaataccaacatatttccgttactgaccgaacatatttcacttataggttttcctgaaaaacctcccaccaagcaattctctcatagatgagatgatagaccgtgttaaagattttctcgaaagcaggggtttactcaaaggagatccctcaagctctcgtcctcgtcgccgtctccatggagacaaggtttaattccaatcccttttctctgcataaacataaacaccctcagtcatgtgaatatctctctcaatatgatcacaggaatggaagatcggaccaacggtgttgacattgtgtgaacatctattcgtcagttttgcaattcgcatattgaaacagcacgccactaaggccattacaagtctaaggccaaagaaagaagaagcagaggccgagacaagtgacagtggttccaatactgcaatggtaccagtagttagtgacaataagaagaagaaaatgaagttcatgtggaaagctggtattgggaacttcgttgcttcaggtatcgtagcttacatcgacggacgtttgtgccgacaaattcctaatccaattgctcgccggattgtgagtgggtttttgttaagttttctcgataaaagcagtgaacaataatcacttcctctgtatatatattcttctataatagaaccattacataaaataaaagcaataaagctcctttacgtttgttttcctcttctctgcatcaatcacgattcatcaacataggactatgagaccgatttcgaagtcttctgcatccgaggtgtgatatatcggccaatatagttttaatggggttattaaacttgtcccccaagcaaagacatgtaatttgttgatcagaagttcagaacagttttgtaaacaagattctactcaacttggcgtgaccaataagaggaataaaaatggaatgagagacgttgaacattgatcatcaaaattatgagaaccaatcaactaaaattactcaagtgattcattacaaataccttgaagaaaagtaacgttttggactgaatacgtacattcagtcagaagcagccttgtctgcaaggaccatgtatcaacagcctcaagtcttgtgaatccaactcctcttggaatctttttagaatctgtaggagaaatttgagaacattcgccaatgatccgttgtctggacactcgtccgtcttcttttctgcgtaagatttcgactttgtattgtcatcaccatctctgaaaaactactcatacttggtgatctgcaacaagttgctcttgtcatgaggccaaacatcactagtatcatccacaattacgacactttgcttatcagccacaacaagctcaagtgtcttcttactaggactttctttactggttatgactcgatctccaaagtaaactttgtccggatcaatcaacttcaacacggtctgtgcgtaagtgaataaccccattgtgtaaacatgcatagtgaaatgctcgttggctcctaatagaaattcatgaagaaaaggtcgaagtttaatgatatactcattggaatggcctttgttgaatctccataaatctagccttgaatcgacttgttcgagtagatacttctcctttttagaaatttacgaaacaagagtcgaatggataagcgtgtggtccaaatcaaggactaggtgaagcttcttctccgtcttcttccccttcttcttctcatcgagattcaagtgttgtaatctcttgacagatttatcaagtatttattataagaaaaaggaaatatatatgtggcgatctcaaataaaccgacgtacattatattgatcaaaaataataataatcaaaattgtaatttccttttttccgaaatacaatcccatctcaaaatttggaaacatctctctatatataatagacgagtagtctcatcacccacattattcatcaatatccctctgttttctctcgagtttcttctagccctagtttcttaagtacgttttctctgcgttgtttttctctcaaacacacaatg

SEQ ID NO: 36327 - DNA, 3000 bp, Unknown; identical to SEQ ID NO: 28800
  misc_feature (1)..( 3000): 2750-1469P.txt file - cDNA_ID_3094211; gDNA_ID_2926220; Annot_ID_203260

SEQ ID NO: 36328 - DNA, 3000 bp, Unknown; identical to SEQ ID NO: 28799
  misc_feature (1)..( 3000): 2750-1469P.txt file - cDNA_ID_3094220; gDNA_ID_2926220; Annot_ID_203258

SEQ ID NO: 36329 - DNA, 3000 bp, Unknown; identical to SEQ ID NO: 15118
  misc_feature (1)..( 3000): 2750-1469P.txt file - cDNA_ID_3094250; gDNA_ID_2926041; Annot_ID_196080

SEQ ID NO: 36330 - DNA, 3003 bp, Unknown
  misc_feature (1)..( 3003): 2750-1469P.txt file - cDNA_ID_3094275; gDNA_ID_2926042; Annot_ID_196087
ctccgccgccaccacggccgcagacgcctcctactttcgtgccagaagaaactcagccacagactcctccgccgccaaatcaacatcaaactcgttccatcttcacacctacccctcaagtaatttcctttctactttgcatttctgtcgaaaagttttcatttttaccaaggaaattgatagacttttaggcctaaaatttgtactctttattgaaattttttggtgggtttgtttgaaattagttaggatctctaagttggtaagttaaagtttccaaatttatgtttggctgcagcaaacgttggcatcattgaattcaacaaagtacacaaacaagttctttctgctgctcttcatctttcacaaggttgtggctattgggtttgtaggcttccttgtcttcagaggcgttcaaggtctaattggatcaaatggtagcgtcaaaaggaaagagaaaaagatcctcagattcttacttccacaagtcgaagctgcatcgctcttgagcatcattcttgcattcctttggcaaatggcattcaggatttggcctgatttcatgattcacttcatactttggagtacgtttttgatgtctttatcctcaggaatcctcttactgtgtttccagatgccagccactgatgctgttggggtttgcctcattgccttctcaattggcaatggtttatatgcttgctgggtcactcgtagaatcaagttctgttctaagattttggtcaagtcgttagaacctgtttccaagttctcggatttgaatttgcccacctactacatgctagctgctggtttcctctggatgtctatgtggattttcggtgtcatcggtgccttgaacttctattttccgccacttgtgattattggtttggtgttaagtctggcttggacgacagaagtgatgaggaatattgttaatctaactgtgagccgggtcattgctttgtactatcttaggggaatgcagtctagtaccaggtttagtttccaaagggccttgtctcgtaacctcgggagcgcgtgtttaggatctttgtttgttccaacaatagaagccttaagaatcttggcaagaggattaaatttgctaaagggtgaagatgagttcatgttttgctgcgctaattgctgtctcagactcatggacttcatatttgaacatggcaatggctgggcctttgtacaggtactataaactaattctttaaaccatgccactcccactctcttttcttaattctttaaacctgctgcagtcattttgtttctatataatatcttcttacagagaatcagtctagtaatagtattaaaatcaagttgattgtggtgggtcttattttttatatcatttctgatatgagaatcttgcatcatcttgacaagtcgaggcacaaccacatgctctttttgcatttatagtaattattttgaattagaaaaatagtcatattgaatcaatagtattgagctttgagtggtaacaacagacggaacaaacttagactagatcactttttcaccattcgaaagtgttttgtaccattggttgtttacttgtttaaaccgtattgttgttacagatagcggcttatgggaaaggatttgtgagggcatcgcaagacacatggaaactgtttgaggatgaagatatggttgaaatagtagatgcagacataacaagctccatatgcttccttacaggcatctgcagcggctgcgtttgtttaattgtcgcagccgcttggactcacacagtttacaaaccttttacagccaccatctctttacttgccttcttcattggatacctcatggtaaattacactttgaacttttcaactctaaaatgtttgattcaaatagtattctcatcatattttttggattgttggtaacagaccaggatctctatggcattgcctcacgcctgcgtaggttgctactacacgtgctatgccgaaaatccggaaagcagattcttcgaagacaaagtgataaaaactaggcaagatatgatcaaaagtggccgtgttgccgttaccagtaccacccctagagttcgccgtgctctagcttagcctgatcatctttttttccttggtgctaaattttcagaatgaaataactagttttttttttaaaatgtatttaaatttgaaaatgtaatttaattacagaaagagtgaagagccaaccaatatcagtaggggtggggaagaaattgtggatagagataagctcgtgacatggacacaatccaactaatgacccaaaagccaagttggttgagagctttttaactttttattttttcctttgttgttgttgagacccctcaattactttctgtacataatttattcttttgttccttcctgtatatgggtatattcctttcttggttttggaaagtagtgtagttttgaactttaatgaactattagtaatagtggtacatcttgttaaagtacttcaagctttagctagctttctgtatatgggtatatatttctttctcttacttagcttcattgagttcagcaacagtgatctctttctacttataaaattttttagtcttaaaggcccatcttgaaagaatttgaaacttttacaagaatcctatcagttttataacatcttactacaaacaatcataggcccatcagtttttcagttatcaaagcagagaggcccattttacaattatactaaacgtcatatgatctccattcttcagagaaacaagtccaatcttatcatttacatgaaatctaaaacccgccacgtgattcgtcgattacacagaacccatatacctgaagaaaaaagaaaaaaagaaaaaaaaaagcgaaattgttgtttgaacgtgtggtcgaattttatcgtggcgctgaattagcatccacaagtgaagaaaacagagagagaaagacagagagatctctctctccttcacacacacagatacacatg

SEQ ID NO: 36331 - DNA, 2267 bp, Unknown; identical to SEQ ID NO: 15119
  misc_feature (1)..( 2267): 2750-1469P.txt file - cDNA_ID_3094280; gDNA_ID_2926042; Annot_ID_196086

SEQ ID NO: 36332 - DNA, 3000 bp, Unknown
  misc_feature (1)..( 3000): 2750-1469P.txt file - cDNA_ID_3094289; gDNA_ID_2926046; Annot_ID_196094
tattgggattgaagaaaaaacgtgtaaagtaaaactctgttgggaaagttatttaatgagtcaactgatgaagttcgaattttttccaaaaaagagaaaaatagacgaacaaattagcgtataaatactaataccatataaatagattaaacgcaagatgaatctatctcatgtaaaactttatgaaaatatagtagacaaaaataaaaaaagagatacgttgttcaaagaagcaactcactaaatatcctatatatatgaattactggtttaaataacctaattacagtttacaggagttttatatggatgttgtccaatgtcgtaagctcataatcttagacttgttatgtttatttcaatagaagcgtgtagactaaaccgcaattggcaactcgagtgttccgtctgtatctccgcatcgaatgagagatacatgcttatgtaatatagttcagcgcgggcatgtttgtatctgcatttagtgattgtgcaaacaaaaatcaaatgatcaaagtagttaatgcctccagtgaagcatctcggaagctgtacacgagaggaagttttcttcaaagaaataatcagttgactcggtttaattgttacgtgtcacctagtgttgtaggttaaggatgaaatttatctccaccagattgcaaatttatttttatttactcgtcaatctatttcatcttcgttgtatatggtcaacgaaactattagattacaatcaattgattttataattattactaaggtatgaataatttcaacaccaccaattagctatagtttcgatctgcactttgacactaaattataatttttataatttagtgtatcaacgtgacatcatgtatgtgataattagcttacattatcttatactagtttgtaaacaaatactggccattggtggaggaaaattatgtgcactaaacaacaaatgagcatccattatagcttagactaaagaatatttgcattatatgtaatgagtctcatatttaagtaaatggcaattctaaaattttttcactagctagataaaaacacatcaatactttttattgatctaccattggtggtcagatgataattcgattcaatgtttagcctaaacatattctttctgaccgattaaaaaccaagtgaacgttttgttttggtcgatctatcccaagattagttggactttgttccaaatttcttgatgagcaaacacaaaagtgtaaattgtttcttattattgttgtcatgtaccatatatatatatttgacaaaataacctagtatagtagtagtagtatatatataattatatatatatatattaatattagtttcagtttgtttattttacaattatacacttctcactctaattggttatcaaagattcatgtttccttcacttgggttgtttcttttacctgtttcgataatattgatgactacatatatatccggttggagtcaaaatgttgaaagaatcgaatttagctcaatctttgaagttggcgtttagtttttgaaattaaagatttctctgcaatattttaattgaaaatcaatattgaaggacttttctgtaatataaatctattttaaaggttattttcaaacctgtataagattcgacaccgaaacatttgacattttcgataacgtggtgaggtcactgtgtgaccttccaagtaaaactccataattttcttagtattcgagacgacttaattgagtcatattaattaagtgatacataatatctctatatttttttggtcgaagatacataacaattttacggataaaatatttggagatttacatgctttcagattcagttttaatactcgtgtacatctgtcttcaaatcccacttaaccgaatagaaaagtattcgcgtatactgtttgttggtcaaaaaatagtcacaaaaagttttcaaaaatagatatcattgtttcacaacttttcttttaaggaaaaaaaaacactttttatactggaaaaactcaacaacaacgtcccctgccgttatatttgaaaaggattaatcatgctcacatgtaaatatttttcttatacgaaaaagtagttatccttattcaacttcgtgtttgtcaagtagctcgaagaatatttttgttcactaccgttggcttgtactaatctaatacttttatagtaggcccttaacaccatacaaatgtccaagtaggtatattcttcaatttttatttgattaaacaaattgagataaactattggcgttgaccgatcttggttttcattgcctcgattttgctgttttatatttggtttcttcttgctggttgggatgctgtttttgaactgtgaggtagtcttcatttgttataagaagagctgctatcttgatgctgtggattagaatttccccgtcgtttagccatttctgcaagcttttctttatcttggattgatggtgggcaatgtctcatgtgctagattctggttatagtttttgattttccatggttcagtttctattttcttatgcatttaaagtaatgtttgttagcttcccatacttttgggctttagtctccgaggatttttgttatccgtcgacttagtttttgagattatcttgttaatcgtcagctttaactttgtaaactctatctataatctatctttcagtaaaaaaaaaataaaaaaaattgagagaaacataatttatgagacaaaaagatattaaacatactctgtaaccgttaagctgttttcagcccaatgtcatgaaacccattattgaatttagttcttaataggcttatatagtcacataataatattgggctaagttacttggcccattaaatcatttcccgtggtaggttccagaaacatatcataaaccctagcagaaactctttcctctctcgtcgtctcaaatctcttcttccttcttcttctctctcgattcaagataatccacacgcaaaaatg

SEQ ID NO: 36333 - DNA, 55 bp, Unknown; identical to SEQ ID NO: 15122
  misc_feature (1)..( 55): 2750-1469P.txt file - cDNA_ID_3094296; gDNA_ID_2926046; Annot_ID_196092

SEQ ID NO: 36334 - DNA, 3000 bp, Unknown; identical to SEQ ID NO: 15126
  misc_feature (1)..( 3000): 2750-1469P.txt file - cDNA_ID_3094333; gDNA_ID_2926048; Annot_ID_196103

SEQ ID NO: 36335 - DNA, 3003 bp, Unknown
  misc_feature (1)..( 3003): 2750-1469P.txt file - cDNA_ID_3094340; gDNA_ID_2926049; Annot_ID_196110
tcgatgaaacactctttatgagttacgtaagaaggtgctactttagatggtaaaagacaaaactgctgaatgatagtttgatacagcgtgtatttgttgttgcacaatcctagtgcgtacacgaaaaaataaacagtactcgaaagtcgaaagtataaccagctcgaacaagtaaaatcctctagctggatattcgttattggaattttagaaaaatgattctctcaaagtgtaaacttgtggaaataaaatatatagcaaagtcgttgacataaaatatcacaaaagtcattctcgactctacaaatatatacttactagattttaatccgcggtacataaaagtttgtaaattgtatctatctataaaatatttttattttgtaatttacaattgttattaagtaacatcttgccaaacccgtcccgccaacccgtcccataaaaaaaccatttcttttattaatgttaatcttatttatgatatgtttatgaattattgtctaaatattttgtaattttgtagtaattaaatgctatcaaatatctctgcggtttgatgattataatcgaattgttataatcatggagaaaatcaatatcaaaaatgataattttgaagtaattaaatgatagtaaatattttggaagttttattttagtaactaatgtggagagttttaggaaagattgttaaatgtcaaatatttatttcgaagatgttttttttaattattaaaaacaaacattaaaattcagtggcagccattgtaaataagtcccaactacagaatttatttcacaaaataactgcaaaaatgtatatatagattctaagagaaaaatattaaactaacatatatttgtaaattgcaatagtattgacttatccgattatgtaacttttattttttttaattaagtatcttgatactacatatcttatcgatatgggatatgtatgaacgatttctgtttattttgttcttatttatgtgaatgcaacgatttaatttctttatttacggtctttctctcgcaatttctggaattctgcatagtggggatcatcagcctagttgacacggttacaaactgacagtgaccacctacaactattaaagagacttcattcaattctacaatattctagttaaactaaaagtttgcttcacattgtaacagacataaatccccaaaattatgggcctacaatttgcaataacttgtttatattgcacttctgtttttttttgtttatggtataagagttaatcatttggtcaacttcttaattgtatgtgtttgtacattgatctacttgtaatttttagcttattaattattatatggtgatgttggcccaatttcatcatggatagaatttaacctccactttttcaactctaacatcagttataaattgacttaaaaattaactacgtcactttccaaaaatatttttcaaaactcaacgcaaaacacatcatacaaattagacaatgggaaaacacgcgtttataatgacatttttgttcatgaagtgacaaatcatttcttcttcctttactgatctgacaattaaaaagcccgactcatccaagttttataatcaaattctaaacatccaagtttataatctaatcccctagaatcattctaaccgaccaaacttaaccggttgttttgtctcacatattttagttttatgtaattattatcactcgttaaacgcgttcctcgtcgattctgtttgactcgtatctctctatcattcaatcaacacacaataataagttgaataaaatatccaaaaatggtatataatataaatataaagataatggaaaggaagaggattgcatgggctaaaatacatacgatggaagttttagtggtgcacatcacaactttagtgcaagaaagaacatccaaacaatattatttttattatacagcttggaatgataaaaaataataatctaaaagctaagtttgacttgtttgcaaaataaaataactgagatgattacatttcggatcaaaccccaatcttcactttttaaaaaacttgtccaaaatccaacttttatatgactacatggtgataattcgcatgatataattactaattatgcatgttggataatgcagtaaattacactttaccagttaaaatagtttatattataaattactctttcggtttccaattactaaatcttttgagttttcacacacatgacacatcaaaaagaaagttacaataacaaaattatctatatgaattgttatttggtattttaaatagggaatggtagaggtgaaccatgaaaaaacttaagtgaaaatttataaatttgtgaaacttttcaatacattaatcagtttgaaacggaaggaaataattattttatgagtactcgaacaaccctatataccttaagaaaaagcacaaaaataatgaagaaaccctaataagaatttgaaacggaaggaattttaattataactagtagaactatataagtttctatatttacttacctaaataaatttaaataaacactacaataaatagtgtagaaactctctactcttttggttttccctttgtttcgtttctatattttattttttgagttcattagaaatacaaaaatggttcaaatctaacggtgctacaaatttcttcacaaggaaaagacactgtaacaaaattgaaattgccataacagtcgcaggaaaaaccatagtactactagtaacatgaatcatgatctgtctgacaatgacaacaaaagaatctgcctatagacttcatttatatattttcctcttttcacattatcagtctttattctttttaaaaattattttcatacttataacgtcaaattcacatttcttctctctatataaaccacactaactttacatctctcttacaaactccaagagcctcggagcattcgaaaagttcgccggaaaaacaaaaacatg

SEQ ID NO: 36336 - DNA, 3003 bp, Unknown
  misc_feature (1)..( 3003): 2750-1469P.txt file - cDNA_ID_3094368; gDNA_ID_2926051; Annot_ID_196119
tgaagaggtaaagaagaaatccgtcaaagagcaaatcatcaaagagccaaccgtgaaaggtaagagaggtagaaaacctgtagaggcgaaaaagttgaccatataactacatcctgctcttgttattaatgagaagggagaagctgatgaaacaaaattacctgctcttaatgtgaagagagagtgttgttgtctccaaaaaagctgaggaagtcactgacaatgatggttagaaggaaggtgacagtgacgtatgagatgtcacataccagtttatcggtgaaaacggaagcacgttccctgagtctgatgatgatgaggattgatataatcgaagctttaaagacgcagagtattaagctgtctacggatggtagtgcattgaatccactctttaatctctcaacacgggtttttcctaatactggagacaacagactgaagtgcatgaggaagaattgtgtgccttcagctggaatatatgatcctctatcaccggctgatacagccaaattgtagaaacttaaggattacttatccccattctagtatgaccctttataccttattaagttgttaattacaacttgttaacattatttctgtatattaacttgtgtttatttgttaggaatctcccattgggcagggcaacaaacgatgttgatttctacagggttatcatctccgaaagaaagcactgaccaaccagagaatatggatggttgttcgatagtgtaagtattacattagcagagttattagtgtgttttgtcagagttttactacattatggctgagttattggtgtgttatgctacattatggctgagttattagtgtgttttgtctaagttatgttatattgtgtctgggttattattttgttttgtctgagttttttttttgtacaacatgtggctgcgttatatagagtcctcaggaataggtacaagcgaaatctctgcccattccacaacaaacgcattgcatttctagacacgtgattcgtgtctttttgggttagagagtatgtacagtgcaaaatataaaagaagatgtttaaattcaaagacaccccgtatgaaaagatagttaatggtttgcttccagataatcaacagacaaatatgaagtgaatagaagatgtgaatcacttgtatttgattccccaaaccagaggcgatcactaggtggcactacacatggaccagattaaggggcacattgattgctatgatatcattgtgggataagttacaagaaactgaatagaattgattagaatgttgtaggccgtttacgagaatgattccagcaatgatgaacgtgctaattcctactacaatcggtgaacataggtttgagcagtttacattcaaaaggagtagtgtctccagggtccctcaaaacgtacaagttggagctgcggcgtgtactcgtgttaattttttgaatgtctaacgcttggtataactttcaatgacatatgtgatttcaacctatacaggttaagatggcagcatatatctacaataaggcacctaatctgcttggacagtttaggattttgacttgggataattatattaacttttgaatcgtatttttttcaacaatccataagaccaatgaattttgttttctttataatggtttgatttcaaactaattttcatatcttggcattttcagataattaaattggaattttacattacaattattcttctcatagaatcaaaatgataaatctatattaaatatgttactatattccaaacttttttggtttagttttatggacttactatattgtgcataactcaaattaaattaagacattttcacttgggatcactatattaatttttgaaccgtatttttttcaacaaactataaggccaatgaattttgttttcttgtaatggtttgattttaaactaattttcatatcttggcctttttagataattttatattagaactattcttctcataaaatccaaatgataaatctaaattaaatatattgcaaatcttccgaacttttgtttggtttagttttatagacttgctatattatgcataactcaaattacatttaaaaactccatttgtcaaacattaggttttaacaaatacctccataatccccatgtggctttctagtacaattatttgtcaaacctacgatctatcttcattttagaatttctgagatttctctcacagcctataaatcaagtacaacattaggtttatagcatgatctccaacattaagaataatcaagtttttaccatttgttgttatttccaacttaacatgatcaaaactaaatgcgtggagtctttatgtcctcgacataacattatgtaaatactttttgactaaaaatagtaccattcacccttctaactctatgtcaatttgactacaaaaacattttgacaaaaaaatgaacgattacaaattacactgatggaaaatatacttagtcgaataaccaccaacggttgaatgtaaatgtggagttccaattattaatcatttttttcggcactcaattcacgaatgtgaatcaccactaacgcatctaggaatatatatagtaaggtatacaacttattttttaatcaaaacaaaaaaatatttgtagatttttgggacctttggttttccttaaaatagataagggaatattggaggatagatatgaatctatatgaattagaatttaaggtcttaaatccctttgtgataaggtttgggatacctatattttaggatctgtgtttatctcctgtggaaactctcttgtataaatacgaacgtgagttcatcaataaaagcaagtcactttgataaccaattctacatggtatcaaagagctgagatcatcaaaatcatcttcaaaaattttgtgttcttaagttaagaattcttaaattgtttcctttctctgttgagttgatagtcttgtgtgtcaagtaacaatg

SEQ ID NO: 36337 - DNA, 3003 bp, Unknown
  misc_feature (1)..( 3003): 2750-1469P.txt file - cDNA_ID_3094390; gDNA_ID_2926052; Annot_ID_196123
gcatgattcgatctgctttggagagaccgtagcgaccaccgtaaccaccatatctggctatgcaacaacctcccctaccgtccatgatctctctctgtatatatctttctctcttaataggttttagtgggagctttgaagaataatgaagagaggtgtgtgtgaaggggtttatatagggactctgaagatgacaagtgttgggttgatacgcgtgtctttgtctagaatacgcttatcaccgttgcacttgcacatgctctttttccttctgtaatggacatgaaaaatgaatcgaatttatgtttaaaactattttctaaaacgacaaaaaaaactattcaaaaatggcatgacatagaaatataattaaacttgtactattttttttttatcacaaattaagcagtacttattgtaatttaatgttttaaaaatggtcggtgttttgttattggaaaattcgaagttctcagtatattggtctaattaatatttgacatgaaggtatatatttgattcttatattcggttgttcaatcaaagcgcggatgaaaaaaatatgatgttagcattcgagatttttataattagacgtatacataaggaacggaattgagaacctaatctggtctaatagtatataattaattagtaggtcccgtggttagctaataatcactttgacccttgtgtttactactttagtacctgaatagtatactaatttgtttggcctaaaaacagataatcatgaataaatgccaaaattaggttaaaatatagtacatcgaaatgaaaaaaaaaaggtaatgttaggcatggtccaagagatgagggttcatacattatcattgaccgattctgaatttaatttagtggaatataatcttaatcaactaaaggtgatcgtgactctagatctcaaatctttattaacgggacaaggtcgatgatctcatgtccaaagaggaattttgtgccaatgaagttaggccacctcttttatgaaagggaaagaaggaacattggatggcgtataaataaaaatcatgagggagtgacggtatcatggagccatcttaaatataatcatacaattgattcggaaaaagtatatatggacatgagagtcaaaatcttattaaaaatccaatatagtaacatagaaataaagtagattcggaaggcagttcgagatggcatcaagaaaaatctgatgggtttgtgttgcgttgtacgttgcacgcaagaggacacgtagagatatgtaattagcttatcaacttacaactataatttacacaaacaatctcattatttaattaaccaaggcttaataattagtccatatatatttatacattcatgaatgtggacgaaactgatgactgatgttgagacttgagagttaggtttgattctttaacattcgatatctcatcttccatttttcgttattacatattttgttgcaaggaaaacacgatataccgtatagagttgatgtagctaaagttttaattcaacaatgtaatcttgatcattaaagtatagatgattttagtggttctacttgacgtccctacagatagtaaatgcaattatcaaaaacatgtcatagttactaaaagaagaaggatgcacaaatacaatctttttgggttggatcagatcaaattatatttggcttaaagacattgattactacgtatatattaaacaaatgaataaaattgactacctttgctctcaccctcacctgctgattctatacctaattaattatataatacgatagccaacagtttcaacataaaaccaccatcgaaacatactactgatataatatgcatatgggacaaatgaaaaatgaaaaatataacggatgaataacgaaaaatgaaaaatatcattaatgatataatatgcatatgggacaaagcaatcttatccgttacggactatataacatatcatttcttaatcatatattatatacgtatatatataatcgtatatcatcagtaatatatttgttgtaagaaaaacacatactgtatatacatgaccaaaaacatttcgctttatgcattgatgtaaaaaaattaaaactatacataaacacatcaaaaattacagacacttaacagatgtaccatgtttttttaagaatcaatagttacaaaatttgagaaaaaggtgatattttgtcatttcgttggatatgaaggaaccaatgataaaacatcgttagttactaattcaaacaacaaaaaaaagaaccccgaatttaaatgctcaccatcgacaaaccttggctatttattttataaatataagacaagtactaaatcctatcaacactaaacaataaaatcgaacatgttcacccaattataatctgacagctgaagaagataaggaaatactaaatatagagaggttcgatgacagagagaaaaaggtagactgaatcaccatcaaaaccacgcccaagaaccctaattggggaaagtggccaaatgaattctcgccacgtgtggatctgatggtgtcagagtcggtaaagtttaaaaaaggtaatgtgtgatgtctcgataagggcttttaaactggtcgttttgtctgggacacttgtacagttttggaaaggaggacccatgactagggcattctttagttaattttaaacttgataaatcagtatttcgtttctatatatttgtttatgaaattctgtatcattagagaaatcagatgatgtggcaatcattatctgttctctttaatcgaccaaaggttcgaacaaaatatcattgttggttatctgatatagagaaaactaatttagaaacctcgttttgaaaaattccaactacaatatgagatttgattctacaggagtttggaatatgggaaagggaatttacaaaagtgattgttgaaacattaccgattgttaaatggtaatagacagctgaagctgcacaatgacatatg

SEQ ID NO: 36338 - DNA, 3000 bp, Unknown; identical to SEQ ID NO: 15131
  misc_feature (1)..( 3000): 2750-1469P.txt file - cDNA_ID_3094396; gDNA_ID_2926052; Annot_ID_196121

SEQ ID NO: 36339 - DNA, 3003 bp, Unknown
  misc_feature (1)..( 3003): 2750-1469P.txt file - cDNA_ID_3094412; gDNA_ID_2926053; Annot_ID_196131
atactaccacgagtgaaatcctagaattgacgggcttgattcgatattaatatgggatggtgtactacgggtgatattttagaattgactggtttgggttgataataatttgcgatagaattaggagtgaaatcttagaatgacaattaaaatataattatacaattaaatactaccaagggtgaaatcctagaattgacgggtttgattcgatattaatatgggatggtgtactacgagtgaaatccgagaaacaacaatcaaaatacaattatacaatattaaacatttaacaaaataaacaaatacaacttaaaactttaaaatttgagttataaaatttcttctcgcggtaaattatacattaaatcaaacaatagcataaatttattaaattatcctaaaaaatattcaattattttttatttaataaaaatatagacccgcagtataccgcgggttaatatctagtagataaactatttatttttcactatcattattaaactttttgtcataagtttggtaaaccgtaaaggcgtaaactaggttttattttaactaggtgaacatacgtgctacatgggaattgttgttttatatatatatatatatattcaaaatcataatcttttttactatcataaatacatacacaacatagtatatattgacaatgatatgtagttatgtttacttacatgtggtttgtaacttgagtatttgactaacttgaatctaaacaaacaattccttattcaacttactctctcatgatctaatactccagccacgcacatcatgatagactcatgattaaatactaaattgacataatttaaacaaaatatttgtaataactaattatttgtttcaagttttttgacaatctgacattctttgacttcaattgtcataaatggaaataagttgtctgtgtatcatgaataaacacaaactcaatttagtatgcagtgttcaactcatcaactctatcatctgttcttacatacaaagtagacacattatttatgcagtcaaagagaaagagaaatatgatcacaagaaatggtagtaacaaaaaaaaaaagagaaaagatcatgaaaaaaagtctatgatgttccacaacaaccttttcctttagattcagtctcttctccagcaacaacaatcttagttccttgcaaaagagaagagtctcctccagattctccttcctcattagcaacaagattctttttactcacaattcgatatatttccgtcaaaaccgtgaggaacgaaggctcaacattgtttgaatccaaggctgatgtctccatgaaaaacagattttctctttgagcaaattctttagcatcctcggttggtacagctcgaagtgtcccgagatcagttttgtttcctattagcataatcacaatgtttttgtcagcatgtcctctcaattcttctaaccatctcgctacatgatcaaacgactgtcgttttgttatatcgtaaactaacattgcccctactgctcctctgtagtatgcactcgtcaccgctcgatacctaaacaaaatctccacaatcagaaatattgatctcatggtacgaagagttcttactatgaacctattcgtttgacaatcgttggcgactacgacatgttattatgttcactgaataaataagccactacaaattttggtctatatacgacaaagttttggtcaaagtccttagcgactgccaagcgaaattcgaagcaaccaaaattttcaacttctaagaactaaaacaaggatctacgatggtaaattatagataggaaaatttaccgttcttgaccagcagtgtcccatatctgagctttgatagttttacgatcgatttcaagtgttcttgtctgaaactcgacaccgatcgttgctttagattcgatactgaactcgtttcttgaaaacctagcgagaagctgagatttaccaacagcagagtcgccgatcaagactaccttgaacacataatctatcttctgattgaaattgctctgaaattttgacatcgttcacaccaaaatcacaagcttatagattttagaggcgatagaaatgacttagttgtaatataagatctctgatgtaataagaagaggagagatctaaaagatgaaagtgggttgcgacttgtgaagcatcgggagacgtgaagggaagaaacgaggagggaacaccaacgaaagtgggtcccgccttttgtttcctttttcttttcattcctttttgacgtcattcttttttttttttttgcaaatctcagcgaccacaaaaaaacacacttaaaatccaatttcaccctctctcgtctacctccggtcgtctcgccgttctcctcctcctccactatagctgcctgtattcgtcttctctatcaccgtaagttatctttcgatgctttctaagctattcctcttcttctttagatattcttcaacatcgtcgcttagacccagccggtacaacattgtgctaaaattatgcttaattcggttcagtgatttctctcctgtgacaggatttttcctaatccgttttacttattctttggtcttattaaataaaattcgaaaactttgattaggtctggaattgatgttttttaagtttgacatttaacttgtttgaacaatgttttgtatcttctgcagtcaagttccgctttatgattagtttgagttaagataaacctgttgaaatgttatcttgttttgatacaaaaggtctttgatttgaatcaatccataagaacgagcttgagactcagttatgtggcatgttaaagttcatatatgattgagactgagtgatggattatatgcaattgtttttctactgtttcataccattatggtaccaaaagtacttaaattcaattgtgtcgtgaagctaatgtttactacattctttgtgtagctcgttatctggatctgaaatattaggtgatacgaagccatg

SEQ ID NO: 36340 - DNA, 3000 bp, Unknown; identical to SEQ ID NO: 15133
  misc_feature (1)..( 3000): 2750-1469P.txt file - cDNA_ID_3094428; gDNA_ID_2926053; Annot_ID_196127

SEQ ID NO: 36341 - DNA, 3000 bp, Unknown; identical to SEQ ID NO: 15134
  misc_feature (1)..( 3000): 2750-1469P.txt file - cDNA_ID_3094442; gDNA_ID_2926054; Annot_ID_196135

SEQ ID NO: 36342 - DNA, 3000 bp, Unknown; identical to SEQ ID NO: 15137
  misc_feature (1)..( 3000): 2750-1469P.txt file - cDNA_ID_3094468; gDNA_ID_2926056; Annot_ID_196144

SEQ ID NO: 36343 - DNA, 3000 bp, Unknown; identical to SEQ ID NO: 15138
  misc_feature (1)..( 3000): 2750-1469P.txt file - cDNA_ID_3094495; gDNA_ID_2926057; Annot_ID_196149

SEQ ID NO: 36344 - DNA, 3003 bp, Unknown
  misc_feature (1)..( 3003): 2750-1469P.txt file - cDNA_ID_3094505; gDNA_ID_2926058; Annot_ID_196160
caattttccactgtaatttaacatcaaaactcacacaaaacttccatcaatcgcaagccaatgaaaaccctaaaaatcacgaaccttaacaattgtatcatttcaaatcaatccagagcatcaattgcacagtagagtaaaagacccaaatcaaatcctaagattacgatcaaaatcgtaaagatgaaagaaatcgaaatcgagcgaaacctttattgagcttgattacaaacttcttagtaggttgcggaagtgtagctttcttccgagagagattagcggcggcgggagttggatcttcctccatatgaaagccaacaaccttgtcggcggtattagggtgttgaggggaatggtggaggtcgtttttggcctttttcatcggaggagaagagtaagaagagtcgtcggaggcagaagcggcggagaaagtagagcgtttggtaggaagagacatgaaaatgggtgaaaattgtgtgagagaatcacgaagaggaagaagaagacatcaatcctaaataataacaaccctttctctctaccaaaagcgcactgtgcactctctctctttttttttttgctcaaacctacgcgaaaactcgcgatttagacccgacccgagaaatgaagattttttgtttatttatatactctgaataaaatcagaattattttatttatacattcataaatcataattactatatgataaaaaaaatattattgataaaaatagacatataccgcaatgattagatgtgcgttgttttaatggttactaatcacaaaagtgaaaaacaaaaaaataaaaaataataatcaattgttgcctgttttgtatggttattttttataactacttttaaattttaactactttttatttttagtttttgacaactgataaatcatatctattgtatatttttagagtcgaatttttattaagtcattttacgatttaaagaataaagaatcgatcacacgagtcgatgcttgatatttagatcatttttgatatatatttttatttttattttaaagaaaattgagttgattttttttccatatatttcttttattttttaaaaaaaactattttaaaagaatatattagaataaaatgcctataaaatagactcacctataacgtggagaatggagataaaaatagagatgattaaatacttttagcagtcggtaatttcaggcagaaaattgtgtgatgttaaaagacatgaacgaagaatcatcacttgacaatatgaataaatataatatgatcgatgtcatggattagccaatgtggggcgtgttgacttgctgctccacagggtttttggacttccggtttagggtttggttctgattacaaaatatgggcttatcaaattatttacaggagttaatactttgggcctgattacaaaggtttaaccgaagcctatcaagcagataagagacgagatgagattgttagagcatctccatcggcaaaagtggtagagagtatctcaaaaagtaaataaattaatattttaatcaaattaatatattttaattagtttgaagtaaatgaactattaattgaatgacaactctcaataaatgctgagaatagtctctcttgccagtttctccacttttctcttcttctctcatactttttctctttttaattattatttaattgatgagtatctcaatcagatattccgatggagatggtcttacaagtgttaccgagacgtaccaattggcgaactcatataacttgtgctgttgtgcgaatgtgttttgattagtgagggttcttgggccaaaaaacatggctggtttttaagtcgcaattgcaaggatgaatattattacagccacagcctcaacgactgcatggtcttaaaactttttattacatgttgattagcctatggaattgtataattactaatacaaaatggtgttcattacattctcacctcgcttaaacttactaataatttttttttatttctttaatccctcattaacatgtcaacacatttattttttctttattcatgtttcaagactatagaatttctcaattaatcccaattgatactaataatagcaaattgtaagtctcttggatcgttggatcaatattttcacatgcaaacatgtgaaaatgaggagttattgaaaaattgtaagcttgacataaaacaaacaattgaacaattttagctttgaatggtttgtacatggaacactgattaataagattgcggattaaaaccgcttctgtttcaccatttatatattctaatcggtagtcatgctgagatataaaagtaaaaataaaattgttgtggactgttttttcttccaaaatttacatcgtaataaaaatagaaatcttatgcaaaaattataaagatttttttttagcttttactaaaaaataaaataagatttgtttttagtaacgctttaccttaaaaagctgctagagtttctaactttcagtttattatcatcagcacaaactcttatgaagatcttctatttcttcttcatcctcttcaacaccaatcactctcaccaaaaatgaataataaataaaccataaatctctcttttatccaatgggaaaattcatcacaaccacactatctccaccgctctatgcccgatcaaagcttctctgtttttcacttctctacttattcagtacaatctttctgttcctctacgtatctctctcaagaaaccaatgcatctttcgatattcgccatttgatccgattcaagcaaaacttttctcttatccttcttcttatggtgaacataaatatgctcttcccactcatcgatcttcttgttcttcccctattttcttttcaggtaattaactatttcttcatttaagaaaaataaaataaaactatttcttcatttttaatatttttactaaattttgatttttagataaaataaactttttgatcagtggccatg

SEQ ID NO: 36345 - DNA, 3000 bp, Unknown; identical to SEQ ID NO: 15141
  misc_feature (1)..( 3000): 2750-1469P.txt file - cDNA_ID_3094509; gDNA_ID_2926058; Annot_ID_196159

SEQ ID NO: 36346 - DNA, 3000 bp, Unknown; identical to SEQ ID NO: 15139
  misc_feature (1)..( 3000): 2750-1469P.txt file - cDNA_ID_3094514; gDNA_ID_2926058; Annot_ID_196158

SEQ ID NO: 36347 - DNA, 3003 bp, Unknown
  misc_feature (1)..( 3003): 2750-1469P.txt file - cDNA_ID_3094555; gDNA_ID_2926060; Annot_ID_196176
tccctcttctatttctaatctacacaaactggagattctagatgttaaattctgctctatgctacaagttattcccaccaacatcaacttagcatctcttgagagactcgacgtgagtggttgctcacgattgagaacttttccagatatctccagtaacatcaagacactcattttcggaaatataaagatagaagatgtccctccatcagttggatgttggtctcgtcttgatcaacttcacattagcagccgaagcctcaagagattgatgcatgtaccaccatgtataactttgctatctctgagaggtagtggtatagagaggattacagattgcgtcataggtctcactcgtctacattggctgaatgtcgatagctgcagaaaactcaagtcaattctgggtctcccctcctccctcaaggtcctagatgcaaatgattgtgtatcactcaagagagtacgcttctctttccataacccaatgcacacactcgatttcaacaactgtttgaaactggatgaagaagcaaaaagaggaatcatacaacgatcagtgtccaggtacatatgcttaccatgtaaaaagatccctgaagagttcactcacaaagcaacaggcaaatccataaccatccctctggcacctggtactctctctgcttcctcaaggtttaaggcttccattctcattttgccagttgagagctacgaaactgaaggtataagttgtagtataagaaccaaaggaggtgttgaagttcattgctgcgagcttccatatcactttttgcgtgttcggtcagaacacctgtttatatttcatggtgacttgtttccccaaggaaacaaataccatgaagtggatgtgactatgagcgagattacatttgagttcagccacactaaaatcggtgacaagattattgagtgtggtgtacagatcatgacagagggagctgagggtgacagtagcagggaattggaagttttgaaactgagagtagcagcagcccagttgggagatttgttgggaaatttgaatttggaggcaacaacaatcaccacacagatggaaatggagatggaaactatgaagcagaaggttccaagttctctcaagatgaaaacatcaaaaccagcaaacgttggttttatgagttggcttcggaagcttggtcagtgaagaagatgaattctcatggagtctcatgaagaccaaaccagtttttggcactttcttagctccttaatcatcttcataaggtactctctcttaaataacagatggagatggagaatatgagcctgaagctgttaagctctgtaaatgtagatgaaaacatccttggttgttggatttagtttgggaagtttaagggtagacgaagaagtacaaaacatgcaacttaggtcgtaggtcttcccattaaccagcataagtatttggcatacactagagaccagtttccttaatttctgttgttgatgtgttgtgtggattgctgtagaagatatattgctctgttctttagtcgtcgcgaattctttgggaacaatcttaagagatggatttatctgagtttgcagagtgatgttagaattgattctggttagaatgtagattgccttagccatagaacgtaaacgttagaagcttatgtgaatcaagctatcaacgcttaacattatattctttctgtttcaggtaggagattgggaatttcgacgcagcacctgattctccagtgatcaaatctaagtccacacaaagagaccatattgtccaatcagttccagatacttggtgcattgccttctgttgtgagcataaaacggcaaaccctatgaaagaaggttgatagcattagagaaaacagagcattgcagctcacacagtccacccatgaactgatgatttttccggattgattgcatcttagaatcataatcctgtttccattggccttaattagctgtttaagtactaagaaaagtcttgttaccttgtgatctagttaattagctgtttaaatactaagaaaaatcttgttaccttgtgaattacttaagaatcataatcttacattagtgagttactttatacagtctacaattggccttgaacttacattcagggagtgatatggcggctgagactggtctataaaagctgctcctggttcaagcctcctaaaatggtcatttgaatgaatcttgtattattgattcgtgtttttactttctactttttagtaattactttttgccagattgattgatcttataatcataacaattgtaactctgtaataactttcttcaacatctcttttactatgaaaccaagaatagtagcagcaaccaaccaaaccaataataaacatcaaatctttaagaaataatattcggattacccaaataatcaaaccttaaggatggggtctcaacgacttttgggggaaacattttgtttttgtatttttctctacagtgacaaattcctttgaaatttcagttccgtatatagcttatccaaaacatcaaattaagcatcgtgatccataattagaagcttgtcattcccaaaagcagaatttagtttcttgtcgaataggtaaatatcaaatttcaacgtttgcaaagaaagtttggttcttcattcttgatgttcaaatggtcaattcgatattattgttaattaacttaatacaaatattctccttttcaaaccaaatattcaataataatatgtacgaaaatagtcattggtcctcgacgactataacaaaacacagagtcgtcgaaatttctcttctccttttcgtattttttcagttccagttacattccaatttcttcgaaacttctcttctcattttacgcgtttttgcttcaataaataatccaaaggatcggagcttgcttttcaaatcatactttcttcaataccagtctaagaatactttcttcaagttcaagcatttgtgatctctcatg

SEQ ID NO: 36348 - DNA, 3000 bp, Unknown; identical to SEQ ID NO: 15148
  misc_feature (1)..( 3000): 2750-1469P.txt file - cDNA_ID_3094574; gDNA_ID_2926061; Annot_ID_196180

SEQ ID NO: 36349 - DNA, 2518 bp, Unknown; identical to SEQ ID NO: 15147
  misc_feature (1)..( 2518): 2750-1469P.txt file - cDNA_ID_3094580; gDNA_ID_2926061; Annot_ID_196179

SEQ ID NO: 36350 - DNA, 3003 bp, Unknown
  misc_feature (1)..( 3003): 2750-1469P.txt file - cDNA_ID_3094600; gDNA_ID_2926062; Annot_ID_196184
acaaattgatgcaatatgtaacattatatatgagcattctttcagtccggtttatcccctctataaagtcctctattgatgctgtatctaattcgtagttttgaaatggtttggtgtttctaatgaattttttttttgttcatgatatctccagcatgtcaaagatcattgatcgttacgaaatacatcatgctgatgaacttgaagccttagtaagttagctacgaatatcattaaaattcttctggatgcagtttttgatgttatgaagggatagaagcactggtcgaacctgagataactcaatgttttgaatttttcgtactggacttaattctctctagttacagttattgcatttttcggaaaactcacaatctttctgaccattcccttcgttttctccatgtgcaggatcttgcagaaaaaactcggaattatctgccactcaaagagttactagaaatagtccaaaggttagcacaaagacacttttatctccctcttcttctgatgaaaaatacttttttttttcttttcttttggcgaattatgaatacagcaagcttgaagaatcaaatgtcgataatgcaagtgtggatactttaatttctctggaggaacagctcgagactgctctgtccgtaactagagctaggaaggtattttgtactgctactaagtgatcaaaccaattatcccaaatttgttttgttaattagttagatctgactacaagtatagtcttttgatattttcgtaatgtcttgttgtagacagaactaatgatgggggaagtgaagtcccttcaaaaaacggttagtacttttgttttttatttgctatcaaagctatattgtagggtaatgctgattttttaatactattaacctcggattctgcagatcctgtaaccaagtttaactctagatatatctctaggtcctgatttattcttggctttatttagatgaaaccctaattagaacccaaaaaaaaagcacttataaacttgtgatcaaattcgacttttctccctcgatgaatcaccgaattggatgaggatcatgctcagatagctttagaacttgttagaaattaatgaccttatgatcttgtccaaacaggagaacttgctgagagaagagaaccagactttggctagccaggtgacaaaaacatctcttgaagctaattcatcagttgatacacaataaaaatagaaattacacttgcgttaaacatatatatataaaagttgaaggactttgattgatgttaggcattttttttgtgaaacccccatatatcttaaaatctatgataaaagtcctttcaaaattcaaatttcttgttactatttagttgaatgatcagttttaattaatgaaattttccaaaaaaaaacagcctttttacaatatagattgatttcttgttaatgtttgttagctgtaggaaaataatataagaaagtttcttacaggtggggaagaagacgtttctggttatagaaggtgacagaggaatgtcatgggaaaatggctccggcaacaaagtacgggagactcttccgctgctcaagtaatcaccatcatcaacggctgagctttcaccttaaacttacagcctgattcagaagtttttacaaatttgtaaattataaaaagcttcataataatctcaacctttttatcttcctcgcgccaatgtggaaattaaggttaaaaataaaataaaacagaagctcatgcgaaagaattgtaaaactaagataaagctatagtagatctttattgtaccttcgtagacgatataagatttattcgtgtgtttgtctttttgtctgcaagtacggattggatttaaagttttactttcttcagcgtgaagaaccctagacatagagcttcttaattcttttggttttacttatttagttgttagttatttgattacttgcacgtgacgtggcatagtgattttttccttttccaagtttatcagttctacttttgaggaactcaaaagactattcttccagaaagaaagaatatggcagaaaaatacttgtcttggctgtgcttccagcttcggcccattgaggcccatcagaagttgttttcattttttgtttcatttgcagctgttactgtcttactgataagtaaattagtaatataatatatttctgtttaacttggttcgaatttttgggttttggaaaacatattaatatcggattggtttggctttggattcatcttcgagttttgaatgtttgaattttaattttgcgggttatttgtttccaatcaaaacaagtttatcggtcagttttagggtcagaaccaaaattaaaataagcctaggatcctgagaatgacaagtcacgagcggaatatcgtcatatgatataagactaacaaaaacatattgaagctctctgatctttcctctagattcgtaagagatagacagattgaaagtttgaaacatacaaacacagaacgattgacgacagccaagaacaagtattagacttaccagtgatactaattgtatccaaaatggataaccttaacttattagttcttaatacatcaaaacatgtgaaacaaacaatataaaactgccgggaagaaggagtaaaactcgcttaaaaccaatttctgttcggtagggatgatcatcggaccggtctaaaccgactggattaaaagtttcattttaacaacactccccctaaggaatttcaacaagcgtaaaactaaaataaataactattacatgcctcttcctcgcttcaaaacggcaccgtttccacttgttattatttttctctctatcgtctaacaaaaaaaaaaactgacttgggattttttttcatttgtctagcccaaaagaagaagatagaaacgaagaaaaaaagcaaacacattttgggtccccggtggttaggatcaaattagggcacaaaccttatcggagaaagaagccatg

SEQ ID NO: 36351 - DNA, 3003 bp, Unknown
  misc_feature (1)..( 3003): 2750-1469P.txt file - cDNA_ID_3094607; gDNA_ID_2926063; Annot_ID_196193
atgtggtcgatatattaagcttttggtccaaaaaagaattgggacttataagcccataggccctttaatttgtgtagaaattgttcatcttacttcatgacaaacaatcaactctctaaaaacttgattatgtatggattttgataataattcccttcaaattgcaagtggaagaatacgtaaaaacataatattaagaaactttaattcagcatgaagaaaaaagttggtaaacatagcagtgaactctatgaatctttaaccatggaatttcaagagattccaccaaaaacacttcaagttattctatgaggaaataaaaatactggaggaccgtataacaacctacatgcaagttaagagttttcaacaattacccatatccaatcgtcacaagatccgtatccaatccttctatttttagtttctataaattttattataagctataattttaaatgaagtactagattttaacccgcggtacaccgcggggacaattaattttttaatatatataaaagtttgcaaattgtatctatatataaaatatttttattttaaagtttacaattgttattaagtaatgtcctgtcaaactcgtcccgtaaaaaacctatttattttattaatgttgattttatttatgatatgtttataaatcattgtataaatattttgtaattttgtagtaattaactgctatcaaatatttatgcagtttgatgcttataatcgaattgttataatcatgaaaaaagcaatatcaaaaatgataattttgtagtgtttaaatgatattaaatattttggaagttttattttagtaactaattgtgtagttaatgtggagagatttcgggaagatagttaaatatcaaatatttaattcgaagatttactttctaattatcaaaaataattattaaatattagtggcaaccactgtaaataagtcccaacttgaagatttatttcacaaaatggctgcaaaaatgtatatatagatactaattttggatgaatttcattaaattcacttgtatatttttttattataacgtaaaataatttagttacaattttatataattaggatccaatccctctattttagtatctataagttttaatgttttattaatgtaaaataatttagatataatttaattattagtatctaattttttattataatataaaatagttttttttgttttttttggcaaaaaatgtaaaatagtttatttattactttaaattagtatccaatcccacagcactgtatggctgaagttatccacaactcacctacctatacaagcatacacgtgatgatatcatgctaatcacttctgaaggaacaatgccgaaaattaaaccttattatgcattcattaacatccgaatccatttttctactttgacaaaatgaacaatatccacatgccagcatctagctagatgcagacctggtaaggcaccaatgggtttgaaaccttcctccatattgttccaatttgtatatattgcatttcaaaaaaccagaaatatttactgtaccattcacgatcgacccaaaggatttgaacccaatctcatagcctaatgaatcgtattcaaaattgatatgcaccatgagaaactggtatcataaacaaaaactgatatgcaaattaattaattaaatcacacatatgctatattttctctatgggctggactggtgttttgttttaattattatgataagaagaattgcaccaaaaaaaaaaaagaaaaaaaaaaagaagaaaatcgtatctttttgttctacctatacagacacataatgcatcattttagtttttgggacaaagacataatgcatcaacgtgtcagcaatatatgaaacgtgaagaatgttttgtctgagtctgagtaaaattactagaaattaaaattagtaagactgactaattacaaatatcccaagtctgtgtttattctaagacaactactagaaaacttaactatattagactaccaactaggcaacaaatatcacaaagaatatcgtatgtcacctacctggaggtgcataccacgtgattttatccccattttagatatggtcatatcgattagttattgtatataaaaaaaaaattcttacaggctataaactattatgctacaaattttggtaaaaacctattacttgttattccgtttccaaaacatattatggctatattaaagtgtgtataaatgagttaaaacatttttaacaacaaataaatgtaaaaaaaatgagtttaacatcgttgtaagtaaacttaggatttgtttgttacctcaaacttaaatattattccctctgtttctaactaagtgtagtttaaaggttttttatttttttcagtataagtattgttttcacttttcgatgcaaacattaaatgtatttaatagtttttaaccaattatattttacatcatattttttattggttggattagttgtaattggtgatattttttttaaaaaaagataaatcaaatgagatttatatattttcttaatttgcgtgcaaaaactttaaattaaaaatattaagaaacagagagagtatcttttctatacataggtatatcacttatatatatatatatgtatacagctaaatatttatgtaaaaatgtaaacatacgaaactgtttatagaaagtataatattctaaaataagatatcaaacacagtataatatttaattttaaagaagatactattttgcgtttaatgttttcatcgaatataatttcttattccgctaactcaaatgtttattatttttaacatcaaaatgtttctaatactaaaaagtttaataaataaaaaaatctctctataaatagataaattatatcgtataatgttcaaaacaattcccacactatctttcctccacattaaagtaaagtatctctctcttttttctcctacgtactccatagtgatg

SEQ ID NO: 36352 - DNA, 3003 bp, Unknown
  misc_feature (1)..( 3003): 2750-1469P.txt file - cDNA_ID_3094611; gDNA_ID_2926063; Annot_ID_196192
aaacaacaaaataagaaaaatactatacttgatataatttgcttagctaagaattcaaaatataaattaaactatcgattgggtcaaatttagtacccttttcataaaatctcttttaacatactatatagtaaggatatatactgctggcataaaattactaatgtctatttgtaacagtgggtattaggtaacaacttttataattaataggttgaaaaatatctgtttaatattaacatataatataatttataggttgaaaaatatctgtttaatataacatataaagtatatatatctatataatttgcttttagaaattgatatattgaaatggtttaacagcctggcaaaaaacttcagtaaaattgtccactttagtttgccaaccgttgaggaaaaacagagttataaacacttagtcaaactagaaaaagactcttgtctttttggtatccatcatccaatcatagtttgactcaattaaatctaaattatttgttttgtttcaataaaatataaatcaatctcttttcgtcaacacatatatagtagcatacttttatttatttactgcctccttcacgcatataagaaatgagttgttgttttcctaataattcttattatggatgcaattataatactgatcagaaaatatacaataattgcctgtctaagaggtgacgcatgagaaatattcagtgatactaataatttctggtgcaaaaatgtttaaaagcaattatgagtatatatcgttcttaattgcgtctggaaaccatggaacaccaatgagtcaatactgttttccctcttatgctaattattccatactattttctacatatgcattgaacattacaactcaagggcagacgtaggagaaagggattgatgcaatcgtaaattgacaaaagaattaaaaagccaaagatcacctgcagttcaaattctttattattttcattaaccactcaataaattacgtgtttttaattaattttacctagaaaaaaatattgttgacattatttgcctcgacaaagcttcacccaaaatccagtccctagtacttcacatgataacacgatttactcgagtcaaaatccgacgtataagactacaaatatagaccatcaaccatttgactaaagacaccttttcttatatagaaaatataaaattaaaataaagatattaatatgcatatttttaactacaacatcacatatatatttagaatattgtttttgattatattttacattaaaagagtagaatattgaggatactaatttgacattcttcacggcatataacatctagaagttgtaaggcacatacatacatagcttaattacaatgtgtattattatttaccatgtttaatttcagatttgtatttaaaaattaatttttttttaataattacttatcaacctaatatcctatatgtttgggctgtagtgaatttgcagcccaatttggagattttaaacccttaatttatcttacaagactagacaacatttcaacaataacaactaagttaccagttttacaagaaaaagagagaggttatttccctataattatgactaaaagaatgtaactacacgtataagttccttttgtaacacatgtaaatgtaatatagcaaatgtaaggagtacaccacgaatcaggaaacttttgtttggccatttgtaccatattacttgcacatttgtggaaatgagtgtgtgactatatctgcatgcgtaaatcaaacacatgtaccttaaatgatgtaaaacagtagatctatcaattgtacacatatatatggatacatcgatgggtcattatagctctgaagttgattagtcgggccaaaaatacacctgatcatcatgatattcatatatgtatagatatatagagcacatatcacgaaactcatctatgtacatatatttatatgtttgtgtgaaaaaataattcaaaagatttattcatgcatgcaagtgtccatcaaagtagtacgaatgaataattatgaagggttcttttggcactttactaaatgtaataatgaaaaacaacattggtaagtcaactcgtgatgatacatttttggttaatagaatttcacaaaaattgagttttgtttttttgtcactttataatcagacagttccatatagttcactggtccgtccaatgcaatcttctcttccaacatgttttcttccttttatccgtgtaatatcaacaccacttgggactgttttttttttctttttcctttttacttttgaaattcatgatgaaaactaactagcaagttgatgtgcatatgtatgaaaatacatttggacgaatgatcaaatcaagaaacctgctgataattttagttaatgacttttttttttgtcaactcattacaaagttctggattttaaatatttgcatttctcttgatattaatgattcaattttgattgtttggagtttggaccatgcgtatgctgacaaccaagttactctggaattactctggattttggtagggatattccagactaaccccaagttatgaaataaaagacattgaaatcctcataaagaagggataaataaagtttatcttttgaacagttaatttgttttaacgtaattttatcaaacgaagcgcgagctaaaataaaatgaataattggaaatctaattttttcaaacacgaacaataaatatgcatgcatgtcaatcatgttgacttctccatacccatagctttagagacaaaatgaaataaataattggttctccagataataatatataataataattgatagggtgtgtccaaatccaagtctcttattaaaagggcacatattcaactactcctccataaacacaaaaagtccatcctaaaaaaagcaagtaagagataacaatttctctctttttcttttctcttcttcaaacttcaattcactaacgagagaaatg

SEQ ID NO: 36353 - DNA, 3000 bp, Unknown; identical to SEQ ID NO: 15154
  misc_feature (1)..( 3000): 2750-1469P.txt file - cDNA_ID_3094627; gDNA_ID_2926064; Annot_ID_196200

SEQ ID NO: 36354 - DNA, 3000 bp, Unknown; identical to SEQ ID NO: 15153
  misc_feature (1)..( 3000): 2750-1469P.txt file - cDNA_ID_3094632; gDNA_ID_2926064; Annot_ID_196199

SEQ ID NO: 36355 - DNA, 3003 bp, Unknown
  misc_feature (1)..( 3003): 2750-1469P.txt file - cDNA_ID_3094636; gDNA_ID_2926064; Annot_ID_196198
atacatttaaccagagaatatgaggtcttcatctagaatgtcaacttaaaaatatgatttataatcaacgaatttcggtgatatcaaatcatcagaactttatgaaaataaattgaataaatcatcagaagcatatcctaagatgaagtaaaaataatttatagttaagataaaaaaaaaagcaaagaaataatagaggaaataatttgttatatattaaaataaaataaagcagtaataatgttgcctttgcgtgagcttgacaaaagtcaacctgagaatggctttgtcttgctgcgtggaatacaagagacatccatcatcatcattttccagctcgaacaaatgattctctccatctatttctcttctttttattttattataactattagtattttctttcattcgcacgatttttttacatctccctcaaccgtttaatatgttaaattgtttacagtaaccatataacataactactacatttcgttttacataatttttttgaatatttcactttaaaatgctttgacgttcttaatcttttacctatctatatgatggttggtttaatacacggttatatcttaaaacataataaaaaaaaatcattatatgattttaaaataaaatatgtatatcagaaacaccctacacacgacggcagatgatatttatcattattgtaaaaattaaaaattttaaaaaaattaaaataagctaattggttgtagaagtagaacaataatttagagcacgcgtaagaaacaattgcatgattagtgtccgcctccgaaagctaactaacaatggggtttagttggtgttgttcatattttatttcatttgtatattactttctttcttttctttcattttctcttaaacttttggttttatatgcagttttcttttttctctttgttgctgactcgctgtcttattattttgttattgtcttgcagttgttgggtttacatcatcatgtcctactagcatataagatagtctaaaattaatgtattagggtcttaacaacaatgatttataatattttaaacaataataacaaggattcagtgattgtttaagctctatttttgtctcttaagtataacatgcatgcatccaaatcataacaacaatattgtcggaagtttgttcaagaaaaatatcacaagttacataaaatggatagtgcggccattggggatagaatctgagcttcttaataaaattgtcactttttcataagtagcataaactacccaaatcacaaaaatccacattaaactatccattcctcattattttttttgggttttcttcaagtgaccattttccgaagaagctcatatagtttatgggctatgttggcttaatgcagttgcttaccttctatgctttagtttggttattttcgctttgaacatggttgtatcaaaacacctttgtcacattttctcaaagtctcttactccctgattattaccgttagaaactgaaagatatgtaagggtaaccaagtccttgtaaccataataagagaggagatttggattaaaaggtcttccttcgttaagcttggaatagaacacaaataggttcgaatacaacaatgcataaatcaaacaaccaaactaaagcatagaaatcaattatcaaaactctcattgaacataagtagttattcatgtctaatctcgaaggagagtattattagagtgtaatacacaatttctgaaaatcgataattaagttgatttatatgtagatttgtttaatcaaggaaaataagttgacaacaaatcaacaatatgtgactgccgacacaaattgattagtaataccaattaataagaaaaaaggtagaatacgaccttcaattataaaattggttagtatatcacattcacttagttattcttaattaattataataaacctctcaaatcctcacgtttagaaacaatattatattcacgatttagagcttaaccatatcgataattacacacactcatatcattatcgcatatcgcagatttttctctcttcaaaattagctttgattattcacatcataaacaggcctagaacaaagtctcttgacccagcataaggtgttatataggcccataaagcccaatctttctaactctcttcgcaggtcttctccgcatacaagagataaacccgtagccgttagattcaggttttgctgattagcttattcatctccaccgtcaatttaatttaattgttttggttcaggaactggacaaaatattaattaatttcaagttctaatctttcttcttctccaactaaactactgtagctagctatctccagttctacgttctttctattaataaaatcttcttcttcttctctttttggttgattcccaccattgaacctctcacgaattcgtcgtcgtatcatcagattctgctcgaatagctgaatttgtttaatcagatagtgttcctcttgatctatcgctactagatttgttgtgcgtttgttttctttgctgataatttgcaaattctctgcttatgatctcgaggtagtaatgtctgttcttctctcccttattgttcattttttaactcgttgcttatcggatctgatccatttcgctctctttctctgatcgtgatctctcgattttatcctgctcgtatctctcgattttatcctgctcttattggtggatttttggttttggaggtttagatttcatgtcgtaggttttggattttattttctggcatcattacttggtgttgtgaatccaattcctcagttaaatctgcattggctgacaaaagttttgcttcatttttttttttgttgggtttcaggtaatggccacagagcctttgcacctggtttttatactgccgtgttttggtattggtgcagtgtaagaaattgattgtcaaaggaaaatatttgctttttctctgaggagaggggacgagtaagatg

SEQ ID NO: 36356 - DNA, 3003 bp, Unknown
  misc_feature (1)..( 3003): 2750-1469P.txt file - cDNA_ID_3094658; gDNA_ID_2926067; Annot_ID_196214
aagtattttttataatctttgtatctatcaaaatcacggtaacatatgtaattggtacttgataattaatttttatcatctttgtatctatcaaaatcatggtaacattagtattagacttttaaatatgatacattcttatttgactataaaatatgtttactccattaatatttagatatacatttgaaatcataattggtaagaaaaagttgtttacctttttaccagtaagtttattgcaacatgtcattaaaacatagtccattcaaattctaattcataattttaaggtttgaacatgaataacatttcaacctatgaaagtttagaaatcatttgataaacttttatattcattatagcaatttaattcttgaaaattggtaatcttagattcctttgactaatcaaaaacttggtaatgttgagatatatataagtgatcaatctagtgagggggtggccatacataggtgtattagtgcttatgagttggtaagaaatatagtctcaagaaatctcttcttctcttctttagtctccgcatgattattatctcgacataatcatgtaaaagatttatgatttaatataaaactattacatagatgatttgttttaatatatattttttctaaatattctagataccggaactttcgagaaagagataatatcacaaaaaaacagcaaatagtaaggtaaaattttcattattcttatttaaacattttttttaataacatatggattcacccaaatgttataatatccatggatatagatatccatattatataagatttatgaaagtatatctttgtatttaattttttttatataagtcacataatatgagaacaatattttctaaaactatacaaaatagattatataaatcttgaaaaagaccatgtattttgatttaaagattaagatctctggatgttcatcttcatatttatttttgtattatatatttatattgtaattagtttttgttatttataatatcaacaaattcagatccggataattgtttctcgaggtaattcgaatcggaacatctcgaaattttaaagtatctagttctgtgtcgactttattgtattatatcattatttacacacaggaaataagttctaagcatatgatattttcagtagcaaaactttttcttatataagctattaaatattttttttcataaaatatactttcagtttttagaaaatttataattggtaaaaatttatttacaaagagcgggagccaggaaaaaagaattgttattatttcaagtgtaattttcttaaacgttgacattttttttgattatatactatacattgatcaaaatacacacgtgcaaaattttaatctaatcattaataaatttgatcttttttattttaccgttacgtttgaaattataatataacgatgattattattttctatatatcaaaccaaaaatagctatttatacaatccaaatctttttctttttttaatcacacaaatcattaacatttgatgaagttgtttctttttcaatctccatcaagatcattaaaaatatcattttacaataaaaaaaaattaggggttaaaacataaataaaacagaaagtataggggacaaataacacaaaaacaccaccacgtccgccaccaaaagttttaactttcacacgaagctagccatgtcactctctgctcttcttgaccattgactttttttagagatacagagatatgtcttactatttaatttcctcattttgcaaaatggtaagaacgaaaaagaataccgtcattgagggtaaaaccgtaaatattaggatacaaacgagggcaatttaggtataaaagaggatgataaatacgtggtaataggtcaccaccaccaagctcttcttatgttcatcccaaaaaagctttaataaaaaaataatcgtttctctatgaagaagaagacgacgacggaagaggaagacctagcatcgccgacgatttatttttgaattttcttagtctaagatatctccggcgaggagacgtagattcatcgatctaatattcatcgatctcgttcttgtggctttttaaatcgcccagacttttaagagacgctggatttgatatccgagaagagccgtttgataaatacgtaatcgattcgagcggtggatagtgaaattacggcggaggagttgaatcggatctcggtggtggtgtgtttctgtatttgagtgaggaggaaggagaaatataaaaagtaggtggagactcaggtatatgaaaaccctaagttctttgattactactgctctttgtttattggttcaatcaaggagagatctgttttgcttatggacgtcaatggaagatcccttaggctgcgatacgcttcgaatattcttttcgccatggaagatcccttaggtttctgcaattttcttgggagatctcttaatcatgagaacgatttctttttaactcatcttcctcaggaacttagtggacatgagtctagcctttacccttctgatttggctcatctatatgatagaattaggacacgatgatactctgattttgggcaagtttaatggatcttggcttcacgcggccattcaagtttttccagaatcttcgatttggccaagggcagtgatctgaagtcagatttaatcggactagaaacatgaataaatacttgttttgtatgcttttaatgtcaaaactctggaggtttttttcagacttatagcgcaatctgtcttaaggtaaaggctcatagagtctttaacttgactgtctagctatgaagtttttttgcctgcagtgactctattattgtatactagaagtaggcaatagctcttgcttatgttttttttttaatatggtttactaatgaaaggttattgcttgcaggtgaggtaagcgttcataaaacaaaaatcaagttttgtgggagtgcattgaagcatg

SEQ ID NO: 36357 - DNA, 3003 bp, Unknown
  misc_feature (1)..( 3003): 2750-1469P.txt file - cDNA_ID_3094661; gDNA_ID_2926067; Annot_ID_196213
ttgatttcatggtggctgcgcttcgatcgaggatagcttctccagtgacggaattgtatgggaaggagcatttaatctcgactcaattgctctacgagctctctccttgtttcaaactcggtttcgaggccgcgaatctcgccattctcgacgccgccgataacaacgacggtggaatgatgataccgcacgttatcgatttcgatatcggagaaggtggacaatacgttaaccttctccgtacattatccacgcgccggaatggtaaaagtcagagtcagaattctccggtggttaagatcaccgccgtggcgaacaacgtttacggatgtttagtcgatgacggtggagaagagaggttaaaagccgtcggagatttgttgagccaactcggtgatcgactcggtatctccgtaagtttcaacgtggtgacgagtttacgactcggtgatctgaatcgtgaatctctcgggtgtgatcccgacgagactttggctgtgaacttagctttcaagctttatcgtgttcccgacgaaagcgtatgcacggagaatccaagagacgaacttctccggcgcgtgaagggacttaaaccgcgcgtggttactctagtggagcaagaaatgaattcgaatacggcgccgtttttagggagagtgagtgagtcatgcgcgtgttacggtgcgttgcttgagtcggtcgagtctacggttcctagtacgaattccgaccgtgccaaagttgaggaaggaattggccggaagctagtaaacgcggtggcgtgcgaaggaatcgatcgtatagagcggtgcgaggtgttcgggaaatggcgaatgcggatgagcatggctgggtttgagttaatgccattgagtgagaagatagcggagtcgatgaagagtcgtggaaaccgagtccacccgggctttaccgttaaagaagataacggaggtgtgtgctttggttggatgggacgggcactcactgtcgcatccgcttggcgttaacttcacacactcttttttttcttcttattattaccatattattattaattttcgagattattctgatattattatcattgtgattttccatttcgaaaagtgtaggaatcttatgtaacaaagaaaaaaaaaagacttttatgtttttctaataataaaagaaagagtgattgggttctttaatattctatattttgtaatatatcttagaatcacgaagatatcatagaatttatgccttaaaaagatgtaatatctgaggaaattttgcaaaagaatctcgcaggtggagcaataacaacttgacaaataatgtgattcttagacctcatacctatgaattattttattagactattaacaagtgaattactacatggtattgtaacttgtcatgttggatatgaaattctttcttacagataatcatattgtatatatgcgtgtgataaaaatttatgattggactcagttttaacgtgagtgaatgtgttggtgagaatataagctaaacaatactagtatacttagaggaaacaatgtatggcgacttttgtggtcatggaccttatagttcaattattttaacactaataaaagttggcattcgatgggtccatatccgatggcattcgatgttcttattttatattatgcttataaagtatccatctttacgcgagacttgtaaaatccgtgtccttggaatattttaaggcatatatgaaatataacaaacctggtcattagaaaaagataatattattattgtttggtgcaagctgtttgcggctaaaattatgcaaaatctttttgaaagacctctcttcttaacctcttgtttgttaattaagatgatttctttctaatatacgcaactaataccgtgttgagtgtttgattggattgttagattgttttccaagaaaaatcacatagacaaaattttatccataatttcttcatagaacaaattgagataaactttttgatcaagccaagtatgtaatgttaccaaatatataaataaaaaacgaaattttcatttattcattcgaaatgctacgaggtcttaacacttcctggtcctatctgaatttgtgatgtaaccaactttcctgatgaccacattacattatacattcatatgaaataaatgttacattcatttagttagagaattttaatgctttgttttttgaataaactgaaaagttcatttatgactcacacatcttatgcagttgacgttggtatatctttcacttgatctgaagtacctagtagctgcaagaaaagaaagtaacaaaagacttacacacgcttgcaataaatgtaagatggttagaaaaatgtggccatgtaggcctagtgcattatattattggagcactaataagtcaatatattcttaagaaaatatgcgatgtatttcaatatggtttggtgtggttcatcttcaaatatattatacagacaatatagagattatttgaaaaataattcttcttagggatcaagcatgaagcaatataaaaaaaaaaatggctcttgttgaaaggtaaaccaagcatgagtttctcgagagtttataaatggttagttttaatagtttacacaataacttatttatatcaatgtggattcttgtattagaagagtaaattgttgcttaaaaagctagaaaaaataaatcaattttgtattttgttagtattatgataacaactaacaatgtaatggcttgagtattaatattaagttttatgtgtccagtccaacgggcaagaaatgtaaaagaacccagactctcactttattgggcttataggtccaattaataaaacttaatgggcttatccacacaacgagtttacgaggagactgtgagagtttgttttcacagtcatcatcatctctaagaaacaaacttgtatgacctttaagcagcaaaaaaagaaaaaaccacaaaacttctctgaaaggtggataaatg

SEQ ID NO: 36358 - DNA, 3 bp, Unknown
  misc_feature (1)..( 3): 2750-1469P.txt file - cDNA_ID_3094746; gDNA_ID_2926071; Annot_ID_196233
ggg

SEQ ID NO: 36359 - DNA, 3000 bp, Unknown; identical to SEQ ID NO: 15163
  misc_feature (1)..( 3000): 2750-1469P.txt file - cDNA_ID_3094800; gDNA_ID_2926073; Annot_ID_196251

SEQ ID NO: 36360 - DNA, 1625 bp, Unknown; identical to SEQ ID NO: 15164
  misc_feature (1)..( 1625): 2750-1469P.txt file - cDNA_ID_3094800; gDNA_ID_2926073; Annot_ID_196255

SEQ ID NO: 36361 - DNA, 3003 bp, Unknown
  misc_feature (1)..( 3003): 2750-1469P.txt file - cDNA_ID_3094841; gDNA_ID_2926077; Annot_ID_196268
caatagtatcgcctaatctctcgcagaaatctcttcttgttgtaatctgtgaaatcatctagttccacatctgcagctaggtaattgactatgtcagcataccatgggtagtccttttcgattgttgtggcggcactgttttcagtcggtaaccaatttcttgtcagattaggagggtgtcaatcgacatcttgagtggtgtcggtcgacaccatcgagcaataccgagtagcatccttttctttatagtgaatgtcgatcgacataggtggagtgtcgatcgacactgtagctcgattatgcaacacaacaattttgcagtcatggtcctcagctgtatctatcatgcaaatgttttcctcaggcaaggaatcattaatgggaacatcatctttaattctaatacgtgacaagtgatccgttacaccattttcaactcctttcttatctcgtacctcgatgtcaaattcttgaagaagtaaaatccatctcaaaagtcttggcttagcatcttttttttttcatcagatacttcagggctgcatggtttgtatggacaatcactttagatccaacaagacaagatctgaacttctcgaaagcgaacactacaactaacaactctttctctactgttgcatagttcatctgagcgtaatcaagtgtcctactggcataatagatgtcgtggactttcttatccttcctctgccgtagaacagctccaactgcaaaatcactcgcatcacacatttcttcgaaaggcaaatcccagtatggtggttgaactatcggtgcgctgatcaaggcttgttttatctgctggaagccatcatgacaatcttgtttaaactcgaactggacttccttgtagagtagagctgtcaatggtctggggattttgctaaaatctttgatgaaaatcgtctgtagaaccagcatgaccaaggaaactcctctctaggacaaaaattccactattctgagttttcaggtcgtggtccctttctataattctgaatttgaagccactgatattataagctgaaaactttataaccttactagatggactaggtgcaaggcaatgaatatcagcaaaaatgccatcgaggctgttcttttctaccttttgcttaatccattgactaaaatggatatgcacatgtcgatctatatctatcatatgtcctctttttcaacgtcgtaattgtgatctgcttaattcactcttaaatacgctacacattttcaaagggagacaaatattaccattataaatgaccacagtcaatcaaaaactgtcagcctaaaatagaaaacttacttgcgatagtcatctaagaatgaacattcaactagaatgtatttgtgtgcttgctgcctctctataggactaagtgtatccaatctggaagcaccaacatgcaacatgtctcccaagaaaaggaaaactttgtggaatttgtgattcagacctaaatcatgctccaccacagagtgatcatccactctcccaatacgattaaatcttgtttctacatcatcaagatacatagagcaaaacgtaacacactcatcagcaatgtattgctcataaattgatcctttaggttgtgttcgatttctgtaacgcccgtgaaccagaaaatcggttagggtttatttttaaatcatccggtttaattggttgggttaattggaaatcctagagtgtgcctataaaagaaggaaactcgaaattagggctttagttagccacttttcgttttataaaggagaaaaagagagaaaaggagaaggagcagaatcgttagggtttgggagaaatcagtttcgtcatatcaaatcgtggtaaaaggtaacgaaatttggtagcgttattcccaagtcctttatcgttattctacagtttacagaattggatttggattaaaattggttgagttattcgcagtttcgtgagacacgttttctcagacgcgaattaggaccagcggagattgaaactgagatcgtggtcttgtctgttttccgatcgtcacgagattttgtgggcagctttgtgacgtctgcatctaggatttcattggagcgattgaatagttaacggttattttgtattttagggtttcgtctttgagactgcttgtttctggtttttcctgtccactttgcttcaaggttgcttttggttgtggacttgttgtagaacgtttctggactgtttcagacgcaaggagagtctctcctgggtttaattgctattagaatcaatttgttaaggtgagtgcgtgaccatgagcttatctgagcgattgggttgtgtgatttgttttgtgtgatgatatgtaggtgtggtgaatgtgttttgggtgaattgttcaatgactggtttgtttgtattgtattcgtgattatacccttttatttgcttgtgtgtatagctcgtagatcggaggatcgcctcactaagtatttatgataatacttacgcatctcattgtgttgttgatgcaggtaaagataaagtgtgatcgtagaatcatggcaaggaagagaggatgatctaggaactcgtttgttttatttttggtgtttttggttattggaacccggttaggattgtcagttattcttggttttgttggtcgaattatttatttattcataaaatagtatttttgacttgcggtttaattattatgttattggttggtttaattagatatttatgggaatatttaattatatatttaaaaaaaaaaatgggtcgggttgtttcaatttggtatcagagcgattacggttctaggatgtgtagaaaaattaattgatgaattattttcctgatgattgattatggagtgtttagtcaattgtgtgttgttggagtcctaacatcatcttctccgagccttaaatgagattccacggtaagttgtttgtgatatattcgtttgttttagtttcttagccatttgttcttgagtagcgcagatg

SEQ ID NO: 36362 - DNA, 2388 bp, Unknown; identical to SEQ ID NO: 15170
  misc_feature (1)..( 2388): 2750-1469P.txt file - cDNA_ID_3094882; gDNA_ID_2926078; Annot_ID_196300

SEQ ID NO: 36363 - DNA, 3003 bp, Unknown
  misc_feature (1)..( 3003): 2750-1469P.txt file - cDNA_ID_3094887; gDNA_ID_2926078; Annot_ID_196298
ccagatataaaaaatcttatctaataattaataaatctaaaaagtagcacgagaaaggaaacaaatttcgaaaatcaatgggttatgtgaataaaaggaacacaatataatatttgttttggaaaataaatgaaatctaaaaattatataatagggatcacttcggattataatgagatacatgagagattggcgggcacatattgatgaaattttccttgtgtgattatattttatatatagccatcaaccatttgtgacttcttatgaatgaatatccataaggatttgtgagagatcaaaataaacaaatgactatatatgtccatggcgtagaaaaataagcacaagaaagataagaaaactaaacgacataggataaaagaggaagaaaagagagctcggaggtgaaaataatcatacttttatttttttgtgacttcttatgaatacataaggggttttataactacaattatatcataaagtttaagcatactctaagagtattatgatatatatataactcaacgatacaataacacaatgcaagttgttttgggaatcaccatttatattgcttttggtatttatgaatagaagcgacgtataggtagaaaccatcaggattgatttgccatagacaagaaccatcgggtttgcatcttgatttgtctctatcgagatcaaagaggacgaaaggagtcattttggccgatgatgagaagatgacgcaattccatctagttgattggtcggtgtcaaacataagcacgtaagtctcacctcgaaataacacctgagacgaagtatctaatttggacgaggtgcatcttatggtgaacggatgagagtcaagtgcaaggttgttggttacctttacggtgaagactggagccgtgaaagataacgaagaagtaaaggctaaggctaaggagacaaggaagaggctatatgctttggtggatatcatctttagttttgttttacacactatatatcaatattcgagtgaatcatatatatatataagaaacttctttgactcacaatgtaatgatcttaccatgtaatcttttaataataaaaatgagtcaagtcaagcaatgagtcaagtcaagtcaagaaatttatcaaaaggaaattaataatgaaatatgcataaaaggaccacgaatcagaaaagagttaacaaactagccatggtatgagtgtacaccatcgctcttcgattacaattactcgtatacccatttaagcattttatttgttgaatgctatttgtttctggcataaccgtggggattacaaaccgggatgacaaatagagaaagaatgcgaataagcagaaaatgttaggatacctattctataagaaaacaagaatttgttgacaaaagaaagaaagttcgctaaaagagttatttagtgtctcaaaataaagagatcattgtttccacaaatagctagcatataatcatcaaaaatacaagaatgagatatttacaaaaaaaaataaaaaaaattaatacattttatcacaacacactagtgaactaaaatccatagacatatacaccatcagtgatggtccatccccatgcgagtggattacaaatatataatttaacataagtgtgtaaacggagaaaaactaggtttacaagcgttttcttttttcctaagacggaggtgatgttgttgaagtgttacgttggaaactgtatgatgacgaaactctatcaaaaaagacgaaaggatgatgaaacgcaatggttaccacaattatttcagattttaagaatgagataatttcataattaaaaaaaaaaaaaaaaatttatgatgatgttaagtatcggttcttaaagtgataacatcgagttagccaactttcgtatatgtgatatgaagaagaaaaaaaattgaatcatacgtatgttttcgttacgacacctaaaccaagttcttttctgtgatttcttcttatgaactaaatcatatcataaatttaaaaataccttagaaatcttataattatattatattatacgactgaacgatacaataacacaatgcatattgtttggtgtatcaccaattgaattgcttttggtatttctgaatagaagcgacatataggtaaagaccatcaggattgatttgccatagacaaaaaccatcggatctgcatcttgatttgtctctattaagatcaaagatgacgaaactactctttcttgctcccgatgagatgtcacaagtccatttaactgatcggtttgtgtcaaacccaaactcggaactctgaccttgagatacaacagcagaccaaatatctttttgtggcgagatgcaacttatggagatcggattagagccaggtgcaaggttgttgcttatctttatggtgaagactggagccgccaaagataaccaagaggtcgttaaggctaaggagaccaggaagaggctatatgctttggtggatatcatcttttgtttgtatcaatatttgtgtgaattaatcatttatataagaaacttatttgactcccatatatagtaatgatctaattaccatacataattatcaaaaagatagaaaaagagtcaaaatcaataaattagtaactaaattaaaaactgattcttaaagagtactctaattaattagagagaaatttacaaactagtgtttggtagactattaaaaataaaataaaatgaatcaacaccatttttcattctcttcaagaatcccattaaaagtcaaaaccatgtttgggctaggaaaaatatgtttgggctttagtaggcccaactacccaaaataaccacataaagtaaacggttatcattaatgggcggttactaatacttaataaatataaatatagttaaattaatatcatttctagagcttatcctaatttctctccctttcgaaaatcgaaacaaatcggtgcgattactccgttttgaatttcaccggcgacgatg

SEQ ID NO: 36364 - DNA, 3003 bp, Unknown
  misc_feature (1)..( 3003): 2750-1469P.txt file - cDNA_ID_3094899; gDNA_ID_2926078; Annot_ID_196295
gggtcgggtcgtagatcatcgggtcgtccggtgtaggaagatgaagagtactgggaagaggaagagagagagaggaggaaacatagagagagaaacgcggtggtgaggattatgtaaagagtgactctcggttgctccggtgtgtgctgcattttctcacggcggcgcgtgaaacttcgacggctagagaagaaagctaactgtagtatgtaatggtcacagtacgcatcgaactctgaagatagaatctttttttcttatatagtttaattaattatgtagcttattacttaatggtaacgactaacgacgatattattactaaataatttgattctataatttccattacatcataacactgaatagatgattttattacacattttacaaatttgtaataatcaagttcttgagcggcttcttcgccattcttggtcaaaattttaatatatgagagaagagcaattgcagcatattttcactgaaatggtcaaattccaaatatttcaaaaaatacgtctcaacatatgtaactaaagcaagacaatatatcttgcaacgactcaagtactaataaacttatgtacaagacaacagaagagcaagcatgaatgatattgggttgttctctattgatgaatggatcaaaagttttgtgtaaaaaaataggaaagatctaagctaatggaaacgtagcttaccaaaatgttctcgtactgaatgtgaatggccaactaagcagcgacaaaaaatgtctacccatcaaaaataaagtatgtgagatcatacaagcacaagatggtgtggaagaaaagtaattaatcaaccatttgggtcagataaaagattttatgttgcttaacaagcgtaactacatttatacatatttataaaagtacaaaatacacaagcaaaaagaatacaaatcgacacttaataaccaatttccaagatatttgagatcaatgtcaatatcgtatcatcatatacatgaacatacatttcaattgtagatttatgtgtcacatcgttagccaaaatagtatactaactaatatgaagtcttgagcatatattgatcacttaaagaactgctttaagatatatcttccttaccatcatcaactcaccataattcaacataacatttgatagatgagcttaaaatcttaagaagaacaaaccaaacctacatcttataacaagctagttagtatttgaccgtcaatccacaagtaaacataaatcttaacgtatgagactatgagtaagcatcaacacaatatcagatttgaaacaaaatggttttgaatggtaatctcgcatcgaggatagaccctgaaattttggtggtctaaaaattttctaaaagttttacaaatttgggagcctatgtataaaagtaaaactaaattagaggcctttttgtaaatacatgttttatggaaattcacaaaccattgtttctcctatttgtttaaagacgacactgtcattgtgatatatcgttttgacaattaccgattttaaaaacgttattaaaatttttttagcttttagagatacaacattatggtcagcaatgaaagctaacattatggttaatgaacaagaggagaacataaatgtcaaaaaataaacattaagaaagtggtaacgtttgattctaatgaattgtgttactttcatgatataaattgaatttagatcgaatcttgtctttgtttaaccaaaacaaaaaaaatctaatcaatccaatttgagagagaagtcataacttttttaacacattgttgacttaagtatcttctaaagatatattcaaatcagatttattttctaactataaattacaaaaatgttaattaaagatttctaatgttgtactccctccgtcctactaagatgaattttttagaaatttcacattctttaagaaatattgtataaagacaattttaacctcttaatatactttaaaaataataataaatatttatctaattatttagtaagggtaaaacaggaaaaaaaagtttataacattaagaagatttgaataacattaaaaagatttgaataattagaatcttgaacttgacaatatttaaggtaaatcgcatcaaaaaaaaaaaaaggttatcccttaattttgaattcataatggcgtaattgtcacaaactcacaactgtgtaatattcacacctttatttttaattataggttttttattttaaaagtaatgaaattcacttttgctttcaaaataattcatagtgtagtgcgcgtagatcatacatatccccaatctaccccgcaagttgcggtggcaattttcataaagtcaaaaaagtattcaacacgtgtcgttccactattcgtccaacactcacgccctcgtaatcctattggttcatatgcatcaccctcttggtcactcaattatattatcacccttcaactttatccataatcacgtgaatgccattacactaaaaacagtaatcaaacttttttatgttaataaaataagaaaatctaatgagagtataagatcaaaaagcgtctatcataagtacggtcgatcttctccttctattttataaggtccactgaagtaaataacaaaacaacgactcacttttggaataattacactcacaccattcaatcacgccgttgattttggtgactaatattaaactcagtggaccgcgttacacttgattgtggcttcaatatacgttataggaaaaagtgaatttaaaaggcaaaggaaaaaaaccattttgtgtcatccccttccccacttccaaccaaaattaatttaaaatgtcaaatattttttcattttcctcttttcgaaattaaagaaaaccctaaacgccgttgtctgatattgagagagagagagagattaaaaacttcttctggttccttttatcaacattttttctctctcttaaaacttcgaagcgatttttgatttacagactatg

SEQ ID NO: 36365 - DNA, 3000 bp, Unknown; identical to SEQ ID NO: 15173
  misc_feature (1)..( 3000): 2750-1469P.txt file - cDNA_ID_3094904; gDNA_ID_2926078; Annot_ID_196294

SEQ ID NO: 36366 - DNA, 3000 bp, Unknown; identical to SEQ ID NO: 15168
  misc_feature (1)..( 3000): 2750-1469P.txt file - cDNA_ID_3094909; gDNA_ID_2926078; Annot_ID_196293

SEQ ID NO: 36367 - DNA, 3003 bp, Unknown
  misc_feature (1)..( 3003): 2750-1469P.txt file - cDNA_ID_3094950; gDNA_ID_2926078; Annot_ID_196284
aaagccatacgcaacggtattaacggtaaatttgctatagttccacatacaaacattatgtgtgagtcatttggattgtacgtttggtattcgggtcgagctatttgcatgtggtgaggttgtatgaaactatctgctaaaaaacatttagtcttacgaggccagaactagtcggacatttaccctgccactaaagtaaattaaggtaaacctaatttcagaagctattaaacaatgttttcaccaaaagaacgactaaaattagggagacagagcactaagtaataattagggattcttgtaataaaaggaaaatatgagatatacttaacaaataattaaggacagatagaggagccggattaatagggaagttcacgtgaaggcacagcttaaaccagctgagccaaacacatatactaaattctcattctcacaaacaaaaatcgtgggtccaatcttgattatgtggctgtaaaacctaaaaacataaactattcacatgaataagattttgattagacaacagtcttacttttgtctcttcctctataagattaatctgacccttgagccactcaaaaacaggtatgtctatattcatttcctaatgtgacatctacacacatattatctcttttttttttaatcatgtgactgtagaaactgattagtaaatagtaataggaaaacaaaatacttagtatagagttatatagagtatagagagagggatgggtccaaatagttgatgatggaccatgtgaaaaaaacaatgaaagcccacaccattaattgtggtaaaggatgagaatctagtgttgtagttttccatgtccttaaacggttaaacctatcttctaacaaaattctccaccttcccttctgacatctcccatcacttctctcttaatttattccatccattccaccaaatttttagtttcactttttttactgtagtgtgtttacacttgtgagtgagtgaaaaagtaaagctagagaggttactgttttgagatgctctttttagaaagggccatatataaatggtagtgtagtagtactagtggagcttcttcatatacaattttgacttctcttcattgaatgtaggagagaggctctttacatcataaataaaacaagaacacagctttcagagagatagagtgagattctccttcattaacatattcttcttcatgttataagaagaagaagaagaagtgtccaaaaggattagagatgggtggatgcacaagcaagcaagagaggagaggtgtgagaagtgtgaaggagacatcaaaagaccaaagcagaggaagaagacacctgataaaagagagagatgagagagagaaagtgatgtttcttcagcttaaagaggcggagagagagtggagaaaagagaggaagaagctgagagaggaagtgagaagactaaggaagaagctagaggaaagagaagaagcaaagacaacaacaacagaggaaagagagtattggaagtgggtggttgaggagatgtgtgtagagagagcagtgagagatgaagccgttgagaaatggaaacaactctatttagctatcaagaatgagcttgatcatctcatctcccacactacttcttcctccggtaaaataaactcaacttatttcaacttaaaattagaaaaagtaaataggatctttaaagtgtgtgtttgtaggagaagcaatcatgcaaaggaaacttgaggaacaagaagaagaagaaacagaagcaaagagagttgaagtattgagagatgaagttagagttaaagaagagacagttgagacacttgaagagcaaatagttttgatggatagacaaaagtatgagaaagaaagagagattgacttattgagacagagtctaaggattcttggaagcaagaagaaaaagaagacaggatcattcgcatcaatgaatctgttgatattgaagaccaaatgtgtcgaatgtacataaacactttttactcaaatagtcttctgcaaacagtcatatctcgtcagagaatcttgatccacaatgtcatatttatttctcttttggttattttacaatttttattttggaaatatagtaaatcatagcactatgagttcaaaaagcacatgtcccatgaaagatttgcacaaatcgtttttttttttttttgttggagttagatacaattctttagcaataatgataatgaaccatttttccaaagaacagaaactgtggaaaaaaacttactagacactaaaagtctaaaacaccacttgcttttttatagcccaagaaacttctagttctaattaagaatgtccaacttccggttcggttactgaaaattatcaaatttttgttagatgagataaagaagtgaatcctacaagaaatatatcatgtggttcggtttggtacaattttgatttctgctagggttttatcctttttagcaaaatttactttaatttccgtagtaaaaaagaagaagttttagttggtttatttcttatttttgcttcgattacggcatttaattttagcaatatttcattaacaaaaaaaaacaattctaattggtttatttctacttctttttctgtcttggtttgatctctattactatattgattatgaaaaaaatatgaaaccaaaaccatttattatgtcttcaattccatttttaacccaattatttcactacaattgtaataaccggttattgcacccctaattataactatttaagcaatcgcatataccaaaccagcgagttaaaccaaattgtttcccaaattatgctaaacgacagcgttttcacaaattaccaaaaaaacctatttttctgtatctatctgaattcagagtcctgaccattttatctcactctcacaaagtcttcacttttgaagtgtctcctccacacgcactgcgccgccaaaaaacccttctttaaaccctttcctcctcgcgccgtcatg

SEQ ID NO: 36368 - DNA, 3003 bp, Unknown
  misc_feature (1)..( 3003): 2750-1469P.txt file - cDNA_ID_3094961; gDNA_ID_2926078; Annot_ID_196281
actctatatgatctaaaactaaatcagtagaagaaaactaatgaagaaccttgggcatgagactgagaaagacgttcaatttcttcagaaactttggcactttcagcctccacagactgaagctcatttctcaagtactccaagtaagcatctgtcagatttccatcacttaatttcaccattatttgactttcatacttcatcttaatctcacaggaaacaacagagcaaacctgaatcttcaacatccaataaatcaacatcgccgtattcttcaacaatctctttcacctttggctacacgaaaacgaaattagcaatctaatcgaaaattagacaaatttgaaaaacggaaaagggttctcgaaatctcgcaattacttcaaactgaagaacaaaatcttgaaccaccagagtctcgtaatcggaactacacgattctacaggctcttctctgcaattccggggaaagaaatcgagctctttcacgcgcctgagaaaaatgagaacaaatagatgaacaaagcagcacaaaaatcaatgaaagaaagagacgaaagagaagtagaaaacctgcgaatctcttggagatcgagagatccgtcgtgggtttcttcttccattgaagaaagctttagtcttggggattcattttggcgctactgttagagaactgaagagagtgtagttgtgaagttgaaagcagagaagacgatttcaattttcaaatgggaaaggtgaaagagaaacggaagagaaacataactctccccgaggtttatacttttcttcaacattaacccctgaattctatttgaatcaatttgacccagagggttgaagttaattgcaattccggttcaatttattatgaccaatcgtaacgtattgaaccagaagactctttaattttaatctgtaacgtttacttccccttttaaaaaaaaagaaaaaaaaaacttaattaaatttaatcaaaatcataattatatatcagtgagtatgttccctcagctcccaaattcgaccctctagtagccacatctgctttattttattttatctttcagtaaatctgcccccattaaaatgtccaataaaaaatcttccttacttcagggtagagattttgatatttacatatagttattcttattgtaccgattgtatcgaatatttatatacttggatatatctttgtacatcaaatggagtcaataataatatcaagaacggtgaagaaactgccagctagagggatgagattgattgatgcagttatcaaagtggattgcaacaactctttcatgtgaatgtgatcttaatatcatgtcacacaaatacataatctgtttctactaattgcgttttgtgtaaaagattaataatacttcacatcttaattactctttaaacgaatcattgatctttcatgaaaggaaaagaaggttctagtctttgtcagaaatccataatccaatcttgtaaaaggcaaacagtttttgtcctaaaagatttgacgagcaacgaatcggttcattcccagccgttggattgatttaaatactcaggaaaagtcatcccaaaaaggtgggaacttgccactccacatcaccatggcacgtggtaagcttacagaggaaaacttcaatattggtttactttctccaccactcaacattttgtttgttcgtgcatgttgttttgtgtccgtgtattatctattaatctatgttagacatttttttcttcttttttcgtcaaggatattcctttttatgtttaaagtattgtgtacatatataaaaaaatattgcatattagattattgacttgaatcgaaggatttttaaaaaaaaaaaaactgtttgtagagaagaaaaatcgaaaactacttgtattcatcagaattaaaaaaaaaaagtcagtctaaaaatataccctaataaactgacatacctatttcaacgatacaattctataatgagttattaaattgatttgatttcgtattctctaaaatatactcatagacatagcagaaactagttaatttgcttatatgttcatattcttgtacatcatgtgatctcacgtggaataaaaataatgtgaccatctctaattctctacttcacttagtatctaagtatccactgtgataccttgttttctgctcaaagttgtacatgcgtagattaataaatacatttcaccccttcaattgatcccaaaagcctctacaagacagccaaaacaaatcaaggattgcgcaaagcattcaagtttcgaaacaataatttttttaatggttgacaaaaagcaataatttgtaaagcgattcataggtcagcttctaaatgttctcgaaataactcgaaccaacacctaaaccatttgttctaacgataatagacgaacgtattagagactcgttaggaaaacactacttgtatatattcacttttacatacatatttgtttccttcatatatttatttatttacataacaaaccaatatgaaaaacgtacgtttcatgaaagagaacgttgtagaacactatcaccgtttgcttgtaagaaaaaggcttatctcacctataaactcgtgagtcatatttatactcttaacaataataaataaaataaaactctattttggtaaccacaaaaaatattctgaggctaaaagcgcgtctgctggaaagttcacgcgctctgctaaccccaccgtccattctgactcttttagatcttaaccgtgtctttatccacatcatacgtttatacacgtgtcacacgatcacctattctataaaaaacattattttaatcttatcctttttatgcttcccctataaattatcttctcttcctccttctccgatctctcctccgtcacacaaaacttccgatttcaaaaaaacaatttgaaatttgtcaaaaggaatattctgacgatcgattcttgattcgttttctcgcgtatagagagaaaaatg

SEQ ID NO: 36369 - DNA, 3000 bp, Unknown; identical to SEQ ID NO: 15175
  misc_feature (1)..( 3000): 2750-1469P.txt file - cDNA_ID_3094966; gDNA_ID_2926078; Annot_ID_196280

SEQ ID NO: 36370 - DNA, 3000 bp, Unknown; identical to SEQ ID NO: 15174
  misc_feature (1)..( 3000): 2750-1469P.txt file - cDNA_ID_3094978; gDNA_ID_2926078; Annot_ID_196278

SEQ ID NO: 36371 - DNA, 3003 bp, Unknown
  misc_feature (1)..( 3003): 2750-1469P.txt file - cDNA_ID_3094999; gDNA_ID_2926078; Annot_ID_196273
gttgccaccacgttggcttgattatatcagctgcttcattaaataagatgtcctaaaggcccaatatgtcccagaagcccattacaaggttggtaataataagaagaggcatgtggtttgggggttcaaaaagatgcgtatatagtattttatagtatcttttttttttttttttttgtaaaggaaaaaatttattatagtatcttacttatatgctctcaacgatttctacattatgtgttagggataatcatattagcaagcccattatgaagattctaacaagtagtttaggtaagtaatcctagtagtttgtattaaaagagtggaatggaaaaaggtttaggcaattaggcatcatatcagattattatcagccattcacataacttccttctctgtttaagttctacctactaaatgcatttgtacatgttttaggcttttagcaagttaatctttaaaaatattttaaatttttaatgagaagcatttttgtagaatattcaagaaagtcttttctgcaggaaggagatacacagcagttgaaaatgaaaaggagaaacgtcacatacccaatttatcataagagatatgttttttttttttttggacaactcataagagatatgtcttcataatattttcactcttcttttccgttttatctaaacgtttttttcttttggcttttaactcttcttttcttaagttgaacatgttttattctattctagtaaatcattgggactatccatcgatgtataatcctatattattattattatattatttttatttttgtataatcctatatttagtaatatatatagaattttataaacttagatgtacaaatacaattatatatataacatcggtccataattttcttaggctatatagcatattagcatagctgataaattaattatgtccttcctaattataagactcgaaccgaaggtctagttatttcccctgttaagacttaagagcttctcaaacattcatgagtatagggtttttgatttatataataattttagagagaaaaccccagtagttctgctgataatatcaattggagtaattttggatgttcaggatcgatcctatatatatatattttgaagagaatttggattaatcgatatttagtgggtcagttatgtatgtttcttggcgtgaagctaagccattaaattctcaggccggcttttccaccgacacggtatcaaaataaaatttacataccagacattactttatagatgttcaacaaaatgttcatgtgattcccaacatacaaacctaacgtacgtgaaaattggttgggtcattcactgaagttgagttgtcaaaagatattgggaccaaactaatgttgataaagtacataagtcacacacaccaaaaaacaagtcacacatatcagtagacacaaccttatactaatatttcctgaccattaatattcacatcaactatagacactagaacgaattaagtcacatttacttgcaaaagaaacttacaaatcacatcaatctagacatatcaacctattggctcttgatagtgaacttacaaaatataccatattagtatataaaaggaatatttactaggtggaattgtaataattacaacgtaattaattagagaaaaagtactaatcaaatcaacatagagatacataggcgcctagacgacccacaatacgaaggtacaaagttcgaaagctgcaactacaaaaatataatgacaggtaagacaacgtatacaattcgagctgagacctaaccttaaatttaatcgacattgtcgcacaccactttcttttccatgattcatttcaatgtgaatttatgtcatttcatattttttcaagatgatatgactcatcagtgtcgtttggtgtgacgttggatagagccaccttgcgaatgttcccaattttgggaagtcactcaaagaaaaagatgtgtgtctccggaacttatcaggataaggatcgaacctctcatctacctatctatctacgcttggccgtgcgtggcatcatagttcgctgatttctgcaaacggagacatcaattttccagttcaagaaatttaaatggaacggttagcaggactagtaccatcatgccccatgtatatatgttaataaaaaatatatatatccacaacttttgtttccaacgtgcatctaatccctaattaaacctagtacgtacttgcaatcattggttaactataaagttcaatgggatattaaaagaaaactcaattgattaccaaaaatggttgctcatatattaagttattaatggtttatctttctgaaattattagtagtttggtactgatcatatctcataagtcataactaaaaccgtttgtatatgtcaaatttatatagctaattaagcaatatttcattatttctttcccaatacaattcttctacatatttacaaatatgagacgatgagtatatgtactatagatagacatacacaacaacatatatggttttccaacacatttatacaacaatgccgttggttacgtagccttctttaggataaaaaacaattaacaatggggtcacgttcacctacaggtgacgcaaacacctattgtctctatgataatattatgcataacaacgtgaatgaattaatacaatcacaatctataaagcaagggtgaaagagagaaagacacgtagccgaacattaacaaatttgaaagaataaaaactcttaagaacacaaaaatatttctatatatatcctacatagctaagaccgaaatatcactcagaatcatctttgtcaatatttctctaccatcttttgtctcatagccatgggtctagttcaagaagagggaagcggtcctgttcatggctttcggttatcaaccgtgagtgcgtccctgccgtcagagacaggtacgacccacgagcccaccggtttagacctcgccatg

SEQ ID NO: 36372 - DNA, 3000 bp, Unknown; identical to SEQ ID NO: 15182
  misc_feature (1)..( 3000): 2750-1469P.txt file - cDNA_ID_3095071; gDNA_ID_2926079; Annot_ID_196326

SEQ ID NO: 36373 - DNA, 3000 bp, Unknown; identical to SEQ ID NO: 15185
  misc_feature (1)..( 3000): 2750-1469P.txt file - cDNA_ID_3095074; gDNA_ID_2926079; Annot_ID_196325

SEQ ID NO: 36374 - DNA, 3003 bp, Unknown
  misc_feature (1)..( 3003): 2750-1469P.txt file - cDNA_ID_3095081; gDNA_ID_2926079; Annot_ID_196323
gcccatttattcaggcccacttgtacttaaatgacgaaattaccccgttagctgtcgaatacgagatatatcgcgtcgtttgctttcacttgtgtcttgtgtgttctgccaaagtttctctgcagcttctcctcttctcagaaattagggttccgtctcaaattacgagcagatctcgtactctctggtaatgatttctcgtttcttatactttgtttataccgaagtatcgattcgcttgcatgtctcgtcatctttgtaccgattctgatttgaagtttctagggtttaccatcgcgcaattacgatttgtagatatgttgtttgcgagtagagatcaattgaaattaccttcgtggatttgtctcgtaagcgcgaaccatgtttagagaaacgagttcagatttgcttcacgcttaattattgtgttgtagctgtgtatatcttctggatctgctgcgtgtgtttggtttttctgggagtcaagtcatattaacgttgttcaaaaacacttttggctgtttgttttagaagatgtctgaagatccggagtaccgttgcttcattggtgggcttgcttggacaacgtctgatcgtggtctcagagatgcctttgagaagtatggtcacctcgttgaggccaaggtaaattttttatctctctttcctcagtggctctctgttcttctggttactgaaacttagaagctttgttctgtttcgccttcagattcaaacactgaagctttgatatgttttgtaatttgtttgctttctgcaactctgtttatggtgaggcgtgtctgtttagtaactgacttcttttagtggctatcagctcttctgattgctgagacattgaagctttgagtgatttgttcattttcttgctctttgcaaatctgtttgtagtgttgtctgtttgataattttatttgaaatttatcttactaccttatttttattgccataactattatgagagataaaccttatctattgatacacaggtggttcttgacaagttttctggtcgctcccgtggttttggattcatcactttcgatgagaaaaaagctatggatgaagctattgcagcaatgaatggaatggatttggatgggcgaactatcactgttgataaagctcagcctcatcagggtggtgcaggcagagataatgatggtgaccgtggtcgagaccgtggatatgatcgtgatcgcagtcgtccctctggtgggcgaggtggtggagattgctttaaatgtggcaagcctggacattttgcaagagagtgtccttctgaaagtagtagagatggtggtggaaggttcagctcaaaggatgataggtacagttcgaaggacgataggtatggtgcaaaagatgataggtatggtgcaaaggaggataggtatggtgcaaaggatgataggtacagctccaaggatgataggtacagctccaaggatgataggtatggtagtagggatggtggaggtagtcgctatggacctgatcgcagtggtgaacgcgctggaggacgcagccgggatggtggcagccgtggagctccaggaggtgagaggcacagtcgtgctccatatgaccgccccagagctggtggtttccactagaattctactccaaagggtatgtatgcattctgttattttaactttttctattgtatcccttcaaagttaagttctggtaagacttttgttgaagtcgctttatatcttcttttgcagttaaagaagttgaaggtttctgctttcagctcgtgtcaagtcaaagttacgcttgatggtctattttcttcaatgtatttggatagctcgagaaagaagatgtgttctctattttggccctaaactcaagagtcgactatgttcctaaagtgctctctctccttttgatatgttgatccctatggaaaccttgtgcttggttggtttgagacaatttgagatgtgctactttatgcttatcgtaatgaatgcgtgggttatcccccaacaccaaatatgcaaaagcctcaggtacgtgattgatctccacggaatatccgaggtcgacatttggtaaaattcaaatgttgttatatatggggatatgccgtttattgattctggtaaacaatgatgcaggatggtctgatactcgggtttagccgtgaaaattaaagactgatctataaaacttgtgatgggattgggaaatatacattgctgattgatacttggctactggaactcaaacatcccttcatgagcaacaaattgtcattttcaggaaaaagattgactttgtgcaattttagatcttggcaagtcaaatccaatagttttcttcaactagggaaatttctacagccaaatggtctctggttggctcgtctagtatagctcactgggtttatcttcgatctattctttgtgggttcttcgtgcctcttcgtctactttgtttcttgctcgtgacctctacctctgcctttgattctcaagctctaaactccaggaattgggaaatggtgttaatgtatatatagttaatatacgcttgaataggtatccttactttgataatttgttgaaattgcatacataaataggtcacacgagttatgtcgggaaaacactgacttgattattttatacaagtgaatagtatatgtatggttagaacttagatgcatgactagttcgttcaccttctttcacaattttgtattgcatacatacatacattgcttaggtgaatatataatcaatttaccataaataaatgactttgtaagtctcataatttaagactttgtttctaacataaagaaagactttgtagaacatatgagttggtgtatagcttaaacgttgactcaattatttgatagaaatcgaatagcatagctattcgacgccactattcggttactcgtacctcgaccacaccaaattaagaacacttaccggaagaagataaaaggagaaaatg

SEQ ID NO: 36375 - DNA, 3003 bp, Unknown
  misc_feature (1)..( 3003): 2750-1469P.txt file - cDNA_ID_3095086; gDNA_ID_2926079; Annot_ID_196322
tgcagttggtacaatagatgcatttaggctcatcatatctttaagtttaaccaaatttggtgaatcgatgttatactaatttctaaatctcgggttttcgacaggtcttcctctagggaaggatggtaagaagaaaacgaagaacaaccaaatgtgggatatctttaactactactacacagttcccagattttgaagaagacttagagcagcgttaatttcattaataaaatattcataaaaaaccctaatctttgttctttttttgttggtccatcttcggaatcggagctttgttgtttcgttttggtcttctctactcagcgaaggcgtgtctcaagagaatgtgtctcttcttgttattatattgttagacattttcgaatgttgattgttatattttttgtagctattcctggagtctctcatctccttttgatgtattttgttaacacaattatttgccagtaaccctatttgtattggaacaacaagaaagacaaaaacgaaattgtttagcatacaacaagaagaaaaaaacacaaaactaattgcttacacatacttccctctatacttaggttttggatctttgaaggctttggaatcagtgtcaatctgagaagaatcaatgggtttgaatatagaggagtgaatattaccatcctctaaccacttaagatgattctctctaaactctaaatgcattaaacgagcagcttcttcaacctcttcactataaggctctactttcaccatcgttagcagaacccgactgtaccgcgagctcaggatctgttcagatacagctactaacttgaaacacgggtgctccgggaacttaacctcgctgccagtctcatctctcaaaaccgggaagaaaaagacgagcctgcctttcatcaccaacattcttgcagcaagatgaagtagatcatgaacacactccactagactatatgcaccagtggatggaatgtgatctgttcttttgtcatcagggacagtgtaaggatccactgttcctctaaggattttcctaccaccggatttacgtccaccagcacgaaccccgtaaggtggatcgcagataattgcatcaaagatctggaccaatagatacataagacataaactcagtgatctctctactcaatataccaaagataataatgaaagaactgagatatagagcattacctcctttagccccgatcgccaaggaggaacgttattatccattctaagtaaagctaccggcattggtaatccatactgcataagtattaacagatgtaagaaccagtgatatcgaaagaaacataacaatagaagtcacacactcatactaacctgtttgaaattgctccaaacattacaatctggaccacgtccatcacgcactactctgatatcgatatctgcaccctaatacaacaactcttttatcagttcgagattcagaaaccacaaaaggaaatcaataaactaagggaaaggttgcaaaccattgtcattgcgccaaagcgtgcagcagaaacaagaatgctcccagtaccaacaaaaggatcatacacaagttttcccgaagtagctttcgcttgattagccattaagaaagccatttcagcatccatagcagttggaccaaggtaagtacgagatttcaactgaaatgtaggtaaaagcttcctatcagcaaaaccaacctccctcccaaaaaatatccttctctgtagaataggttgaagtccattgttctcttcagattcaatcatttccattagaaaaaagttatgatctgggttcttcaagttaacacgaccctgcaacaaccaaatcaccaaagaatcaaaacaatgaagataaacaccaaaagagattgaaacaagaaagtggaatcagacctcaaatggtatataagtaaacgactggattcgatctttctgctcgtcaaaagttaaagcctttccaaaagtttcaacagagattctaaaagttgaatcagaagtgagaaatggaagctttcgagaatcagggtagctttgaatcgagtctttaagctcttcataacaagttccttcaccccaaagctcatacattcctttcaccaatatgcttcgtttagcaatgttacgagcgatttcttcagatgaaagttgaacgaaatggaatggagtatcgttatggtgattttcaggtagacgccattggagagactcattctctgcaatctcttctccgaagagttcagctaaagcttccacttctggctttctgaagtctaatagcctgtgatagaagacacacagaaaccacatctctctctctctctctttcccctgaaacgaaaaccctaatttgacaacagaactgagaaagaagacgaagacggagaaggaagaaacgaagaacgacggcgactaaaaccttttcttcaaaacccttatacatgggcccaataaagcccatttattcaggcccacttgtacttaaatgacgaaattaccccgttagctgtcgaatacgagatatatcgcgtcgtttgctttcacttgtgtcttgtgtgttctgccaaagtttctctgcagcttctcctcttctcagaaattagggttccgtctcaaattacgagcagatctcgtactctctggtaatgatttctcgtttcttatactttgtttataccgaagtatcgattcgcttgcatgtctcgtcatctttgtaccgattctgatttgaagtttctagggtttaccatcgcgcaattacgatttgtagatatgttgtttgcgagtagagatcaattgaaattaccttcgtggatttgtctcgtaagcgcgaaccatgtttagagaaacgagttcagatttgcttcacgcttaattattgtgttgtagctgtgtatatcttctggatctgctgcgtgtgtttggtttttctgggagtcaagtcatattaacgttgttcaaaaacacttttggctgtttgttttagaagatg

SEQ ID NO: 36376 - DNA, 3000 bp, Unknown
  misc_feature (1)..( 3000): 2750-1469P.txt file - cDNA_ID_3095091; gDNA_ID_2926079; Annot_ID_196321
tacaaagtctttctttatgttagaaacaaagtcttaaattatgagacttacaaagtcatttatttatggtaaattgattatatattcacctaagcaatgtatgtatgtatgcaatacaaaattgtgaaagaaggtgaacgaactagtcatgcatctaagttctaaccatacatatactattcacttgtataaaataatcaagtcagtgttttcccgacataactcgtgtgacctatttatgtatgcaatttcaacaaattatcaaagtaaggatacctattcaagcgtatattaactatatatacattaacaccatttcccaattcctggagtttagagcttgagaatcaaaggcagaggtagaggtcacgagcaagaaacaaagtagacgaagaggcacgaagaacccacaaagaatagatcgaagataaacccagtgagctatactagacgagccaaccagagaccatttggctgtagaaatttccctagttgaagaaaactattggatttgacttgccaagatctaaaattgcacaaagtcaatctttttcctgaaaatgacaatttgttgctcatgaagggatgtttgagttccagtagccaagtatcaatcagcaatgtatatttcccaatcccatcacaagttttatagatcagtctttaattttcacggctaaacccgagtatcagaccatcctgcatcattgtttaccagaatcaataaacggcatatccccatatataacaacatttgaattttaccaaatgtcgacctcggatattccgtggagatcaatcacgtacctgaggcttttgcatatttggtgttgggggataacccacgcattcattacgataagcataaagtagcacatctcaaattgtctcaaaccaaccaagcacaaggtttccatagggatcaacatatcaaaaggagagagagcactttaggaacatagtcgactcttgagtttagggccaaaatagagaacacatcttctttctcgagctatccaaatacattgaagaaaatagaccatcaagcgtaactttgacttgacacgagctgaaagcagaaaccttcaacttctttaactgcaaaagaagatataaagcgacttcaacaaaagtcttaccagaacttaactttgaagggatacaatagaaaaagttaaaataacagaatgcatacataccctttggagtagaattctagtggaaaccaccagctctggggcggtcatatggagcacgactgtgcctctcacctcctggagctccacggctgccaccatcccggctgcgtcctccagcgcgttcaccactgcgatcaggtccatagcgactacctccaccatccctactaccatacctatcatccttggagctgtacctatcatccttggagctgtacctatcatcctttgcaccatacctatcctcctttgcaccatacctatcatcttttgcaccatacctatcgtccttcgaactgtacctatcatcctttgagctgaaccttccaccaccatctctactactttcagaaggacactctcttgcaaaatgtccaggcttgccacatttaaagcaatctccaccacctcgcccaccagagggacgactgcgatcacgatcatatccacggtctcgaccacggtcaccatcattatctctgcctgcaccaccctgatgaggctgagctttatcaacagtgatagttcgcccatccaaatccattccattcattgctgcaatagcttcatccatagcttttttctcatcgaaagtgatgaatccaaaaccacgggagcgaccagaaaacttgtcaagaaccacctgtgtatcaatagataaggtttatctctcataatagttatggcaataaaaataaggtagtaagataaatttcaaataaaattatcaaacagacaacactacaaacagatttgcaaagagcaagaaaatgaacaaatcactcaaagcttcaatgtctcagcaatcagaagagctgatagccactaaaagaagtcagttactaaacagacacgcctcaccataaacagagttgcagaaagcaaacaaattacaaaacatatcaaagcttcagtgtttgaatctgaaggcgaaacagaacaaagcttctaagtttcagtaaccagaagaacagagagccactgaggaaagagagataaaaaatttaccttggcctcaacgaggtgaccatacttctcaaaggcatctctgagaccacgatcagacgttgtccaagcaagcccaccaatgaagcaacggtactccggatcttcagacatcttctaaaacaaacagccaaaagtgtttttgaacaacgttaatatgacttgactcccagaaaaaccaaacacacgcagcagatccagaagatatacacagctacaacacaataattaagcgtgaagcaaatctgaactcgtttctctaaacatggttcgcgcttacgagacaaatccacgaaggtaatttcaattgatctctactcgcaaacaacatatctacaaatcgtaattgcgcgatggtaaaccctagaaacttcaaatcagaatcggtacaaagatgacgagacatgcaagcgaatcgatacttcggtataaacaaagtataagaaacgagaaatcattaccagagagtacgagatctgctcgtaatttgagacggaaccctaatttctgagaagaggagaagctgcagagaaactttggcagaacacacaagacacaagtgaaagcaaacgacgcgatatatctcgtattcgacagctaacggggtaatttcgtcatttaagtacaagtgggcctgaataaatgggctttattgggcccatgtataagggttttgaagaaaaggttttagtcgccgtcgttcttcgtttcttccttctccgtcttcgtcttctttctcagttctgttgtcaaattagggttttcgtttcaggggaaagagagagagagagagatg

SEQ ID NO: 36377 - DNA, 3003 bp, Unknown
  misc_feature (1)..( 3003): 2750-1469P.txt file - cDNA_ID_3095096; gDNA_ID_2926079; Annot_ID_196320
gttcccggatctttcctcgacgataatcctagcaattctacgtaaagataacttgcatgagaatctaaccgaatcattacttctttgttaaacttcaacttgtcaccatgataaacctttatcacttgtgtttggtctcgttcttcagggtctgtatatagcacaactacgtacttcttaaagccctcgtaacgtttcagaagagttttgtcatcgcttgcgaatgctcctaccctcacgattaaatctgttgtttcgtcttcattaatttttcttttccctttgctaatcattagtcttcgtttcttcgccgctgcttgccccaagttcttcatcatctctagagaacaaagtgaattaagatttggagttttagggttttatatacaattatttcctcttttttctagggtttattctaaatatgtttttccttttttctttgcatggtgataatgatgaaattatatactccctctgtttctgaatatttgtattttaagggttttacacacaaattaataaaacatacaaatctcatttaatttatctcttacctagaaaaacatcattaattacaactaatctaaccaataaaaaaatatgatgtaaaatataattggttaaaaactattaaatatatttaatgtttgcatagaaaagtgaaaacaacacttatattgaaaaaaataaaaaacttttaaactacacttaattagaaacagagggagtatatgaaaattggtcaagtctctccacataaatgacatatcatcacacaacaaagtgacatatgtcattcgatgttttttaaattaataaaactaataaaattaaataagcaaattaaatatatcatcaattctactcttaattgatttctccaaaataaaaataaaaaataaaattatgtaaacaaattaagtactactttcattatactctttttattttattaattttttatcatcaataatcatgactaatttttttattgtgttgtaattgtttgctacctaacctcttattagtttagtaatttaattttgagtatttgataaccttgacattcaagttttttcaaataataaaccttcaaaatattagacctaccaaataatgtaatacacgatcatttctcttatattgatatatgcaatgacagacgatataaaagtattgactttaatgatactttaatttttgcattctttttattcttttcatatgaatactcttgaaatcttgttcagtttatatcaattctatatatttaatcatgagcctataacatagttgttggagtattatatctagaaaataaataaaaccataaatagtttatttataatcaagttgaacaattttcaaattatccaagacacgatcatttctctaatattgatatatgcaatgacaaaagatccaaaagtgttgacttcaatgacattcaatttttgctatctttttatctttttgtacgaatactcttcagatctttttcagttgatgtcaatcgaaactttaatcatgagtctgtcacaatgttgttgaagtacataaaacaaggaattgatttatttataatcaagttaggaaaattttaaaccacaaaaattacatagttacacagaattgtatcaaaatatcattattgttgttatatgtattcatgaagtgaaaaaatattaaaatcttacaaataatcagctttatacacacaaatatataaattgatatttcaagtcacaaatgaatctaaccataaaaattgtaactacatattatagatctaattttattaacaatacaagaataaacaaatagtaaatataaattagcataaagaacaatcaatgtaatttttttttaacaattttcataacaacgctagggtaatcatctagttagaattgatttagttatgaattatgatgtgtgatttggtgagtgtaagtcactcgcttctcatgtaaactataatatattgaatctcctctctcttctctttttcgcaactttcacagagaggtagtttttgatgtttgccggccggaatattttccggtgaatagccgtcccgagtggctcggacttctgcccggtatctttcagctttgatagtggagatagccggtttacgtctggcaaacccaatttctatgaatggttttggccgggtttttatcttttctcgccgtcgatcggtttataccgattgcttttcacttttatttcaataatttctacagatctgagttaggaattgatttttaggtactagatcctaaaaattaataattctggcttgtgattttggaaacctcgatttgcaggaaatctatcaagcggttatttcttggttgaaagattgaagaatattccgatgcatattaccattcccttatgttgtgttctttaggagttccgttcagtgttatttcggtggtaaacaaaaaaatttcgtgcgatgtttcgacgatattttcttcaccggattctgggcttctcgacggcaaggttgatgtcgttaaatttctgatgatgacttatcggcatgtgttacagttgaattctaaagtcaacacgtgttttcggataagagtccaacgttaagaatctttttgctgtacatgttactctaatgggctattgttgggctccaattttcttgctgcacaatcgttgtaggctttaagtcttgtatcttttgtttaataaaattcacttgggaaaaaaaaaaaaagtcactcgcttctacagcgcgtgatggcttgtttctccacccatctctccttcgttgagaagcatgcaccaaaaaaaaaaaaaggcttcaaagagaataaatcccaaaaaatttcaatctttacgcaaaaggaataaacatttctgtgacggtttcaaggtttcatcggaaccctagatctaatactttttcccgatttgaatttgcgatttcagatctgagagaattagtcaaattctgaaatttcaaaattgatg

SEQ ID NO: 36378 - DNA, 3003 bp, Unknown
  misc_feature (1)..( 3003): 2750-1469P.txt file - cDNA_ID_3095105; gDNA_ID_2926079; Annot_ID_196318
tgaacattcgcaaacattgacgttttcttaggaaccttgaaaggttcaatgtattgagttgctatgagtgtgttgtaatagtaaagctcgaatgtcacatagctaaactccacactacttttcttgcttgggtttgtgacgtttgctaaaatggttagatcaccgtttagaagaaaacccatgtcgagataagcagcgtttaggttagcagctgagatgtcgacgtaaggtgagcgaggacggtagacgaggtaaacgattaggatgataagaccgccgagaataagaatgacccagaatattgcacagcaaaatgcagctgaccatgtcattgcgtttgtctctcttgagggtggtggtaaccgtgggccacggcggtgatgcggggatggtgttggagcggttctccatggacttggtttgggtattggaggtaatgttgatccataaccccctccgttgcgttgtggtgcttgtggtggtggaggtcgttgttgttgattatcttcagggcttaatagcaatggtcttttcgatgagttttgagtttttcgtggtggaagtctctcctctgggcttaatggtacaggtattacagaatgtttcggttcttggattggattttcacggtggcgaccacgagtcttgattaggattcctggtggagctactgggtgaggttgcgtggttttgtggtgcgatttttttgggtgcggaatgggcgggatgtgtggttggttcgaagatgtttgtgaggtagaagcaccaccgcttttgagatgtggattctgcgatggaattcgcgcaaaatgagggttagtttcatggtgatgatgatgagacatttagatgaagaagctaaaaagcatcaaaggaaactaagttaagtaagacttgagatgaaagaatgagaacagagagattttgaactgttttaagtttctaaatgagatagagagagggagagaataacttggtgacaagttcaagtaaggattctttgttgtagaaaacaaaataaagaaggaaagtgatagcacgaagcaagtaatctttgttgtagattccttgcactaaaattaaaatcagtttctaatctcatgaaaaagtataaaaacattctctgtatctttttctcattcaaaagtttttttaagaaaattgtaattactcggtccaatttatctaaaacccaaataaaaagatctcgattttaggagagacagggttaaggacttacagtaacagtcatgaatatgtcaatctttctacttcagctcactccaggggaaagatgttgattctcagagcaacttacgaaaacttgtcgaatatgtcagtaaactatgaacatgttaagatatgtctcccatagatcaagaaggccgcagattagttagcgcaaatctgatgcgaaacacgttgcttctgcaggtagatactctgttctctgctcaatttctgcagcatcaaacatgaaaccaactctgcaatgccggttactgcaaacgttgacaaagacaactaccaatcgagcctgaccaaacagatactagtaaaaaagctggaagcaaactgaaaactaaacccatacaaaaggtattttccacgatcttcggtgcaattgttcttcctatatctcttatccccattctttggcatggcatggtatatagtaacatgaatatacataaaatgaaagtgtaaacgcctggaaagagctaacctacgctttacacgcgaagaaagcagaacaatctcagagtaatcatggccggaacaagaaacacaattcaagcacagagacccacagaacacagtcatacagagtgcaggagaagcaacgcacttgccctgaaacaactttcaatacatgtactcctaagatctgatgttctttctcaagatcattgaaaacttacgaaagagaagccatagagtaaacaactaatcaaatccaaaattccaattccacattgattcaactcatcaaaagttcaaaatgtaaaactgtgttatatcacacacagatactagtactgatcaacatagcagcactcttgcttcacctcagctctcataaacctctgcaaagaataacaataagaaatacgcaagatcttactaaactaaacaacaccattaaaaccctaaaaaatgtgaagcttttgagaaaaatcagaaaacattacctgactttcttgatgaggattgattggagttttcgagcaaagtcaatggatttgattctgcgttcaagattcttcctagcgagaaccttcttctccgaattcttaatgtgatgagtctgagtccctttgatcagcctctccattccactcgattgcatcttcttctgcaaaatcgtcagtgccttgtctaaatcattggagaacaccttcactcttatccctcgctcttgctgcaactgctggtttagactcggacgagtcaccaaccccgtaactcgcttcgctatcgtgttcatctcttttacttgttttctgaaaaagtatgtttctgaaaacgtaaatgagattgacgagagacagtgataggatctgaattcgacttaccggtcggaatctcgccggagagaatcaaagagccaatttgagtgatgatggagaatgtctaggttaaaaaagaggcgatggaggaaatgagataaaaaccagagaatttactaatataggggtggttatgtaagttttatgagatatagggatgtttttgtaaatatccttaaatctaatcttctgtttgattcagagagtattgactttaaagaagaacattcaagcctttcaaaaaaaaaaagcttctttaatttctctctctctctgtggagtgttcgaatctccaagctctctctcaaatggcagcgtccacatagtagagctgaagaagcactgtatctatctacagagaaagtgaagaggaagaaaaggaagagaggatatagaaattaagctggcgacttttagtccgaggcgagcaatg

SEQ ID NO: 36379 - DNA, 3000 bp, Unknown; identical to SEQ ID NO: 15179
  misc_feature (1)..( 3000): 2750-1469P.txt file - cDNA_ID_3095127; gDNA_ID_2926079; Annot_ID_196312

SEQ ID NO: 36380 - DNA, 3003 bp, Unknown
  misc_feature (1)..( 3003): 2750-1469P.txt file - cDNA_ID_3095157; gDNA_ID_2926080; Annot_ID_196350
aaatgaaactcctgagatatttctttcgtctacttaataacatatcgtgtaggtttttaaccaaaaaaaaatcaaaacacatgacgggtcggaccataaattaagttgttaatttttttgcatcaaaagtttttgacctttttaataggaaaaaataataataataggtagagttatttgtgagaccgtagactagggggtgaaaatacagaaggagagaggggaaaaaaatgaaagatgcatgcaaaataaaagaaaaggatgggaatatgatttgatgtaaagcctgtgacaactctcccttttaaatatttttcaacgcgacgttaccttattgcagacatgacgcgtctatatcctatccgtccattttttttcttcagatgctgatggatggatgtgatttcttcttatgatttgatgcatccatgcacctctttctttcttcatatttgtttttttctctctaataagttttggattaaatgtactaatgcgtttagaattatcgttaaaagtatcttgtaaacagacaaaatccaagtagtatccaataagctaaaggtctaaagtgtttcataaagttaaatttatcgtctttttctttaggctgacgtagaatcccctgaatttcacagtcacgcacgcattgcatgctcaaaagacaaatgtcgtccaataatatcatatagatcctaaacaagttttagcaaaattattacaatcctatacacacacatatatattcgttttgtgtgatgtattgtacacatcaacatcaactctatctgtcactagctactgtcaaatatcacatcagttgcttgtagaacaggagaaacacagatcattaaaataaaggaccttttttattttcctcttcttttctcttcctttatctttcaacatttgggaactctagggttttgttatttttagagctttcttcttgtgccgacaatggatgttgatgtgtttaacggttgggggaggccaagatttgaagatgaatcccttatgccacctgggtttaggtttcatccaactgatgaagagctgatcacttactatctcctcaagaaggttcttgactctaatttctcttgtgccgccatttctcaagttgatctcaacaagtctgagccttgggagcttcctggtaagcccacttaactcaagtcaacccaccttctgtttcacaggatgcactcaaaaacttttacaaaacttgataataagtcccatctctagatttttgcttaaatcgtcataaaccctagtttcatcaaggccaacttattagactttcctctgttcttattgccatatccaaattctaggactttatttctgtgataatgtgctagatgagtagatgttaatgtagcatgatataggcttagtggagacactgttagaactctttaattaaactttcattagttttgaaactaaaccagtccttgttcggttctgaaacagagtctctacgtagttataaatcttgctaacgactttgttataaattattaatatttgatcaagttttaaagaaatcaaactcttgttcaactttatatcaacccttcacatgagtgaccagtccttgttcggttctaaaacagagtcctccttactctgtttgtaactttcacttataccatttgagcagagaaagcgaaaatgggggagaaggagtggtacttcttcacactaagagaccgtaaatacccaacgggactgagaacgaacagagcaacagaagctggttactggaaagccactggtaaagacagagagatcaaaagctcaaagacaaaatcacttctcgggatgaagaaaactcttgtcttttacaaaggcagagctcctaaaggagagaagagttgttgggtcatgcatgagtatcgccttgacggcaaattctcttaccattacatttcctcctccgctaaggtaaagtattaaatctctatatatcaatccacttttctcatacatattataatcaaaatatgttttcttttacactaggatgaatgggttctctgtaaagtttgtctgaaaagcggcgtagttagtagagagacgaacttgatctcttcttcttcttcttctgccgtcaccggagagttctcctctgccggttctgcaattgctccgatcatcaatacctttgcgacggagcacgtgtcctgtttctccaataactctgctgctcataccgatgcgagctttcatacattccttcccgctccaccgccgtcactgcccccacgtcagccacgtcacgtcggtgatggcgtggcgtttggtcagtttctggatttgggatcatcgggacagattgatttcgatgcagcagcagcagcgttctttccgaatctaccttctctgcctcccacggttcttcctcctcctccgtcatttgcaatgtacggtggaggctcccccgccgtgagtgtgtggccgtttactctctgatcgccatgcggtcattaaactatctttactatcttttaatctaagagaaaaactaccttgggttgcttaatattagtggctttgtattagtctcgaatcatttcctcgtagcattttgctgttgtacgtgtttgtagtaacgtctttgtgcatgtttttaaacatgaacctgctaagtacttatttgtagaggtttgtccttcggtgataagattttaaatttttaagtgatgcagaagcaacatgaaacattacaattgtaatatgacaatttcgaatcgcatggataacaaatagtcaaaacactagtcatattgctcactctaatgggccttatcatttaaatgggccaggccttatcatttaaatgggccaggccttatttaaagagttttccaattgccacgcgtttgatgcagtgtttagagtggtcatcaagaggtcttttttgtctctcattcagcttgctcgcaacgaaacatattttgttggaaaaaaaaaacaaaggaaatcgccatg

SEQ ID NO: 36381 - DNA, 3000 bp, Unknown; identical to SEQ ID NO: 15190
  misc_feature (1)..( 3000): 2750-1469P.txt file - cDNA_ID_3095172; gDNA_ID_2926080; Annot_ID_196347

SEQ ID NO: 36382 - DNA, 3000 bp, Unknown; identical to SEQ ID NO: 15191
  misc_feature (1)..( 3000): 2750-1469P.txt file - cDNA_ID_3095177; gDNA_ID_2926080; Annot_ID_196346

SEQ ID NO: 36383 - DNA, 3000 bp, Unknown; identical to SEQ ID NO: 15188
  misc_feature (1)..( 3000): 2750-1469P.txt file - cDNA_ID_3095182; gDNA_ID_2926080; Annot_ID_196345

SEQ ID NO: 36384 - DNA, 3003 bp, Unknown
  misc_feature (1)..( 3003): 2750-1469P.txt file - cDNA_ID_3095235; gDNA_ID_2926081; Annot_ID_196375
gaaaacgttaatgcatataatgacttgcaacaagccaacaatgcgtaagagcttcttaagatttgaacataataatttgcaacactgtcaataacccgtacttcaaaatcaaactttattagaatatatagcgaatgaagtaatgaaccatggtacttcaaatgtactactatcttttagagttagggttgaattgtataaaggatattcttaagcaatgtttggttagtttagtgtttgctttagctaggttagtttagtgtttgctttagctaagtaagacttaggcgtgggcattcgggttcagttcttttttttcgggtatcgagtctattcgggtaagaggttgagaaccattcggatattctaaaaatttggtttggatcaggttcgggtcgattcggttattttagtaaaaatttaaaaataaccaaaaatacccaaaatattttcgggttcagatcggattcggtttttttactcatatatacctaaatctacccgaaataccagattaccgataaatatattggttactttttatccaaatataaccaaatgtaagcaaaatacttaagttacctaaaaaaaatctataacattggttacttttatcccaaatatatccaaatgtatatgaattactaaaaaaatctagtatatttggatttataattttaattttgggtgtttgagatattacaaatataaatataactaatattttaaggtttacatttgtattcgggtacccacaagtattagattcggttcgagtttggttcgggtttttttgggtagtgagttctaggactcattcgggtaattttaaaaatcgggttcggtttggttcggttatttttcggattttcggttcggatattcggttctggatattataaaactaatacttaataaaattagatttattttgttacatgtatatacatggttatatatatgcacacagggggaaaaagtcgaaataaagtgataagaaaaagggttttgataacttgattgctgtagagggaaagtatcatcagcttttcgttttggggagacgaatctttgtttcttttttcgtgtttttcaatgttacttataactccattttctatattgctataacaatctagcattactcttttataacacacacacacacacacgaataatcgagtatctaatttgttttatacaacagaacaattactgtattaaacagagttccacaacacttaactatggtcaaataaagtttatgtacttgttttcttttaacttttgtagttgaatgttcaaatgactaaatgagtaaaacatgtacactatcaataactttaatacgttgacaaaaaacaatggtctagtacaaacaatataagatattgatttagatgcatggcacaattttggacatgaaaatcgaggcaagtattagaatacaatagtacatgattgataggtataaaaatacgtacgagtagtcactattgaaactcataatgtatttgtatcattgtcctctaatttaccagcagctaggataattgcatacatgcgtacaaaggaagagtcatcttcttttttattcgttttttaaaaccgtacatttctttaaattctcgattccacctttttctttttttactctatttaaacttttatttttgttgtttacttttacttttctttatatgaatagaccaaacggtcaaatatttggggccccttcttttgcatgatttttagtaaatttctttttgattaatggttgtgattttaatgtgggttaataaagtaaagcttaaagtctcataattacagcatgggtttaaagttataaaaattgtttaaatagcttattattctatattgttctcatttcaacattcagattattactgccataacttttactttttcttttacaactatttaaaaaaaaaatctcagcctttttcttcttttgtcctttagtggtcagtctaatattgttttccccaatttttactgacattatattattattactcaaaataacccgatcatacaattaaatcaaaatttaccaggacgagtagtgttaatagatttacttaagacacgtgttacataattattggattaaaatcagtttccaaaaaacgaataatccattttcggatatgcccgatattccacggtagtggaggacaaaaacgtaatttcggtattaccacaattactgacacgtctccagtaaaaaggattcaccaccacgctaagatgaaaacgacaaaaaaataaaaaaaccatctcctcccattaaaacggtaaaacaattaatatccgacgtggcatttacagtgcctagtcagcttttttacctttgaagtctcttcagcttcggacctctctctcttactcctttataagattaagccaacctctctttacccacacaatccacacacacacacataagaaaagaaattaacaaattatcacaaaaatacgttttcttgtataataatttttctctagatttgtcgcttaccttttgaaattctccggcgatgaatctcgccgggaaaaggaatattccggttattatttctgtttccgttactagtgactcttaccatcgccgtcatgtcttccgtgaacatcgtcggacctgaaaaatccttctcctagactttttttttttctttcttctctttgtattattattctttgcttcgtttttgtgaagaagatgatccgctgatttcagaagttttcttcttctggattttagctgagaggtttttggtagattctgtttcttcttcttcctctgtggttttcgaatccagttttggaatttttgaagattttgtttagtttctgttgaagagatctgagatatttgaacgaagcagagtgtatatgaaatcaaatctgtgaaaatttctttgaatttgaattgactttggacttgtgagagaagttagatcttcttcttcgtgagctatg

SEQ ID NO: 36385 - DNA, 3003 bp, Unknown
  misc_feature (1)..( 3003): 2750-1469P.txt file - cDNA_ID_3095242; gDNA_ID_2926081; Annot_ID_196373
tcgtggctttaccggtaactttttgggcaatccaaccgagcccatcatacaatccttctccagtaaccgcacaacttgcttgaatatgccaatcatggttcttgatactgtgaaggttaagtgcatccgtgatctcagcaggagtcattgcgtctttcagatcctgtttgtttgcaaaaactagtatgaccgagttttgaagatcctcatgaccaagtaacctggctagctcatctttcatgaaagagattctggctctgtctgtgctatctataaccacaatcacagcatgtgttccacgatagtatgttgcccatgaagttcttagcctatcttgcccaccaagatcccatacctaaagacaacatatcataaaagtaaacatcgcctcaaatattcgattgccagtgtccaacagttagtttttgacaggaaacaattcaaactttagtaagtttagttacgtttatattcatcattgagttttgacatataagaacacatgcagattgtcataaaacagagatgaattcatctcaggccatgactttgaccactgtataaagatgttccaaacagtcctctggcaaaaaaactaagctaatgggaaatagcaaacagttcctccggtataacaaacaagctagataaacaacatctacaaaaatttactatacaaaaccataaatcgcacatacgaaaacgttcattatgagtttctgacaccttctcaaccaatcatgacaagaacttagacaaaaacatcatccatttttcaacgagaaaaatgcacacacccaagcaagaaacatagctagggacaataacacaatcaaaagatggcaatggcaaatttaagaaacatccataaagtttcaaacttctaaaacacgtccctagataagaagctaagaaacaacttcacccaaatgaataaagaaagagtccagtacctcaaagcgaatattcttgtagacaagctcttcaacattgctaccaacagtaggatgagtagtaacaacttcacccaaatgaagtttataaagcgtcgtcgttttaccagcattatccaaaccaacaacaacaatcttatactcttttgcaggaaacatcatgaaccaaaacctcgacatgaatgctcccatctcctccaatttctatcacaaacaagatcctaatcaaataaaacacatcattacttttacgatcaaattgttctacaaacagagtgaaatcgagaaaccctaaagatacatcctttaaattgacccatcaattttacaaacccaagtaattgaatcagagaagcccagatcagatttggatacaacgatcccagattcgataaagttaaccaaatctaaattatatatatacaaatcgggaaatttgtgatcaaaccttgaatcagctagaatctgaagattgcagaggtaagaatcggagatcaaaaaaagttcttcttctactattttgtaagcttttgaggttccttccttaaagcagatgggtggagagaagaagaagaagaaaagtatgcgggaaacaatgtcaaaactgtaaatatgatgatctaaattattaataacttttaatataacaaatattaaaatgaaaactatatagtaatgttttcttttacttacccaaacggctgcagcctctaccgtaatggcaccgaacacgtcaccgccattagccacgacgccaaagacgaacattgttgaagacttgaaatccacaaagatgtttttaaacgagaaaaaaaaaaactcaaacgggcttagggcctttccatatattttagattataacaattacattttctcggcccacagaagtatataaaattaaatagaagtaaattatattgaggatttaaaataacaaatttaattataatttgaaatcatggttataatacgatcgtgtgaaatgttaattaaatgcttatattgattattttattattaaatttgtgctaattttggtaacgaatcttatttttgttattgtatacgatgatttaaaatatatatatatatatatatatatatatatatatatatatatatataatagttctagaaaagtctaattggattttttagatcctatcatagttgatagttctctttttgtatatggctagcaatgcggaatcgactctctacattagattcaatgaaggcttggaatgtgaacttgaatcgaacatgtgtgttatgtaacactcttatcgagacacgagagcacttgtttttcagctgtaagtactcgtcggcagtctggtcctccctagcgaaaccactactctagtgacgattctctacaatatggcaagctctagtcattattattacttctgatcactgtaacagaatccatatattcttcctctaatacagttttcaaataatggttcattcgatttggcgagaacgcaataaaaaaaacacacaataaaactctgattcttatcacacatcttcctaagtgaatagataagctggaaaaaaaaaaaactctcaatcatttgaaaggagaaatatagtagatacgaaccaaatctccaaacatggtttgcatctaaaagtccttaaaacctctcttgtataatctaatttcaaaacaattttggaaaagttacatttgatgtatcctaactttattttttcttggtcgaatttaatattttattaaaaataataatagtaataatcacaaaatctaatttgatcattcttaggtgggtaggtacacttattttacatacagcctcgacggcaccaaaacatagaatatatatataaatacaaatacaaatattccaaatataacctctctcccaaagtcctatcatatcagaaaaaaaaaaaaaaatccaaattcaacactctcacacttcgatatctccgccttcattctcctcagagccaactgtcctgagatttcgatttcgatttctccgatctctcttcctccgtcgccggcgaaaccatg

SEQ ID NO: 36386 - DNA, 3000 bp, Unknown
  misc_feature (1)..( 3000): 2750-1469P.txt file - cDNA_ID_3095246; gDNA_ID_2926081; Annot_ID_196372
aagagctctgcatacttggacgattctctgttgagctgctggaacttgctcaagaggtatctgagctcccagatctcctcttgcaaccatggccccatctgatgctagaataatttcttccaaattggtcagtgaatcgatactctcgatctttgcaatcactccaatttccctgcatcatagttgaatacaacatcaaaataaaactataactaaagatggtgaatacatgacgcaaaacccaatcccaaagtagatcatatgtttcctgtacagtagtatgatgtgttgatattgagcatgtttacttaccctccacgggaacgagcagcaagataacttttaaggtgattaatgacttcagccgacttgacaaacgatacagcaatgaaatccacaccttcagcaattccaaaatcaatatccaaccagtcctgaatataaagaattgaggtatcatcagtgaaaatgagtatgttttccctcaggtatcatctgttttgctaacatggactcatctagtttccaaaagtgtacatcttcaccattgctttgatccctcccaaatttaccaagtaaagtgaatcataattcaaagcttaaagggaagatacaaaattacaaaccttggaagaaattgttggaagcatggcattacgctctcgtacaagacttccatctctccaaaacgtcaagttagctcgaggaagcaacaatccaggatcggtacatagacacttaacatcaggaccaatcttctcaatcacttcaaatctcaccatcccaccatcaaccaaaagttcatccccaactcttacatctacaccacacacaaagaccaaatgattcctatttcatacgcagtcaccataatattcatctaatgttttcacttccacttttacataaacataattgcatataccttcagcgaaaccatcgtagctaacactaatggtacgttcaggacgagaagaatcaaaagctctaacagtgaaagtccaaacctcaccatcctgtaaaaatgtcatcaccaccaaagcttaaacatctaaatcacaaacacagcaatgtctacatcgaattcaaatcaaaataagaagagattaaacaacctctgctttagctgaagcttcaccaccaagatctcccatatgaatctcactaccttcagtatccatcataatagcaaccgcaaagcctttctcctcattaagcctccgaacactacgaatcacaccgcggtgccaatcacgcgtaccgtgacacatattaagccttgccacattcatacctcccacagcaagcgcctcaagctgctcaaatccacaagtcgccggtccgatcgtacagatcagcttcgtcctcctcgtacttctaaatccattctccttaagctcagcttccgtcacagtatcaacctcaatcccagacgtatcagtcgtaaccgccgtagcgacaacggatctctcatcagacttcacagcaccagtaccgttaggtgagagaagtacttgcgaggatgatgatgaggacgatgaatcgagatccggtgaaggagatgatgacgaggaggctctgatggaagtgtatttgatggttgttagagggaagcgacggaaggagatagaggagagaggacggttgaattgtgagtgagggagatggagaaggtgaggagtgtgtgaaggagtggagaattgaatagactgagacatggtttcgccggcgacggaggaagagagatcggagaaatcgaaatcgaaatctcaggacagttggctctgaggagaatgaaggcggagatatcgaagtgtgagagtgttgaatttggatttttttttttttttctgatatgataggactttgggagagaggttatatttggaatatttgtatttgtatttatatatatattctatgttttggtgccgtcgaggctgtatgtaaaataagtgtacctacccacctaagaatgatcaaattagattttgtgattattactattattatttttaataaaatattaaattcgaccaagaaaaaataaagttaggatacatcaaatgtaacttttccaaaattgttttgaaattagattatacaagagaggttttaaggacttttagatgcaaaccatgtttggagatttggttcgtatctactatatttctcctttcaaatgattgagagttttttttttttccagcttatctattcacttaggaagatgtgtgataagaatcagagttttattgtgtgttttttttattgcgttctcgccaaatcgaatgaaccattatttgaaaactgtattagaggaagaatatatggattctgttacagtgatcagaagtaataataatgactagagcttgccatattgtagagaatcgtcactagagtagtggtttcgctagggaggaccagactgccgacgagtacttacagctgaaaaacaagtgctctcgtgtctcgataagagtgttacataacacacatgttcgattcaagttcacattccaagccttcattgaatctaatgtagagagtcgattccgcattgctagccatatacaaaaagagaactatcaactatgataggatctaaaaaatccaattagacttttctagaactattatatatatatatatatatatatatatatatatatatatatatatattttaaatcatcgtatacaataacaaaaataagattcgttaccaaaattagcacaaatttaataataaaataatcaatataagcatttaattaacatttcacacgatcgtattataaccatgatttcaaattataattaaatttgttattttaaatcctcaatataatttacttctatttaattttatatacttctgtgggccgagaaaatgtaattgttataatctaaaatatatggaaaggccctaagcccgtttgagtttttttttttctcgtttaaaaacatctttgtggatttcaagtcttcaacaatg

SEQ ID NO: 36387 - DNA, 3003 bp, Unknown
  misc_feature (1)..( 3003): 2750-1469P.txt file - cDNA_ID_3095251; gDNA_ID_2926081; Annot_ID_196371
tagaagagatactctcaagacttccattgaagtctacgagagcagtgagatcgacttgcaaaaagtgggactctttattcaaaaatcggagctttattagtaaagcagcagcagcaagagaaggagagtctcagatggtcgtgttgatggatcacaatcttcatttagtgagcttcttcttcggcagtgatacttctgtagagattaaaggtaaacgtatttgtctaaacgacgattcagattcagaacaagtcaagatatctcaagtttttcactgtgagggtttgttgttatgtatcttgaaagatgataactttagtcttgttgtttggaacccgtattggggacaaacaaggtggatcaaacccagatgttctttcgaaataccccagggatgtgacatgtacaggtacgctattggatacgacaacaagagacgcaaccacaagatcttgaggtttatagattatgaattccattaccctcgagacaacgttgttttgtggtatgaaatctatgattttgagtctgatttatggacgactcttgatgttactactccacattggttgataaattgtggtaaccgtggtgttactctcaagggaaacacttactggtgtgctaaaaaaaggaactctgacctttttctcaatgctgatcatataatctgttttgatttcacaagtgagaggtttggtccgcttctgcttttgccgtttagtgatttggatggtgttgttactctagcttgtgttagagaggagaagcttgcggctttagtttgtcacgaggatgttgttgaggtttggattacgattaagattgaggccaatgaggtattgtggagcaagttcttgacagtgaatgttgatttgggtgatgagattccgagttcactgacatatggtagttttttcatcgacgaggagaagaaagttgctatgatttttgataaaactttggatcgcggcgacacagttcacatcatgggagaggctggatatggtggacaagttgatctcggagaaccggttaataaaagacgttgcccacttgtgtgctcttatgttccgagtttagtgcaaatcaagaaacctgcaggattccaaaggaaacagcaaagcaagttagaaaagcgtcaatatgttcgaaacatatcgaaacttcgcgcacttaaaacccaaagttcttggacattaagtatgtcacttgaatgtcatcaacagtaagatttatgtttcttggctcgtacttcgatttattactgctatgttttagactgatactttactaaatattacatggcttcatcaggagcttggtagagtgagaaagcattgccagccgatttttgcccgtatagctccgtctcagtttgtttcgggccattgttgaaaggacttcctgtgcgcttttttgtcgatcaatagtttagaccgctcttttttgttgccactttcttgcttaggggagtctttagatcgagttttcttcatcttcttactaagagcctcatcgcttaaggtttagttgatgcgatgaatctcgaaaggattatgcttccatgtttttttcctttttttggcatgggaccatgtttgtaggttttgcttcttgtaactcctaaactttcattttatatgatatttacattcttatcaaaaaaaaaaatatatatattacatggcttcatgctaaaggacatgatattaatcagatttttaaaatttaaagatggtggaacctcaggttttcgataatataatttagagatagcttctgttatctggcctagtctctacaaagtttttaaaaccgaaccagcgactcgactagatggcattgtcgatatatctatctagcagaatttcagtagcagagtctttttagtgagagggtcaggtgcattatcagtccttggaaacatcaaagacaagagcaagttgttcatgctcaaactaaaagattaccatccaccattttgggatatatattcaacttcttactctttgacatcttggaagtcttccacatcctcttcttcttaggtcgttatcttcataaacatcttcttcagtcaaatctgcctcaccttctgagtagcaaatattttaaaccagaccatttgtacttctgactattcttctgtccgatatgtatctctttagaagatcttggtgcataatggcctaatggggatcatcattaattaggaaataaaaatcaattcttatatgtgctgagaaaaaaaaaaaaaagctttgaagttaaaactagaaataataaaacatattggattaaagataattaatgtggatccatggaatgatcgatcatgacgagaaataaaatattatggggaatatataaagaaagaaaaatgtgcaagatgattagtatgaaaataacattcccttagtttcacaatataagtgttttggagaaatttttgtttcgaatgttttcaaaattttatgcaaattatagatttttttatttttataattatatatatatattatatggtctattttatgattggttaactttttaaaaaaataaacatgagttattgaggtttcaagaagaaagttttatgtttatggccatcaagactgaaataatgttttgtttttcttatttccgtcgactttcgtctttttcaaaatcgcaacttttatatatatttttttctctcgcctttcgatcatcggaaaagctctttttcaagtctccccaactcataactttgaattttctatttgccccctcataaaatttgcttctattctctttgtttgttggagttctcaagatctgtttgattctgaatccttgtaatttttgtatccaaccagtaacaaatggggttttgtgaaggtttatgagtttcccatattcaaatggcgatcttttagtctgagtaaaattgtggttcttatctgtttttgttaaagtttcgatttttattttgagggttgaattcgagaaattttgatg

SEQ ID NO: 36388 - DNA, 3000 bp, Unknown; identical to SEQ ID NO: 15197
  misc_feature (1)..( 3000): 2750-1469P.txt file - cDNA_ID_3095263; gDNA_ID_2926081; Annot_ID_196368

SEQ ID NO: 36389 - DNA, 3000 bp, Unknown; identical to SEQ ID NO: 15193
  misc_feature (1)..( 3000): 2750-1469P.txt file - cDNA_ID_3095271; gDNA_ID_2926081; Annot_ID_196366

SEQ ID NO: 36390 - DNA, 3003 bp, Unknown
  misc_feature (1)..( 3003): 2750-1469P.txt file - cDNA_ID_3095277; gDNA_ID_2926081; Annot_ID_196364
agcaaagtctaacccaaaaaatacattaagggaaatttttcagcttaatatcaaccaatttagagatttctaaaaaagaaaattaaaactttttttagagatttatatttttaaaagagatataaaattgcctacagaaaatcttcaaataagccaaaccagctcagtttatgaatcattaaaatgaaacttccttaccaatataatttcaaacgaaaaaaaaattccgtatcgaatttttttgtaaagaaactcattttagtgggtttttataagctagactgatgaatttggtcgaagtacagcttattggcatctaactcattaaatgcaaatatcatacaaaattcgtaattacatgtaaatttcttccaaaattcgtaattacatgtatgtaataatctaattttgtgtgtgttagtgatattagaaatattattgaaaaaataatataggcatcgtgtgcaattttcaattaccttcacaaatgaagaaacattccgagcatatctccttggcataatgagtgggattttagagttaagccaacgaaatttgggcctaatttttcatcaaatacttgggcctagtcatcggttatgtcattgctacttatataagacccataggtataccgataaagtcttcatattgagatccaaaggccgggatcgaacaagttttgttcttattgaatcagcgttagacgcagccttgtctttattatgttcttcttcatccgttagaaaaagtatccgtatgatgtccattcgtttcatttgtaataatttgatgaagtcttcttaaagacatttggattggagttagaatgttccttcttttatttttcttcaggacacttggagtctcggattagtcaagagacttcgatcatattttctttatcacctcttcttcaatttatatggatcatctttaggaaaactataacgtgttaattgtgaaattatgatacaaactttataattcataaataaatatgtctgtgcatagtttttttttttaaattatccggataatgattatgagagaaaagcaggtaggtcgatcatgaatgtttaattttggcacatgttgaatgtgaggtcccagccaccaataaactgatcaagtcctacattatccaattcctttaattaccttaaagtatttacaaaatttgaattagtcaaatctttgagttaagacaccaaatgattttacaaaactcgaataatataagaagagtatacttgttgtaaccttggagtactacgaattcaacaatttgatgaagtgaaaacatagttaagaaatgattgggagattattcatctaaagctaccagtctaccaactttccagttttgacaatatttaccacgtggccctgaggaacatcattgtcagtttatcaaacactccatatttcgtggcagcttcgggtcaagaatccaaattggtattgtcacttggtcaggtcaaagttgaggagcttttatatatagtataatcaatgagtcggctaaaatgtaaaatacatgttctaaattaaacgtaataaattactataatcgtatcaaatttatccctcttatcaaattagtactttcgagtttcgatattgtttttctttctctgggaaactatatatatttacatttctagaaagaaagaaaaaaactatatattacattttatacgtgctaagcctagaaaagattaattacaaagaaattatacattttattgatcaagtggtgcttaaagcagtaaaaacaatttgaactcataaatcgtaaatacgtcgacatatttcgtgatctccattaatttttctttttttaaagattgacgcaaaataatattctgaaaatgaaaaagtaaaataagaggggacaaatattcgagatgtgacgtggcagatcgagtggtttaaatattctattagcaagtggtttgtgtaataagcaaatgggtggtcgaacctgaccgtattcttggatctattcaactgtagcatcagtccaccttccttacctcatctttcctaactttttaatacctttttaatttgctaaaaacatcactactatttatatttgatctctaattactgtttcaactctgaatattccgtaatccttatattaatatgtccaaaaatatataatttctggactttcccttgagatgggaatatgaaagaattgcatcatttacctaatcatatgaacacaaatagatattggaaaaaatgtggttttatttttcatgttttgttcgattatctttatctttatcccaaaaaaaaaaaaatcattcgattatatctaaaattcaaaatagattacagaaatataatttattagcaaaacggcatgtttaaagcgtttgaagttattaaatcattagtaagaatatataagaatgtaattagtggaaatacatagtaagtatcattggtttttgccacatatggtgagcaattttttattttaagaagggaaaatcaatttgtacatagatttatgtcacttattcaattgaataatacagaaggatttaaagtctaaagtaaaaacaggcaaaataataatatgtttttttctttgatcgctcagattatcgtattaaaatttggattatgacataacaacgataataatacaaactagttggttatgaactctgaataaattattttaaagaaagaatactactatttaattataaaatgactctgcatcatatcaataaggtaacctcgttattataaacgtcacactacacactattagtattttaattacacagtgaaaaaatttaattaattactaatctctgtccaggtacataatattattccaagatacggtccttcgttactataaactctataaaaaccaattttcacttccaattgaattgggaacaaaccaaatctctatctctctccattagagcttgaagcagccatagcctaacaaaaccttcaacaatg

SEQ ID NO: 36391 - DNA, 3003 bp, Unknown
  misc_feature (1)..( 3003): 2750-1469P.txt file - cDNA_ID_3095311; gDNA_ID_2926082; Annot_ID_196398
tgtaggtagaagaaacgaatatgccgtttatgtggattttatactgattattgaggagaatgattatatgattaaagattctaacaatcgtaatcgaatatacagaagattataaaggaatatgcgtgtaacaatgtagatttcgttgagatatagaactaaacgtgttctgcctaagattttggtaagattgcaatcttcatggtccaccgaaaatgtagattttgctgtgatcgaaagcccattaaacgtaacccacccatctgaataaaacgcggatcctgtttacttaagtttttgtcttggacgattttaccctttagcatgaagaacaaaatccaaaattgaaatcaaaattggggacaaattagacaaaaattcaatttgtacttctcttttaataataagaggatttgatattattgttttattaagttattgttacaatgatactttatttaatgaggaaaatatataaaatatattttattaataaataattaaagtaaacaaatagaaaaagaagtaaaatccaaatcaaatagaatgttgtgaaatagaaataaaagccaaagccaaagtgttacgaagaaacaaaataaaaccatagtctaaagcatagcaatttcaattgcttgaagacgtttctcgatcgaggagtaaattctcatcacgactcttcttcaattcattttcaagttcatcaactcggtgggctaacgttcctacttcttcttcagtaggttgtggggaaaccgatgaaccattcaaatacacgaccttgttttgatattccaacaatctataaaaaaaaacacaagtacatatataatgagatgtattttaactcctcataaaatataatctataaatttgccttaagatagatttcgtttttctcctcttggctgagattatctactgtcaaaacttctccattgggagactccatttcagacaatcgctcttgcacaagttcatcaattttttccgcaactagccgggctctttcatcaacatacgtaccatcagatttttggtgttttttttttcatcacaacaatgaaggaagagtcttcattgtttgccacctataaggaaaacattagacaatgtaagaaatagtgttaatctttaaaaaacaaaaaattgttatcaataattttaaagaaaatatagaaacattaccaaggcatcttgcactttagcaaaagaacgtgaacctgattgataagtgtgtattttgcatgttttgagcatccatttgtcatcactttagcatcatatcatcacttttcatctccatctcttgaccaccactcgatcacatcactcgacccagaggtcgagtgtcttcatcctattgccagaccagtactcgacctcatcattctacctggaagtcgagtatcaccatcgccaccactcgaatgcatactcgatgacaagcttcagagccttcttcattccgcactgaaccagacactcgagcacaaggaagaaaagaagactccagctattcactcgacctcccactccaccacatgggtcgagtacagttcttaatccgtcccaatactgcgtcgttttgagtattagggtttcgggatatttggctataagtagtatgtacttcacattttcgcagacaagtttttatctagttttatttccgcagaccttgtgttctagaccttttgtaatctggatttctctttatctattcagtattcagtattcagcttttgttcttgatttcgtttactgttgttcattctgtcatcatcctgctgttacactgttgttatcatgttttcaacttgttcaacgtttatgctttctgttatgatgtctaagtagtgaataggtttctgaggatgggttagagtagtgtagaattctcagtatgctaggtgattgagtattgattgataaatcccttatggattagttgttctaaatgcctattgctttctgatcaactggaatttgagcccagacatttccgcgcccaaaaggtgttcgatgaaatgtctgaaccactaattccagagattcgtgaccctgtaccaaggtattggttgcaaggagcgttttggctttaacttgttgattcgtaatgcctgttaggttagctctcgtcaatggtgattgagtctgggactaggttaacttgagagtctctattgcggtggcacttagatttggttaatgaacttgttgtctagggttaatttattgagcatgttaatcacctgtaaactgaggaaacgaaactactcaattaccccatcctcgggaattctttatctgattgattttattgtttactctattgctgtttactgcatcctgtcatttgttgcttagtttctgcaattctttactgttactcgacctgatactcgaccacccagttgtctggcgacagactgtgcagtcgagtatacctgttacattatctgtctgttactcaacctgtcactcgacccacccagtgctctgcaacgagctgtgttagtcgagtgtttctttgtttctgcttgatgttctgttttctgcatgttcacttaggactgctagaacgcaccaaaacctgttattgcttggcttgacttagtgacttctgatcacatcttgattgttagcatcacacctatttggattgacaaccttcagtactaccacgacatgatagtgctttaggattaattgatcttaaaaacctattatcaatttggagctgttgcaaattgggtgtttgtttgttacatttgagatttcagacttgcttagatcaagttctttttcaattttcttttcggttactaactatgtgtttttctcgttgtcttcttgatccaggtacacctctactgtatacgaactcgatcaacaggcaatcagaacctccttttcaatgaaaacatcgaccgcatagctcgcaaactcaaagaaaggagaaacacagtcaaccttgtacctcagcaaccactcgaaatg

SEQ ID NO: 36392 - DNA, 3000 bp, Unknown
  misc_feature (1)..( 3000): 2750-1469P.txt file - cDNA_ID_3095332; gDNA_ID_2926082; Annot_ID_196392
taagagacatgttttaagtaactaaatgcgacggtttgagactatagtttcgtcgtagttagggacgaaacggatacgtagtatcgatcactcattaagacgttttacagacaaaagttttactaagtaattgtgactgataaaggacattttattagtaacttaatgcggcattttgagactatattttcgacataataagggacgaaattgatacgtagtatcggtcacgaattatgacggtttgagggcaaaaaatttggtcagtatttgtgacatttaggatacgtttatggatcgttacatttggtgactatattgcttctcaattcaaacgtcacaatgtaagtgacgattttgttacgaaaaaaagttgtgacgagtgtattgcaactgtttgcaaaacgtcacggatgcgtatcaatacttttattgtgacaaaacatttattattatgagtaaatatttggtcataataaaatcattttcttgtagcggtgttgacgctttgttgtgatctgactcatgagaaagagaaacaagcattggtcattgaaggggaacgcaaacagattagaggcaagaagggataatcagatctagagaagacaaagaagaataagaaatcgaaaagaaaacggagatgaaggtcgaaacatgacagacgagaaatcatcatcaccacgaaggagaaacagtggcaaagtgatttcttgttcttaatacttatgagaagtattaagtgaagaagactgaaccagatcgaagctaagcgaagcaaagaaagaagaaaaagagaaaagaggaaggaggaagaacagtttcaagatggggttttatgagactcattcccgtcaatacatagagaattagataacgagtaaggtgtcctcggaaagagtacatttccaaaaatccacatccattgacggagtttgaatcggatttatattcaagaggttatgagtatttctttctggacaagtaactgtagaagctgtccaaatctatgccaagtataaatgcagaacactgtgtgactattagttttgtgatgcatttttccgatgaacccaaaaggaattagatcaatatcaagacgtctataaaaatatcttgcctcaagaaactcagaatagctgatatcttgtccatcagatttaatctccatccaaaattgaccttgaaattttgcctagaattatctcaagttgcagaaatttagaaaacagttctgatgcagcatcttcagaaagacgtgcgagattcatgtgctttcagatcgggaataaacttggtggatgcgttcatgatactattggctacatttgcaacggtgggattacatttttaacggttagttattgacttatgtgtatgtttctgagacagatttataaagagtaaataatgacgagtttgtgttgttggttgggtaaatgagctcggtttgaacttaaaccttgcaggaggcttcatgaattgtaggctaaggtcttcgttgatggataaccaagatggtgatcaataataagttgttcgagccatgctagtaattgtctaaacgggaaaaagagaagtgagttggtctttgtaacgcccgtgaaccggaaaatcggttagggtttctttttaaatcatccgatttaattggttgggttaattggaaaccctagagtgtgcctataaaagaaggaaactcgaaattagggctttagttagtcacttttcgttttataaaggagaaaaagagagaaaaggagaaggagcagaatcgttagggtttgggagaaataagtttcgtcatatcaaatcgtggtaaaacctaacgacatttggtagagttatttccaagtcctttatcgttattttccagtttacagaattggatttggattaaaattggttgagttattcacagttttgtgagacacgttttctcagacgcgaattaggaccagcggagattgaaactgagatcgtggtctcgtcggtttttcgatcggcacgagattttgtgggcagctttgtgacgtctgcatctagggtttcaccggagcgattcaatagttaacggttagtttgtattttagggtttcgtatttgagactgcttgtttctggtttttcctgtccagtttgcttcaaggttgcttttggttgtggacttgttgtaggacgtttctggactgtttcagacgcaaggagagtctctcttgggtttcattactattagaatcaagttgttaaggtgagtgcgtgaccatgagcttatctgagcgattgggttgtgtgatttgttttgtgtgatgatatgcaggtgtggtgaatgtgttttgggtgaattgttcaatgacttgtttgtttgtattgtattcgtgattacacccttttatttgcttgtgtgtatagctcgtagatgggaggatcgcctcactaagtatttatgataatacttacgcatctcattgtgttgttgatgcaggtaaagataaagtgtgatcgtggaatcatggcaaggaagagaggatgatctaggaactcgtttgttttattttggtgtttttggtttttggaacccggttaggattgttagttattcttggttttgttggtcgaattatttatttattcataaaatagtatttttgacttgcggtttaattgttattttattggttggtttaattagatatttatgggaatatttaattatattttaaaaacaaaatgggtcgggttgttttaatttggtatcagagcgatcacagttctaggatgtatagaataattaattgatgaattattttcctgatgattgatgtgggattagctagggtgttagcatactgagggttgattatagagtgcttagtcaattgtgtgtgttggagtcctagcatcatcttcttcgagccttaaatgagattccacggtaagttgtttgtgatatattcgttgttctagtttcttagccttttgttcttgagtagcgcagatg

SEQ ID NO: 36393 - DNA, 3003 bp, Unknown
  misc_feature (1)..( 3003): 2750-1469P.txt file - cDNA_ID_3095377; gDNA_ID_2926083; Annot_ID_196408
agcctatctcgggtaataatattattttttggtattataatatattgaatcaaataaactaatttggaaattgtgtatatatgcatgcactcgtatgttgatacaatatatgtgtataaatgattactttttgatgatgagggtattgatgcttgtatgggtttaaagttataaggaagagtttcaaaacgtgaaaagattcactgtttaataatacattaatctctatatatatctacacacatatacatatatggattgtatatgactagcaccaaaatcgttaagacatttttattttacatgagatgcttattatattcaagattatatgttaataaatgatgtgtttatataggtatgatgttcattttgggatacaagacccttatgaagattgtgtagcgacgatgaggctttacacgagaatgagatatcagaaacacaagattgaagcttaccctttagccgccgatgcgcagaaccgtagcaaccaggtggcttggaggcagagtgaggccgagaggatgtctcctgatgaaatgctctcaatctctcgttccgactattactgctggtgcttagactcactagcttaatttctaaacttatggggttatttaagtggtctcttaaaattagtaattcttcaaacttttccagagatttttaatttagtagtgtaatgtcgaataacattggttatgattttgtagtagtatctaaattttcgagtgtgtgttgtgtgagatgcctagattgttattgaactttgtaataatgcattaatctcaattattgattaattgactgctttttttccaatcacacattacttaaaatatgattccattacttgatatttaaattttagaagaatatacatttctgttaaatatattaaacacttttattttttaaaaggtatgagttaaaaaaatcaactttaatactagataaaaaaaacgaaaattgaaagaaagcaaaatattagaaaaactagcacaaaacatactgatatcttattgtataaattttattttcaaagttagtccagtcattaataagatcaccacacatgactcataacttaaacaatatgtaacaaacttttcatcttgtgtggcttttccttcatatcatataaaagatttggacagtcaatcatatacataataaaaaataaccttattttttgtagtaattacataggtatgccattagaaataaaaatttaaagagtaaattaattcatctttttaaaggttaataatgtttaagacaataaattttgtgatatggcatataatattttgaataactttaacactaactaattgaatattttcaataaataatcatactcgcactcattagtcataacatcatcaatttaattctttttttatgggattattatatgtacttgatgactaaaactttgagaatattttcatgaataatatgaatttcttcaattgattacaatatttatcaaaaacagcagttaccaaaaataatagtttcatattaaattttacacgttggtcatatagggaatccttgcgtactgcattctgcatggcatgtcagcacagtgaatcagcatgtgatataattttactataagtagagcattcatcagtcgtgaattttcggaatatatattgatgataacgtcggttgttaaatgacacaaaaataatgacgtcgttttgagaaccgttgtaacatcgtcgtaacaacaatatagaaaagacacaagcataaaaaagaagcctacgcaacaattactacaacatcaatctccatattgaattgtcttctgatatacaataccattccatgccaagcagactgagactttataagtatgtgaagcatctcacgagagttctcagtcaaatgcaactcaacaaagaaatcataagaaagcattgagaagcaaattagttcatgaaccacatcacatcagcatcctggagaccaaaaaaggaagacagtgaatcactcaatagaagaactgataagttcttgctttcagtgccaagagtgtaagaaacataccgcaaaaacagactactaaacccttttcaagaacaatccgaaggaaattgattcttctccacatcatttagcatccaaagcaatgaccaccatctttagttacagctctacgcagcacatctaaagctttcttgttcttttaccaattctaaaaatctcaaagaagagatcgattccagatacaagagctgcataagattcattcaaagttgtcaaaattacagtaccatttttttacggaggaatgacaagttatgagagtgtatcttttcgggtaaacattgtaacgtagtgaaagttgagagtgaattgcgtaacaaccgatagaatgaaccaaaaagaaaaaaagaacatcttttctatcgcccaaaaataaatctaagggttttctatttattaggtgtatattgtcttttctagtactaaaacaataatggctaagtctcatcctcacaagagattaaggttgagaatatattgtattgttgttagcataaacaaaaatagatgaaaccaatttctaccaaattcatttttttttaagccatttagagtacattgggtaacaagtatttcaactaaattactctaagacaattctttctatcttttatgagctgaaatatggaccacttttcttttctgttctttgtggataataaaaccaaacttcactgaattatatcttcaattcacattgcactaaatttttagattgatctcaaaataaagtttttttcctaaatattgtcgtttatcgaatacaattaattaaaggataaattgattaagttgctttgctttgtatataagaccaccatcgctccctcctctttcatcagttaagataatataaattcagtaattaagagagaagaaataaatacaaaaatgttggttaaagttttctcttttttcatccttatgataataatg

SEQ ID NO: 36394 - DNA, 3003 bp, Unknown
  misc_feature (1)..( 3003): 2750-1469P.txt file - cDNA_ID_3095382; gDNA_ID_2926083; Annot_ID_196407
caccttgataatggtgcaactgtaatgtctggaagctcagatatcgtcttcgaggagttacacgaaggatcctgatgacaaataaaacataagtttcttttttattataaaaaaaacaaaagggaaaaacaaaaaatcaagaaatattgagttctttaagtaagtttttctttttgtgagtctaatacaaaagtatagaaacgaatacttacattctgtgggtttacacactagacgtaaaatgaaatttcattaattaactataataacaacgtcaataacataagtaaacaacttgtagttgaacttttatttttcttactaaactttctaattgaagggtatatttttgttaattttgttaacgtatctttaatcgaaggtattttaggtattaaatgtagataaatttttttgttttaatttagaaatccaaaacaaattcaatgtatattagagcttaatagtacaataggatttttatatgtaattggatttcttttgtgagtctatatatgaatagatgcagtcatgaaacatgacaaaagagcatccgaactttggggaatatgctaactttttcttactaaaaatatgaatatggatgtgcatggacacatcttaactgtagaatgtgctgtaattgagaagaaaaatattgtggtgattaattcatttcaaagcctacatttctattatgcatattagaaactatttatcaaaaattcattaaaaaagaggtttcgaatcaaattatagatgaacgtgttgaaggaatattttcaacaaggaaaaagctttgaaagtttaaatgaataaattggattttgttagtcaagaaaagagataggtgtatatgcatggtctgataccaaaggaccatctttgcttttgttctttaacacaattatatgcatgaataatacccttttttttattatcaaatttggaatcttttaggatcaaacactataaactagaatcttagacttggcccatatttcctcggtcaaaagatagtaagcttctaaaaaaacttcaaacctttcaagcaaaatatttttttaagtcaaaattaagaatctaaaacatatgtaccattttgcagtctgatttatactgcaaaatttggtcactcaaaattcgagacaatattttgtttgcgtttaaattgaatactgatatttattgttaagaagatatcatggttccttttcgaattaattcacacacattcatacacaaaatagagaacatgaagctctgaatccatgtgaagttaaattagcatatccaaagaagattgaaatgcgtgacgtcgtaagtttaagctacatttttgtaaactaagagtaaacttgcagaaaaatattacttatattttcttagaaagccctacatattatttatcaaccgctaatgtgaactatggacacaaacgcaacataccgacatgcatacgcaagagcatgatattgcaacagttaaaagaaaagcctttatgaaaaaagtaaaccttatcttcagcgcgtaaataagataagataaagatgatctttgagtcaattaataaatttattttttctttttgaatttctgtcacagaatttttttgttctttattattttgataaaacaaataattttttacagtagtgtgctataagacaatcgttaattgaagtagagagatactgactagtaagaatttgatggaacatgaattcttaaataatatatatatatatctttaagtttataagacaattttcgaaactactttatctttctaattttctttatatgtaatataaatatttgaataaatgatacaaaataattattttattttaacatcaaacgaactttgattaatttgaagagtgatccttgtggaagatttgtacaaaaaaactaggaagaaataaatggtgtataaaattcacattgtttggtattaagttctttgtcaatcaatcagccgcttcgttgttgttccttgaaacccatgtgaaggtagaatttgtgaacttttctgccaggttatagactttaaaattcttcatttctctattgataatatgtggtatttgcttgttatctccttcaaaagtgacattccaaatcctcgtatccaagtgtgttgcagttccgcctcaatgacgatattacaggctttgcctctactttgtgttgcttcaacaaataatcctctatcatctcgtataatctagccagctttttcatttttcccagtccgtaggagactacaatcataattacattttaaaaaactacttgatgtggtttacgccattgttggtattcttgtgtatataaaatgatttttttttcttagtacatgtacatacaaacttcattttttcaacaaaaaaacaaattttagtgtattgaaggctttttaaaaattcgaaaatgaagtgaatgatgtaagaacattttctaatattttagagattattcataaaccttttattggtatttttgaaagttatataaacaatcgtaattgcttgatggtttgtatttttgatcctttgtatttttatgtgagcctttgtatatttgtttttcttccctacacctacttagtgttggctagctagttatctgtgtgagattttcttgtttataaacttgatcgacatcacattttcacacacacacgtgcatacaataatagcatcttcgttatcgtccaaaacaaatgacaactaaaaattatgattccttttaccatgaaaagcgaccccatcgcattaaggcatctacttcaatttctgttcgtctctaacggtcatatatgagaatggtcagctttgcttttcttcatcctgcttttatgaatattcatctataaataccttctcacaccttctccattcttcacatactcacacactcagctatcaagaagagaacaaactctctcaactctttcgttctcaagtatttgcttgcaagtgtctgatacgtacaatg

SEQ ID NO: 36395 - DNA, 3000 bp, Unknown; identical to SEQ ID NO: 15201
  misc_feature (1)..( 3000): 2750-1469P.txt file - cDNA_ID_3095390; gDNA_ID_2926083; Annot_ID_196405

SEQ ID NO: 36396 - DNA, 343 bp, Unknown; identical to SEQ ID NO: 15206
  misc_feature (1)..( 343): 2750-1469P.txt file - cDNA_ID_3095417; gDNA_ID_2926084; Annot_ID_196426

SEQ ID NO: 36397 - DNA, 620 bp, Unknown
  misc_feature (1)..( 620): 2750-1469P.txt file - cDNA_ID_3095417; gDNA_ID_1591346; Annot_ID_150858
gatgaagagctctattcgaattcaagtgagttctgtctatcttcttgtctacttctcaattttagggttatataatyttatctattaaactctaattaggttcaatttagtttgactttttttttcccttttactcaatttaggttctatttgggtttatgtgagacattgtgtggttttatttccagggagaattggtaccagttttagtttcgggttaattcttctcattgtttatctctacttccatgattggtcttcttcacttatgatctcaaagatcaatcttttcaattgctcttggattctgagtttaatggataacaagatttgctatgaatggtttcacactactgttggaagatctatagaatgagcaatattgctcgttgagcagagaatatataaaatatataacaaagaaacttgatagattaaaatcaaatccaatttgttgttattttcgttttcgtgtgcagatgtttccagttaggaggtttaagtctagttattattacagtttcttttttacttgtttgctaattttactctatttcataaacttgttatctacagatattcttttgatgtttggtgcttactagttggggatggaaatg

SEQ ID NO: 36398 - DNA, 3000 bp, Unknown; identical to SEQ ID NO: 15205
  misc_feature (1)..( 3000): 2750-1469P.txt file - cDNA_ID_3095426; gDNA_ID_2926084; Annot_ID_196423

SEQ ID NO: 36399 - DNA, 3000 bp, Unknown; identical to SEQ ID NO: 15207
  misc_feature (1)..( 3000): 2750-1469P.txt file - cDNA_ID_3095432; gDNA_ID_2926084; Annot_ID_196422

SEQ ID NO: 36400 - DNA, 3000 bp, Unknown; identical to SEQ ID NO: 15204
  misc_feature (1)..( 3000): 2750-1469P.txt file - cDNA_ID_3095438; gDNA_ID_2926084; Annot_ID_196420

SEQ ID NO: 36401 - DNA, 3000 bp, Unknown
  misc_feature (1)..( 3000): 2750-1469P.txt file - cDNA_ID_3095455; gDNA_ID_2926084; Annot_ID_196414
acaacatatatcatatcaccaattttgagtttgtttcttttaataacaattttaagttgtttattagtgagaatcaaaatttaagtttcaatctttggttagtctttcaatctttttttttttccttacaaaagtttggcattgatgccctgagtgctttcattatgtgttatattatctatctattgccaaagttgttggttacaaatctcagtcactcattatcatcattctcaaagtacaaaatttatttttactttgtataatgggttgtcaactttttttttcttttggtatttgtgtggttcttaggttgataatgaatcattttctatatatagcaaagagagtcaatgctcttttagattaccattcattcgcgcaatttcctttcatggaaatgtgtctggaaaattatgtgtttgtctccacttttttaatttcacaggcatactcaatattgacttttcttccttttcatattcttcattttagttattttttttcatttgcccccaaaaaaaaaagtttttttttcctaaaattctcgagatcacaaaaaacgaatctagaattttcttgtttggacgacaacgaaattaaataataattctctaagaaaagaaaagattgctactttacaaatttgtgtaggtatactagaaattcaaatgtcgccacaaaatttctgaataaagcgtcaccaattttttttttcaattagtcacaaaatttcaactaataagtctgaaatagaattatgaaaatcatcctctaattttttttttaaacagcttgaaacgtttattaaaacgttagtctaaacatactatctcggttcaaacgattttattaataattcaattacaatcgccttttgtaaaatacatcataaattttaagttggttatctcactttcgtttacaggaatgaagagaaatggttctatatcaaatattatttcttagcgaatcgaacaaattatcgcgacaagcttaatgggatgagtaacaagttgatgtagagcttctttgaggtttagggatagagatagcctatgtttctactttcacgcttaagttaaggagatttgacaacaccacattttcatattattgtttatatatataaaagtaaatgaacacatcttcatattgatcatataaatataatagcaattgaaaacacagaatgcctaagttttattagaaacatatatgcatatatccaagtgtaagtagctatacgaccgttgttgtcttcaaattataccttattcaatattgtaacttcagaaaatgatgttttagcttggtgggaaaaacttcagaaaaaggaaaatacttgaagccactatatggtgcgaaatgtaagaggataaaagtcatatatatatactagttttttttttcatttttttgggcaacaaagtcatatacttcacttaatttctactattagaactccacatttacgaagaacttattattcatatcagtcatctaataactgaatagttttatccagttgattattttaatggtctttctcacgtctttttttcttattgctcagcttctcatatatatatgaaatgattataaattgcttattttttgaaaaaatatatttccaatcctacattatcaatgtctgcatttcaaccttaattttacgagtttacttagaaattgatgttcttttccctgacgatgtaacatcttgatgctctttttttttcgtttttttttgtttttaatcatttaaaacctttataaatggcttcgagtcttcgacaacactcaaataatgtccaagttactaagtttgttgttccatgcttcaccactaaaatatggtttatgatgtaataggttgttgtacatataaacgtacatcttatttctgtgccatttttttttaatgtatataggtgcattatcctaaagacgtcatgtcttgatatggtttacggaaagtttgatttttatcgaattttaacacttcaacaatcgacataatggaaggttaattatataagttatctagagaccagtacttctatacatattgggttgtgattctgtttactcctaagaataaatatggaatgttttctgtaccaaggcaaaaagtatattaattcaaaaaaattagataacaatattaaaatcagatcatgctcagaaaacatatactcaaattcatagtcgactaatccttgaaatgatggatggtttacttttggatgatggatttgataatttatcaaacgtgtacttattggagcttagtattgttcttaaaagtttgatgtcacacaatgtcgaattgggaaaaagatataacaaaataggttttgacaattataattgcacaaacacaatcacacaaagacacatttatggatgtatagggaaatcaatatatttgtgtgtgcgtgtgtgactacatatatgtacatagataaggttgtgttgtgtatcatgggtttgttaggttggctgtactctataaagttttttggtatatcatcatgacaagaaactggggacccttaaaactctatgatgtgataataatatcttctgtcaacaccattttcaaaaacttataatgtgatccaattccaaattcatgaagaatatttcaagataaatatgggatcaattcaataaatatataaaggagaaaaagggaatataacctgactatttggaaccataaatgacataaagataagttcatacgacttttgtggctcatcaaaggccatcatcgtcctctatatgcaatttagtgctttatagtacaaaaccttccacttccctttgtccaaagttttccaatttaatttataaacaggaataatattatctaaataataaagtgaaaaataactatcattgtccaaataatttggtcgttgatcatgttactacaaagaaatgaaatccttagtagaagtatatatatatatttgtaacacactcaaaatg

SEQ ID NO: 36402 - DNA, 3003 bp, Unknown
  misc_feature (1)..( 3003): 2750-1469P.txt file - cDNA_ID_3095497; gDNA_ID_2926085; Annot_ID_196439
tcagaatcttctcccgtagagacgaagaagctgtttataactggtatactaacacttgagattgtatgcatgaattgggtcacatagccatataacatgttatagtgacaaaatctccatagcatttaaaggaacaaacacataccatataactggtacagtgacatgatggatgtgctgttggaagcttatagagatgaaaatacagagtataaaatcacaagaaaccatatcaagtccgtgatcgtggtaaatgctcctctcttaggtggattcgtgagtgaacactattgctttgacctgactaagaaacgtttcggttgtgaattcgggtgaaacctttgaataaatgtttggaatccctaaatgtttctgtttgctactacaggatcttattgttgtaggcactgacaccttaacgcaaacaatacagtggacaatggaggagctcactaacaaccctaacattctggagagattgcgaatcgattgtagggcttaacaacgttaataaaaaaaactgatctaccaaacctctcttactagcaagcggtagtcaaagaagggctaagattgcatccaaagccggccataaggccaagcaagcaaaacacatgcttgcggccgcctagaatatcatttagtttcgggcattttctagttaagttcttgtcgtctaatagtttaaactcaatgagttcgacccttgaaagtgaagtttaaacataaaaatattttacaaccaaatcatgaaattaaatatattatgtggcctattttttttccttagcttgtagcctcgcgaaactcggagacgtgaactcaatgggttttgcataccagagaagacaatatttgttgtcaatgcttatgccatgatgagagatcctgattttttgggaagattttgaggagtttaatcctgaggatttaaaaaacatgaagctaattatttataaatacaatataatcgattattaataaacatacaaaaaaagggtgaattattatgattttaaaacacttgaaaattgaaatattgtattcgattatgtacagccaaaataaagaagccacgagacttagtaagcattatattaatatcaagtgatcatgatgatcacaaatatagacagcgaaactgaaaatgtcagagatacgagagatgtgtgttaaatgaaatcgtatatcgttatttaagaaaattttaaaaagttttaaagaactaaaatcctaaattttactcctacaatcaaatagattttttttgacgtattatctgatcggttcaactaatccaccgaatcactggttaatagcaaattttctaagttttctgattttaaaattgccagctgacgttaaaactaaacccaaacaaacaaaaaaaatatactaaagtcaattatgtaaagccaaaacaaagaaaccacgagagttagaaaacattatattaataataaaatatcaagtgattagtgatcatgacaatcagaaacaaagacaaaaaaaagaccgaccggtttgttgcgctaaagttagacgagagatgtcacaaaatatgagagaggtgtgttaagtagtatatcactatttgagaaagattcaaaaattttaaaagtaattaaaatatattaaagtcataattttgaccggtttgttgcgctagacagaagtatattattttgggcgattatcacgagttattaaagtattgaaacacaagtaatgaacaccggttatttaagtattaatttgatcaatggttgtacaaagaaacttatgaattaataaaaggagaccgtgtatcaggtgaatcggactgtttttccagttatgcaaataccaaatcttttaggttaccttcaaggcttcaaatactatttttaaacttgataactggtatgcttaacatttgagattgcatgcatgcttttgcttttgaacttacatagtagaatctgttattacagtgacaaattctccatagagtttaaaggaaaactaagcgtttattgaataatgatgattacttttgcttcctctcaatttgttgcctacaccttaactcactcagaagataacatttacgaatacatcatgtttcttggttttgtgaactagtctacacatctgagaaaacattacgtgcagcatttgaagggttttgtgaactagttgaaggtactcatgatttgctatccaattcaaaagtaagaaaaataatatcattgggaaaagatagataatcacagccctataactctcctctgcagtcaaaattattatggacaagatatcagaaggctatgcctttcgagctagagtacacgaaaaaggaagccgcaagagctgcattaaaagagctaaatggaaaggtaaagctagattaccaaaccgatcaggcaaaactgaagtcaaccaagtttggggttctagtatcgagtattaggtgatgcaaccatggggatttgagatgcttcaggccaagaaagaaaaggcaagcaatgtcatttttcacactagatcaagctttatgaggctggagtgttccaacttccaactctgcaaatagcaaaagacatttggttacgtttaacgaggacattaccctaatatctaaatatttcacatgcacatatctaaatacccactatgcatgtgacatctctgcaaatatttcacatgcacatatctataaaattggattttacaagattccggccgaattaaagggcctactgatagtgaagtaatgtatagttaatcaccttgggcgatgaacacgcttaacgcaagttattaaactactactattcatttttatcagaaaagaacttctgatctacttatatataaaaacacttcagatgtacttatatcacgttcttttagagagaaacgtattactttatgtttaggtaataaacaaagtatggattcattataaaagattactctgtttcatttgcctctgcactttcatcaacaatggcagcaatg

SEQ ID NO: 36403 - DNA, 3003 bp, Unknown
  misc_feature (1)..( 3003): 2750-1469P.txt file - cDNA_ID_3095511; gDNA_ID_2926085; Annot_ID_196436
tttcgtttctatattttggtttttttatgttttaagatcagagtcagtccaaccttcagcttcctccttgccttgcgtttcgtctaggtcctcgccttgagtttcatctaggtcgacctcttcagtctggtcgggacctcctgctgaatctgaggagttgtttgccgcatctgtgatgtttacaggttgctgattctccatcaaaccagaaagtgctagctttggtgaccactcaaggacatcatcaatgatgttggacatccttctttggtacctgtatgaacaaaactcatcacaattcaacctctactgcactaaattcaaatgagtagagtacaattagtttaagcgatatttaaaggtggacgagaaggcagtgtatacctggcccgagcagcttcatcaggggcatgacgcctaagcagcatgacaacaacaatagccactactgtgtagaaaagtcgagatgtccacttgggcggttcttcctcgtctttctttggccagaaacggaacagttccttcaatgtggcttcctcagctagaatgttggggaagaaccagacacgctttcccaaaagaatccacatagcaccgaaagcaactgctctcactgcaagaggtaatcaagaaggactaatctcagtataagccaagttaaaactacatgagtatatgacccccttcagtttagtagctatcgctagtaaataatactcccaagaaaatgactctcgaaggtgcaattacaaaaatattaaacagagtatttgtgtaatagagcttaccgaaaagtaaggagagaatcatcagaagaatgcccgcacatgagtagagtacaattagtttgcaacggtgtggatacacaggaaacaaacaaattgcaagagtcaatacaggccagaagaaggacaaaagcgtttgccatagcggatgccgtttttcgaacgtccatgcaaaaaaggcatcattttcagagaaagattgatcgtcctgcatcaaaaaagaaaaatgaaatcaaaagcgctgatatacttgcactgatgaatgcatatcttactcaaaataaaaacaaaacaagaaccaaagagaatgatggtgaaagggttgaatagcaattttctctaagaaacaaacttcaacatacaagacaacaagttcaatagcatatgaagcaacaccaaaatcaacttacacggaaaatctccaaatgagcaggccaagtagagagctttttcttcccgggacgaagagttttagtaacacgatcacagcggaccaaaaggttctttcccaacaaaacattggcaatatcgtctgtgtcaaggtctttatcttcttccagaatatctttaaagtcagggttattcttcataaagctcacaaaatctttccctctaaagtattcaactcgtgcttgctccataacagcccatctggattctaatcccttgtggtctctaactttctcagcaaacaactgaaaactatccttcttcacagcttgcttctagtaaagtaaagacaacaataagcatttgagcatatcaatcactaaatgcaaaggatcatcatttaacagtaccaaggccaaaacaaaaaaattcaaattctcgccacacaagtgattcaattaacattccagagattataattcacaagtcacacaaccaaaacagtaaaatttacgagcattaacatacaatttagcaaaacttaactatgaaaaaggcctatataatcatgcaatcgcaggtcaaatgctccatcagagaccaaaacagatcaaacaaaaggaaacgtaacctaagaacaaatttttataaaagagattagagagaaatgagagaggagagcaaaccctaggttgagaatcagaaccagaatctctaacggaagtagatgcagatcccgatgatcgtttaaccctcttcttctcggctccgaccggcttcttcatctctctccctcttcttccgagtcggagagtttttttttttcgatttttcttttacagatccaatgttttttgttttgttataacagaacaaaaaaaaaaattctggttttttgggtaaacccgtagagttaagattgcaataccggtttatagtagaccggttaactaacctagatttattaccaagtgctattaaaataacgtagactaactttgaaaattttggaatctaaaaagtatttcatttttctcacatttcaagattgatgtttgactaacatttatacatttaccttataaaaagatttccacaacttcaaattatattggatctttcttcataactaaaaaaatcaacaaattagacgtttagacctttttatctaagtaaaattagacctaagattatcatttaaaaatattttcagtacaaatgataatgtgatttttatgattagaaactttaacttacacatctttttatgttgaacgattttatgattgacggtttatcgataccacactcacgattaaaaaattttactttttagtttttactgattgaactatagcgatcaactctgtatgtatgctagagattttcggtaagcttgtctttgttaatacgagaaatttgtattctatgaatcgaacctcatattcatttatgatatacaatcactttaattttaaacttaagtgttacaatagaaaaaagcataatttttagtagaatatgatctagtgatgatataatagacggtttgcaatagaaaatgtgtttactcatgattaaaagagagaaaacgaaactataaattgctcagctttcacttgattagaattttactttttaacgggccaattcatgtccaaattataggccttttaacggcctatactttttgatatgcttagcttttttacttatccactccaaattcccaaaaagcccctgagtttttcggattttacattttctaccagagtggagaaaaaaaacagagaagaggaaacaaagcaagcaaaaaagagttgccatg

SEQ ID NO: 36404 - DNA, 3000 bp, Unknown
  misc_feature (1)..( 3000): 2750-1469P.txt file - cDNA_ID_3095515; gDNA_ID_2926085; Annot_ID_196435
tacatctactactatcatccacccgttgataatctgcacagagaaaaaagaaacaccataacatctgtgaatcaacggtcatgtttagattttactttgagttgataacaaagattttgctttaagatctcgaaaatctagatttacctttccattcatctcttttagtgcagtgcctgcggcttcctctgtcgtgtactctagaaaggcatagccctttgatctcttcgatattttgtccataattattttgactgcagaggaatgttctagggctgtgattatctatcttttcctaatgataaattttttaaacccttggataggatagcaaatcatgagtaccttccactagttcaccaaacccttcaaatgctgcacgtaatgtcttctcagatgtgtagaaagacagtcctaaaccaagatacatgatctattagtaaatgttatcttctgaatgagcttagttcgtaaattaagatgcaggcaatgaattgggggaagcatgatttttccttaaaatgctatggatattgtgtcactataacagattatgctatgtgaccaaaagaatgcatacaatctcaagtattaagcataccagttataaacagcttctttgtctttacgggaggagactctgaatcatcttgatctcttgaatcttgcgtactatcgccttttgtgaaaaagaaagagagccaaagttactacaatgtgagattatacactgatattcatcaaaatcagctacacaaagattctaaacaatatcgtagaacattattttcaatccataagatcagtattcaagacagaccttcatagtctttgtttagtgactcgaaactgttatcaggaacaacagcaagaacaccaggtacgcctgcattaatttaaacaccatctcttattctgttagcttaattcaggacaaacattgttgtctaattttttcattagctaaactcacaaaccagctaactccacagcacttctttcatcgagatcacaacaaaatccgaaatcagactgccaggaaacatgataaagacacatctgtgcatccttctcactgcaaagaaaagagtcaaagttgcagttctaaaagctgaaggaaataataccttcccttaaggcagaataaataaaaaagaaacttacttccacaaaaccttggatagcaattgaacacaatgatcaaccatctgtgctttagtaacaatcccaactcctggcttatctattcgtaccatccaatgttttactgtcccatgatcaaacaatgaaacacctttatggctaccaatgccataattcttcttctctgaactgtaatcctgttcaggtctaatagacactactccaggtaaacctaagttcgtagataaccaattaaaacacctaagtaactaaccatagaaacagaatctgaaactctctgtgatagaatactcactagcgagctgtcgtgaagcatcttcgtcgatatgacaacaaaacccgaaatgggtatcaaaggaagcatcatatatactcacttgcgcatctttttcgctgcaaacaacagaatcagtaccaatagtaagcagaaagttgaagcacaaagctcaaaagaaacaaacaagcaatgaaaaagaacccactttcccagtactttcgcaagaatctcgacataataatctaccatggctgatttggaagaaacccaatgcggaggtttatccaataacaccatccaatagctgtttcgagtaagaacagtagaagaaggcggtgcggaaattgcagaagatgagaagacgaggtgtgatgatgacaaggaagttttccgaaaagtcccgaaatttaagttgggagaataaaatgaagggaagaatctgttattgataatgtgtgaggaggaagagttggagatggggacgaagaaggaagtggaagcaataagagcttccatggcaactcttttttgcttgctttgtttcctcttctctgttttttttctccactctggtagaaaatgtaaaatccgaaaaactcaggggctttttgggaatttggagtggataagtaaaaaagctaagcatatcaaaaagtataggccgttaaaaggcctataatttggacatgaattggcccgttaaaaagtaaaattctaatcaagtgaaagctgagcaatttatagtttcgttttctctcttttaatcatgagtaaacacattttctattgcaaaccgtctattatatcatcactagatcatattctactaaaaattatgcttttttctattgtaacacttaagtttaaaattaaagtgattgtatatcataaatgaatatgaggttcgattcatagaatacaaatttctcgtattaacaaagacaagcttaccgaaaatctctagcatacatacagagttgatcgctatagttcaatcagtaaaaactaaaaagtaaaattttttaatcgtgagtgtggtatcgataaaccgtcaatcataaaatcgttcaacataaaaagatgtgtaagttaaagtttctaatcataaaaatcacattatcatttgtactgaaaatatttttaaatgataatcttaggtctaattttacttagataaaaaggtctaaacgtctaatttgttgatttttttagttatgaagaaagatccaatataatttgaagttgtggaaatctttttataaggtaaatgtataaatgttagtcaaacatcaatcttgaaatgtgagaaaaatgaaatactttttagattccaaaattttcaaagttagtctacgttattttaatagcacttggtaataaatctaggttagttaaccggtctactataaaccggtattgcaatcttaactctacgggtttacccaaaaaaccagaatttttttttttgttctgttataacaaaacaaaaaacattggatctgtaaaagaaaaatcgaaaaaaaaaaactctccgactcggaagaagagggagagagatg

SEQ ID NO: 36405 - DNA, 3000 bp, Unknown; identical to SEQ ID NO: 15214
  misc_feature (1)..( 3000): 2750-1469P.txt file - cDNA_ID_3095555; gDNA_ID_2926086; Annot_ID_196461

SEQ ID NO: 36406 - DNA, 3000 bp, Unknown; identical to SEQ ID NO: 15213
  misc_feature (1)..( 3000): 2750-1469P.txt file - cDNA_ID_3095561; gDNA_ID_2926086; Annot_ID_196459

SEQ ID NO: 36407 - DNA, 3003 bp, Unknown
  misc_feature (1)..( 3003): 2750-1469P.txt file - cDNA_ID_3095566; gDNA_ID_2926086; Annot_ID_196458
agcacatgaaggtgaagagggtgcagattacatatgaagatgttatcaactccatagaggctgaatacgacggagacactcataaccctcaccatcacggcactcctggcaagaaatctgacggcgtaagggtttaacaatgttgtaaaacctaacttttcacataaaagatatttacatgagtagcaaaaaaaataatctgacggcgttagctagtactcttcacgaccttctccatatatactacatctttcaatttatggatgttgcaatgggtttagtttggtcggtctcggtcttgtggtcttgactcttgacgggttgccttagtttgattaactgacacttaattactaaatgaaaagaaaaaatgatgggtcctgctaggtctaataatagcatataaaaatgaattagggctaggaaaattttggtctactatatttttgtttataatgatttatttattgtatactttgatcgaactaatgtaatatatttgtttttgtaggtgagcttgagcccagacgagtacataacagatgttactggctactacaaaactacaggggctgaagatgctatagcagcattggcttttaagaccaacaaaactgaatatggtccttacggaaacaaaacaaggaaccaattctccattcatgctcctaaagataatcagatagctggtttccaaggaattagcagcaatgttctcaactctattgacgtccactttgctcccttaccttcctcttcgtcgtcatcgtccagtttgagtcaagccaacaaagttgatgctcaaggtgggaaaggaggaacatcatgggacgatggtgctcatgatcatgtaagacgagtgtacattggacaaggtgattctggtgtcacttatgtcaagttcgagtacgagaaggacgataagaaggaatcacgcgaacacggaaagaagacccttctaggagcagaagtggtgagtatgtttagttcctttcctatattataactagaaagttcaaatccgttgtactttagttatattatgaccgatcttgccaaagaattaacttatttgaaatctctgtatagtttgaggttgatccagacgactacatcacatcagtggaagtgcaatctgacaggatatttgggcaagacacggaagttatcacctccttaatcttcaaaacatccaaagggaaattctcaccgccctttggactcgagggttcacagaaatatgaactcaaggacaagaatggtggtaaactcgttgggttccatgggcgagtaggcggcgaacttcttaatgctctgggagcttatttcgctccttcatccggtcgtggtaccccttcagccactcagccacctggatcagctcaaccaactggatcagctggtgctaagaaactagaagcaaaaggtggtaacgtgggaaatccatgggacgatggtcctcatgaaggtgtgaggaaagtgtatataggtcagggtgattctggtgtatcatacgtcaagtttgtctacgacaaggactctaaggaggtccccggaaatgatcatgggaaaagaacactacttgcacctgaagaggtcaaatatgtatacacatagaagaaccagcatataacctcatttctaaattattgtttcatattagattttttttttgttttttttttttgcagttccttcttgaatatccaaacgaatatataacatcggtggagcttaactatgacaaaatatttggaactgaaggtgaaatcataacgatgcttaggttcacaacgaacaagcgaacctctccaccttttggacttgaaggtgccaaaagcgtcctactcaaagaagacggccacaagatagttggcttccatggcaaagcgggtgctgacataattcaccaagttggagtccatgtcaagcctatttccaagtgaagtttgtaatattttctcaagtcccggtctaataaaaatgagctatcaaaaaatctctgttctagaaattgtcattgtacttgtgtaaatggtaataaggtctttgacaatatgctacttgtgtgtttgtttgtgtttcaatgtctccttatactgtactggattggagtctgtaacactgtttcaacggtttctaagacgtatatataaaatcttggttacgttgattcatataatcatatatctaatttgcaaagtggacagttgtgggttgtggcaaacgtggttgtggcggtcgacgaatcatccattggagaagactagtggcataacacatcactaattctctctttcttatccatggttattactttcgctctacttttaaaaactatatgatccaaaagatcatatatgatttgttaccctgcaatttaatttgaaaaccttttatctaaaaaagagatttatttcttataatatgattctgttttggcatgaaatggatcaaaattaaaataacgcatacaaatttcattttcttattattgaaaattaatggataagaatcttcataaattttaaataatttcattttataatatttataaaaaaatattctaatggtttgatgcataatggattaaaatattccatttatcctattttataaaattggttaaaatcatatattaagaaataagaaatatttttcatttatgaatattcagtcaataaaagaaaaagaatactgcccaattcatcataaactattaaattaacataaattatgtataaaactagagaaaaccttatgaaatagaataaaaataaaagcctaaaacatcttatatattataaaagccttaagtataaagctaaagagaaactgcaaatttgaggtcaatacttttacaacctttttgtgtagaaccacaaattttaaagtttttgtttttatagtgttattgctttcttattagacctttttttttctttgttacggattgttcttcttcttcagagcacacaagctctgagatcccatcaataaatg

SEQ ID NO: 36408 - DNA, 3003 bp, Unknown
  misc_feature (1)..( 3003): 2750-1469P.txt file - cDNA_ID_3095580; gDNA_ID_2926086; Annot_ID_196455
ttttggtcaatagtaactagatttaatctcttaaatattttattgctaagtcctcttcttgaccaaacgtcccggctatataatcatcctctcaccatggttccaagtttcaacagcaaattggtttagttcaataagattttcacattcacacatcttaaagctgcaatgaaaaccgggtcagcaaaatccaacatcctcctatatgtttttgttctctcacttgtcttgtctccaatacttccatgtcaagccgctagtgtgcttctaggaggtaagctagttatctatgaatatcctccactatactgtatgtatgactctctctctctttcagttttttagagggattaatgattttatttttcactgaaaaggtggagggcgtaagctgatggcgccgtcaccaccaattcgcatgtgtccacagtgtgtatgttgtgcaccggctccacctgattcttgctgcccatgtcgttgtccaggcggcgcctgaagactgacgtttgctctcaatcaaatgggttattttgatgtgttaaatatgtgtaatctttataatatgtatatataagtaaataaaaagtgtaatctttgtattgtgaataaaataaccttgggttatgttgaatagttttactataagctagttttgatagtaacacacttttatacattgttttcttagttggtgataatgggatcacaaaagatttgatattatttggaaagaatgtttgacaaaaaatattaagaataaatgattcttgtttttagaaaatcgtgtgaaaaaccctcttcattatcccataaccgatacgtatcatttcaatcttcatcttcgtcacttacttacgaaatctcaaatgaccttttcccattattttatgttttaattgatttgcatatttgttgtgttgtgcatgtatatatagacttgactataagcatttgaatgtaataaccaatactcacttgtacatgaatttttttttatagttcttcaagatgacgagtaaacatgtttatttttgtaaaagtccactttgtacagtaacacgcagccaaacagcgcatgagaaaaaagaagtaaaaatgtattttccatcgttcatagttcaaagtagagtgtagagatgtgcctcttccggtcctatcactggttttgaagctacaagtaagagataacaaactttcatgagtgttactacagcgccgtcattcatccgaaactgagatgtgagtgacaaataagattgatgaaaccaccaaagtggtgtcgtggaggaaggtcttagctctaccactaagccaagcaagatagtcgaaacttcacataaacgagttaatccggttgcgatgacacttttttctaagagaatttgctaaaactcaaagtattactgcaattaattgtcttctacactacaagactatatgaagtgtaaagtctcttgattgagtgaaaaagttaaaacttgaaaaattaaatttttcttcggaccaatcctgaaaacgtgtttgcgaaatgttaatacatacgtgagatcacacctagttttgtagaaaatatatcaactatattttttctgtgacaaaaagttttatattatattaatttggatttccaagtagatatgcaactttgactaaaaaaaaatataatttgattaagaatataatttgcaactcgaatatgcattattataaagagttcctattatcaacaattggaaaaattcgctatgagtcacatgacaagatcacaagatagcatacttcgagccttcaattactacagacaaaagtatttaatagtatcgtacctttgactttaaacatcctttgtatgttaacaatattactgacgtcttaagataattcaagagtggcaaaaaatccatgcacaaaagctttaactacattatctcaaattaaaaacaggattcaaacaacaacaaaagttgaacaaaaagagtaaaagaccatgggaaaatgtattattttcgtcaattcttatctccttattttatctactaacattctataaatacacacttagacatataagcttatagaaaccaaaaaccatactcaagactcattatgactagctctatgaagaaaatgattcttatcattttcatcacaaccatggttttatctccgacaagttttatctcttgtctcgcaggtaagtaaactgcttagttaactgatttaatttgagaatttacctatcaatttagagttttttttatgtatctctattcgcatatgaagatgttcatgctactgaaagtcccaccgaaccagcaggcaagaacattgacaaacctcatcactaaataatcagaacattaatgagagcattttcaatattaatttatcttatttgtaaacattttttaatgattattttgtagcctctcacgttactggaggtgataaagtagcatgtcctgcttgccgctgctgtgaaggcccaaaacctccaccgggaacttgttgccgttgttgttaaatgttaattaagctcaaaaatcaacttcctcgtaaactttagttaagcctcttaattactattagggttcaatatctacttatgttgttgtagtgttgtgtattcgtacttgtcttgaccaaataaaagtgtagctagccgcttaaatccatccgttgttaggatggtgctttggccaaagtgattcgaatataccttttatacacaaatacatgtttagaatgatgtgttattgtgttacacttttaattggtctttaattttcacacaaacatgcatgaataaatattctaacatatcatagagagtgttccacatcaaaaccaatttatagtggttcatggtaaaaaaaaatcatgagtctggtataaaaaaaacttaccataacatcatgagtatgttgtgtgatagtgacatcaaagagattgtgaaaatactaagattagaaaataatttgagaaaacatcagaaaaaaaatg

SEQ ID NO: 36409 - DNA, 3003 bp, Unknown
  misc_feature (1)..( 3003): 2750-1469P.txt file - cDNA_ID_3095585; gDNA_ID_2926086; Annot_ID_196454
atatgttttatttctcgcactggtcttgtctccaacacttccatgtcaagcagctagtgtccctctaggaggtaagctaattaatctctgaaatttctcccatctactatcactctctctgttttggtttttcatagggagaaattgatttattaatggaaaagtgaagggcgtaagatgatggcgccaccaccacctattctcatgtgtacacagtgtgcatgttgtgcaccggctccacccggttcttgctgccgttgtggctgttctggtggtccctgaagactctgacttatgctatccaatgtgctatccaaggtccttaattccttataatatgtatgaacacgtaaacaaaaagtgtattctgtgttttgaataataaaacctttgggttctgctcagtacttatatgtttataagttagttttgatgtcctccttggagagttgatgaactactgtaaaaaattaaaaatgtcgaaatcctagagttcacaacaatgtcgaagttaatctttcgggttatgaatgtaaaaccatgtttacaatacatgcatctttgtttgaagtttataaaagtcagctaaaaatggtacaaggttatttcttcatctatgcttgtacagaatttttaggtgctagcaaaggctcttctatcatcgtttaatatgaactcgttacacaaagtcatctcatgcaaactacctcaaggtcaactaatcgcaatagttgcaacatgtatttattgcaatatctatcaggtagatggtgatatcagaagatagtgtatatcaattaccgtgtgaaatcaaaatatagctgcatcatcaaaactaatggcttattttggtcaatagtaactagatttaatctcttaaatattttattgctaagtcctcttcttgaccaaacgtcccggctatataatcatcctctcaccatggttccaagtttcaacagcaaattggtttagttcaataagattttcacattcacacatcttaaagctgcaatgaaaaccgggtcagcaaaatccaacatcctcctatatgtttttgttctctcacttgtcttgtctccaatacttccatgtcaagccgctagtgtgcttctaggaggtaagctagttatctatgaatatcctccactatactgtatgtatgactctctctctctttcagttttttagagggattaatgattttatttttcactgaaaaggtggagggcgtaagctgatggcgccgtcaccaccaattcgcatgtgtccacagtgtgtatgttgtgcaccggctccacctgattcttgctgcccatgtcgttgtccaggcggcgcctgaagactgacgtttgctctcaatcaaatgggttattttgatgtgttaaatatgtgtaatctttataatatgtatatataagtaaataaaaagtgtaatctttgtattgtgaataaaataaccttgggttatgttgaatagttttactataagctagttttgatagtaacacacttttatacattgttttcttagttggtgataatgggatcacaaaagatttgatattatttggaaagaatgtttgacaaaaaatattaagaataaatgattcttgtttttagaaaatcgtgtgaaaaaccctcttcattatcccataaccgatacgtatcatttcaatcttcatcttcgtcacttacttacgaaatctcaaatgaccttttcccattattttatgttttaattgatttgcatatttgttgtgttgtgcatgtatatatagacttgactataagcatttgaatgtaataaccaatactcacttgtacatgaatttttttttatagttcttcaagatgacgagtaaacatgtttatttttgtaaaagtccactttgtacagtaacacgcagccaaacagcgcatgagaaaaaagaagtaaaaatgtattttccatcgttcatagttcaaagtagagtgtagagatgtgcctcttccggtcctatcactggttttgaagctacaagtaagagataacaaactttcatgagtgttactacagcgccgtcattcatccgaaactgagatgtgagtgacaaataagattgatgaaaccaccaaagtggtgtcgtggaggaaggtcttagctctaccactaagccaagcaagatagtcgaaacttcacataaacgagttaatccggttgcgatgacacttttttctaagagaatttgctaaaactcaaagtattactgcaattaattgtcttctacactacaagactatatgaagtgtaaagtctcttgattgagtgaaaaagttaaaacttgaaaaattaaatttttcttcggaccaatcctgaaaacgtgtttgcgaaatgttaatacatacgtgagatcacacctagttttgtagaaaatatatcaactatattttttctgtgacaaaaagttttatattatattaatttggatttccaagtagatatgcaactttgactaaaaaaaaatataatttgattaagaatataatttgcaactcgaatatgcattattataaagagttcctattatcaacaattggaaaaattcgctatgagtcacatgacaagatcacaagatagcatacttcgagccttcaattactacagacaaaagtatttaatagtatcgtacctttgactttaaacatcctttgtatgttaacaatattactgacgtcttaagataattcaagagtggcaaaaaatccatgcacaaaagctttaactacattatctcaaattaaaaacaggattcaaacaacaacaaaagttgaacaaaaagagtaaaagaccatgggaaaatgtattattttcgtcaattcttatctccttattttatctactaacattctataaatacacacttagacatataagcttatagaaaccaaaaaccatactcaagactcattatgactagctctatgaagaaaatgattcttatcattttcatcacaaccatg

SEQ ID NO: 36410 - DNA, 3000 bp, Unknown; identical to SEQ ID NO: 15223
  misc_feature (1)..( 3000): 2750-1469P.txt file - cDNA_ID_3095633; gDNA_ID_2926087; Annot_ID_196482

SEQ ID NO: 36411 - DNA, 3003 bp, Unknown
  misc_feature (1)..( 3003): 2750-1469P.txt file - cDNA_ID_3095638; gDNA_ID_2926087; Annot_ID_196480
aatggggctaggattaggctaggtggccatcgtaaaaagatacacttaaagagaaataaaatagactgctgcagaagagagttaagaaaaggaaccagacaaaaacaacactttaagtagagagcttcagttttgcaagtcatagtgcgttagttaaaaattggtcctaataaagagaactcatgatttatcagattcactattcagggatgttatttttcgaacaaattgaacaaatacaagcaattacttcttaggcagagtagtaacctggtgagtcaaagcatatgccatcgctctctcacgcttagctgcagcttcctgcctctttagcagcttggcttgaatttgttcaacagatccaatgctatcgcaccaaccttcctgaaagatgataacacatagtcaacatgactgttattaaaggccaaccagaagataaacaaatacaaagtttgtaaacaacttagacaagtgacaggcacctctatttctcgaactcgggcttcatctgctaactgttgttgaagtgtctgctgactcgtctcactttccaattccaaggcgagacgaacacgtcttgcgcgtacacgagcctgaactcttaccaacgcttgcatgcatcgaagcgttacagcagcttgttttctcacagcatgtcctctaacaagggcttgaagtctaaccaatcccttcaacgctcgtaaagccctcctagcctaataaatatatcatcttccttatcaatccactcttctttttaaaaccaatgaactagcatcactaaaccataagtaaagcaacttaataaggcaaattgataccagaaatccccgataagccgtttggatacgcgttgcagcccgattttccctactttgttcgtcataagcaacacccccatatgattgtagtgaagttgaagtagagaccccagtatcaaccatactacgcgtattggaatcttcaaatccatcttgaaacttttcaaagtcaaaatcaactgaattctttctcccaaacctactcttggtagcaaccttcaccttcatcagttaaacaaacacagaaatgaaccaacattggcataattaagacaaaaagaaagaaactcttgtaataatcttcctttgaagtactcacattttcatctttcttggaagacctagacttatcagatttagtaaaaccaaccaatgctttaatccatctccctgaagctcccattctatctcaattccaacgatcagcaacataaaacaacacaaaacctgcaaaattgccaatttagcaactaaattattcaaaacagtaaagctttctcctttttgataacaaaatagacaaaaatggaaactttaattgagttcactaaattctcctgacaatgttggatccttaatattaaaaccaagaaatttagtaatgaacactaacaaaaaatccaaactttgcaaaattgagacacatcgaggagaagcaaaattcaaaaactttacaccggcggcgaaggaaagatcgccgatgagatctttaaagagagtgagtggcgacttcgtgatcttttcttcttcagtcagtgagcgtctttctcggctactttactttttcctctctctctctactctacaaaaagaaaaaggtccatactttattctctctctaggggatatgtgtgtgaacgaacatatacagatagataggaattgacttgattgatcgtttcgttttccctctcctctctcagatacgattgattgaatgatagattagattgcacgccgtacgcgtgctctattcttcaatttggcggcgttttttgacctcgaaacggcacgcagttttagtttgaaatatgtttgattctcttttttaattaatgcatgcatttatgtgtgtaagtcttgtttgcagtctgatattttgaatggagaagacaaaataagttgacgtgtcacctaattatatgatgtcactagtttttgtaatgttggatcattattagtatcttttttaatctaaattaaagataattattattttttcgtttacttttgttagacgtaacaactatcacatggttatgtaataatcttatggaaactcgtatattaaaataatttttactccagtttttcctactatccctccttagaaattgaaatatgccatcaaatttggctactttttctgttagttgggttggcctagttggtgtttttatttagtaaatgaaaaataaaaagataaaaacaaacacacaaagaaaagttattagaatatgtcctacataaaattttatttatgtatagaataatatataaatatatggtaaaatttccacttgaagtaatttttaagtatgagttaggctcatactaatatgctataaacctaaagttttaatgtgtctcgattgtgaaccatatatagatgtccagtcccataaccttaacgtttcagatgtccatttctaaacgcgagggaagaagtgtattaaaatgtgttccacatcgagacataatttttttttcttcaaattggagtgattttttttactatatttctccattttatttatttcagcagaaaatataataaaattttaattgatatttttatggtatggctgctatatacaactagcctcttatttgttttttctttcccttgctactactgcaccagttacaacctattattattatctctgtgagagagcagcaaaatgatttgtttccctttaaaataaaataaatcaaaaataatattaagaaaatgactcaatgacacgtcactggaaaaaatcaaatggaactcgaaaagattaaataaataaaaagatataaggcatcatcatcatcaattcatcatcctctgttttgtaaccaatctcagctctccctctcaaacaatccaggattcttcagattcctctcctttgatcctctctttaacaatctctctctctctgttttcttcgatccgttgtaggagaaaatg

SEQ ID NO: 36412 - DNA, 3000 bp, Unknown; identical to SEQ ID NO: 15224
  misc_feature (1)..( 3000): 2750-1469P.txt file - cDNA_ID_3095643; gDNA_ID_2926087; Annot_ID_196479

SEQ ID NO: 36413 - DNA, 3003 bp, Unknown
  misc_feature (1)..( 3003): 2750-1469P.txt file - cDNA_ID_3095648; gDNA_ID_2926087; Annot_ID_196478
cttcatctttccctgatttatagatgcacttctcaaacttaggcataaaattatcatgttgcttaacaacttgaccaagattctcagaaaccttcatcaatacatgccaaagaaaaaggcaatgccgtgtattggggaagatttcgggaacaatggagttcattacaacgtctagctcagtgatcaaaacctttggagcttgtccaccgattgctctcagccaggtctccattaaccaagaatatgttgctgcactctcatcggatattaaggcgcacccaaggaccatatactggtagtgctggttcactccaacaaaaatagcaagtggcatcttgtacttgtttcttacgtaggtggtgtctagagaaacaacatcacaaaaactgccatagttatgcctgctctttgcatctacccaaaatacattcttcactcgctgatcatcgcccagatctactgcataaaagaagttggaattcaaggattgcatccgtgacaagaagtcaagcaggattttgaaatcccctgtttccactgataaagtccgacctttttcaaaagaacttttcgaatcgctttttagacttataacagttttgtactcagcaaactgcttagccattgcagcatatatctttctggtctgttcactcacagcttgtgcaggtaaaagctcatgattatgctccctcacaaagctgtgaattacccatttcccatccggccttctcttaacatgcatactagctttgcaatcggttttcgcacatgttctcctaccagccatattctctggatcttgcttactttgtctagctcgtggccgattaaaagatttgtcatattctcttttagtaccatacctagagcaagcaaacttcgcatcaataaactctcttgtagttttcgatctacgactgttctgtatcgcagtgttaaaccccatagctcgagaatactcctggtaaaacgaatacgcttcaccgtgtgactcaaactccataccattaagaggttcaagattcataccctcagtgtactcaaccaactccccagttggaacacccatgcctacactgtcatcagtattaacctcaacagaaacatcctcaattttgccaatatccatatcttcttcattgtgtaacacattatcaagtcctctatcctcatcatctcctttgcaaaggtcacctgaatgtagtcgaagatctatatccatgacaaacctatagtctcaggcaaaacaaacgtcttacaacactgcaagacaaaatctaggtctcagtacatatatctaggtcaaaatgtatactaaagtcacacacaaaagatgtaacaaaccagagaaacccatcaaaattcaatctttctatgatgataaatcgagaaagtatacacattttgcccttacaattgcagaaaaaagcaacttgcagctaaattcttagtgggtatttcatcacataaacgaaatcctcaaatccaattcctaaaacgaagctgatcaaaactactgtataacccaatcatttgtgttggttatcactataaaacaaaaacaaaaaataaaaatgaaaactttacctcgtacgaaacagaagatatacgaatcggagcagaaactgagaaaaggccgtctctttttaatctcttcgtcgtcgagaggaggaagaagaagaagacaacacgcgccaatcgggtgcgagttggggtatcgatctgcgaaaaggagatagagaagaagaagagagaaagagaagaaaaattggtgagtggtgttcacgcgatctgaggaagcgagtgggcggaagatccacgattcgttcttttggtgtctagggtttcttcttcttcttctctctgtctaaacgcatcaccatgttttttgataataataatatctctatccatttatttatgttattaataaaataaaattagaaagaaaaaaaaaaactgtttttgtttgaaattttgtgcaacgcgcatgccaaaacaaaaattggagggaagcgtgaataatgggaatgatgagatttacttacatctataagagtagacttgtttaggcttttaaaatttgtttggtccactctaagactaagacttgtttgaattattttattttgtatttctaagtatttactatggtgaaaactgaaacattacggtgaattacaaaaaaaaatcatagtaaactattcaaaatatttttttgttatttacaaactatcagttttgaatttggactatatatatatatatatattagtaaatgcttttaccaactttcaatagccaagagccaattggtatgactatttcagaattggattaatttattatatttgatccaaaataaaaagatcaatagccgtccaaaaaaataaataaatcaatagccactcattagcatgagtcactgttctttttaattttgtacatatagattagctcagtcttaaaaaccatagttataattagtcccactaatgttaaaaagtttggtaaaaaaaaaattatttcctaacttttttttacatattagctacaataaaataaataccatttttggaaatattttatgaattcaaaataaatttcataaaatatcataatcaatagccaatagccagttggtaatttactatttccgacatgatttaatttaatacagcatatattttttgacaaaaagccagccaatatcctgaaatttaattataattatgccaaaattatttataataccaaaattatttataattaattatccactaatgtaaaagttgggtcaaccatttggacttaattaagactaaacctgccacagtaacagagagagacgatattttctcagtccctttcccttttcaacgagcaacaacactcttcacttaatcgctccggcggtggcgaacggcaacgtgacggtgacgttgtcggaaaattagagtttgtttatctttgcttattgttgttggagaagaaggtatg

SEQ ID NO: 36414 - DNA, 3000 bp, Unknown; identical to SEQ ID NO: 15220
  misc_feature (1)..( 3000): 2750-1469P.txt file - cDNA_ID_3095655; gDNA_ID_2926087; Annot_ID_196476

SEQ ID NO: 36415 - DNA, 49 bp, Unknown; identical to SEQ ID NO: 15232
  misc_feature (1)..( 49): 2750-1469P.txt file - cDNA_ID_3095690; gDNA_ID_2926088; Annot_ID_196518

SEQ ID NO: 36416 - DNA, 3000 bp, Unknown; identical to SEQ ID NO: 15233
  misc_feature (1)..( 3000): 2750-1469P.txt file - cDNA_ID_3095710; gDNA_ID_2926088; Annot_ID_196514

SEQ ID NO: 36417 - DNA, 3003 bp, Unknown
  misc_feature (1)..( 3003): 2750-1469P.txt file - cDNA_ID_3095725; gDNA_ID_2926088; Annot_ID_196510
taatttctaatttttcaaatttcatttttctcagtattaatgcattaactaaaaatactataatttagtattgttatattaaccttaataaatattaattaaactaataatgtaacttaataaataggtatttattattatatgatttctaacataacaaaaaaaagggaaaataacaatatagaaaattagaaactatttatcattatccattatttgatcaaactggcactagtatatcgattatttgagccaaacatatatcaattattttgttcaaaaagtctaactaattgaagaggtaaggttgtataaggaaattttggtatagaaaatagacaaataatatatcgaagaaaagtgtgctaagtgtcttttggcttgtggggtattttgggtgcgccttcgtgcgaaattccattaggccacctttcttatttcacatatatttacacatttttgtcatgattatacaggatacatgcatgcccatatatatcatgtaaagatatgcatgagaagacatgtacttgtatacaaatgtgtgtacacatgccaatacgtagctatagttgtgacttgtgaaaatcagttgattattctattttagatgtcgtcgaatcaaatgaccttttgaaattcggtataattagatatctacaacaatatatagtgtagtaattaatggctacgatactatatatacgtacgcggatcagaacggtttcttgggactttgaaaaaatatggtttgcttttgatttggttggtatgagaacagaaattagttagccaaaatgtattttgttctattttatttggaaataaaccaaaactaagtctatagaattgaggctgacccgggccagcaacctaaataaacagagtcaattataggaccggctctatacattaatgttaaccttggagtacattacgtaatgaaacgaagctctacaagaaaagtatgatacacttatctaatgctaattcaatctcctcatgattagaccacaagcgcatcttctcactttcatataaacgtatgtcatattaaatagtgtgtgtatgactatgagcggtataatatattagaatccaaggaagtgagattctttagccgcttgaatactttggcgatcgttgattgtattgagcctaaaaagctaatcttttcattttgtaattatagatcaaaccttttgactaatgccaaacaagataatttcccattctctttttattcactttataatagtgttgtcaaaaatattaattcttttgggaaacctatgattcttttatcatatctattaacgccatttttaagcttttcatacaagcaatacctaacacgggagctatcttattaccttatgatgatcgtcacttttaattgtataatcaatttgataaagaaaaaagggatagatacaatacaaattagtgctttgatcatatctaattattgcatgagtgtctttaatttaaggtcgtgaatctttggaaatccgagaggttttttgacttaagtaattgaaagcttttatttatctattattttatttgtagctttttgtaaaaaattgaaacttgtaaaatctgtatagtatttgtttgctcaaaaaagtcaccaagattgagaattgacagaaatagaataataaaatgaacaatttgaaatcaacaagagccaaataatatgcatatataattttgggaattgtggtgttgttttcatttggaccatatctccatgtgaagaaccacttgaccaggagaatatttttgtcccaattgatttcacaatctctagggttttggatagctgagaacatgatcctttgtcctctttacgaaattgatgcaaaaccacttaacaatttgtcccttcgttgaaatttatgctttcgatttttatttgggggggttaggggagggggtgaaatttatggacaatgtgtaaagtataaggaacaacgacacatatatatgctgttagttaggaaatgttaaaattgaacaaactttatagcaatcaaatctttataagtactcagtatttcattaatgcccacatgaccattgactgaagccaacatcaacaagagggtatgcttcaaaatcaaactcaaatctatcaaaagctataaaatatattcacaagtgagttaatgcataattttggtaaatataatctgcataattggtttctctaccaatgatttgcttctttgtttggcgttagatttcgcctccaacattctcacaaagatctctcattgttgcttctataataatagtggctcatcagccccaaaccagctttgcagctactacagaacaacaaaaacatagcactctttgatagttagatagttagattaccagggaatgtcatgaaggtggttctctgataaaaaaacattgtcactttaaaatggagataaagtttctaactttaatcttatgcaaaagaagaggtaaaaccagcagggtcctctcataggtgtcgacaagtgatattacacactgtagaggagattcatggaccaccaaatgcaagtcttaggtcttctcacatggagatattgcaatcatttactcaccagaaatatataagtcgaaaagacaaccgaaatgctatatctgtaagcaatgacccctgctcactaaggagtgagtgagaggtagttgagtgtgaaattgagaaagacacacatagatgacaatgccgatcaggtttacgcaataataataaaaaggcccaacccactaaaatctattagcaaaagcccaatttcagtccatatatgacgaaacgttaaccgtcagggttttactacttgggagaagacggaggcctcttaaatcttaatgctaacagacgaataataatacgccacgtgtataattgaaccgtcaccgccttatcgttaccgctgtcataaacgaatagctattttcgtgctcggaaaaagcagagtaaagctttaaaaaatg

SEQ ID NO: 36418 - DNA, 3000 bp, Unknown; identical to SEQ ID NO: 15229
  misc_feature (1)..( 3000): 2750-1469P.txt file - cDNA_ID_3095744; gDNA_ID_2926088; Annot_ID_196506

SEQ ID NO: 36419 - DNA, 3003 bp, Unknown
  misc_feature (1)..( 3003): 2750-1469P.txt file - cDNA_ID_3095749; gDNA_ID_2926088; Annot_ID_196504
aaaaagtgtatagttaatgtgtgtgacaggaggagactgatagcagctgtgacagcattggccgccgttgaagatgtgtcccgtgacggtgacagagctaacgtcaaaggacgttcgggacctacaataattaagccctaacttagattaattatctcaactcttttaacactaatcagattcaaacacaaaccaacatattgaagtattgaactatattcacagataaaagaatatataacttgttccaaattctaaaatagacaaataatgaaacttgatttaagagagatcgtgggatcatgcgtcgtggaaatttgcatagaggaggaccacatgatctaaggattttagtttttaaaatttttgtagtaataatgagagaaagtaaaaaaagaaaagaaaagagagtgaaattagagagataatgattaggggatggaatcggaccccacggaggtttactagatgacaccgaacctgaactactcacctgtgattgtgctctgttctatacttacacattttggaccatttcctctttattttgtgtcttacacattattctaattgtaattaacttccatatcttatactaataatccgatctcatttattctactttgtttgatttcatgcaaagccaatcacgggttcttgttaaagaatttgttttttttatataattaacaataagtaatggtgcgtcgtttagtcttgaatgattcttaatcaatagattattgtaaattacaagaacaaaactatgcatttcaagtattttaatgcaactttcaaaatttgatcagatgtgtcggctgtgactatacgtacttgtttttttttaattgtcaactttgaaaattttatttaaaatctaagtacttgtttagaaaatcacgtttatgagatggagactgcgtttgattcaaatttgtcatatattacaacgttgcttatcgtttcccgaggtaacaacggacggtatgtcagcttggaggattttggtgatcgagagggtatttatgtgaaactaaaatatggtgtcataaagctacaaaattttaaatttcaaactaaagagttttactacattattaaactacttctgctaaaggagaaaagtagaaagaacaaaacaggctatctttcagttcaagcaatttttgagctaagcaagcaatttcaaatgtcttgttattaccaatagattgtaaacaaaaaataattacaccaccccaagtaataacatgacattttcttatggtatttaagtaagcattttaacgaatttaatttcatttacatcacataattagttttattttagaaaaagtagtagacaaaactatacaaaattctaaggagattgagttatgaccctaagcctattcaagctgtacataaattgttagtcacaaaatttgagtctttcacttttcagattgtagtccctcccatattcaaaactgggacctataaaggtaaagtttggcttccccaaagcctaaactaaatctctccaaagtcaaaaactaataatattttaaatctgagattagtatttgtttattctccaaatgcatgttttgctaaagaattagcagctgatcaaagcttaaaaaaaatatgtaaaggaaacactttggtgggtatcataaccaaatgtgttggactatggattaaaagttcaaactagatattattataagattaattatttgaaaaggcccaaaacatattctactatattttttttttatgaaatcatgaagagtagcattggaaaagacacaacagataatagtaataaccagaagatggtaattttgttgttactacaaagcaacacagaagcaaagagagactagtagactagagaagaaaaaccaaaaaccctaaaaaaagaaaaagagagagattgttttcacattttcgcggttttcttcttctccttgtatttatctctgaagtcgtgcttttgatgtgaaaggagaagaagcttgaagacagacaactttaaagttgacgaaaccaatgcttctggtaatatcattttcttcacaattgtttgtgttcttcttcttcgtctggtctcactcctatagttttgtttaatcgttttcgtggcggtgaaattcatgagagcttaactggtgaatcttttttttggttctgtaataattttataatcttctttctctggcagtttgcgacgaaactaatttaatatataaatgtaaatctagcagccattcttattggtttattgttgaaatctctacgaaaattcctttttattcgatttcgtggttttaatcttcaccattacgatttttcttcagctccttctctctttcaattcaatttttactctttttgtatattgcaggtgaagttttgagcttttgagcgatcttttgggtcttgctcttgctcttgaggcagagaacccatagacagttgttttgtctgtttgttggtgtcagatccaaaatcaagaggctgttatagctttgacttggaagtgatttgacacaatgaaggaagaagattcaaaaaaaataagagggtaggaatctatttggtcgcttttgcttcctcctattctggggagaatttgggatcttggagttgaatccgttgtgagaagaaggatctttttgagcttgtgtactgtgtcctctcagttgattcatcgcagagagaagaggtcctgtcatgtctatgagttttgtattcatctgaaaggtcttactggaatgacttatcaaaggggagagtctttggttcctgtcttgatttccaacttggtgggggcataggccaaataatgcaaacctaaaatccttgtttcttccagaatcttgtgagctttttaatctctccaacaaagtacaatttctctgaggattgtgttattacacagagaaaacaaaaagagggtccaagaaaatctcttgcattctcttctcctctctctggtattggtatcttcaaatg

SEQ ID NO: 36420 - DNA, 3000 bp, Unknown; identical to SEQ ID NO: 15236
  misc_feature (1)..( 3000): 2750-1469P.txt file - cDNA_ID_3095766; gDNA_ID_2926088; Annot_ID_196499

SEQ ID NO: 36421 - DNA, 3003 bp, Unknown
  misc_feature (1)..( 3003): 2750-1469P.txt file - cDNA_ID_3095770; gDNA_ID_2926088; Annot_ID_196498
ttgtgtaagaaaaaaaacatattgatctcccaattcaccacttgcatccttccacgttgataagagtcaaccaaactccattaaacaaagaaagcttacgactaattgacgagagttgatggcctagtgatctttaaaacttcgataactgagactacgatggagtagattgtaatctatagtgtgctacacttcaaccacaatactaatgagtaacgtagatataacctagcgtacgtagtttcatttgcatacctttaaaatttctaatcttgaaatgaaatgaaaccgctatcaagaaagaaagaaaaactaacttgatcgaactatagaaattctcaatatatagcatcctataaaatccttggaataatactttcgaaaaagtactggtatccactatcaaactatgcagagtacgaactaataatatacatcgattggtctttatcacacgtttataaaaaaaaagaatccaacaaatcccaatattgtgtgttttaactgatcacaactcacaatatccaatggatcaatcatattttatggagaaatctcaaaagaaaacgtgccttatttcatctctatttatacacacacaaaacactcgtttatttatagcacaaaccttcatctagagacacaaaaaccacaacatgactaacctcatccttatcttcgccgcacaaatcctccttttctatgccgttgcttccgtcggagatgaattgggaagaaccatgaacgggaaacaccttggcccttacaaaaaggagaaactcactcatctccgagtctattggcacaactctgtaaacggtagaaaccctagctccgtgatgatccaacagccggtcttgaactcttccttatccggatcgatcaccatgatggacgatccactaacattcgatgtgccaaggaatgcgactgtggtgggccaagcccaagggatgtacgtagcagcggcccaaggagagataggcttcttgatggtgatgaactttgctttcactacggggaagtacaatgggagtacgataacgattcttgggcggaacgtggtgatgtcgaaggttagggaaatgccggtggtcggaggtagtggaatctttcgatttgctagaggttatgtcgaggctcgcaccaagtcgtttgatctcaaggccggtgttgccaatctacatatacatttttgcagccattttaacaaataaatcttagagttgaacttatttacaacccaatgccattagcattaaatttttttttcaaaataattaattttacattaaattcttaatttaaattgtcaatcacattatcaatcaaatttaatccaaacaaactgcacatcaatcctttaaaattagcataaaagtattttgttaacaatattttaaaacaaagttttttgtttaaataaatattgttcttactaaacgttttttgtttaaataaacaaatcatgtatttgaacttatttacaatgtcatgctactgacattaattattcaggcatgaaaatatttaattaaagatttaaatcttctaaattcttgcttttagaattattatatcattacctaaaaggcaaaaaatattaattttttaattattattatttatatatttaaaattcataaaacactattaatatttaaatttataaaaagtttaatatatcaaaaaaattaacatcattatataatatatagagtttaaaaaatctcaaaaaaaaaatcgtcatattttgtgattcaaaattttaagaatgaacatatattaactaattggcgaaaaatgtatggattcaacgtcccgcaacgaataaaatattttgacaatgattcataaatatattataaataagatcaacattaataaaataaataaattttttttgtggacgggtttggcgggacgagtttgacaggatgttacttagtaacaattgtaaactataaaataatttacaaatttttacatatattaattttaaaaaatgaattgtctccgcggtgaatctagtgttgaatataattgttatattctgcattactgaaataattaagtttggaatattgttcatttgatttcattacttatttgtttttatgtctcgttttgttatgagagtgttattgtcttttcccaagttaaataatgtattttatcttgtaatggtttgattttattcatctaaaaaataaataaataagtagttgtttatatatacattaaacatacattttttggtcaaattaagtggcacaaaggctctactccgcgttaatttggaaaatcatcaactgattagcgaataaattatttgaaattttgatagaaaataaatgttcaaataaatataatgattagttagcccaatcacgagctaatcaaaccttaaaaaaaaaacaccaaatcaaacctatttattgtctaaaaccaattttgatattacacggagaaattaaataatacatttagctacttttttgtttgaaatagaaaagacattcaaaatagtaaacatataaaaccattgtaagaaaagaaatcaaattttttatttcttaacaaaaacgtgaaacgtttgtttccaaattagtcgcaagtcacggaccgtgtgacgcaaaaaaagtccattcacatcattattacataatttttgtcataaggaaaattaatttgatttttccaaatttttttggttcttcctcttcagaatatctgacgtggcataaatatcgcctttttcacatcgcctgtcttcttttctctctccattttgggaactttcatccataaacttctatttttctcatcgcaaacttgaaccgtcgtaaccctaaatcgccatcttcatcatcggcaaatcgaatctccgattatatatcaaatagcttaccaaatccgacatgacccaggccctcgttttcggaggactataatgatcggactcttcgtgtcccgtctcgattgcatggggtttgagctatg

SEQ ID NO: 36422 - DNA, 3000 bp, Unknown
  misc_feature (1)..( 3000): 2750-1469P.txt file - cDNA_ID_3095788; gDNA_ID_2926088; Annot_ID_196494
caaatttcgatacttgatactaaatttatgaaaagaaaagcaattttctattcgttgtaacttggaagtcatttctttttcttttttttgttcatactcaacttttgatttgtttttttcttttgaggagacttcttctccgtcctttttcctcggccactatttgaatttgaacccatttagcatgttattgaatattgtagagcgcgttatacagtatattatagtagttcgaaaacaaattatctaattgagttaagttgcctaccaacaacgtggcaggatgtaattggcagagttcttttatttgttgactattttatttgatgatacttccaagttccaagtcttattttgtctgatgggcttaatatagttgtatctcacaatcacctacgttacatatacatatgctcgttaaaaaggaaaacaatgggccgatgatgttcatttaaggccattaagatattttaaaaaggaattgcctctttcaatactcgcttggccattagattaagaccaaacggtagtgtgagatgtagcaaatacaaaaacaaaaatcacgtcaaaaaaaaaagaagtatcaaaatctattaaaagacatagtcccccaaaaatcatccatcactttaagcagacaaaatccaacaaaaagtattttatcaaacattaaaaaagagaggcataataattcatcactatcatcaataatgcaagacataacagctgtactcaacagtagcatctcctgacttttgatcaaaccacatggtccgagcctcgacataacctctagcaaaccggaagagtccacttcctccaatcaccggcatctccctaaccttggtcaacacagcgttccggccaagaatcgcgatcgaacttccgttatacttccctgtcttgaacgcaaagttcatcaccataagcgcagatgcatcacgttgaccagtagcagcgtagatcccttgcgcttgtcccactaaagtcgaattcaccgcgacctccgtagttaatcggttatcgatcacagtgaccgatccgaagaaggaagagttggagataggagggttgatcacgaccgaactagggtttgagccgcttaaaatgtcgtgccagtagacacggaaatgagtgagtttctccttacggaggccaaaatgttttttgtcaatggtttttgcaaagttttcgcctttacgggcggaaacaacggctgcgatgaggaggatttgggtgacgatgatgaggatgagttttgccatgagtggagaatgtggtatgtgttttttttcttcttcttgatggtgtctatgtctagactatatatagtagaagaagacgatggcgtaggtaccgaaatattaaatatttgtgccacgaaaacatgggcggtattattattacaagtcgtcgtattattcgagccataaaccaataattgtacatgcaattaagcttaaacaaatgattttttaaataataacttttctctattacttttgatattcttacttttctctcggccgtactaattattcaaaaaaagaccaagacttgtagtctattattacactgtaacaagaaataattaaagaccttttaaagatgttcatacttcatactttttttggaaaatattttaaagatgttgataccgaatttactaatttagtttgattacagtttgctctttcgtttatacattgaaaaaatggtaatgaactatttttagatttagcagttattgcagttaatatatgaaaaaggtaaaattactttcactaaattttcttatgagtggaatttatttaggttaaacaacaactattgaattatgatattttgtgagcaagtagacaatatatccataatccattgctttattttgagctagagatttgccatatttgaattggcaacatggcactgcgccaatggcggcagaatattattttgttgacacggtataccgaaagttttccttttgtcgcggtcaatgggtctcgttcatactttcatgtttctttttgatacaaaaaaattcaaagtgtttggtgtagaccatcttccaaagtcttttcttaatcaacccgttataattgacaatcataatatatattgatgaataagacatgatgtcaacgttacatgtattggttagctagtccctttcaaagtgtttgggtgtagtttgaaagttgctatcaaacaatgacatttgtgaattgtgatacataaatttgaaaatcaatccatatgggttaacatcaatcaatattcattttgggccacattagcatacttcccttgggcctggcccacttcagatgtaatttgtttctatcatgaatggtccctcttcagcacgaattgcaatgtggattttattctctattctcattggctgagaagtgcataaaattagtcagaaaaaaatccaaagtttccttttaacacatgttttggagtccacaaaatttgatatttatttattgtatagaaaaaagaccaatccctataaggtttaaaatctaggcctaataatcagcatcatatacttagtgccattgcctattcatcatcacttcaacattcaccaccaccgtcgctgtcgaaaaccccaccttcaccgtcgtatactctgcatctccctcgccgagctcccatatagtgtggtacgagatccttttcttcttcttatcctctcttgtttctcttcttaatcgtctttcgagatgggttgattccgatacactcgtatgttgtggatgaaattgttcgattctagtttatgagttgttgcatgttggtacccttaattgtatagctgttttacttgtcaattagctctgttattatatgcgtctgtctactaggtttaatctccattcatgattttgccaaaacccaacatcctttaaagacttctcttttgattacctcgtgagcctaattgttgacttgtgtatcttgtatgtaatattctcaagagagatg

SEQ ID NO: 36423 - DNA, 588 bp, Unknown; identical to SEQ ID NO: 15240
  misc_feature (1)..( 588): 2750-1469P.txt file - cDNA_ID_3095839; gDNA_ID_2926090; Annot_ID_196552

SEQ ID NO: 36424 - DNA, 3000 bp, Unknown
  misc_feature (1)..( 3000): 2750-1469P.txt file - cDNA_ID_3095848; gDNA_ID_2926090; Annot_ID_196550
caatatctgcttggggacatgctatattacatgcagcaggattagttcgcatcaggccaacaagtaatcataagttctctccatctcaactggttctcggtcaggaaccaaatatttcccatctcaaagtttttggatgtgctgtatatgttccaattgctccaccacagcgatataagatgggacctcaaagaaggttgagagtatatgttggttatgattccccatcaataattaagtatctcgagctatctacaggagatttattcaaagctcgattcgcagactgtcattttaatgagtctgttttctcaacattagggggagaaaataaacagtcgggaagtgatatactttggaatgaattatcaatgtcttatcttgatcctcggactaaagggtgtgaattaaaagtacaaaagataattcatttacagagtttagcaaatcagctgccagatgcattcactacccaaaaagtgtgatcaaatcacatataccggctgcaaatgctccaataagaataaatatcccaaaaggacaaaatcaaactgcaaatgagtctaaggcacgtttaaagcgtggtagacctattggttccaaatattaaaatcctcgaaaaagaaaaggggcagaaattggcatagataaaacagaggaaataattacaaatgaagaatctccagaagagaccttagacatgacacagaaagaaattcaggtacctgacaatgaagagatctcaattagttatgtcatgtctggaataaaatggaaccgaaagcaaatcgacgtcgatgatatttttgaatgcaatgtagcagttgatgttatggatgaggatcatgaaccaacatctattgaagagtgtacacaaagaagtgattggccaaaatggaatgaagccatagatgcagaattaaaatctctggcaaagagagaagtgtttggatcattaaactcctgaatttgcatatccaatacagtgttaaaacactccacttgataatgatgcaagttggtcatgttgcttttttttcttggctttcttggatcaacaaattctccatccataatgacaaactcaatgtcatgatccttacaaaaagaaaaaacttcattaagaaaagaatcccatccatcatctctgagcttgaataactgttgcttggtggatttcactagtgacatagcattcagaatgtcttggtctttcctttgtagagccactgataaactatttgtgagtccaagaataagcaacatcaactgtaagtagaacacaaagtcaaaggtattaaagtacttgagaagaccattagcttgtcgtcttttggtactatcagttccatcatcttcgatccactcaagcactttaatgataacagagaataaatcaactaaccggagtaatgttgtgtagtgagtaccccaacgagtattaccgggtctctgtagtgaaagtttctgattcaatccttttcccgtcttaatttcaccttgattgattctttcctccagctttttccgaaattcatctcgaaccctatcctttctcttacaagaagctccaaccacatttatcaagacagaaatcatatcaaagaaatctccaatttcaaaatgttttttagcaactgccacgacgactaactgaagctgatgcgcaaagcagtggatataatatgcagaactattttctctcaaaattagagatctcaacccgttgaattcacctttcatattacttgcaccatcatagccttgtcctcttaactgttttatactcaatccaagtttagcaaacaatgaatcaatagcacatttcagagatgcaaaaaatgttttcttaacatggataagaccaataaatctttctttcactgtcccatgtttatcaacaaaacaaaaaaaccactgccatttgttctttatcagaaatatctgcagattcatccaccatcaaccaaaatacatcatgatcaacttcttgaattatagatctaatcacttcttccgcaaagcaatgcactatatctttttgaattttgggacatgccatctgattattttttggagcattctccaacacaattttacttacagcctcattttgccctgcagtatatttcacaagctctaagaaattctccctgtttgctgaatccactgactcatcatggcctcgaaaaggtaatccttgtcgtactaaatatctacaacaatcaattgaagcgttcaatctgattttgtattctcttttgactatgtcatcttgcttataaaaagcatgaagaattgattgaccttgcctcatcaaacaatcagccctttttaatgcattattgtgaaagctattcaccaatcccacgtgttcgcgtaaactctgaggatttttccaagtatcgaaacctttcgtcacaaacgtatcactcccacctttattttcagtgtaatctctaaacaagtagcaaaccaaacagtaagctttatccttttttacaatgtattcttaccaaccactatagagatcaaaccactctggattaaatcgtctcatttttttttctgatagtgttttaggaaaatcatgcccacgagattgataaggacctttaatcagatatttgcgtcttacctcatctctttcattaggatgatagtccaaaatatgtttcctatcgccaggatccgaaggcaaatcttctggaatagcttccggaatattttctggaatatcttgtgacgttgattcatgctttcttttgaaaaatctatgaattgttccctaataagaatagttatatgaacatattagaaaccaaatttatattaaaaatttgttaacgaacgaattatcaaactacaaaaaaatatgtcttgcataaataatcataacgaataatttgataaaactaacagttttgtttcattcggtctactacagttttaatattagttaatcacaaaagagaataagagatacttacgttagacatg

SEQ ID NO: 36425 - DNA, 3000 bp, Unknown; identical to SEQ ID NO: 15244
  misc_feature (1)..( 3000): 2750-1469P.txt file - cDNA_ID_3095855; gDNA_ID_2926090; Annot_ID_196546

SEQ ID NO: 36426 - DNA, 3003 bp, Unknown
  misc_feature (1)..( 3003): 2750-1469P.txt file - cDNA_ID_3095863; gDNA_ID_2926090; Annot_ID_196544
aaaggtatcaactttcattgtttaaccaagccaattatcagcttcaatctgatacattttttcgtgaaattgacattgagttttaaccattcgattcgtgcccttctttggattgttacttcaactacttcgattttggttttggaatctcttttgtgaataaagcttttggcttttttgatttttgtctctgaatcctcatgtttaggctatggtatggtaatctctagtctcttaatcaattttgaactgatagagaatcttatgaattgtgaataaagattgtggcttgtttgcttttggctctgaaacctcatgttaaggctctatgctcatctttctagtctcttaatcaattttgcttctttagtttttaactgagaaaattctatgaattatgaataaagattgtggctttgtttggttttggctctgtcccttatgtttaggctatgttcatctctaattcctaacctgtttgcatctgtagttgttaactgatagagaattttataatttgggtggcaggagaaagagaaagtgggataagccagcggagcaacttgttgcggctggagttgcgtttcctcagttacttcctttaggcaacactatgaatgttccttctatgtcaccattgctccaaacgctttcggtgcctctagcagttccaaaagttaatcaagtaaatgactcttacgctcttgcggtgtttgttatacttattttcgggtctaacctttttctcacttagctattgcattatgtactatggtatagatgatatgtcatgttttcatctagtttggtgtcttgatgtatgttcttagtgaattgtaataccttcttaaaattgttgcatcacttgaatcatgttgtcccatgattagtagttttaccatgtattggtccagttccctctggtcatgtatgagactccacaagcacccgaaatatactgtgtttgtgactttaacattattgcctttatactgaacgagctgtttttcgtggatacgtcttttgtctccttttatcctgtaattcaaacatggtgattcgttgtaatttttcttgcatgtggtatctagcctaaaatccaggatgaggtgatcatagcgcgagaaattgttatcaacgatgctgaggcttctcttaggcacaggcttaccaaacgctcaactcaagaagatgtatgtgtaactttgctatgcgtattagttacacttttcctatctctagtttaacttctattcgtcgtgcagattcagaggtctaccggtgctgtggtgattactaggtttgtacaacatccaactcatggagaagaaagtcttacaataatctttctagattcaattgtttaacttcttttgtaggggcaagtatcgtcctccaaatgcacctcctgatggtgaaaagccattatatcttcacatatctgccgctgcccaggtttgttatcctttttggcctaaaggatagactctataatatggcagaaagtaaaacgtttgtggcttaaagaaattcccatattcatatttgagaagctttatttgaccgcctagctttgagatgttggcctggtttttacgtatgttattgcagttgcagttaaaagagactacagaacgtatcttagcagttgatcgtgcagcagctatgattgaggagatgatgaaacagaaatcaatttcacagatcggatcagttggtttacagacggtcaaggtatatactgcgtgacacttcttttttgtagttatgaaattggaacagtaagaaattaaaccatatttccagatgctgagcacatgcgtatatttgggtttcgaagctgacccatcatctaatgttgctgctcgtattcgtgggcctaatgtgagtcttccttcaatatctccccccttgcttctttctaatttacaccaaaagaattgaatctacagtctaatatcaatcaagagaagggttagccatttggtgttaggttttcatctttgattaatagttgcacttttttttatttgtctcaatccatgaattcgagagattctaatgttgaagctctctctgacatctccgtgcaatcgggagagaactttttttgtgttggtggtggttggctttcgtacatgcaggatcagtatataaatcacattatgaatgaaacaggagcaactgttgtattaagagggcgtggttcaggaagccttgagaatcaacatggagatggtaatatttccttcgtttgtgtttttatttgcctacttatgaaggtgttatttacctcaaggtggatgtatctgaatgatattgttaatgtaaatccctttaacgcattatggtagaagcacagctaccgctgcatctattattatccggcagcaacccaaagagcatcgacgatgcaaaacgtttagctgagaatcttatggatacaatcagtgtagaatttggggcttcaaggttaatttttccttctatgtcttctatattatattcagaagcatgttcctacatctttgtcatttcatttgctgatctgtaattgtatttggttttgctacaaaatgtttcagggtttcctcaagcaaggtgtatggtgcagtaccaccaccacagcaactgatttctggagctccgggttctgaccaggagaaccaaaatttgatttcaacgtatggtttgatgacatcgatacccatcacagcaccaccatacgctgttagttcgtttccagttactccagcaacaagtctttatcctcagtttccagtaatgcaatctctaggaatatcaaatggtggcccctcgcagcccgtggctggaggaactagctatagtgggtatgctggaatataccctcaagccacaccattgcaacaagttgctcaagtccttaagcaatcaatttctcctgttatctctactgtgccccctactatgttgacagctacgtccttatcgatcccaagtgataatgcaagtaatgaaatg

SEQ ID NO: 36427 - DNA, 3003 bp, Unknown
  misc_feature (1)..( 3003): 2750-1469P.txt file - cDNA_ID_3095868; gDNA_ID_2926090; Annot_ID_196543
gtttgttttgttatatattttaaattatataactgtattttaattgttagttataggatttcacccattgtataccgtctcgtattactataaacccaaatccgtcttacctcagtgaaattaaatatatttaatggattttaccagtggtatactgtctcatattactatcgatccaaacccgtcctaccatctaaccccgttcagtaaaattaaacattattttattatttttgttttaataatactttaattttaaaaatatataattcatatcaatttaaattttttatttaaatgcttatttaattgttataaagttcatatattataatattctaaacccgtcctgccatctaatcccgttcggtgaaattaaatattattttttatttttcgtttaaataatatttttattaaaagatttataattcaaatcaatttaaaaggtgtctttcaaatggttatttaatttttatagatttctcattttataaatattctaaacattttttcctataaatattataaacgtttaattaaataactacaatatttaccttttaataaagtataatattaataatattgtgaatgattatgtgtagctaattttaagaaatttgatttgaagttttttgtttggattaaatttgaatgataacgtgattgatattttaaatcaagaattaaaaatcaaatcaaataattaagaatttaatgccaatggcatgccattgtaaataagttccaactatacgatttattttacaaaatggctgcaaaaatgtatatgtagatttaattacagtttttgaattgtctagtcatgatgtaaactcttaaatttaattaaagacaaaattgtgttgtctttaaaagagagtatgtttcagaaaataaaaataatatatgttacgttcttataaatgataaacataaattagatatgatatagaaatatttaaggttaatttaaaagatattatcatgattatagaaaatattggtaggaataaataacgagcctaatttcaaccaactatattacattgagacttgaagctacgattttttgaaaccagtatgaatctccataatttcgttttctacaattcttatataattcatatttgattttgattacactgttttaaattttattccaaaataatgttttctacaatcttggtaagattcatgttcactttcgatgttcattgtatgtaacgttatttatgatatttattattatttagactatgatatgtgatgcataaataaaattccgtggaatttagattcgattttggtattttatagttataatgattggattcatattcgatttgattatgtattatgatattgtaatttgaatatgatataattgtatattgtgtgtactgaattttgattgcggtgttcactgtgtttgatttttctttatccattctatatcaatattcaatacattttgtcctttgttttttttggtcgaaaatatattacgtctttatgatttacttctacgatttcttaaacgagtatacatcttcaaaacatttgttcttcataactttgtagtaagaacctaaccttattgttgaaaaaaaaatttcatatgcgcttactgatacccaaatcataagagatcaagcaaacatatcagatttctgttcttggtggttcagtgatatatgtcaaattaaatctaagaccactctctcaaatctctcttaatataacacttaaggatcgatttctacaaagttttttattcaaacataaaattatttatctcataattaagcaaaaccaaatgagtaaattaaaaacaaaaaaaatagattaaattgattgtaaattcagatgattaaaacgtcatatttaggaaagttctcaagaaatagataaacagtagatttaccaattagataggattattagcaactgttttagaactcaaatcacaaaagtataactttgttcgtaacttatgtttcaatgaaatcatttagttctttgatttttcaactttatcttagatttcgaatttttgttctattttaagtccaaaaacaagaaaagcctttttaaaattaaaaaaaataaatattgacggcaggaccaaaacgaagttgtagttgaaggagttcaaggaggagttgctgaaaacaaaaatgaggttgcagctgaatgagctcatttccatgagattcacattgctgatatatgggcaaatgacaactggttgttttactatgatggagttgatatgctacaatggtgctactagtgtcagtatacttcagcctcgtgtgttggaaggaaacactattaaagctgcacaaatagttatatatgtgtttgcatgcttatagttttaaacttgtattatttcatattaactaaaatcttaaattaattgacgagtgcacaaaatgttcaacttgttagaagtgttatgagttagttttagtaatttactactgaaccactagaaagttttaatagttttttacggacaaaatttataatatgatcgatatcacggaaactactatcgaccattctaccggataagtgattaagaaagtattatctgaaattattttaataattaaaaataaatccaattaccaaaaacattaaaaatatttttaagctaattatctcctaaaataataatccatatgctcaacatttttttacatgcacctctcatttttcactttctcaataaaactccaaaattatttttatttataaataaatcccaactctttcctatctatcaaattaacccaattttagtttagagagcccaaaatttctaatgagacccaaagtttctcaattttcgtaagggcaaaaaagaaaagtttttagaccgtccgattttgaatcctttaatctcttccaagaattctgaattcttctcttcgtagtctttgaatcctaaagtaacaatctttcgtttcagagcacgtctgtaagatg

SEQ ID NO: 36428 - DNA, 3000 bp, Unknown
  misc_feature (1)..( 3000): 2750-1469P.txt file - cDNA_ID_3095903; gDNA_ID_2926090; Annot_ID_196535
agaagattttgacacataacagtaaagggattaagtttcagattctttcgaatcccgagtttttggcggaaggaaccgcgattaaggacctatttaatccggaccgtgttcttatcggagggcgggaaaccccagaagggtttaaagcggtgcagactctcaagaatgtgtatgcacactgggttcctgaaggccaaatcataacaaccaatctctggtctgctgagctgtccaagcttgcggcaaacgctttcttggctcaaaggatttcatcagtgaatgctatgtcggctctgtgtgaagccacaggcgcagatgtcacgcaagtgtcttacgcggttggtacagactcaaggattggtcccaagttcttgaactcgagtgttggattcggtggttcgtgtttccagaaggacattctgaatcttgtctacatctgtgagtgcaacggactcccggaagtggcagagtactggaagcaagtcatcaagatcaatgactaccagaagagccggttcgtgaaccgtgttgtttcctccatgttcaactctgtatcaaacaagaagattgcggttctcggtttcgcattcaagaaagacaccggtgacacaagggagactccagccatcgatgtgtgcaagggtcttttagaagacaaagcaaggctaagcatttacgacccacaagtgactgaggatcagatccagagggatttatccatgaacaagttcgactgggaccatcctctacatttgcagccaatgagcccaacaacagtgaaacaagtgaccgttacttgggacgcatacgaagcaactaaggacgctcacggtatctgcatcatgaccgagtgggatgagttcaagaaccttgatttccagaagatctttgacaacatgcagaaaccagctttcgtgttcgatggaagaaacattatgaatctgcaaaagctaagggagattggtttcattgtttactccattggtaagcctctcgacgactggctcaaggacatgcctgccgttgcctaatgatgttcattgctgactctttcgtcctccatcatttgtgcttttcttcttcttgtggtttgtctttaagacttgttatatttcttacaatatgtttgttatgttctctggtgtgtgttttgttttttttggtattactttcatatttttttggtcgaagaggacttgtattcgacaatgtcgcttcaattttgttgtttccttagaaactaaataaatattggtttatattggagtaaaatgtgtttgtactttgtagttaatcgttgaaagttttgccacttattgagctttgtctgcgagagttgactcggaagaatatttgcacattgttcatagagaatcacatgatatctcttctctggtggattaggaaccaaacgcatcttgtaaaagtttccaggttggagattctgatttctgagtgacacctaacgattccatatttaaagctttatgtttttgtatgtctctcattgcgattggtattttttgtttaagtaaatatgcataaatccattcgtagaggcattccttacagtactagtgaccacatattaaccttttaggtacgcacaccgaagttggctacataacttgggtgagtattccaatctgtaatgtgaatagtttaccatatcacatatagctctgataccataaaaaactatatgtgaataatattaaaaatcttatacacaaaattttcttttaaatggttagtctaattgtaatttaaaaatatcgaaataataagttgcaattttttttttttttttttgggtctttgaaaagaaaatataatgtcaaatactttaatttttccaagtaaatcgaaacataagattgatatttttcttttatataagaaaattaaattagatttaatattattaaatgagtgtttcatattatatttttcagaaaaagagtttttattaattaaccaaataccaataatttacttaaaaacttgtattgaatccaaatgtttcccaaaaaaaaaatatttaattgggattgacaaaaatagcaccaacaaaattttttcttccaaaaataacaactttttgaaaaatttcacaagtagctttcaaaattttaattaaatattaaatataaataattaattttatttaaataaataaaaataaaaattttccgctaaaaatttttcgtcaaattttctgccaaaacaattcggtaataaattttcccgcaaaaaaaattttccgtcaaatttttcttgtaaaaaaacttgaggaagctaactacgacattcgtgaggatttcacggaattcaggaaagattttacaaaaaaaattttcgtaaaattcttcctgaatttcgaaaaagaaaaattcgggaattcaggaaaaattctacaaaattcaggaagggttacaaaagaaaaaaattataaatttcgtgaaacctttcctgaattgcttaaaatctttcctatattttgtaaaaaaaattctgaatttttttttgtaggtaaaatgtgggcggcgtaattatttttggtggaaaaattttgacggaaattattttgtagaaaaatattgttgaaaatttttggtatgaatttttgtatttttttaaatgttagttgtaataattaaaaattaaataattatttgagtgttatttatgttcacaaaacttttgaatggtatttttatcaaaaaaaactttaaaattatgttaattatgaaaattctctatttaatttttttcacccaaataaataaatacataaaaatgtccaaatatttgtgtgtttctcttttaattattgtttcccatttaaagtaaaaaaatctggtagcagcgttacaattcgcgagaaagacaaaacacaagtttcttcttcttgggattggctatttccagaaatccaagtcaataatcaaagtccaaacaaaaaaatcctctcccaatctccgcttcactcttctcatg

SEQ ID NO: 36429 - DNA, 2615 bp, Unknown; identical to SEQ ID NO: 15239
  misc_feature (1)..( 2615): 2750-1469P.txt file - cDNA_ID_3095920; gDNA_ID_2926090; Annot_ID_196531

SEQ ID NO: 36430 - DNA, 3003 bp, Unknown
  misc_feature (1)..( 3003): 2750-1469P.txt file - cDNA_ID_3095931; gDNA_ID_2926091; Annot_ID_196564
tatgtcgaaagagctcgcactacaaaatttatgaggatctctttgccacttaagacaagaatttggctgaccatgtatttagccgtttttgaagtctatctcgtacaaatgattacacttaagttttagaaccatgaattttctgaggtaaacccaagtaagtccccatacctgacagtattgtccacgtcatggccaaacattacagatgacttagcagcattgagctgttgtcttgaagcctcgccataaatgctgagaatattgataatctcttgaccctgagatggatctactttgtagaaaaaaggactatcatctgcaaacagtaaatgggatgtagatggacttgcacgagatatttgaaggccttgaatccgcccattccactctgcatctttaaggtttgctactaaaacttccgtacataagataaataggaaaggggaaataggatcgccttgtcggatttccctcgttggtttaatgaaaccccttggtgccccatttaggaggactctatacgaaacttaggagatgcaaaaaattatcatgtttacccatttctgcacaaaccccatctttaacatgagtgcacgtaaaaatgaccactccactcagtcataagctttactcatatcagtctttatacccataaacttatttctgcatgccggattggtccgtagagcatggaagttttcttgggctataaaaatattatctgtgataagtctccctgccacaaaggctgattgagtctcgaatattaaatccggaagaatttcttgagacagcaacttaatacttttgaaataaccttgtagcttacattacaaaggctcactcggctctttagtagactacattgtccattaggaatacaactatgatcaagacatatggtcttcaaaacccacatctgcagatccgaattatatgatcagtagacataccagtcacaacccttcttttgagcacacctaaaacttattttatccttctcccacctattttgcttaatgtttagcctattcttcatagcataatgtaacataacctctttgaactcaaacccagtgaaaaatgttttacctataactaacttatcacctgatgccaacctaattttcctatctttagtgaccacgggatcctaatctgcatcacaactctctggtatttcatcacgccgaatctgaaactcatcaaaccaatttgccacggcttcctctatctcgaactcgaacctctccattatgtcttcttcacacagatctttcgtctcttttctccccgatttcttctctctttgccttacttcagaatcaacatcgtccttctcgccttcatgtcgtttcctgttccttcggctttcatctccatctttctcacccttactttcattgtcggagtcgtctcctccatcattgtcactatcgccgtctccctcatcgccgctttcactttcactgtccgccgtttcgacctcattccactctccggaccctcaaaatcaggatcatctggatcgctctgatacactaaatcttcctcgtgttcataactcgacgaagccccataccagaatgacataatttcaaagaaaacccataaatctcaaaaatccccctttctctctagaaccctaatttttcaatcgatcgaacaatcgattgggtttggttttttttgggaaaacaaaacaaaggtgaaacgacgtcgtttcaagaagaatcatgattacttatgtgggtaatcgtaattgtggaacagtaaacgcgattttgtggttaaacccgctttaataactagtttaattggaggcatattttctcggatgaatccaaaaatatacaatatttgtttcagaaatattaaagttgatgattgtatttcacgaagaatatacatcagtttataaataatttaggttggaaaattcaaaaaaccttatatacatcagttttacatttttttttttcgtccagttttaccgaacttactgctatgactgtaattaggcaattattaatttactcatataattatcaaataataaattacgcttttttaaaaaaaaatcgttttggtaattttgcaattaataaaacccaaagataatcttctctcccctgactctcgtttcctctctctttctctcttcctttacagagaaagcagagagagagacaaagggaaagctaaatccgtgacccggatccgaaataatcgggttttcaaaatctaattcctcttatcttctctcttcttcttcttcctgggttcttcccaaaattcaatttcattaaaagggcactgccctttatcatgcctaaaattctcaggtacctaatcaagattcttctttaaattcctccacattgtgttcggatctattctaattccgctacgtatgaaacatgatcgtcatagattcgtaaagtttgagtcttttttttttggtagtgtctgattatttgaataaagttttgatttttatttgatgattctgtttcctgttttcaacgtttttttctcattgatgatgttgacgttatgaagtcatatttttatgtttaagatttgtatctgaaagtgattgaattttaccaattagtgttggttttgttatttgagaattctctgtttgagatttttcttatgagtatagtttttaatattgagatttgttgttgttgttgttgttgttgttgttacatgttattgtgtcccacttactcttttaattgggtacactttttgagctggctacattattttatagttgagagattgttttattgtatttgacttggttgttgattcttcaaaacttggtcccaatgttagtaataagacagaatgaaacaactagtttctctatgtgggtcttaactatctttatttgaaagctgtgtttatatgttgcagatttcttattcttatacttacattacatgtttttgttgaacaggatctaaataaaagtatagaacaatg

SEQ ID NO: 36431 - DNA, 3003 bp, Unknown
  misc_feature (1)..( 3003): 2750-1469P.txt file - cDNA_ID_3095944; gDNA_ID_2926092; Annot_ID_196576
aaggggtttaaaagacttacaagagttttttaaagatttttaaagggtttaaaagtgttttaaaatatttataagatttataagggatttttaaagggttttaaaagatgtacaagagttcttaaaagattttaaaagaatttataagaaaaccctttaaaaactttggtaaatctttttaaaaccttttgtaaaggttcacaagagttttaaaatggttcaaataaagttgtaaatgttttaaatacttacaattctctttctaagagttaaaaaatgcttgtaaaaactttataagagttttaaaagcatttacaaaggtttaaaatccttgtaaatcattttaaaacactttaaaaactcttgtaaatcatgttttacctttttataagcttttaaaatccttgtaatcattctataccacttacttatcctttaaaaacgattgtaaaccatgcaaaccctttttaaaatcccttgtaaatcattctttgatacttacttatgctttgaaaacgattgtaaatcatgttaacccctttttaaatcccttgtaaattattcaatgccacttacttatgctttaaaacgattgtaaaccatacaaacacttttaaaatcccttgtaaattattctatgtcacttacttatgctttaaaaacgattgtaaatcatgttttacccttttataagcttttaaaatcccttgtaaatcattccaatgccacttacttatgcttaaaaaacattgtaaaccatgctaaccctttttaaaaatccttgtaaatcattctatgccacttacctatgctttaaaaacgattgtaaatcatgttttacccttttataagcttttaaaatctcttgtaaatcattcaatgccacttacttatgcttaaaaaacgattgtaaaccatgctaaccctttttaaatcccttgtaaatcattctatgccacttacttatgctttaaaacgattgtaaatcatgtttcaccattttataagcttttaaaatccattgtaatcattcaatgccacttacttatgcttaaaaaacaattgtaaatcttataaaactattataaaaagttttaaaatgatttacaaaggtttaaaaaggggttttaaagtatatacttatgtttttaaagactttataaagattttaagaggttttaaaatgatttacaagggtttttagcaactaccaaatcttttaaaaaactttacaagttttttaaaagagtttttaaaaaatttacaaggatttttaaaagcattttttttggctgggaaaaaaatttaacgagaaaaaattttggcgggtttttttttttttggcgggaaaaaaagtttggcggaattttttttttggcgggagaaataaattttggggccaaaaatttagcggaaaactttcagtttccaattacatgttcttattagatgagggtaatttggtcattctgttcaagggaagagatatttttaaaaatgaacaatataaaagggtattgttgcaaaagggtagtaaaaaaagggtagttttgcaaatctccctattttctaatgaaaagaagaagttaatattttttaattgataatacaaaaaaaaagaagatttttctggttttagtttaaaattttatatcttaaaactttttaatcattttgtacattcttagtttagtttagaaattgaaaaagctaactattataaaaatcaatatattaaatatatatgcaaaatatattatagtagatatagagtttgttttttattttacaacaccaaataaaactacatttttaatactaaaaataaattaaaaatataatttttgtaagtcaacgccgatcgacgtaagagttaattgaccggttaacctgaaaagtatgtttatgatgttgactacatgactctatatatttcgtatatgtgaccatgcaatccatatacatcaggtagcttattgtcctttagtttagttggcatgtgtggccatgtgttcagctatactttagatagctaataatattttttttcaaaaagtaaccaaaaatcctacaaattaaaaatgtctccaacatacatacatgtgcatatttgcaaaagcacacacaagttcctcacttaaattccgacaaaactctgttcgccgccacatgttctccgcattacaaaactcttctgatcgcacccttgactctcccaacgtctcctctccacttttctagtgtcttttctgcttggaatcataaatttccggcttcttgttccgtggtgagtttgtaatctatgttttgctctgtagactttaaagcctgtttcttttctatctatgagttcgttttcgagttgcgtttaattttgacttatttttttcggaatctgatgttgtactcttgttgacatttctaaagcaatgatatctatgctcaaataagcttattaagagaaatataaaactgaaattagatagctcattaagagctttattattcaaagaaactaaaagaggaaagattactttgttgtcaccaagagcacaatgattcaattgatacttttataaagatgagaagaagagttgttttgagacaattctcaaacttaccatcaaagttctccttacataactaaatatatgagtcactatcttgctaacccttgttacatggcccatttcatgggcttttgggttactcatgagacactatattgggcttcatatggatcctctaacatctattagacttaagggcccagaccatagttagggttttcaatggaaggagtaaattttgtcaaaattgaatctgggtttggtcctacttgttgctcttttggtgttcttagttcctccttgatgaatccttctcttttaccaatcacatagtttctgagtatactttatgttgatgactgttctatatgatgatactaatgatttgaatcatgtgcaagtgtgtgtgtgtgtgtgtgtgtgttgttgaatg

SEQ ID NO: 36432 - DNA, 3003 bp, Unknown
  misc_feature (1)..( 3003): 2750-1469P.txt file - cDNA_ID_3095950; gDNA_ID_2926092; Annot_ID_196588
cttctactggctaagaagaatcctgtccagcttgtcattcagcgctttgatctccttcctgtgtttgtcatcagagtcagttgtgcctctgatagttctgtcgcagtcctcgttgtaattaccatctgattgagcaaggttctcaaccaattcccaaccttcttcaacatctttgttctggaaattcccattgctggcggtatccagaagcattctgatccgtggtagaactcttctgtatagagtgctgagcagagaagctttcttgaagccatgatgagggcattggttggtgtaacccttgaaacgctcccatgcttcacagaagctttcaccagtcttctgtgaaaagccagaaatctcatttctaggtcttgcagttctggcattggagaagaactttgctagaaaagccttcttgcaatcatcctaggtggtgattgagtcatggggcagattcttttcccagatgttaacatagaaatttatttatgttagatatttcataataaaatttcgatatatcataactcattccattattttagtagattatatttaaccagccttctactgtaagtattatatatatatatcagttttaggaaatccaattagagtatttacaatttataattttgttttattgttttaaaagacaagaagtttttaattgagagagatagtgagagacaaattattattcttgtcaaccttcttctctatattgtcgggtaacaaaatttaaccttgtttttttatctattatgtatttatattttatttgaaatatcaactaaaactatttttaaatgttccaaattaaaatatataattttttttggttatatacaaaattatacattccaaataataaatgtatgaaattgaatttagatattcaagttctaacccgttactcaatgagagtttttgttaaatttattcttgtttaaaagaaatatattactcaaatctgtattttgactgttataattttttcttcttagattgaaacatttaaatttgattttaaaaatttaaatcatggcatgtgcagacaaaaatctaattttcattattatattgatgatatgatgatttatttgtttaataaaaatagaatcaaataaagatgaatggtgaagtataatgatgaaaaacaaaatcatatatcatcaaacaaataggccaattgattagtctaatttctaatcataatgaacaacaagtttcattaattgaggaaatacgattcataatatcttttttaaaaaaaactgaagtcgaaaacgtaagttatgtgtatgattcaaaattgataatttattaaatttgggaaaattccccaaaaaaccagaactatttaaaaatctgcaagaaaaccacctgaatttttttctttatcaaaaagcacacaaacaaatttgggttggaaataaaatacacgatctattatttttccgattacctcccttcgccgtaacggactgttaacgacgttaaccaaataatcaaacggtgttagttttatttagtatttgccaaaaaaaatacatgaacttttttcttctcataaaaatacacaaactaacttaattggaaatataaaacagggtctatttttattttttcgatttccgtaatcaaattgtcaaatgtggttaattttatttacaaaatattcttaaaaaacttgactattaaagcaatcctttaaaaccttaattttttgagtaatatcaactaaaatcatgttattgatgggtatgttttatcctaaattactaatatatttttcaaattctatcagatatttagattcgatgtaagcaacattaaattaaaaaaaattaccccctttattcccaaaggttctttttattaatttcttcaatttattgtggttaaattctgaaatggatatatgtgttatgttaaaactaggattcaaaataggttcaatattgataatgggctttgcccactctccgacactctctcttattcctgaatccaaaatcgtccttaactttcttttctttagattttgctccaaaatgtctccttatctccattgttgtcccactacatagagtacctgaaaagacactaagaagactcgataaataacataaaaactcaaaatcgtatacctaaaacatagataaaaatcagtgaaagtaaggatatatcaactcccccagacttagcttttgcttgcctccaacaaaacacaaaagccaaacccgtggaagaggttttgaaaacaaaggaactcccaacattctctagcctattgccatgatcatccaaactaagtccatatgccttacaagtctaatcaaatcctaaccaacatgtacttctctgcaagcttacacaacattctagattccatacctaaattccacaactatatctaccaggcttttatcgctgggtctcatcaaacaagctaacattcaagatccttttagactcattcatgtactacaccataataaatcgaccattctttatataaattttttctttggtgttctttttctcaccaagacttattctttttagagagtaaacaaaggagaactcgcatactggatcgacaccctcagcatttttccaacctttgtaattgatcattccaaatcatatatataatagcagagttttctctcctctaaaagtgtccacgtcactacatctttttaatgtggagcccacatgtttttactctgccttcacatttttttctatgcgtgaaatagatttagtgatgtttatggggccacgatttggtcaaaaagcccatgagccaaagaaccaaatagacttagtgatgtgtatcgggccaagatttagtcaaaaaacctatgaaccgaaaggacctaagaaaacccagttaaaattgcaaaccctcgatttcattttctccaattcgatcgacgcaattcagaggaccacgaaagagaaaaagagtgtttcagtcactgccccatg

SEQ ID NO: 36433 - DNA, 3003 bp, Unknown
  misc_feature (1)..( 3003): 2750-1469P.txt file - cDNA_ID_3095980; gDNA_ID_2926092; Annot_ID_196580
gctaaatatgcctcacatcctttcccgatcatcctttcagcctggattgccgagattaccaagcttcacgaggttgttcttattccttgaaattttaacataccttcgtccctcttgaattgtatccgtcctcggtgacaatctatgtgagccttgtacttccccaaccagtccatctctaagataacatcgtgtttctttagtggaacaatgattaggttcactacaaccgagatgccccgaacaagtccggtaggatacattgcctttctgccggccgctcgtaccattccataatccgtgtttggttctttcctgaacccagctgattgaaccaattccagactaacaaaacaatgtgtagccccataatcaaatagagtgtgcgtttctacgtcacctactctcaaggtccctacacattcccttagaatgttgagtacctcccctttcccatatgcatgatgcaatgcaaatgcagttatagaaataatgaatagggagttgcgagaacgtaccagtgatcgccctgaagtttccagcatcattagcttcctccgacaactcataaactcgcggtgccacggcttgccgctttgggggaggcggcagtacgtttcccccacgattgtccctttgtccgccttgcttctccgcagtcagcttagggcactcccgctttagatgtccaaccttcccgcaatagaaacaagtccttgtctcttcaccgagaaccttggactgtcctggttccattctcgggaagctctggatcgcatggtccttgcttccacactggccacatgcacctatggccttccagcaagttccgctgtggctcttaccacaggtcacacattccccggtcttagcatcggacttggtgttatccaccttgtcgaatttccttttcttatccgcgggttgggtgggttgattgttctggatcggagctttctcccgattcaagtacctttcttcctcaattccttcctcaatcatcactgccctttcaactaattcgaaaaccgagttgaatgtccggaccaaacaatggttgcggatctctatccttagtctgcggataaatcggcgcacttgggcttgttcctcctcaagttcacggcccacataacgcctaaggcggttaaactcctcatcatattcacgcaccgtgcgattcccttgaactaggtcaaggtacacacattcaagcctgtcccaagcctccggtggaaagtacttcttgttaaactcgttttcgaaatccgtaaaggaccggacctcgtcccctctgcgtttcttgacggttaaccaccagttataggcgtctccttcaaggaagtggaccgcaatgtccctttgggaatcctcagggcagcgagtagacttgaagttccttttgagtctactcctccactcatcggccacaatcgggtccgtactgcccatgaagtgtctcgtgcccagccttgagacatgttcgagaaggctcagatagtctccccttttccgcccatgattcggttgcagattcacttccacaacttccgagtcatcgtcattttggttatccactctttggaccactggatccgctacaacggccttggttaatgtggctagttgcgccatcaatcccttcatcaaatcccactcttcttgggtcgttggagtattgttccggttatatgtgctgtcccttgcaccgctactctccgatgcttcctcatttatggacttcttcccggtctcaggttcagctgagtctgtcccatcgagcatcgtcccgattctagttttctcgttgatcattgtttcctcctcaaccaaagtctcctcgacaatgcccttgtccttcttactctttcccgttttgctgctcttacccatctgcgaaacctccaaagttaatccacataactcatagtaaaatcgcaaaagagtaaagaacaactaccgcgagattctcaagccgacgagtggtgataccccttaacccaatacctagtcctagaaccaagcacgcgcatcagtccggccgattctcggcaggttagttaagacccgccggtcctccgctgagccgcgtccccgcctcagccgatcccttgcctggaccgagtcttgtgtaggatgcacatgacctgattctacccaacccactagtcgttcctttcaaggaatcccgactcatctataacgcatcctagaatccttagactcgaggtctaggattccctaaccttccttcacgttgttcggtcgatctgattcggtagtccagctaccgaatcctccgactatttattctcccgagagggccagagtttaatggtgagtttccggtgtttttctgtgtcttgtggtgtcccaaatggtcatgggagtcgttccttatataggggacaaatagatgctttccgaatcaacacatccgttccttgcacctttccgaagagttgcacctttccgaagagttgtatctcttcgcccttaactgctcgcccttctccaccctttgggcaagcagccattcgaccataaccgcccaagtaaccgtccggataaccgcccagctggtcggacagtcgaccagttaccttgagctcaaccgtcactcgtccaggtgcctcgagcttaactgtcactcgtccagctgcccgagctagactgtcactcgacctgagtaaccgtcactccttccagctgagcttgagcttcgggtgagctgacccagctgattcccttatgatcctagcttagcctgcatgatttcccctttgtccgagcttatggccagctccttctcacttgtctgagactccaccttcttctctcggaccaagtcctagccaacgatcctattgaagatcgcgggcgatacaagtttggacagaggtacgcaacatcaacaacctgatttgctcctgtcagatcctaaagctacctagctcacaaacacagcaacaacagtgtactctctttgttcactcaccaatg

SEQ ID NO: 36434 - DNA, 3000 bp, Unknown
  misc_feature (1)..( 3000): 2750-1469P.txt file - cDNA_ID_3095999; gDNA_ID_2926092; Annot_ID_196575
accttggcaacccaagcaaccagataacataagtggtatctgaaaaatctacttcgtccttttcatttgtttgttatgtgatacagaaaaaaagaaaaagagaagagattgagagaagaaagaaaaagagatgagagagagaggagagaaggagagatttagaatgaggtggagagaaaaggataaatatgttattattatatataatatagagagtatagcagtttttttgtcttgtgttactttcttaatttataagtttttgttagttattcttgcaaatttcccttgcaacaatacccttttatcttttccatttttaaaaatatccctttccctgaacacaatgaccaaattaccctcatctaataggaatatgtaattggaaactgaaattttcccgccaaacaaaaatttccgccaaacttttttcccgccaaaaaaacatatcccgccaaattttttattcgtaacaaattttttctcagccaaacaaattcttttaaaaatccttgtaaaatttttttgcgggaaatagatttacaagggattttaaaagggttttaaaagatttacaaggaattttaaaatggttttaaaatatttacaaaggattttaaaagatttacaagagattttaaaagggtttaaacgatttacaaggaatttgaaaaaggttttaaaatatttacaatggatttaaaaaaaatattttaaatggttttaaaaatatttacacgaattttaaaaggtgtcttcttgtaaattctttaaaaatcttttaaaaaccattgtacatcttttaaaacccttttaacccctttcaaaatctcttgtaaatcttttaaaaccattttaaaatctcttataagtattttaaaacactattaaatcctttaaaaagttttaaaaaaaccattgtaaatcttttaaacccctttaaaatctcttgtaaatattttaaaaccctttaaaaatctcttgcaaatcttttacaaccttttaaaatcccttgtaaataatttaaaactcttttaagacaattttaaaccctttcaaaatctttaaaaaacctttataaatctttaaaaaacctttgtaaatctttaaaagccctttaaatcctttctaaatcttttaaacccttttaaaatcccttgtaaatcatttaaaacccttttaaaatcctttgtaaatattttaaaaccctcttaaatcccttttaaaatctcttgttattcaatttccagccaaaaatttttttttgcgggaacaaaatgtggcgggaaattgttttttcgaaaacatttggcgggaatttttttttcaaaatttttttgcgggaaatttattttgaaatattttagacgaaaaatattaatatttcattttgttaacctaaaacaatttccaaataggggtaaaatgatcattaaaaatttaaagaggataaaaatgaaaatggttaaaaaaaatggtagagttgaaaaggggcatcatgaaaagggcattaaaagaatttttcattaattaattgataaattaataaattttattttatatacacgtttttggttgtgtattaagtcttttgcgattttaagtacttgtgacgggattggatagttttgggcttcctcgtgtcaaaacgggcaagaggagttaatttttacgattctggcggtctacttccagcggtccacctccatatgtgcttgactgccagttttaccgaagattctagcaatctacttccatcggtctaccttcatttgttgctcaactgccaatcttaccgaagattctggcggtctacttccatcggtctacctccatttgttgctcgaccgccggtttcggttttctttaaccgaatttattttctattttctatatttgggtataaaaccccagaaacctaatttcattgtcaaggcttctttttctacaacttttctagagcttttctttgtaagcaactttgggagaaggatccatcctctttgacactttggagaagatttctaatccctattctttatatttaattaatcttttatgtcttcttcaactctttgtgttgtttattttactatgaaccagtagtctcttaattgggttttagggttctaagtaggggattcaataaattgatggtctgattgttgtttggagttctttatcttttagttctttgattcccatgttcttaatgctagaataggattgattaccctgttttagattctaggcttttctatgcatcaaaagtgttcgatagaatgcctgaaccaatgtgaattgagcaatggatttctagccaacaataatgaacctaattctaatgcgaatttgagtagaaaattacaaatgaaagtttagtagtcaagtagtcaaatttagtgattaatgtcttgagagagaattagtctaaacgtgtgttcatgttcgagaacggttctttgtgctgaattccttgtctaatatttccattaatcattgatctctgaaataccgtatggctcaatgctttttattatataactttaatcgtttattttcttacattttaatttataatcgagaaaaccaaacaaacaaccttttcgctttagctaagaacgagtctcggaaatctttagagtatctttggtccttgtggattgaccttgcatatactacctttcagttaagtgtatcgagcatttactcgagtaaccaagttggcgccgttgtcggggacaaattgcgttacctaaagatttaggattagtttttagtctaaagcatttttatttactgttaatgattatcatttccatgttttctttggtgttttcaggtgtatgacccatagccaaggctcatcacacctagtacactaccacgaggatatcggaaagtttgaaagagagaataagaaaaagaagcagttatcagtgcagagagaagctgaaatggttgaccgtgccgctgctaagaatctcctgaatgaggatg

SEQ ID NO: 36435 - DNA, 3003 bp, Unknown
  misc_feature (1)..( 3003): 2750-1469P.txt file - cDNA_ID_3096020; gDNA_ID_2926092; Annot_ID_196568
aattcaacattttcccgccaaaaacgacattcaacattttcccgccaaaacgcaatttaacatcttcccgtcaaataacgcgattcaaaattttccgtcaacaaatgatttcacatttttccgccaaaaacgacattcaacattttctcgccaaaaaggatttcacattttccggtcaaaaatgcaatttaacattttcccgccaaaaatgatattcaatattttttcgccaaaaacgcaatttaacattttcccatcaaatatatatgtaatacataaaataaatacaatttaaaatatatttatgagggatttttctgccaaacacgacttgtgatcttcacaaatagtagattggatccatctatgagggatttttattggacatctctaaaacaacgtcttcggctcgtactccaagcttctctttaactttacttgcaaactctttgtacatcattgaatctcgcaggcaaactaatcgattttcctccatagtttcagattctaaattccaaaccaacggatcgaccttcacccattctcttataacgagcataacatgctcttaagcagtcatttatgcagcgtttacggttggtaggaggagaatcaatcaagtcctgattttttggttatttcaataataaacactaggcctgggcaaaatacccgaatccaaagaactgaactgaacccgacccgaaaagcccgatccgaacccgaacccaaaattttaaaatatccgaacgaatcctaaactttaaaacccaaaaacccgaacccaaatctgattgaacttgaacctgatcaagtacccgaacatatctaaaatatatatacatagaaataatttaatagtaacaatcatatttacaacaacttaattgcctaaatgtttttggattttaacctattttgtatatttttgggtaatttaattatttttgattgattcggataaaaaatactcaaattcttttagaagttgtgtattttcaagtaatttgaatatattttgatacaaaattttgagttttggatactccgggtaaacccgaatccgaacccaaaaaactcgatcccaaccagacccatacctaaagtcttaaaatacccgaacagctcttaaattttttctagtcatgatagttgtatctttaacataaatcttatagcaaaactatactttttttttttttttttttttttttgataaaccctatcggctaatccggtcaaccccggtagaaacgcaccgaagtacttcagagtggactttttcccgaaggaccaccacactgtctgtcccgagtttggatgctttccgactaatgccagggggtagtcaggccgcctgcatttctgactaccaggtaaatcaattgggccaaagcccaactgacagacttcccaaacaaatgtgatttttgtttccaggagcatcgaacccaggtctgaaagtttcacccttccccaaatcttctcctaccactggaccacagatgcttggacagcaaaactatacttgatattctaaatttatcaatttgctcttgtgaacctcatattagcctagagaaactttgaaattctttcaagaagttctatgtagaatacagttttagtaacatttattagccatttcgattaagattattgttagcaaaaagtttttttttttatatatataagaaaaactatgttttagatacaatgtgagttaggcttcttaaattttaaaagttaaatacatttatacttaaaaatagttagaaattcaaatttatacataaatatgtcaatttgaaccttatacccattaaatatttggtgttagatatcaaaataaaagaaaattaaccatttgttacttatattgaattggatattgttacatgtatttatgtttttttttgtttaattttgaaacgttgataaaaaccattaaatttaagttttgtactatatttatttgtcgaaaatataattgtcattaaatataacgttaactttatttttaaaatacgttgttatttttatttcgtatatagaggtaaggtaacttcattttttaaataacaaatacaaatcattctttattacgatttgtttagttaaacaaaaatatttcttgtatatttcaatcataagtagatatgtctaaatttaactctcagattactatgctattcattgttttagctttggtgtgtgcgtttgttccggctttctcaatcgaagaagcggaagcaaatttattatggaaaacttgtcttgttaaaattactcctaagtgtgcgttggatataatcgctgctgtctttgaaaatggaacaatgcatgatccttgttacaacgatctcgtcaaagaaggaaaagtgtgtcacgatacgcttattaaatatattgctgataaacccatgttaattgcccacgaaactgaatacttgaagaaaagtgatgacttatggaaacattgtgtctcaatatccaaaagtgcttgaaatatgtaatattttttactgttttgatcaataaattggtattttctgttattgaagttttcttcactcaaacatttatattttcactttactacaatttcaatcaaagcgaatttcgttctaaaaaaatgtaacataaatttatgattttctattatcacttaaaacaaagtttcttatgaatagcgaaataataataattcaatatttaattattaagaggcgctctaaacattatttttagagaattgtttttttgtattttctttttaatgagattaatatctttttcataatttaacgaagtttaacttttttcaaagcatttggagaacttatttctttaaattccggaaaaaaagaatttaaaatctttatcattattctataattcagtgaccttagccaaaaacctcaaacaaataagcaaatcattttcaagcagatttacaaattttaaatttgaatttcaatgcacaaaacgaaaaacttgatg

SEQ ID NO: 36436 - DNA, 3003 bp, Unknown
  misc_feature (1)..( 3003): 2750-1469P.txt file - cDNA_ID_3096040; gDNA_ID_2926093; Annot_ID_196596
tcttaaatgattataagagactttggttccaaactcgagcttttaaaaattgtcgaagaagaagatatgtggtcagtgtttgcaacggaaatagattcttttacgtaatcattttagatgttttgcgatatcactatacctagaaagttgaatatccgagctgacacccttgcaaaagggtttattttcgagatgtcattttttctatataaattctcgggttccgaagtgattggctcttgatgcctaccttttcgaacctgtttaataatatatagaatattttgtcgtaaaaaagaaaaaaatcccgatttcccgctgcggtatattgttttctgaaaggcgattctaactaagtgttgtttatatgttgtcatttggattgaaaaacgaaaaatcatctctaacatacatacatatcgtaaaatgaacataaattcatggaacctagaaaatcgatttgctatagttgtcgtgtctaatcacagtaacgaattaacacgacaatcatttaacaacatttgatctcattcgctgattgatacgatactcaaaggagcattatttagtcacggtcgtcgactgccatagaaatctatatataacaattaatattattatgccacctacatctcgtaaatacttcctcacatttcttgtgtactgttgttacaacgaatgagtgccaaccaatgattaaactaaacttactaaatatttgtacacatatattattataattcctccatatttataagaattaaacttcgtaaattcattgtcaattttttcaagaaaatacaaagcgtgaaagttgtctacttgtctggtcggccagaagcgcagagtcgacttcgtattcattgtttatcatcgtattactctcccacatattaataatcttattcttatccaaattatttgcttttgcgtacacatttcacgaaagtttctaaaattgtttttcttgtaaaataccatataaataaagcgtacgtaaatacgaaacacatcgtgatagtgagctatatatataatttagatgttaatttgatgatatatacatatatctccattttcttccctattgatgtgttatttgttattatttactcctccaatgtaatttattagaaataaagcgtatgtaaatacgaaacacaaattagtcagttttccgtcgtccaaaatacaatgtcaattaaaaaaaaattatagaaaaaaagtaaagacactttaataatagttttatatattaacagaatgtttcaggtttactgcaaaataataaaaataggccacatagcgctcttgtttgttttcacagtttctagttctaccatttggtaaatctctaatataaaattttcaatattaattgttttaaaatcatatgaaccacgaggggacacgtgtcggatacaaagacaaccaattggatcagatctggtcttcgataggacaagtattcctgggaccagagagagagagagagagggacaagatcgccgttcaatagactctttcttcctattaatcacgtggtgaggtacttaccacgtgtttatattattggcttcttacgtgaaccaatctcatggtcctagttttcacatacatcgttttcctttgtgttgttgtttttctatatgacaataactttgtatctcttttatggtttatataatgtatatgcatgcaatgattaagttctcaatattacgattactctcttggaaacaaaaattctcgtataaactaaagatttgcaaacttcaaaagattatagaagaacaagttgtataaaagtgtttgtttgatcacttcaagagttggagtttttgtgattgtgaccattagagcatccacattggtgattctctagaaatgtctttacaataattattataaaaattaatattattctaattttgagtcatttattagttctgtatgatgtctttaaagatacaaaaatgtctctatagagatatgaaagacacaggtctcccactgtaccattttcttttttttttttctttttcttttaaaaatttaaagacactgttatttttttatgcaatagggatggtctcccactgtaccatttttttttttttttttaaaaaaaaaattaaagacactgttatttttatacaatggggatggtcttagatctccagaagatacggcgtattgaaaagtactgctgatctgtccaatgtaagggctgagttggaactaaccttcaatccactgagcgacatttgtcaatttcaaccaaaacaacaccaactggatgattatattgttttcttgttatttgattttcttgatgatatgtacaaaactataagtcttttttggtatcaatttagaccattagctaggacgcaacaatatgaaaccgtatcgctataagacattttaaacctagattttaatagttctactttcaaacaaatccgatagtttactcggcctcctatatcaaacaaatgaatcactatacaaggccacatagaaaaatcttatccctacgttatacaaatacaaattcacaatttttatttataataaaaaattcgcaatttgattagaacctttggttgttatttattgtacacataatattaaaatggtcaatcattgtctcgtcttgtagtttagcatatgtatggattacatagttttctgtctgttaccctctcacaagcataagcgtcgtctcgccaaaattagacactattcatatacacaaatatagatacgtatataaatatgtagacatttacaacttataaaagaaaattaaataaaaaacaaaagtcggcaaaccaatttgcatgaaataattataataattttttaaagaaataaccaaccaccaagaagtgctttgttaacagagaaagctctgtaagaaccttaaaaaggttctgttgcagaggttccgaccaaaagccagagtttcatctttatgtgaacaaagacagagagatg

SEQ ID NO: 36437 - DNA, 3000 bp, Unknown; identical to SEQ ID NO: 15252
  misc_feature (1)..( 3000): 2750-1469P.txt file - cDNA_ID_3096047; gDNA_ID_2926093; Annot_ID_196593

SEQ ID NO: 36438 - DNA, 3000 bp, Unknown
  misc_feature (1)..( 3000): 2750-1469P.txt file - cDNA_ID_3096052; gDNA_ID_2926093; Annot_ID_196592
tacgatctttgttgtttcagtacgaaagaaaaaattactgaaatagaaatctgaatatgctttatttgattctgatttagtttgcaatttttaatctttagttcactgtttcaataaatgattgttactgtttgattctgatttagttttgggctaaaaatttacagagagggaatgtcaaaagtgcactaggccaggattttacatagagatgttgacgctaggagaagatcaaatcggtagaattggggcaagctctagctggtctaggtcgaagaagcttcgggttcatcgctacgagattcctgatctaaacgtagaacctagtttggattgggatggggaagaaacaggggaggccactaaggctctgagcagtacatgtttgaaacctaaggatgcagattattgtttactaaatgttcctcagctcgtatacgagttagaggtcgagatactcgcacgcgtgccgcgtttcgagtattggaaactaaagttacttaataaggggttttcgcgtttgctaaagagtgatgagattttcaaggtgaggcgcgagcgcggtgtagttgaaccgtctgtctttatgttgtcgagtggtgatacgtgttggacgatgtttgacaagggctttgggaactgccagaagcttccggaacttccttctgacatatgcttcctccatggagataaagaatcgctttgcgctggaactcatttgattgtcactgggaaagaggagaagagcattgcgctatggcggtacgagttggagacgagcaaatggttcaaaggtcccgcgatgatcacaccgcgaatcttgtttgcttctgctacttgtgggactgttgtgtttgtagctggtgggttgaaaattgaaggaaacgggaccatggaagttgtggacagcgttgagaagtatgactctaagaccaaaacgtggacgcttctacgcggaatgcataagcggcggaaattctgctctgggtgttacttgcgtggcaagttttatgttctcggaggccgggatgagaatggtcaaaacctaacttgcggagaaagttacgacgagaagacgaacacatgggaactcataccggacattctcaaagacatgtctttctcttctgtccaatctccaccgctcatcgcagtggttggggatgatctttactcattggaaacctcggcgaacgagctccgcgtttatgatgcaaatgcaaactcttggaagaagcttggagatgtgcccgtgagggctaagtctaatggaggatggggcgttgcgtttaagtcacttggagataagttgcttgtgattggagcatcagccggtccgtctagggccgagacaatgtcggtttacacgagccgtccatccgcaaatcctgcgaacaagctgtattgggaggagtctaaacgttgctgtggcgttaggttcaatcattttatcctaaactgttgtgtaatgattgcgtaagggcaaaaactttgcgaagctgtggttttgtgtgtgtgtgattgaatagaacggtgctattgtgggttatcttctgattcagagtctatcttgagtttttggtgaacgctagtgattgctcattttgtgatatatcttaagcttttgcaagattgtgttaaaaataagaaaggttgttatatctgaataattcgaaacaatctgtctaaatcgaatgagcttgtttcaattcaattagaattgtttatatatcgaaaacttggtagttattagttcaaaaattttagttaatttattgctttagaaatccttagtgatttaaaaaaatcatatatgaacttgagaaaacaaaaacatccttagttttagtttggtttctttttgctagagaatttagattttttaaatggatcaaataaaatgttttttttaaatgggttaaatttttagaaaactaatttccgaatttttagggaaactaatttccaaattcttgagaggctaaaaaacagaatctacaaaatctaaaactacctcaaaagcttaatggattttaattttagaaaatatagctcaaatgagatgataagtgactcgaataaaggggaaaatgtgatatttatctaaaaccaaaactcttcgtgaagatgcagcattttacactattattcgttgtgtaatattctcatgtatttgcagttttgttatgcaacatacttctactactaatgtgcgatggtgttgtttctattagactgtaatgtgaggcttaagattggatgcaacaaagcaagtcggcatcgttgttacaaaacatatttttacaatgaattggcaaaataaatcactatatatacccaaaaatttgaattatatattcaaatattgagaaagtttagcttcttgatagtggtgttaatggaataaaaaaatagattctagatattaagataaaaagaataattaagaaaaattaagtatatgtaatccaatatatatggagagtcttctgtcagataatagatatattttattttataataacataaaactgtattttgatttttgctaaaatttggtgataatgtgaattaaattataagataactaatccaaattttaagaaaaaatgagtgatttaaaatagatttttatacattaatttatttaaaagaagtaattaatatgtaaaagggaatgttacactattaggcacttttagaaaatctttttacgtttgaggcactttctaaggttcagacacttttccttatttctagaagataaaaggacaattatatcctttcaaaattaaaccataaattgcttaaccagttcgattggttttgctgtgttatctaataaaacacacgtgtaatacatgttctttctatttcgtgccggttgagatctcgacatgagaaagggagtaatctcacaattacagcaaataaatggatatttttttaaaataaataatatatagtgtcgctcttcatctctaaaatcaaattcttatg

SEQ ID NO: 36439 - DNA, 3003 bp, Unknown
  misc_feature (1)..( 3003): 2750-1469P.txt file - cDNA_ID_3096072; gDNA_ID_2926094; Annot_ID_196614
aataaaaattaattcagcttctttctaacttttcttaacttagtaaaaataatattttaatttaaaataatgttaaaattgaaaattaagaaccaattggggttgctcttacaagaatgggaaaattaaatagaaaaaaaatgaaatcgagggactgtaacgagaaagacatttggttatatgttgttgtctctgtcacataaaaaagtaaatgtggcatttgttcccatatcccatacatgttaatatacacgtatttacttcttcaactttttagtttttctcttttgaagtagagtatgtgaaaagaagagggctaatgtggaaaataggatcacaacttcacaaggatcaaggatgctattgcacttctttaatgtctattgattattgataaagatttttttctttacttctttaattttttttttcttatagctcttccagatgtcccgttgacatttatttgtagttaattattggcatagctttattcaaaataaagggataaatgtgttttattattctttgtagcttccataggtaagagcatctccaatggaaaagctttttctatggttctcttcattttttaaaattaaatttttaaaaaaacttacaagagagcttttggattttctttttagtttttcattctccaataatagtttctcttacacaaattctctaaagaaaggaaattattttactattattttattaataataattattgcaaatcataaaatattaaaaatacattattttgaaatattttaaaatagatattccaaaaaggaaaattgaaataacgatcagttgttctgttgattgatgatacgatgatgcatctattgagattgataacgttagaaacgagatccaacagagtaatatccataacagaacacaagaataaaaaaagaataaaaggcaaaaaaaaaattgttaaaaattttaaacagattaattatagcttgccacgtagcaggctcctcaagttaaaaaaaaagctcttctctccatattaatgtattttcatttatttttattacaattaaattagagaacccgtgatttttgagcagagaacctcctattggaagtgctctaagttcgtcgtagacaaagttaatcaccgtcctggtattaaccacacgacctcaaatagacatagattttttttttcttttacctttttaaatagagagttatagttataacctttctatatatctttgtttttatggaacttcgttcttattaatttacaacgtttctatgttttacttataaactatttatctatctctatttacttatcagttgatcgattttgattcttaatttgtaacatgtgtttttatggattttgcttaaatctttttatttatctgaagccgaaaaatcttatatgttgtttgatgtagaggggttgaagtctcctatcatttatgtttttttgcttaaatggttcttttgtgacattaattattaagttgctctattttatgcgtatgtgtgttttaccatcgaagcagtagtagctgactatactggacgaatccctaaccttttttttttcgtccggaatccctaacctacgtttaaaatttgaggcagactttagtgttgctaataatagtttagggttaatatcattggtttgtaaaaaaaaagaagaaatcattgacttatgtaagtttttattattgtgtgtcgtttgatatgtcaatgttgacttcatgtgtctaaagatgattcattatcttctttggccaaacaaaaactatttgtctgcatatccgaataaaaattatttactttgcactgattttggtggagaattaaactttgaaaatgttccctaccaaaaaagaaaactttgaaaatgtttattttattgcaagcatgcgttaatattttttttccaagatttcatatccactcatctacaacttgatagattttgttctttcacattacaaaatatgcatttgtaagaaattaatacaatactagaatcttctcatggaaaatacccacgatgaaagatatgttcatgtcatgagctcaatgtttgagcttcctttcaatttcagttttagaattttagcatataaaagtttctaaatttttaatgtaatcactaatttgattgagaaccaacttttatcattgcacaaaagaatacaaaataaaaaatattttaccttgtgttatgtaccttcaaaaaccaagtaagtactatatgatgttttactattttctgaatttcgtatttgaaatcaaatttctgtcaatagtaattatttttttttgaaaaattacagcaattataaagtcttttatatattagatacttattattaccaacatcaatatatatatatataattaatattctgacaactattattaatcatactctctatgttttttattaatgtatattaaaggattttccacatattatgatatgattatagatgcaatatttttgtgatttataattttgaattttttataactcgaaatcatctgtatttaattattattttttgaagtttataattcattaaaaataactaataaatattgcattgagaacttaaaatatctttttttttgaaataaaacaattcctaaacatagagtaacaaaaataaaaagagagtatatatatttcaccaaaatataagataactgattaaaaaactattagtatatagtacatttcaccaaaatatataaaacaatctactactttaaaaataataattaagctctctcgaacttaaaaattgcatagcacaaaccgagactaattgattcaaccgagactaaaccggagaataagcctaaaccagaaccctcggaatcatttagaaggatagtcttgttgtatcacagcgagacagcttctcttccccatcttctctcgctgcttcttcgatcattgaagcatccacccagaaaaaccctaattctcctgacaaaatg

SEQ ID NO: 36440 - DNA, 3000 bp, Unknown; identical to SEQ ID NO: 15257
  misc_feature (1)..( 3000): 2750-1469P.txt file - cDNA_ID_3096082; gDNA_ID_2926094; Annot_ID_196612

SEQ ID NO: 36441 - DNA, 3000 bp, Unknown; identical to SEQ ID NO: 15256
  misc_feature (1)..( 3000): 2750-1469P.txt file - cDNA_ID_3096096; gDNA_ID_2926094; Annot_ID_196606

SEQ ID NO: 36442 - DNA, 3000 bp, Unknown; identical to SEQ ID NO: 15255
  misc_feature (1)..( 3000): 2750-1469P.txt file - cDNA_ID_3096101; gDNA_ID_2926094; Annot_ID_196605

SEQ ID NO: 36443 - DNA, 2324 bp, Unknown; identical to SEQ ID NO: 15262
  misc_feature (1)..( 2324): 2750-1469P.txt file - cDNA_ID_3096137; gDNA_ID_2926095; Annot_ID_196637

SEQ ID NO: 36444 - DNA, 3003 bp, Unknown
  misc_feature (1)..( 3003): 2750-1469P.txt file - cDNA_ID_3096143; gDNA_ID_2926095; Annot_ID_196636
tgtaagcacttatttttaataaaatggttttaattgatttttatatttaaataaagggttcaattaataaattaaagaggaaatacatttttttaaaactattaatctaactacatttttaaccactcttaaaaatcattttcagatcattattggttatatattaagtttcgttgggacgaacacaaaaagacaattaataaaagaagacataaacattatctaaagatgtgtcttatcatttctgttagttgaacaaataaaaaataacaaagaccaaagagatttttatttttgaatttgttggtattctccttcttgcaaagatctaaaatagcacagctcctcgagtaacacgtgtcataatttcacgacttcatcgtatctattctcatctaaatttatggaaacatcactttcacacttccacaacaagccacacattccaaataaccaaaccaagctactaattattcttccaataagaaaatatttacatctaaatccttaatttataagagcatttaacctaaataaactattttgtaactattaatatatatgcaccctaccaaaaaaatctaatatctatgcatatttctatttatagaacagttaaataaaaaaatgtttagggcttgttctatgcaaactgaaagtctttttttatgttatgataagttcccgtttcttctttcttttttgggtaatattagaaagtaaccatagaattgaaaagaatgtagtaactaaccattgtcagtttatatgtgagtaaataaccttatgacggcataagaaaatacaaaaatatccttgcaagttgaaccaaaagcaagagtatgaaaatagcatgatatttataaaaaaggtgacattttataatgtgttataagaataaataatatgttatatgaaaaagtagcatgttgacagagaaagatttccagttataacgtgtaattcgaaaaagtagcatggtacaaaagaaaataacatacaatttaaaaagaaaacataacgacgatgattccaagaaagaatcaaaatcgaacaaaataaatagcacgatatttatcaaaaaagtgacattttataatgtgctattagaataaataatttgttatatggaaaaatagcatgttgtttgagagagattttcaattataacgtgtaattcgagaaagtagcatggtaaaaaagaaaataacatacaatttaaaaagaaaacataacgacggagattccaagaaagaatcaaaatcgaacaaaataaaatgagaaatcttctgcaaattgagggaaagatgatccgtcaatataaataacgtttagcagcctaaatttatcgaaaaagagacttggtggttgtgatggtggaagatgtggtggttgtggtggtggaagaaagagagatgagtggtggtttgttcggattcatcaaaagtttttcgccatataatcatctaagtgttctgtgtgattttgtaaaatagcatgtaatacatataaaattcgacaatgggtataaaagtaattgcaaatgatgaaagagagtgtattctgacaccatagttactttgttaattcttttacaattcatagtcattttgtgcatattctcttcttttttttaggtaagaatatgactttctatttcaattcaaaagttcttgttatccaacaaaatagttaccatggatttgtatttatactatactctaatgttattgaaataagatttagaacatctttaaatcgtaatacagtgacaatgattatgtcatttaaattaacaaaatttgatctataccaaaaagtttgataacacaagataacttgattgtttagattcaaactcaagcatcaaatgtccttaaagtagaacttaggaaaaatgattagcaactgcataaaaagactccatcatataatcaaactttaaaaatatcttattagctatacacaatattgtcattatataagcacatctctaaacaaacataaatcatattgtaaacaccataaccattatacttaccattttttttgtgtcaaaatccattatacttactatgtatctacagaaaaagacgccatcacatatggaaacttgaaaaatatcttattagctatacaaaatattgtcatcgtatatgcacatttctaaacaaatataagttatgttacaaaacaccataatcattatatttacttcttttttttttctcgaaacctattaaacttactatttatgtgtaatggttgccaaaattcagaattaaccgagattgactagtgctgataaaaaactatattatttatttttaaacacataattaaatacatttctccaacacaaatattttatatactattgaaaatgttttaaccaaataaaaataatatttactctcttttaaatattcaaaactctagctattttaacatatcattttgtaagaaaattatatgaaactcaaaaatcacaataactcagtgaataaaattaaattaaaagagctactcacttatgactatgaagagtcatgctcatgaacaaaagaattaaaaaaagaaaacacgtgctaatgcttctcctcctcctcctccacatcgccgggttttcctcttcctcccccgtgaaaactgcatttatatcaattcttcagattccccaaaccctaaattctctctctctcccaatttttctccgtcgttttcccccaaatttcctctcttttttatgtcttcaaacttcaaatccaatcttcttctctctccagctcattgactcaaccaaatctagatcaaagtttgaatttttaaaacctttcttttttttgttgcttccttccaaaaaaaaaaacgtttcttttttttttcttcttcttcttccttctgcatctgaaagtttgtatttttcctgggtttttacctttcttggtttgaatagacaaaagggttttcaaaattctgtagatttcattgttacaaaaaatg

SEQ ID NO: 36445 - DNA, 3000 bp, Unknown; identical to SEQ ID NO: 15263
  misc_feature (1)..( 3000): 2750-1469P.txt file - cDNA_ID_3096156; gDNA_ID_2926095; Annot_ID_196632

SEQ ID NO: 36446 - DNA, 3003 bp, Unknown
  misc_feature (1)..( 3003): 2750-1469P.txt file - cDNA_ID_3096161; gDNA_ID_2926095; Annot_ID_196631
gaaatatattggctaacaaaggggaaaacacacaaatttcgacctaaatatatataatccaacgatggtgagaatgagaaagtatgcttacgacggtttaaagaaccaaataacccgttatttacgctacttctctatttttaagaggagataacaaaactcaattacaaaaaaaaaaataacaagaaaaacttgagaagtataactagttgtttatatccatcggacataaccgcaaaggatgcgaccagttgtgaggagaaaagtgctttactccctgccatcggacgtctcactcaagaccatttacgtcaacttgcccaaaagacaattactttccaataccactcagcaaaaaattcacaagcaaatttttctgataagaaaagtctttgtttggtttagtttatttataaacaaagagtaaccgttgacgttgagtatttatcacccaattaatctttctatattgaactagtcgtggagtagttcactcacctaattttttcttttatcatccacttttagttaaaaagtaaaaaagccattaatgtgaaacattgtttatacataactgatgtgatacagtttaaaatgaatttttgtatcaaattatctgtttttacatttgcgtatcgaaaaatttaaaataaagagaaatttgtgaactcatccttatcgctctgaaatttttccaaatattttgaaaatgcttgtcatttagttgaaaaacacataatcttcaccacatatgaaaaatctgtaaaaataattactaatcatacatttcactcacctaattttttaataaaaatataataaaatacaattttgactagcaaaataaaaatggtttgataataacacgttcgcaaaatttgatccatgacctaaaaaagagtttgttgttatagtttccacaaaaaaattgggatactattcattttacatggcaagaaacgtaaaggaaccgaatcataataaacaaatgaaagatacttagagctaagcattaagcatcccattttgcgacaggatttgacgcattatgcttacctccattttaaaatttgatatctcttgtcaaatctttatttatatatattatacatgatatgtataaatatttcacgaagaaacaaagtatagatgcttcttattgtctgatcagatctctactttttattgagaatcttgtatcaaatatggttctttttgagccaaacacgccaactttcaataatcttcactttgctgactactacttcatgttgattaacatacttattccaaattacggctctaaagaaagtgaaactaattaaaacgtgcgtgttgatacttgatagtatatatacttcttacgcatcgcctgattagatatttgtttttattaggattccatgagagctatattgcatggttaattggataaatggtcagagagacgattaggattaaagtaaatgacaaggacatttttgattatttctcgattatcatggtgggtgtaatttaacatgctgtttaattgaacgaagatactgtactaatattttacacgccctaagtaagactcactttatcccattttatatagatttttttaagaaataataaacattttatcatgataaaaattcaaccaatagaaaaaatacggcagaattcaaatagtcataaaatatcaaattaatagttatgcatagaaactataaaaaaaaaaaaccttataacaaaccatcaatatattgcgacaaaggcagttataagtaatctcaaggtaatataacatgcttatacatccatattacaaaactcatggataaattataatgggttttctgcaaaagaacctttcaagtcaatctcgtttgcaagtttaccctccaaatccgagttatgcaagtcaaccccatcatctctaaagtcatccgcaatacagccttcatgtatatcgataacgtggcactcaataactctgtttaaaaacataagggttttatggaaaaaaaactctcaatataaatttgttttgcaaaataaaccttcatgtcaaataaatacagatcaaactacaatctaaaaatctcatgaaatataccccttttgtgtatcgatgacatgacagtcgatacccattcagagcatgtgcaataggtatagattttatgagtcgtttatttaagattttctgctatcacaattccattaataataattttatatttttatctattcactattctcgatcctggtttatctaaacatagtaaataatttttcttattttttattcatgataaatcaattacttatttaatttaacgttctataatttatatttcttttaataatttattcaattaatacttaaataataaagggtgtgctggtaaatttcaatataaaaagagtaagcatagttttttcaaatttgcataaatcatttgaactcgttattttcttaattatataaatggtatgtctttcactttgtacggagtatcccaatgtggggtacataaatattaagagaaaaaaagagatcaagcttactagtttaagcgttaataattatactgactgaccaatctacttgttcatgtagctctaatgttattaattaatatatagtcttagattgatctaattaatgtctgtgtatgatgtcactttgtgatgatggaagtcatgagagcttccattacttaactctctctctctctctctatctatttttacggtcatgtatagtgtaatcaacaataacaagaaaaagccaagttcaaagcactatactattagttaaagacaaatgcgataatgatacgattctgagcattacttgagtcacaatatatagtcacaccctcatcaaattctttctatcttaccaacttctgaaaaaaaagaaaaaaaccaaaagacaagtaaatacatatataaatatacactcacacacacacacatatattgatatacttataatcataaatcatg

SEQ ID NO: 36447 - DNA, 3000 bp, Unknown; identical to SEQ ID NO: 15264
  misc_feature (1)..( 3000): 2750-1469P.txt file - cDNA_ID_3096189; gDNA_ID_2926095; Annot_ID_196624

SEQ ID NO: 36448 - DNA, 3003 bp, Unknown; identical to SEQ ID NO: 20730
  misc_feature (1)..( 3003): 2750-1469P.txt file - cDNA_ID_3096224; gDNA_ID_1620808; Annot_ID_168930

SEQ ID NO: 36449 - DNA, 3003 bp, Unknown
  misc_feature (1)..( 3003): 2750-1469P.txt file - cDNA_ID_3096237; gDNA_ID_2926108; Annot_ID_196653
acgatatgctttcttcatcttcttctgatcaaatcaatcgcctcgctgtttccgtcgagggaccctacggccctagttccactgatttcctacggtaattcacttaaatcacaaacagagaagttcaacattctgtttcttccgacacaagtaacattgatgctctgtttttcttccaacacaagtaaaatgctctgtttttctttaagtgcagacatgaatctctggtgatggtgagtggagccagtggaattacaccgtttatctccatagtccgcgacctattctacatgagttcaacgcacaaatgtaaaatccccaagatgaccctgatctgcgcgttcaaaaactcttccgacctatccatgctcgacctaattctacccacctctggtctcaccaccgacatggcctcgtttgtagatatccagatcaaagccttcgtcacccgagaagagaaaacatcagtaaaagaatcaactcacaataggaatatcatcaaaacccgacatttcaaaccaaacgtctcagaccagcccatctcaccaatcctcgggcccaactcttggctctgtcttgcagccatcctctcttcttccttcatgatctttattgtcatcatcgcaatcatcacgagatatcacattcacccaatcgatcaaaactcggaaaagtacacttgggcttataaatcgctcatttaccttgtatcaatctccattaccgtggtgactacttctacggctgctatgttgtggaacaaaaaaaagtactatgcgaaaaatgaccaatatgtcgacaacttatctccggtgattatcgagagctcgccgcagcaattgatatcgcaatctaccgacattcattacggagagaggcctaaccttaacagtaagtctatttataacattttcatagagtaaaatgctgagttctaactctgtttattctattgtgtgaaacagagcttctagttggtttaaagggttcgagcgtgggaattcttgtgtgtggtccgaagaagatgagacaaaaggtagcgaagatctgttcttttggttctgctgagaatcttcactttgaatctattagttttagctggtgaattttaaattcagactgatgttttatcatagatgtttgggttacaaaagaactaggtggcttcgagagttcataactctaaacatgtcctagtactaatttatccgtctccggtctcctagtagactagtactaatattaaaatgtgaagcgatatatgagtcacatgttggcaggatttaaagtttgacagatctatatgcggtggatacgagttcggttagctgaaatttgtagaacaagcatttatgtcatgaacgtttctgaatggttttataatggtaattagtgaatggtttaagacattctttaggcagtcatgtagttttgtaatatcaaggaaaattggcttggctctgaatatgatttttttttctgaattggcttgttcgaatcctcaagatgattttttgaaatgtaaagttgcattttctgatataatttttttttgttgccttttataaataatcatcttttctttaacatttggttgccttttattaaaaatcatcttttctgattttttttggtcaactaatgtaacaccttttctttaacattttttttaaaaaaataaaacgcaaatgaagtcatggtaacccttttgactttcacaataccattcagtgacatctttcttacttaatattccgctgtcatgtcccactttggttaacatttgaggaatttcatcagtaaaaatcgaaaagatataaaggcatcaaaggagaaaccttaaaaagtcaaaatagagacacaagaagtgtttctttgtaggcttagatgagaagaagaaactaaggaaactgtattcctaaagtaaatactacttccttcattcctatgataatcaattattaaaagatatggagtcgcttaccaaatcataaaaccggtaacccaaatctaggaaattttattgtggaataaataacaaagcctttattttatttaaatagaacaagataaaacaccaaaaataatagctatgttctgaagtcttgaccaaactactgatacgggatctcacctagattacttacaatgtaggtgtaaaccgagtttttaaccaaactaaaacgaattaagcgacaattagttacggaagcttaaactctacatagattgatagattaaaaaacccttgaacaaaaaaagaatccaaattcagcttgaagtagattcaaccaaaccgaaataattttttaaaaatatgaattttgtttcagtttgaatttcatttgattttccaaaaattcacaaaccaaaccaaaaactgaatatcacttgtagctgtacctataaattattagagcattaaatctatctcaccaccgccaaactcaacgtgtgttaatcttttaaccctaaacttctaaattaaaaaatagacgacttttttacttatttcttcttcttccccaccatctttttttgtgctctatgttctcaactaatctcatttaattcaccacatacagctgcatcaaacatatatatatatgcatgtatttatgtacttatacacatacatacatatgatcatttaatgaaattcattaaatgaaactattcctttcgctgcaaaattaggtaccagtaaagcataaacaccactttaccacttcttgaattccaaatctgaaagctctgtcattatatatgtataaaccaatttaaacatatacatgtctcaccgataacaacggaggttcattaatgagggtttgattatgatacttacgagtgacagattgtgaatatcaaagagaagcttcttcctcccttttttctccctataaatttccgtagaaaaatcattcattcgcatctcttctcttctcaaaaatcaccacatttctttacttctctgggaaacaataataaaagagctacatg

SEQ ID NO: 36450 - DNA, 3003 bp, Unknown
  misc_feature (1)..( 3003): 2750-1469P.txt file - cDNA_ID_3096242; gDNA_ID_2926108; Annot_ID_196652
cataagtttctccttcatcgctctccctggtttctacatcttcttagtcgatcgtttccttcggtttcttcagtcacgtgaaaatgttcgcttgctcgctgctcggattcttccttccgacactatggagctcactttctccaaaaactctagtgagtaccttttgtccaattggctaattgtatatgaaaagttcacccttactggatattgatctaattctaaactattctttttgttttatagagttggtttatagcccgacgagcataatgtttgtgaacataccgagcatttcaaagctgcaatggcatccgtttacgataacttccagtagcaaactcgaaccagagaagctaagtattgttatcaagaaagaaggcaaatggtcaactaagcttcaccagaggctttcttcttctgatcagatcgaccgacttgctgtttctgtagaaggtccttacggccctgcttccgccgatttcttaaggtgatttgtttatatacactttctcaatcacctatctaataactttatattcagatttgttaagagtcctggaaacttgattgacttgcatttcaagaaacattgatttcatactttttttttttttgctttctaggcatgaagctttggttatggtgtgcggaggaagcgggataactccgtttatctctgttattcgtgatttgatcgccacaagccaaaaggaaacatgcaaaatcccaaaaataactctcatttgtgcgtttaagaagtcttcagagatctccatgctcgatcttgtcttgccattatccggtcttgagactgaactatcctccgacattaacatcaaaatcgaagccttcataacccgagataatgatgcaggagatgaagcaaaagctgggaaaatcaaaactctctggttcaaaccaagtctttcagaccaatccatctcatcaatcctcggaccaaactcatggctttggctcggtgcaattctcgcatcttcgttcttgatcttcatgataattattggtatcatcactaggtattacatttacccgatcgaccacaacaccaacaagatctattctttgacttcaaaaaccatcatatatatcttggtcatctccgtgagcataatggcgacttgtagtgcggctatgttgtggaacaagaagaagtatggtaaagttgaaagtaaacaggtccaaaacgtcgaccgtccatctccaacatcttctcctacctcatcatggggttacaattccttgagagaaatcgaaagtacgccacaagaatcgctcgtgcaacgcaccaatctgcattttggagaaagacctaatctcaagagtaatatatacatgaccttcttttaatttctctatctctatcttatatataaggaattgttattctaattatgttttttgttggtttatatgagcagaacttctacttgatgtggaaggttcgagtgtgggagttcttgtttgtggtcctaagaagatgagacaaaaggttgcggaaatatgttcctctggtttggctgagaatcttcattttgaatctatcagtttcagctggtgattgcgtatataactctgttttcactatgtgttgtgcaatttgcttgagttgcaagttaataaggtggccctgtgatttgacctatctttgtgtgctttacattgacttttcctgttttttgtttttctttatcctcttctaggaatattcagtgttaaaaaaaaaacttcctttcaaaagttccggaatatcctttttttgtttgtaacacaaggcatacagcttttgtaaattgtaaatgttgaaatataatactcatgttgggtcatatatatgattttatctctatttttcagttaaacatacttacgaaaaagtcaatttgctcgaaacgagttgggttatacacagatgtgagctacatgtaaattaatatttggatctatcagaatttatctgtcaaatacagaaatactatcttgcagatagcacaaattacctaattgttggttaaaaagacaagaagaagttacgtgaacataaaaaaaaaaaaccgtttcaattgacatgtcactaattattcgatttaagtaagaggaagtacaagaacaaattaaagaactcacctatatatacatccgtttatttaaaatctgtgttattgtgtaactctgctacaatttagtgggtaactaacaaaaaatatcatggttaaatttggtgttctgaggaaatttaatgtaaaattcataaatttacgtgtgattttttgataattgattattcaaaactcagtacaaggaataaaatcgaaaaagaaaaaaaaacgtaaagataatagaaatatacgtctacacgcatcggcgtacaaactcaatgattctgctttccgttgaatttgctaattttaagcccaaaactatagaattgcgttttcaatgtgaaatgaggaaattacacactttacctagactcttccacgagtcaagcctgttttgtaagtcagcagtaaaatgaagctgtaaatcacaaattaattataaaaagattcaattataatttctctggataatattattattttaaaataataataaaataatttcttattggtttatacaccagaccatattttcatataaatttaattattattttaagaaaataatattatgcatagaaaaatgacttaaatatcatttcttttatataagagtatattattttatatatatactctatatctttaaacatctcaagttctcaacatatttaattattggatcttttctgcatttagcataaaactactaattacattggtgtaattagcatatatatatgctggaaaaaaatatctttctatatatatgctggaaacaaatatagcacatatatatgggttttgtaaaattcattgcaaactccatttcgctttgttttttcttctcatttcttggaagttcatctctggtgccatg

SEQ ID NO: 36451 - DNA, 3003 bp, Unknown; identical to SEQ ID NO: 36450
  misc_feature (1)..( 3003): 2750-1469P.txt file - cDNA_ID_3096242; gDNA_ID_2926108; Annot_ID_138555

SEQ ID NO: 36452 - DNA, 1019 bp, Unknown; identical to SEQ ID NO: 15270
  misc_feature (1)..( 1019): 2750-1469P.txt file - cDNA_ID_3096248; gDNA_ID_2926108; Annot_ID_196651

SEQ ID NO: 36453 - DNA, 2231 bp, Unknown; identical to SEQ ID NO: 15272
  misc_feature (1)..( 2231): 2750-1469P.txt file - cDNA_ID_3096257; gDNA_ID_2926109; Annot_ID_196658
  misc_feature (569)..(569): n is a, c, g, or t
  misc_feature (1467)..(1467): n is a, c, g, or t
  misc_feature (1480)..(1480): n is a, c, g, or t
  misc_feature (1497)..(1497): n is a, c, g, or t
  misc_feature (1501)..(1501): n is a, c, g, or t
  misc_feature (1529)..(1529): n is a, c, g, or t
  misc_feature (1562)..(1562): n is a, c, g, or t
  misc_feature (1565)..(1565): n is a, c, g, or t
  misc_feature (1580)..(1580): n is a, c, g, or t
  misc_feature (1589)..(1589): n is a, c, g, or t
  misc_feature (1614)..(1614): n is a, c, g, or t
  misc_feature (1622)..(1622): n is a, c, g, or t
  misc_feature (1639)..(1639): n is a, c, g, or t
  misc_feature (1655)..(1655): n is a, c, g, or t
  misc_feature (1687)..(1687): n is a, c, g, or t
  misc_feature (1702)..(1702): n is a, c, g, or t
  misc_feature (1706)..(1706): n is a, c, g, or t
  misc_feature (1709)..(1709): n is a, c, g, or t
  misc_feature (1753)..(1753): n is a, c, g, or t
  misc_feature (1797)..(1797): n is a, c, g, or t
  misc_feature (1814)..(1814): n is a, c, g, or t

SEQ ID NO: 36454 - DNA, 582 bp, Unknown; identical to SEQ ID NO: 15274
  misc_feature (1)..( 582): 2750-1469P.txt file - cDNA_ID_3096271; gDNA_ID_2926110; Annot_ID_196664

SEQ ID NO: 36455 - DNA, 3000 bp, Unknown; identical to SEQ ID NO: 15273
  misc_feature (1)..( 3000): 2750-1469P.txt file - cDNA_ID_3096275; gDNA_ID_2926110; Annot_ID_196663

SEQ ID NO: 36456 - DNA, 3003 bp, Unknown
  misc_feature (1)..( 3003): 2750-1469P.txt file - cDNA_ID_3096285; gDNA_ID_2926111; Annot_ID_196670
aagcaaaaaaccgagttatggtttatcgaatgagatggtgcgattctgtataatcatcttaggggtcaaacctcaaactgtttttcaatgtctgtctccccaccgccatcaagtttcttcacagtgactgaggatttttcatcgagacaagctctgtaaaggcatccacgaccacctcggctcaacacattactatcactaaacttgtttgttgcagattccagcaattgatattcatacacagggatggttcctttcctcacagaatcaatcttgtgtacagtcggtttcgtggttacactcttcaccgaatcttcagataaccaaagcaccaaaataagccataacaaaaccaaggaaattacaaaaatataaagagatagaattgaataccggatttgcgtttgataccggtgaagctgttcttcatattcctgtacctccatagcaagagatacacaaggaacatgactgtgacacagagcagagatgatgagactataagagcaattagaatcttcttgttcaagtcctcgcgaagcaccactttaacaatgggaggtcctgagcaaagttaaatttaaataagggataaaattcaatttatttgcttaattatcggaaagttttcagttttaattgggaaacagtatcaattcaactaaattcaattcctttatgaaagtatgagcaaacacatttcgacaatttcaagaactagtaagacccaatcaccaaatattgatatttttgttcttaggggcaacatggagaaaatttggaaaggggaaactaataagtacctggggattgagctcccattcgtggagaagcctgagaaatggggatttcgggggaagcaccagaaacgtagacaacggaagattcttgtgatttagtagcagtggagaagaagaagaaaccaagaagaacccaaatgggtagcaaatgacgaaggagacacatatttaattttgttgtctggtatcaacaaatatgcagagaaaagacaaaaagagagagagagagagataaagagtacgaagctgcttcgtgttctatctaattcttttatggagatggtgaaaaatgctagagattatctttgtctggaggagatgtagacaagagacactgttggagttgggaaacagagagagagaaggacaaaggttttaggtgtttggtcttcatgtggcagttatgaaaaggtggacaaaaaggctaataaagcagcaaagagtgcctaatcccagacgtggtgataagacgtggagttgtggagagagtgaggaggaggatgtgtagttagcaaaacagtttcttcccattagccaatctttaaaattttgattttctctctaccattacaacaatttaacatcccaatgttagagatgatgctgatactactagttgacaaatagaattaaaccttttatacgtaaagctaacagatttttatctattaattaaagccttgttcctttttctttaacgtatagttatactatatctttattaaattagaaaaatcaagaatacaaagaaagtacataaagcaatcaaagtacaatccaattacataaatggtgtttttaatgttccttcatattcataagtttagtcttttaatttccaagaaaaaaaaaatacatcttgtcgtaaaagaaattattatttttaatcagattaataaaatggtgtgatatatggaaagaatatggattgagaatggattgtgtaatctctcgatagagttgtttgcatcgaggcacagtaatccaaatgattcgattgggtcactccccaaattcaattcatgcggatttagtgaacaaaacgacaagtcatggtttaatagagtgcatccaagaattttattctttttattttaaaaaaatacagacgacaaaggtccaaaagtttgagcattattcatgtgaactctctatgtctgtcctcttcaaactttaattaccgacacaagtggtcactgactagtcacaactgtacagttgaataacaactagacttattgagggccttacaagaataatgagccttttatatcttattgggtcaatacaagcccagttttgaaattttgaaatgaatcagtcgttaggcccaatatctgttggaaaaacaaatatagttattgggccattaaggaataaaaagccacaacaagcccagtttcgaaattttaaaattggataaggttaaaagccagctgccagcgaaattgaaggatgatatatagttagttacatactgtgtttgttgttagtttgatttgagctaatcttcatcaaatccatcatccatggatttacctgaagaatgttgggaattaatctgcaaagctatcgatgaagacgattatcgattcctggaatctgtttcactcgtatcaaccttgttcctctcaatcaccaatcgcgttcgctctactttcgtcgtcaccgatcgagctgttcctttactcaatcgtcatctccttcgattccgcaacttgaagcgaatcaggttctctgatttcactcaggatctcaattcgattcttctccaggtttctcgttccggtttggatttcgaatcggtagatgtctcgcaaacgcgctatttcccagattttgagatgaagaatgtcaaggaattgaaatgttatggagttggaggttttagtgatagcgatctggtttccatcggagtgaattttccgttacaaaattagagtagctctcatgtcagtattggtggtaattaatgccattctccgtttctttttctaatctccgagtcgaccctgagtataaagtatttttaccaatttcatttcaattttattgtataatcggttttatagaaaaaaatgtgattcattaatttaagttttaggtcacacagccaataagagttaaaagagtaattaattaaggattttaaaaactaagaaaatgaggtgaaaacttaaaacaaaacagaataacaacaatg

SEQ ID NO: 36457 - DNA, 3003 bp, Unknown
  misc_feature (1)..( 3003): 2750-1469P.txt file - cDNA_ID_3096331; gDNA_ID_2926114; Annot_ID_196687
ttactaaaatcatagaaagtaaataaattataaccaagtgctaaagagtttttataatcttgttattagttattctataatttagtgaagtttctcaaacaatatatctatttgatgattttttcatgattttattttgtgaagaaaaatgtataaaattataaactaataacacaatagtttaattcattaacaatcatacattttttttaattaaacaacacaaaaaatttattgactttattaaattttgattctaataaaatcagatttatgaaaattttaaaagacttttaatttacaaatcaaaaactaataatacattttaacagaaattaataaagttttgattgaataacaagagtcaaaagatctactaaagtttttaaaacaatatttcaatcacaaaccattttaggtgattttatttattttaatataatttctttctataggcagtagtgtggaccataaaattactgttaatttacttcctaaaaaggattatttaattgcaagattctaaactggattattcccacaatacacctttgtaaataaaaaccattaatccttcacaaatacagagtcgtgaacttaacgtctctctctattcctctgcttctctctttctccctgtgaaaaaatggactcggtggctctctactgcaccgctggtctcattgccggcgccgtctactggttcatatgcgtcctaggtccagcagaacgaaaaggcaaacgagcctctgatctctccggcggctcaatctccgcagaaaaagtcaaagacaactataaccaatactggtctttcttccgcaaaccaaaagagatcgaatcagccgagaaagtaacactgcttcgtcgacacgttctcacaatcttgtcactgatatctacgagtggggatggggacaatctttccatttctctcctcatgtccctggaaaatccgacaaagacgccacaagaatccacgaagaaatggccgtcgatctcatcaaagtgaaaccgggacaaaagattcttgacgctggttgcggcgtgggtgggccgatgagagccatcgcgtcccattccaaggcccaagtcactggaatcactatcaacgagtaccaagtgcaacgagccaagcttcacaacaagaaagctggacttgattctctctgcaacgtcgtttgtggtaactttttaaagatgccgttcgatgaaaacacgtttgacggagcttactcgatcgaagctacgtgtcacgctcctaagctcgaagaagtatactcggagatcttcagagtgatgaaaccaggatctttgttcgtgtcctacgaatgggtcaccactgaaaaatacagagacgatgacgaagaacacaaggacgtgattcaagggatcgagagaggagacgcacttcctggactaagaagctacgctgatatagccgtgacggcgaagaaagttgggtttgaggtagtgaaggagaaagatttggctaaaccaccgtctaaaccgtggtggaaccggttaaagatgggaaggattgcttattggagaaaccatgttgtggttgtgattctttctgctattggggttgctcctaaaggaactgttgatgttcataagatgttgtttaagactgctgattatttgaccagaggtggtgagactggaatcttctctccgatgcatatcattctctgtagaaaaccagagaaagcttctgaatgaatgattgagaatcttcttccttgttctcgtttttcttcttctttctttctaagttcatgttttgccccttaagaatctctttgtcgtcgtattaatgttatcactttgttgtttattgtatttttttttttcaatttgatttgtttaaattgatgatggatcactggaaattagtttttcgctcttcttaaatagtttctgaaagaattagccgggaaattctattggagtgatcctttacctttttaaaattttgtagagtttacaagtctctgtttagttttaatttctaagatcaaactcggaataaaccggattagcacgtctatagagttgcataaacttttagtatcatcaatgagggtagtttggtaagtccttaggtgtcacattgtgtctgtagtagtgagtcgggagtggtcgtgtgggattttgtgggctgtccgataatgcatatgttattgtcgtcaactgtctgatatattaatctatgtatcttttaaagatttgattttgatttattttaggcttatggtttgtcgcattgcggtagtgggtagcagcgtggtcgcacgaactccggcttaccttagaaaacgatattttatttagttatttagtttttttttttccaatttgttttgtgcattactaaaaagattgtgtcatttgtgtgtaaaagtttactaaaacactgggtcatttctatagtgggcttttataatgatgggcttaaggccaatttttattggtttacctcacttccagttccaccgggagtggatatatgcttatattcgtacgtgacatcaacaataatacgcgtatacatgtgtaagtcaatggaccaatttgggtcgaagctgtgaaaattgtcccaacttatggagagcttgcggaaatctttttggttcctttttggccaatacatttccgcttaccagttggaaaggaacccaacatggccgaattttaaccaacgggtcaaattaggccttacttggattgctgggtggaatttttcaagaattgccaacaactttgaacaaaaattaactttgaatttgcttttagaaacaggcaattctcacccaaggttcaacatattccctttttatatccccacggaaaaaaaatctaattcaacagtgaacacaatcccacacaagtttaaacaagtggacataaaagtcttggacccattttaaaacatctatccacattaaatcattcactgatctctaaccaatcccacacacactaccacaaacaatg

SEQ ID NO: 36458 - DNA, 3003 bp, Unknown
  misc_feature (1)..( 3003): 2750-1469P.txt file - cDNA_ID_3096333; gDNA_ID_2926114; Annot_ID_196686
gctcaaaacctaagacattatccaccatcagtagatccacttccgccaccagggcgccacctaagctcgctttgaagtcctctttgaaggatttcggtgtcatcgcagtggcaacagcagcttcgatcgttttagctggaaatgcgatggccatggaggttcttttaggatccgacgacggttcccttgctttcgtaccatctgaattcacggtggctaaaggagagaagatcgtgttcaagaacaacgcagggttcccacataacgtggtgttcgacgaagacgagatccctagtggtgtggacgcaagcaagatctcgatggatgagacagcgcttctaaatggtgcaggggagacttacgaggttactttgacagagccaggctcttacggtttctattgtgcgccgcaccagggtgctggtatggttgggaaactcaccgtcaagtaaattgtctagatattctcttgttcgagtaggagcttacatattcatgatttataaatctaatttggaagagaatgttggattgataaagaggatcatataatgtttactatcataagttactggtttcagtggctcttttgtacattttaagtcacggtaatacaatccgataacctttctctgtgtccgtgtaaagagcttttagtttgaataaagtttgttttaggtgtatctgcgttgggtttacttgccttactttggtcccaacgtttgagtcttttagaggcccagcacgcctatatatcacaaattgggcctaacgactcatgttttttggggaaatataggaaacaggtttagctaggtcttacgcaaccactactgacccacccaaaaaaattgcattaacaaatcacgagaaagagagaatatcacgtgatgaaatcattattgattttaaatagcaaaaatgaagacggatcatggatccattaccaagggtcaggcagggaaaaatgtctatttcggtcgcctggtttgatttgatcttttgctgaaggaacagggaaagagacaaataacacagatcagcacactcatatatagctgatatgtaaccgagactctctttctcgtagagagttccacgttgaatatgattcccatatcttgacaagtctagttgcaattctgaattaattaatatgaatagtttacattggtaatgcgaagaaaaagctctcaaacagttgtcacattttgtgttctagagaaaagcacaaagtgattattaacatatttgaaggtttcatctctcttatctgtgtgtatatcagttatatataatgtttaaaatgtataaatcatgatttcgacaagcttcaaaaatagtttcttcgaatataacagctggagatggattgtcgtatgtgcattatggtctacagttggaattattagagtaaattatatatcgggttcataaaatacgataaaattggaccaatctataacgaatttgtcctcactcacacattaattatgtcgtgtgagcaaatagatcacgtgagtgatgttataaaaacaagctgtaatatggagtgatcaagattcgtgttaacatagagacagattgctaacacatcgtagacatgtgatacgatcatatgagtcatgcatgtgatacgaccaatttaccaaaaacaaaattttaatttaaacaataattgggatacctaaaggaccagctaattaattagttattaaatgagctcacggatcctggacaaaagtgtaacgattgtagtgcctttttttccttggtaatcagagttttatcattaggatataggttaatccgtatcaagaaaagtatcctacctaaacctaacgcattcgagaccataacaaaaaatcaacgtcacggacttatacccggaccgagagcttcaagccttcaaacatttcattggctatatttttccttaattcatgattcaatgttatactacacagtctcaattctatgaaaacaaatctgaagtcgtacggagagcgagagatacatacgattacagtatatgaaaaaatgttaggtgactttcacattaaaaatatattataaggagctggcctgaccctacaacgtggaaagagtgaaatgcttgtagaacttattaaggatatcacaaaaagaaaaatctctcagatatatgagttcaagatcgcaaaataatgatctcatggcatttatattcacatgtactcatgtagatctggatctataaataattgtagtttttcattgtgataactgatttgagaaaacaaatataaacgcaagaaaaattgtgatgttacaaggtgttattggattataatttaaaagtaattttgatgcctttactaaaatcatagaaagtaaataaattataaccaagtgctaaagagtttttataatcttgttattagttattctataatttagtgaagtttctcaaacaatatatctatttgatgattttttcatgattttattttgtgaagaaaaatgtataaaattataaactaataacacaatagtttaattcattaacaatcatacattttttttaattaaacaacacaaaaaatttattgactttattaaattttgattctaataaaatcagatttatgaaaattttaaaagacttttaatttacaaatcaaaaactaataatacattttaacagaaattaataaagttttgattgaataacaagagtcaaaagatctactaaagtttttaaaacaatatttcaatcacaaaccattttaggtgattttatttattttaatataatttctttctataggcagtagtgtggaccataaaattactgttaatttacttcctaaaaaggattatttaattgcaagattctaaactggattattcccacaatacacctttgtaaataaaaaccattaatccttcacaaatacagagtcgtgaacttaacgtctctctctattcctctgcttctctctttctccctgtgaaaaaatg

SEQ ID NO: 36459 - DNA, 3000 bp, Unknown
  misc_feature (1)..( 3000): 2750-1469P.txt file - cDNA_ID_3096352; gDNA_ID_2926114; Annot_ID_196682
ggataacaaatcaattcattagtgtcaccttacaacacaaaaatatactaatttgattaaaaagttacaaaaatggtgggattaaccaacaataacaaaaacaatgttcaaaatcttcaaactaagcttccatcattttgcttagagactatgacttgctctttcaatcaattttcttatgaacaagaacttggtctgtgttttgtccacagctgccaaagtttaggtctggatagtttctatagttcaaggaatgtaaccaaagagccatatttccgtattttcgctctgtagcgccgatatgagaatagatatgcttcaatttgaatgcttcagcttcttctttgtatgcttccatggacacttcttcatgactgtcttcaaagtttctgttataagacgtgaagaagcattcgtccagataaagtccaacttctggcgccattggtacagttatattcacatccctggttacataatttccgaactgagtatcaaaacaaacaaaactatagacattgcgaagcttcaaaccaagaaaaaggagaagcttacttgctgaaagcactttggataagtgattcagaagcacaattccgcatgattgcaacagcaagacccatcatcttccgaatctgatgaagcataaagcttttgcctaagacttcacacttgataaagtcaatcccatcaagattaatcacagtattagcagtgaaggagatgatttgacgattcgcagtcggaacatctgcttttgttcttgtagtgaagttatggaaattatatgatccaacataacaacttagtattctactgaacctttccttttccttttcaccataacaaaacttgctctttaccttagtctctgatgaatttgtattcaatttacaactgtcttcttgtatcctacctacttcaacatctactgagcataagccagctaaattagaactcaaagcttcaatcttgatgtcacttcttaatgcactagagttgttcgacgaaatgtctgactgaaaatccaatgatttagtcccaaagttggtacctttccatttacccacaagacctgggaggaatcttacgacctctctctgagcactcaaagcacttaacatattcctctcccggacccaaactagccattactgtttctctatcacgatgcgagattggatcaagagcaaacactggaagcagatacacataccttcttcgatcgcaaaacttcttggagctaaacgacggcgttacatgcttgtaaccgaagattctaatctgattagggagatttgaattgagacgattcacgaatccaagtggatcaacgataaagcgacctgaaactacttgtccaacagcactaactcctttatctgtccgtgcagatcgtgcaaaatcgtatagttttggcttgcctctaatgactccggtacagctccggcatgaaacaaagcttcttcgagctcgcctttcaatggttttcgcgccgggattcttttgcattccttggtatcctacaccacaaaacgcgaagattatagcaactttttgaggctccgtgacacctccgtcgcaggacaagtctatttcctcatcggtggtagttgtcaacatattgagctacttctgatctgattctcaatcaggaacctcgaaccgggggaaatctctcggttttcaaactcctgagcctccattatagtaacaagagttcatcgaactctctattttccagctttcctctgcaacaacgttaatggctaccgcacaaaagtcgaaacccttgaagacgactgaggtatgcttctctacgacggcgtttttgatatcagaccgctctttgaactgggcctatgaattttgttttatatatgggcttattagtctcaagcccaaatgtttctcttataattcaagtcaaatttgaaaaagtcaactatatccattgagcacacatctttggaaatacagtctgttctagtgggcaaaagaaagagagaaaattatagccgttctaattgtatcaaagtatgaaactttcaaatctccttgaggtataggcgttgttgtcttgctgatggtacacgcgtcgtatgaaaaagcgtacacaaatcttatttcaattgaagttatcgactttattctaacagtcaacgcgtgtctagatttttccttcaggtggacggagaaagaaaaaaaaaaactacttaggcaaattcatgaatcttcgctttctcgattgagatttaaataaccctcacataatccaaaagagagaaaaatagacatagctctttaatctctgagatcctctgctcaagtcgctttacagcattcactacttcacggaaagaaggtattgtaatcctataataggctcatctctcgatgaaataccgtagaatcgaatcgacactttgtgtttgtgggtatagtccaatttgctctctttaattcttcttcttcattgtaacatttataaaaggtttgttttttgtgtggccgaaagttgtttgacacttgattctgattcgtttgggatcagaaactgtttaatcacttcacgttctctcttcggctctatatatatatatgtaggattgtttctttaagggacttgtgtgatttagcttcttcgtttccttggtatttgatcttcttttatgtgtgtgatcttgttaaacagaattttggttagcctataatcaatctcaaattggaaacagaattttgtttttgtttcatttgatctgtcatgaaacaaatgttgctcttcactgatttttttatcttagtggaaatgtttggaatttaggatcttttgattaattagtttgcctgcttcagaacacatactggtttgtgtcctcaatacgcttattacttattgttttggatctctctgaaatggtatcattctgtatgcaggtaatcgttctgttttttcgttgattactgtttgaggttttcattgaatcttgtctcgacatg

SEQ ID NO: 36460 - DNA, 389 bp, Unknown
  misc_feature (1)..( 389): 2750-1469P.txt file - cDNA_ID_3096356; gDNA_ID_2936587; Annot_ID_143893
ttcactgagaagcactaattgcgaaggtgttgttagaggtgggtttagtgtatgcttattcgttctttaggtttagatatcattctacttgagtagatgcttgatggttttggcttctctggtttcattagttttgtgtcaattttgagaatgctatgtctaattcaattttgagaatgctatgactaattcaatttgagaaagtgcatgtagttcaattttaaactatctttctctctggggaaaacagattctgaggcttagttatgttcataaattgctttgagtaaacatttttcatgcagttgttatagttcagttacttgtgtatattgaccttgtttactgtggtcaggtattttgctgcatctacgcttgtcctgataatg

SEQ ID NO: 36461 - DNA, 3003 bp, Unknown
  misc_feature (1)..( 3003): 2750-1469P.txt file - cDNA_ID_3096360; gDNA_ID_2936587; Annot_ID_143892
cttgagtccaattgcattcaactgggtcgaagccaatacttggtcttcagtttagttacctgctagtaacaatctcttccataattcccatatatctcttataaaagttatgtttccacaaatctacagaaactgttgtatgctcgtcataataaaagggtatatatgatatgtatccagggtttattctttacttaaaactggtccaaacaaaaatgtttggtaataatttcaaattcttataataattgttattatgattcttgattggtttgagttgtggataaaattttttgagtacttaattcattcaattttcactagacatgtttatatttttaatttatattgaagtttgccagattaattaaggaaacacaaacgactaaaaaaaaaaaaaaaaaacacaaacgactacgttaggtgtgaaaacaaaattgaatttgtacgtctctaacgaccaaatgactatcaaatgacaggcaaacagttttcttaacggaaaaaatacagtaaaaataagaaaaaaccgtttgatcatgtttataaaaaattgaagtgggctaattttgtcaaattgatttagctaatgaaacgggcctaagtgggtctattttaagcaagtatacaaaagcttcattaccggaagcccatattctcgccaatcacatataagaggccactatcgtaagcccatatattatctaagaggccactgtggtctgtggggtgatttaaattccatctagggttttgactattgtgtatgtcacctatctttcctctcgcgtctctcccctttactcaggttagctgcttatatccggctgatcgctggatataatttgacttttaactcttctcgtttgtttcgttggtgattgagtttgaaaagttgtgttgtgccgttgttacagaaatggcgaaatcgaagaatcacacggcgcacaatcagtctgccaaggcgcataagaacggaatcaagaagccaaggagacaccgtcacacaccaaccagaggagtaagagtctctgttacattttaaacctataaacgattacagattctgatgttacattttaaagctataaacaattttcagattcggatgttaccttccaagtttgatatttaatctatttttgtgaaatgttgcagatggatcctaaattcctaagaaaccagaggtatgcaaggaagcacaacgtcaagagtggcgagaatgctggtgtcgaagagtagatcttttgatcgtctgattgacagtttaagttttttttatgaatttcacttgtttagacaaaggaaccaatgttctacaatcagggattatgtctatccagattctcttatatattttgcatgttacttgatttgatgcaattctttcacttgttcgtttatgttcatgtagacctataatctgaaagctgaacctgatttacatatataggtttgtctggcctttacttgaatcaatctggttttattcaccgatgcctgttacttttctagctttcacatttcatgaaaactccaaatggttctattatcatttgaaaataaccagatttgagtgtatatctattgccaatacgtcaaagacaaaatcttattttgcattattgattggaaatttgggtagacgccaacaatggtcttaaattggtttaatatacttgcaacacaatttgtcaaattgtaaaattatatgattttttttcgttctggtgatatgaaagtaaagtgaaaataatttgataaagtggtgatgacgaaagaacccttgtttaagcacacgaaggttacaaagctcgtgtcgtggtttcgattcctttgtctcgccttttagttgcacttcggatagatctaccaactacctaatgccacgtggttatttctttgaccacataagcctatacacttcagagcatcactaatctcacggcaacaatgatcaaattcccacctggcgcattttcattggatttaactttcttttacacagacaaaacatttctgcttgtcatttcttctacgtcacaggctgtcgtttttaaagagagcgaaccgactcgcggcaaaggagcgcgtgggtgtcgctcgatggccttttagtgaatacaaagggcaagtaagggtattaatggaatttagttcataacgtatgaagaattatattatttttctgctgctttaattttttttttctttttttttttctcctctctcttctctcttctttcgcgtttcgaaggttggggaaagctttcgcagaagaaaataaaagctagagagagaatgtcaatgtttttttgatgctccgtctggcaattagggtttcttttttctttgatttcgtccccttcgagaactgaatctcccgcctatatcgacgccgtctaattcctatcatttctcgttgctccaaaaccctaactttactaccgtcggtcattattttcactttctcggctcgatttggtgttggaggttggtaatcagttatgggcgctccggaaaagtctcaatctaataccaattcgatgcaggtgtctctctagctctagctttgttttcctttattggctcacttgattcgagctgggtttgtcttgattagtataatttattgtagagcttctgtattcatattaaatcactcctgcttctgagctgtgttatttattgatgaaattcatggtgaccacaattcaataggtatctcagttttaagagcacacagaagatgagatttgtaatttgactagtttctatggttcacttgttgtgtattagtttcagtggggtttagcgtagggcgtagcgtagttctctagtttctgtgggtgtttgtcctcttttgaacagtgtaccatagccgataatttagagtagctattcgaccatgtggtagaccttacttcttcagataaaacggatctcaattattgagacactagaaagttgcgttgttttgacgaattgtgttgaattgagatg

SEQ ID NO: 36462 - DNA, 3003 bp, Unknown; identical to SEQ ID NO: 27395
  misc_feature (1)..( 3003): 2750-1469P.txt file - cDNA_ID_3096365; gDNA_ID_2936587; Annot_ID_143891

SEQ ID NO: 36463 - DNA, 3003 bp, Unknown; identical to SEQ ID NO: 27575
  misc_feature (1)..( 3003): 2750-1469P.txt file - cDNA_ID_3096369; gDNA_ID_2936587; Annot_ID_195144

SEQ ID NO: 36464 - DNA, 3000 bp, Unknown
  misc_feature (1)..( 3000): 2750-1469P.txt file - cDNA_ID_3096378; gDNA_ID_2936587; Annot_ID_143886
cttttatgatttttattttagtttgaggcagcttgggctctaacaaacattgcatctggaacatcggatcacactaaggttgtaatcgatcacaatgctgttccaatctttgttcagcttcttgcttcccctagcgatgatgttcgtgaacaggtatggaacttctgatgactacagaatgtcttctcatttattatgagagattatgcaattgaaaattttgtgaaaccctgatcttaagatttcgctctaacctgcaggctgtatgggctttgggtaacgttgctggtgattcaccacggtgccgtgatcttgttcttggatgtggggcactgcttccgctgctcaatcagcttaatgagcatgctaaattgtccatgcttcgaaatgccacttggaccttgtcaaacttctgtcgtggcaagcctcagcctcactttgaccaggtctatttttttcccctccaagcttgtttcgtcaatgtttatgtctagtattcttctaacatatgaagcatgtttaacaggtcaaacctgctcttcccgcccttgaacgactaattcattcagatgatgaagaagtcttgacagatgcctgttgggctctttcttacctctctgatgggaccaatgacaaaatccagactgtcatccaggccggtgttgtcccaaaacttgttgaacttctcctgtcagtaccattttataattcccttatttcatgtccacttcacacatttgttgacaaataacttgataccttgctcttgatttttagccatcattctccatctgtgctaattcctgctcttcgcactgttggaaatatagttactggagatgatatacaaacacaggtatggatctaaatcctgtctattgaatttctcacagtatttcggttttgcacattgtatatgatagtatatatttttcctactatgccaaagaatatctttgtggttatgcaattctttggcctttaggaataggtctgaagataccactagaacttttcattaattgaaccgatagcaaaaacatgtcgaagttagtgatataccatgcatatcatctaatccaagactggtaattgcgatgaggtgttgttcaaatgtatggcaccctgttgctattattcatatccaacattttatgtgaaaaatgggagtattgaatgcttatcatgagattctccctctgttgccactctgtccatattagcagataggatgcagtgccttttttgctatatattgcttgtgtttgagttttgttacaattaattcttgttttaaagtttaaaccaacaacatgcacaaattttttgcttggtgaaatttggtttttcatgagtttagcaaaggtgatttttctatatctgaaatagtttacatcgttttacttggaaatctgattttacttcttctccagtgcgtgatcaatagtggtgctctaccttgtcttgccaacctgctcactcaaaaccataagaaaagcataaagaaggaagcttgctggacgatttcaaacatcacagcaggcaacaaagatcagatccaggtaggcaattagtactgtttcatcatatgttttgtaccgtttcccatccagacttctatacctattcattaattgtgttgtttttcccctgatggttgcagacggtagttgaggctaatttgatttccccgttggtgagtctgcttcaaaatgctgaatttgacattaagaaggaagctgcatgggcaatttcaaatgcaacttcaggtggttctcatgatcaaataaagtatgtcactgtcttttttgcgttcctctaacttccagtttcttctctcatatatatactttgtgtatatatatattgatgttctgttcccgttggttatacagatacctggtggagcaagggtgcataaaaccattatgcgatctcctggtttgcccagatccaagaatcataactgtctgccttgaaggattggaaaacattttgaaggtgggagaggcagagaagaacttgggtcacacaggagacatgaactattacgctcagctgattgatgatgcagaagggctagaaaagatcgagaaccttcagagccatgacaacaatgagatctatgagaaggctgttaaaattctggagacatactggcttgaagaggaagatgatgagacacagcaacctccaggtgttgatggttctcaggctgggttccagtttggagggaatcaagctccagtaccatccggaggattcaacttcagctgaaggtaaataaaagtaaaaattcttaaatttctaacaacgtctcttgatgaaaacatgcaaaatctgatatttagatcaatataaacccacaggaatggaattggaagcttgcaacttgagaatggtgaaaggtcagagtcagtcagagtctagtttcactgccatggttatactccaggtctggtctggtctggtctcagaggtttgtaccgggtggtcggtttaaaagtacagcgtctgagaaagtgtttggttcattgtccagggctatttttttgaaatgactggtacaccggtcgtgagtcgacctttgtgttgtttttaaattttggagggttataaaaacttacagtggagtcttttgtttttgtgttgacaacagtttgtatgtcggttaaaaaattgaaaccataaaccctttattggtcttaatatgtttggtgtctgatttcctaaggaaaggtttttttttttttggtcaaacctaaggaagggtttatcttcgagttataaagactcgaatctttatttgaattatgaagtaaagtatacataaaacagcaataaattattatgaatttgactttacctgagcaagtaaattgtaaaaagacaagaactaatgaactattagtatatgtccagttcaattgccttatcgtctaaaacccctcaaaagctaaaactgaaatcattttgaagcagaaatcgatttccaaaatg

SEQ ID NO: 36465 - DNA, 3003 bp, Unknown
  misc_feature (1)..( 3003): 2750-1469P.txt file - cDNA_ID_3096391; gDNA_ID_2936587; Annot_ID_195138
ctacatgtcttaagttcttgttttgttgttgctatatatatcttggtttagtgctcacggctagttgcttgtcgtttaaagagaggaatcaatgcttggctattgtatccacacctgagcctctaaagagttaaacagacagattcttgtgtgacggaggatgatgcagtgatttattgcttcaagtgaacttgtactgatcgattggcagagtggtgatgggtcaaaaacattatactcagattcaacaatggcaaccggttggggtgatgatgaattgaaacattacaagaagtaagaaaaaaagggcaatgtcctggtcttagtggacaatgaccggataaaaaggttcgagataaatattaggatttaagaaacgaccacatcctttcccttatataaccgattctctcagtgtcccaacccttagctctcaaaatctgaaaaaacaaaaaaacgagacagtgatgaagtgaagatgtaataatatagtagtgtctatcaagttcttcgtgatttttgtgtttaccttccatctcacaatacgaaactagggtttagctctgctttcctgtctgtcatttttctcttcaaaagatctaacgagtttctttttgtggtcaaattgggccgcagcccgttttctttggaataatacttattggatcgaatattgttatttgtcaaaactatttttcatacagagttggaacaatactcagccctgtttgtttgattatttggcatttacatccaaatgatctatttagatgatgcatttgaataatgtttgtttgattatttagtattttatctaaatgatgcatttaaatgaatatttctttgtttgatcattttgtaattcatctacattctcattctaataaaaatgactaaaatacccattctataattttaacaaatgacaaatatttaacatcattaccaaatataattttaataaagaaatgattttacggttttggcggaaaaatatgattttacagttttggcgagaaatatgattttgtggttttggcggaaaatataattttacggttttggtggaaaaatatgataataaggttttggcggaaaaacatgattttgtagttttggcgggaaaaatacaattttacgattttggcgtgaaaatacgattttacggttttggcgggaaaatacaattttaggttttggcgggaaaaatatgattttacggttttggcgggaaaatacgattttgcggttttggcgggaaaatacgattttacggttttggcgggaaaatatgattttacggttttggcggaaaaaatatgattttgcggtttggtgggaaaatatgattttacggttttggcgagaaatatgattttgtgattttggcggaaaaacatgattttatggtttttgcgggaaaatatgattttgcggttttttggactaaatcatctccatccaaatggttcgatcaagttcatccaaatgagtttcacaaattagtctaaatttacaaagtcattcagatggaccatccaaatgattcatccaaatgatctgttaatttgtcaaaaacaaacatcatttttcatccagatgatctggatgaaaaaacaaactggaccttactatttgaaaataatactatagaattaatttaattttaattagacgaaattagaggacatgaaatgccaggctggcaaattaacgtatgattggagtgggacccatacccgccctgtcagtccacatgctccgctctactcgtcttcttcacatttactgcttccttcaatcttattctaaccatttcttctacatcttttatttttcaagtcgaatgttctatttcctattcagattatttttaaatttcattgtatctgagctttattttcttccgaaattttataatttccaatgattttctttataaaaaatcaactacataagtaattattggttcctaaaaacctatatagtagtatagattcaaaaaaaaaaaaaagggaacagatcataaaatttgcctaatctagtttttcaggacttaaaaagaatgttctcattagtaaatatgaattttcagattacttataaacatatgggtcttattttcccattagaatataagataaatatgtacattttattgactaatttagaataataatatttgaacggtgataaatctaaaagataagggaaaaacagtcagagacatatatgtaaacattttgaaaaattaatataaaaatcttaatttgagcacaaaaaatataattgaaacagaacataaaaacaaaaaaaaatatcaaacacatgccttgtctaaacaaaactacaataatattttcatattattattttgttggcaaggcacacagcttaaaacagccatattaacttatctcttggttttttcttcctcaccctctcgtcgtctcttctctctccaaagccgagaagatttgtcggcgataatacgttaccagatcccattaatcaatatgaagacatattcgacattaattgcttaaatagtgtatagtattgattatacattaatgattactattttctctcttttcccacaatcaatttctttctctatatatcttattttatattcctatttcgcattattaacaaaatcaatttatttgcgcatataaggctgtcatttcggcgtcaatcttcttccttccttatttttctttcttctaaaaattatttatttatgtttctgtaaataaaaattcgtttttttctgtcaatcatactgttttgtctcagaataaaaaaaaaaaaccttcactgttttgtgtggtgtggttacgaagaaagaactcttctccttctccttcttattctttctcttcttcttctctctctctctctctctgagtgtctggttacatttggcgcgaaaagttcttcactttatagcttttttatctctttaattatccgacagcttcgttacaaataaagatg

SEQ ID NO: 36466 - DNA, 3003 bp, Unknown
  misc_feature (1)..( 3003): 2750-1469P.txt file - cDNA_ID_3096391; gDNA_ID_2936587; Annot_ID_143882
tcccaacccttagctctcaaaatctgaaaaaacaaaaaaacgagacagtgatgaagtgaagatgtaataatatagtagtgtctatcaagttcttcgtgatttttgtgtttaccttccatctcacaatacgaaactagggtttagctctgctttcctgtctgtcatttttctcttcaaaagatctaacgagtttctttttgtggtcaaattgggccgcagcccgttttctttggaataatacttattggatcgaatattgttatttgtcaaaactatttttcatacagagttggaacaatactcagccctgtttgtttgattatttggcatttacatccaaatgatctatttagatgatgcatttgaataatgtttgtttgattatttagtattttatctaaatgatgcatttaaatgaatatttctttgtttgatcattttgtaattcatctacattctcattctaataaaaatgactaaaatacccattctataattttaacaaatgacaaatatttaacatcattaccaaatataattttaataaagaaatgattttacggttttggcggaaaaatatgattttacagttttggcgagaaatatgattttgtggttttggcggaaaatataattttacggttttggtggaaaaatatgataataaggttttggcggaaaaacatgattttgtagttttggcgggaaaaatacaattttacgattttggcgtgaaaatacgattttacggttttggcgggaaaatacaattttaggttttggcgggaaaaatatgattttacggttttggcgggaaaatacgattttgcggttttggcgggaaaatacgattttacggttttggcgggaaaatatgattttacggttttggcggaaaaaatatgattttgcggtttggtgggaaaatatgattttacggttttggcgagaaatatgattttgtgattttggcggaaaaacatgattttatggtttttgcgggaaaatatgattttgcggttttttggactaaatcatctccatccaaatggttcgatcaagttcatccaaatgagtttcacaaattagtctaaatttacaaagtcattcagatggaccatccaaatgattcatccaaatgatctgttaatttgtcaaaaacaaacatcatttttcatccagatgatctggatgaaaaaacaaactggaccttactatttgaaaataatactatagaattaatttaattttaattagacgaaattagaggacatgaaatgccaggctggcaaattaacgtatgattggagtgggacccatacccgccctgtcagtccacatgctccgctctactcgtcttcttcacatttactgcttccttcaatcttattctaaccatttcttctacatcttttatttttcaagtcgaatgttctatttcctattcagattatttttaaatttcattgtatctgagctttattttcttccgaaattttataatttccaatgattttctttataaaaaatcaactacataagtaattattggttcctaaaaacctatatagtagtatagattcaaaaaaaaaaaaaagggaacagatcataaaatttgcctaatctagtttttcaggacttaaaaagaatgttctcattagtaaatatgaattttcagattacttataaacatatgggtcttattttcccattagaatataagataaatatgtacattttattgactaatttagaataataatatttgaacggtgataaatctaaaagataagggaaaaacagtcagagacatatatgtaaacattttgaaaaattaatataaaaatcttaatttgagcacaaaaaatataattgaaacagaacataaaaacaaaaaaaaatatcaaacacatgccttgtctaaacaaaactacaataatattttcatattattattttgttggcaaggcacacagcttaaaacagccatattaacttatctcttggttttttcttcctcaccctctcgtcgtctcttctctctccaaagccgagaagatttgtcggcgataatacgttaccagatcccattaatcaatatgaagacatattcgacattaattgcttaaatagtgtatagtattgattatacattaatgattactattttctctcttttcccacaatcaatttctttctctatatatcttattttatattcctatttcgcattattaacaaaatcaatttatttgcgcatataaggctgtcatttcggcgtcaatcttcttccttccttatttttctttcttctaaaaattatttatttatgtttctgtaaataaaaattcgtttttttctgtcaatcatactgttttgtctcagaataaaaaaaaaaaaccttcactgttttgtgtggtgtggttacgaagaaagaactcttctccttctccttcttattctttctcttcttcttctctctctctctctctctgagtgtctggttacatttggcgcgaaaagttcttcactttatagcttttttatctctttaattatccgacagcttcgttacaaataaagatgtcagtaagtgcgttctctctttttgcttctctcttaactaccattacattacatacctcttctttctaggttgtccctttctcggaattgctcttcttcatcgtttctttaactatttacttctctatttttcatcattccgttggatcggattctaaacagtttgacaaacctggatctgtaattctaactcagattcttctgttgtagcaggtggtaacaatcttgatactggcattaaccagtgttattcccatttacgcaaacgttcacggcgccgggaaaatatgcgacgaacttggccggcgatcattgagtacaagaccacacagtgtctccattacagattttggagctgttggagatggcaaaacgctcaacactcttgcgtttcaaaacgccgttttctatcttatg

SEQ ID NO: 36467 - DNA, 3000 bp, Unknown
  misc_feature (1)..( 3000): 2750-1469P.txt file - cDNA_ID_3096403; gDNA_ID_2936587; Annot_ID_143878
tcgagaacgagaagagagcgtaggaaatgaagaagaatatgaagtagaggaagagagggttttgtttaggagtgtcgataatgttcgccgtgtgctgataagagccatcgccggtgagggtttcggcttctgttcttcttcggtccttctctttgcagaagctttgagaaactatatgggcttagtgggcctttgatttatactttttagatgggctattaaaaaatttctctacattaaattccttagtttagtagttaaaagtttcccaacagaaaaatactttaaatcttcttgtcaaatacttcaacactcctaattgaaacactttcagtgttaaaaaaatgtttcaattatcgcttgtcaaattgtttgttcattcttaagtgttttcagaaagaaaatttcgtcctcgttagctataaaacgtattcattttgtattagctttcttaatgtgaatatgacgtcctaagtcaaatcacctaatctaaaattttgatttgagttagcaaaatgtccatcaagttaattcatggataacttttccaacctatatatggttagtaattagtaattatctttggctttttttggatgcatataaaatcacaatgacgataataacgatgattatcaaaatcaaaatggttactgtatttactatttataaaaaaagaaaacatagaattatctctccaaaaataagaaaagtagataaacatttctgaaattgctgtaaggtcaaaagtaaaaagaaaattatccaaaagaaaggttatgcgactttccgtaaatggaattgttggtatgaatgcgtgtatttgtgttttagagagctattcttgttgatgaatctctgaggagcagagcgagatagaggagagtgaaggaacatcatgggaagcagcacgggcgatcttgtgacacgtatccaatcagctcaccgtttcgatcacgatgccttgtttcgttttgccgccgacaacgtctctggctttccgaccaacccttcccaattcaaagtctcacaggtatgttttccaatcgccgaggttttttctccggtaagaaagaaacttttatctgactgtgttttgttttggtttggtttacatacagttcggacatgggcagtcgaatccaacgtttctgatagaggttggctcagggagttccttgaaacgatacgttttgaggaagaagcctcctggcaagcttcttcaatctgctcatgctgttgatcgagagtttcaggtatcaatcaattaataatctttacctctgtaaaattcattgtaactgttcatactcgatttttgaagaagatgaaattttgttgtttctagtaccgttttgaaatgcagaatcattgtaactttttgtgatgctgcttataagagatacggtatcaactaaaggtagatgctttttttgcttaatactttgatggtggttggtttatgtaggtgcttcgggctttaggtgaacatacacaggttcctgttcctaaagtcttctgcttatgcactgaccctgctgtcattgggactgctttttacattatggagtttatggaaggacgtattttcattgatccaaagttgccggtaagatattctctgttatgtgaatgtgtatgtacggtttttttagcttgagatgtgactcattgtaaacgaaaggtgtaaatttgtgtgtgtttcatcggttttgatttagaatgtagcacctgaaaggagaaatgcgatctatcgtgcaaccgccaaagccttggcatctcttcactctgctgatgtggatgccattggtcttgagaaatatggtcggcgaggcaattactgcaaaagacaggtttgttctttatttggggctggtgaatttccaaatcactactcactagtttgatgttctcttaatgcttatatgctcttgctaaagttttttcttttggatacctccatttcagatagataggtggttcaaacaatatttggcttcaacaagtgaaggtaaacctgaaaggaatccaaagatgtttgagcttgttgattggttacgcaaaaacatccccgcggaagattcaactggagcaacatcaggccttgtccatggagactttcgcattgacaatctcgtttttcatccttctgaggtcttaatactttcaagatcttttgttttctgatccttggatagtctcggagacttaactgaaaatatcttaaactgtaggatcgagttattggaataattgactgggaattgtccacgcttgggaaccaaatgtgtgatgttgcatacagctgcatggtaataacctattcttgtttgttgtattgtactcataaagcagttttctttgcttcctgctctgatatacagttcatttgtgttggcagcattacattgtgaatgttcagctcgataaggagcatgttagtgaaggttttgaaactactgggcttccagaaggaatgctttcgatgccagaatttctcttagaatactgttctgcatcggtattgtcctgcaacaacatgtagtctttaaaaggaatcaagtcaggtgttccttgtacattgcctatattttctcaatttctgttgtagtgacatattggcaaatgaactttagggaaaaccatggcctgctgcaaactggaagttctacgtagcgttctccttatttcgggctgcttcaatctacacaggggtgtacagtagatggttaatggtattccccgggcatatttttgaattctaagattctttattatgcagttgtagagccattgacattgtgttgatcatgcaggggaatgcttctgccggtgaaagagcgcgaaatacaggggttcaagctaatgagcttgtagagtctgccttgggttatattgcacgtgaaaatgttcttccagaacaccctccatctggtaatcgacctctttgagattcaagtttgttaaggataactgtttattttacatttcttatatatg

SEQ ID NO: 36468 - DNA, 3000 bp, Unknown
  misc_feature (1)..( 3000): 2750-1469P.txt file - cDNA_ID_3096411; gDNA_ID_2936587; Annot_ID_143876
atccatgagagagctttatttatgaggagacacatacccggatcttgttctccttctgcctatcttgaagtgcgttaatggcaggactcaagctgcaaaagcatgaagttcatataacgaatgacaaaaccacgtatcaaatgttttaacacgcttcactaaccagtattcgatcaacttgcacatggaggcttgatatgttgatgtgttgtgaatgaaagcaagaggatgaactcgcccatctctagagaagaaacagaaggagctttagcactaaaatctctatgattagggtatgaaaaagattaattgaaaacctcatgttttgctgcactgattggtagtacgctgctcgttcctcctcgtacagtactcgttgcaggcttttaaaagatgctaaaggtgaattgactggaagaagggatgaagttggcaaaacatgaagtgggacttcttttctaacataccccgcaccactgcacgtaaattcctaagcttagtaattacgtaattgaaaaattgtagtgttcataagcctagaagcgtatgttgagaaatacctggtatctaaatttgaacggagcattgcctcttgcatactttcagacatgtccatcgagtcaattcctatagttgtgctgctgagattgcctgatttgtgagtttcatctctgccggtgatattggcctcaatattgtttgtaaagaaaggcccaaaatctgaaacccgtcctccaccctagtcagccacatacacatacaaaactcaaacatcaatgtgtatatacattgcagccaatggttcagtcagaaatagtaccatgattgtcttgagaattttgaataatgatgcagatattacaatttgtcaactttcattaagctcgagtaaaatgctatatagcatttggaaaaagagaccttagatccggaagttgtagcagtatcaattgtgtctagctcgggcttagaagaagaggatcgctggtatatcgagtccgaagaactagatgaagattctatatcgatgacagaatctttattagcaagaaccaggctcattgatttaggaatactattcggctttccatcagaagactggaaagcgataacttggattctaccaacctggaaacatcaacaaagccagttcagcaaacaggagaagtaatcctgaaaagtttcaacttgctaatccactcatagaaagcaaataccaaccttgttagcatcttcactaaaacaggaaaatatgaggccaataaaaccagaatctaaaagctgatacatagcttgtgtccgaacatctgcaggacataaatatgaggaacaagatcataaaaaaaatcataaaaagttacaatgatgatgatacataccgacatgggaaggaagaacggtaatatgaggatgggagtggtaccatccaatgacccgtgtagttctgcccgttgatatcgtcattctgtgtcagagaggttagttaaggaagacaacaaaacactcttgttttaaccaaaccatcatatctaaaagacacaagaagaaccacacatagagaccatcaatctgaaaatagcaagtttacaaaaaggatatatcagcctgagcagaagcagcagccaattgttcaggattggtttcaactcgatccttctgccgatcagatcgtggctgaggcgatgctccccagatcatagctgtggcactttcgccgttctttgagtactaagtcaatttccaataccacaaacaagatttgaaagtcagcgattgattttgattatctgggaattgttcaagccttaaaatatcatcaaaaacagagcggcaaaaagccaaacttttggactgaattcaattaaattagagtaatatcgaatccaagtaagatgaaacattcgctgcagagtaaaagtaaagcgtagacgaagagaagatgaagaaatagtgtgaacctcgatgtcgccgagaaggagacccatgatttcttcggtctcggtggataatgcgtgagtgaggcaagtcaaccagacatcctccgacatatttacgcatgtcagagacattattacttcttccgaagagatctttcaaacttaatgcagatgagcttcttcgagaattcgatttgaattttgcctctttcggacgaaactgaggaaagcagaagaaagaatcctacattaattatgtgtcggaacgtgtaatttagcacagttccgatggcgcgatatgagaaattagggttgtgtttgtgaattttgggggagaaatagataactacgtcgttgtacaaacggaccttgcccgaattacacccgcctttttttagaattagaaagcaggttcgtgggctttaaaatttacaagggtttttggtacattattaaacatcactacttcactagtagttaacagggatgatgatttgcactgtgacattcaacagtactaaacccttattcttcatctctaaatcaacaatttcccccatttagtaagaatcattcgaatcacatattctcttaagaaaatcatcaagattacgattaatatgtatctcacacttcatcccacaaattcatgaccatacttactattcataggctatcataaaatccggaaaccagatcattttagattgggaaaaaaaaaccttactaaagacagaaaatgtaacatagcctcatgttctttcctaaaaccccagaaatagtattacaactcttttctatattaaccccatcgatctttcgattcatttgttctaagcattgtgtataccaaacacgaaaagatcccttccccctaaaaaaaaaataaaaaaattcagagctagaaggggcctcatagttatagccacagttataggccccatctgctccatttttaacatgtgtagaaaatcatattagaaaagtaggaaaaaatacttgagcaaagatacctttttcgacctttagaatttttgtgaatatataggaaacagaaaaaatg

SEQ ID NO: 36469 - DNA, 3000 bp, Unknown
  misc_feature (1)..( 3000): 2750-1469P.txt file - cDNA_ID_3096416; gDNA_ID_2936587; Annot_ID_143875
acgaaaagatcccttccccctaaaaaaaaaataaaaaaattcagagctagaaggggcctcatagttatagccacagttataggccccatctgctccatttttaacatgtgtagaaaatcatattagaaaagtaggaaaaaatacttgagcaaagatacctttttcgacctttagaatttttgtgaatatataggaaacagaaaaaatgggttctgatggtgacaagaagaagaaattcatcgtcgccggtagtgtctccggttttctagtcatcatggttgtctctgtagccgttgtaacgtctaaacactctcccaaagacgatgaaaatcatatcagaaaaaccaccaaagcggttcaagcagtttgtgcacccactgacttcaaagacacttgtgttaacagcttaatgggtgcttctcccgattccgatgaccctgtcgacctcatcaaactcggcttcaaggtcactatcaaatccatcaacgaaagcctggaaaaggcctctggagatatcaaagccaaggctgacaagaacccagaagcaaagggtgctttcgagctgtgtgagaagctgatgattgatgctatcgatgacttgaagaagtgtatggatcatggattctcggttgatcagatcgaggtctttgttgaggatctacgggtttggctaagtggctccatcgcattccagcaaacatgtatggattcctttggggaaattaagtctaatcttatgcaagacatgctcaagatcttcaaaacatcaagagagcttagtagcaatagccttgccatggttactagaatctccactcttatcccaaactccaaccttacaggtatcttttcaatttactaaagagatctccaaactaatccataaccaaccagtcagaatcattggacagtaatgtgatgcttcaaaccaggactaaccggagctttagcaaagtacgcgagaaagcttctgtctacagaagatagtatcccaacttgggttggaccagaggcacgacggctcatggcagctcaaggaggaggacctggacctgtgaaggctaatgccgtggtggctcaagacggaactggacagttcaagactatcaccgatgctctaaatgctgtgcctaaaggcaacaaagtgccattcatcattcacatcaaagaaggtatctacaaggagaaagttacggtcaccaagaaaatgcctcacgtaactttcatcggcgatgggccaaacaagactctaatcaccggtagtctcaatttcggtatcggcaaggtcaagaccttcctaacagccacaatcagtgagtttcaatctccaaactctaaaagtccacaaagagagattctaaacattaccaaattattgtttcgcagcaatcgaaggcgaccacttcacagcgaagaacatcggaatcgagaacacagctggaccagaaggaggacaagcggtggcgttaagagtctcggctgattacgccgtattccacagctgtcaaatcgacgggcaccaagacacgttatacgttcactctcaccggcaattctaccgtgactgcacagtctcgggcaccgtcgatttcatcttcggagacgcgaaatgcatcctccagaactgtaaaatcgtcgtccgaaaacctaacaaaggtcaaacgtgtatggttacagctcagggacgaagtaacgtccgtgaatcgacaggattggtgctccatggctgccatataacgggagatccagcgtatattccgatgaaatctgtgaataaagcttacttaggaagaccgtggaaggagttctcgaggacaatcattatgaaaacgacgatcgatgacgtcatcgatccggcgggatggcttccctggagtggagattttgcgctcaagacgctatactacgccgagcatatgaatactgggcctggatcgaatcaggcccaaagagttaaatggcccggaattaagaaactaacgccccaagatgctcttttatacactggcgacagattcttacgtggcgatacgtggatcccacaaacacaagttccgtatacagctaaagtgtaggagattccaaattttgtaaattgatttaatttgtaaatgttttaaaactaaaaactgtttgaagaatgattaattgattatgtcatagtgtggaagctgatcaaaaccctgattatatagaatagaaaaggcctatcgatatctcaatgttacacgaataaggcacttattacgattacttataatatctgaatgccttttaattggataatataaataaatactgacgagtttttaattaattaaaacatttaggagatgcatgtgttatatagattcacgtgatggtgatgcacatgtatcgtccttcgagattgagagcgcctggctacatccaatattgaatcccttcgtctttgaagtttgaatggtgaaaacaataacatattaacattcctcgcttcgggaactaaaaccatgactttatagcgtacgatgcagtaagtaccatttacgtgtctttttctgcttattgttatatggagagttattttcgcattgttaaatatagacgtataattagttattcgttaggtactggaatatgatatgattgattaatttttcttttttgtggtatgaaatgtaaagacgaatgataaaattgtaatgactaaaaaaggaattgaaaaggagatgaattatcatgtatgggccatttataaaagtaaaaaaaaaaaaaaaacttagaaaaatacgggttgtttgaaaatgacagaatagacgactctcgttgcattgaatttgagtgaaccccacactctctttcaagtctcaacggccatctccattctcttctatctcttcttcacaaaactctttcacccatttttcctccattaaacaacaaacgacctcgtaagaaaaatgtcaaacatttccccaatcttctccatctccaactctcaacatttcagcgactatg

SEQ ID NO: 36470 - DNA, 3000 bp, Unknown
  misc_feature (1)..( 3000): 2750-1469P.txt file - cDNA_ID_3096428; gDNA_ID_2936587; Annot_ID_195131
tattaaccccatcgatctttcgattcatttgttctaagcattgtgtataccaaacacgaaaagatcccttccccctaaaaaaaaaataaaaaaattcagagctagaaggggcctcatagttatagccacagttataggccccatctgctccatttttaacatgtgtagaaaatcatattagaaaagtaggaaaaaatacttgagcaaagatacctttttcgacctttagaatttttgtgaatatataggaaacagaaaaaatgggttctgatggtgacaagaagaagaaattcatcgtcgccggtagtgtctccggttttctagtcatcatggttgtctctgtagccgttgtaacgtctaaacactctcccaaagacgatgaaaatcatatcagaaaaaccaccaaagcggttcaagcagtttgtgcacccactgacttcaaagacacttgtgttaacagcttaatgggtgcttctcccgattccgatgaccctgtcgacctcatcaaactcggcttcaaggtcactatcaaatccatcaacgaaagcctggaaaaggcctctggagatatcaaagccaaggctgacaagaacccagaagcaaagggtgctttcgagctgtgtgagaagctgatgattgatgctatcgatgacttgaagaagtgtatggatcatggattctcggttgatcagatcgaggtctttgttgaggatctacgggtttggctaagtggctccatcgcattccagcaaacatgtatggattcctttggggaaattaagtctaatcttatgcaagacatgctcaagatcttcaaaacatcaagagagcttagtagcaatagccttgccatggttactagaatctccactcttatcccaaactccaaccttacaggtatcttttcaatttactaaagagatctccaaactaatccataaccaaccagtcagaatcattggacagtaatgtgatgcttcaaaccaggactaaccggagctttagcaaagtacgcgagaaagcttctgtctacagaagatagtatcccaacttgggttggaccagaggcacgacggctcatggcagctcaaggaggaggacctggacctgtgaaggctaatgccgtggtggctcaagacggaactggacagttcaagactatcaccgatgctctaaatgctgtgcctaaaggcaacaaagtgccattcatcattcacatcaaagaaggtatctacaaggagaaagttacggtcaccaagaaaatgcctcacgtaactttcatcggcgatgggccaaacaagactctaatcaccggtagtctcaatttcggtatcggcaaggtcaagaccttcctaacagccacaatcagtgagtttcaatctccaaactctaaaagtccacaaagagagattctaaacattaccaaattattgtttcgcagcaatcgaaggcgaccacttcacagcgaagaacatcggaatcgagaacacagctggaccagaaggaggacaagcggtggcgttaagagtctcggctgattacgccgtattccacagctgtcaaatcgacgggcaccaagacacgttatacgttcactctcaccggcaattctaccgtgactgcacagtctcgggcaccgtcgatttcatcttcggagacgcgaaatgcatcctccagaactgtaaaatcgtcgtccgaaaacctaacaaaggtcaaacgtgtatggttacagctcagggacgaagtaacgtccgtgaatcgacaggattggtgctccatggctgccatataacgggagatccagcgtatattccgatgaaatctgtgaataaagcttacttaggaagaccgtggaaggagttctcgaggacaatcattatgaaaacgacgatcgatgacgtcatcgatccggcgggatggcttccctggagtggagattttgcgctcaagacgctatactacgccgagcatatgaatactgggcctggatcgaatcaggcccaaagagttaaatggcccggaattaagaaactaacgccccaagatgctcttttatacactggcgacagattcttacgtggcgatacgtggatcccacaaacacaagttccgtatacagctaaagtgtaggagattccaaattttgtaaattgatttaatttgtaaatgttttaaaactaaaaactgtttgaagaatgattaattgattatgtcatagtgtggaagctgatcaaaaccctgattatatagaatagaaaaggcctatcgatatctcaatgttacacgaataaggcacttattacgattacttataatatctgaatgccttttaattggataatataaataaatactgacgagtttttaattaattaaaacatttaggagatgcatgtgttatatagattcacgtgatggtgatgcacatgtatcgtccttcgagattgagagcgcctggctacatccaatattgaatcccttcgtctttgaagtttgaatggtgaaaacaataacatattaacattcctcgcttcgggaactaaaaccatgactttatagcgtacgatgcagtaagtaccatttacgtgtctttttctgcttattgttatatggagagttattttcgcattgttaaatatagacgtataattagttattcgttaggtactggaatatgatatgattgattaatttttcttttttgtggtatgaaatgtaaagacgaatgataaaattgtaatgactaaaaaaggaattgaaaaggagatgaattatcatgtatgggccatttataaaagtaaaaaaaaaaaaaaaacttagaaaaatacgggttgtttgaaaatgacagaatagacgactctcgttgcattgaatttgagtgaaccccacactctctttcaagtctcaacggccatctccattctcttctatctcttcttcacaaaactctttcacccatttttcctccattaaacaacaaacgacctcgtaagaaaaatg

SEQ ID NO: 36471 - DNA, 3000 bp, Unknown; identical to SEQ ID NO: 36464
  misc_feature (1)..( 3000): 2750-1469P.txt file - cDNA_ID_3096461; gDNA_ID_2936587; Annot_ID_195141

SEQ ID NO: 36472 - DNA, 3003 bp, Unknown
  misc_feature (1)..( 3003): 2750-1469P.txt file - cDNA_ID_3096465; gDNA_ID_2936587; Annot_ID_195139
tttgtctcagaataaaaaaaaaaaaccttcactgttttgtgtggtgtggttacgaagaaagaactcttctccttctccttcttattctttctcttcttcttctctctctctctctctctgagtgtctggttacatttggcgcgaaaagttcttcactttatagcttttttatctctttaattatccgacagcttcgttacaaataaagatgtcagtaagtgcgttctctctttttgcttctctcttaactaccattacattacatacctcttctttctaggttgtccctttctcggaattgctcttcttcatcgtttctttaactatttacttctctatttttcatcattccgttggatcggattctaaacagtttgacaaacctggatctgtaattctaactcagattcttctgttgtagcaggtggtaacaatcttgatactggcattaaccagtgttattcccatttacgcaaacgttcacggcgccgggaaaatatgcgacgaacttggccggcgatcattgagtacaagaccacacagtgtctccattacagattttggagctgttggagatggcaaaacgctcaacactcttgcgtttcaaaacgccgttttctatcttatgtctttcgccgacaaaggtggggcccagctctatgttccgccgggacattggctcaccgggagttttagcctcaccagccacctcactctctttctcgaaaacggcgccgttatagtcgcttctcaggtatattacaatgcttctttctcattctcacatttatcccaaacttttaaatttatccaaaaaccccaaatttttacttcaaaaggatccatcgcattgggaagtggttgatcctttaccttcatacggaaggggaattgatttgcctgggaagcgatacaagagtttgatcaacggtaacaagctacatgatgttgttgtaacaggtaacaaactatgctttatacatttttatttcattttcacttgttacaatatccttcaaattataatatggttactccatccttttccttggttaggtgataatggaactatagatggtcaaggcttggtttggtgggatcggtttacttctcattccttaaagtataaccgtcctcacctcatcgagtttctttcttctgaaaatgtaattgtctccaatcttacgttcttgaatgctcctgcttattcaatctattcaatctactctaggtaagagatagttcaacactatctaggcctcaacctttttttggtttttttgaatgataaagtcttgactctaatactgtccttgtgcagccatgtatatattcataagatattggcccattcttctcctaaatctccttatacaatcggtattgtaccaggttagttgtctctacttcttctagactaaaaccctttttgttgtgtctaagcatagaagaacgaaatgtcttatgttttgttatgtttctcagattcttctgattacgtctgcatccaaaactctaccattaacgtggggtatgacgcgatttccctcaaaagcggttgggatgaatatggaattgcctattctcgtcccactgaaaatgttcatataagaaatgtgtaccttcgaggagcttctggttcctctatctcctttggcagtgaaatgtctggtggaatatctgatgtcgtggttgataacgctcatatacactactcgttaaccggcattgcctttagaaccacaaaaggcagaggtggttatatcaaagagatcgatatttcaaacatcgatatgttgagaataggtactgccattgttgctaatggtagctttggatctcaccctgatgataaatatgatgtgaatgctctcccacttgtgagtcacatcagattaagcaacatttctggagagaacattggcattgcggggaaattgtttgggatcaaagaatctccatttagctcagtgactttgtcgaatgtttctttgtcgatgagctcaggttcttctgtttcttggcaatgctcctacgtttacgggtcctcggagtcagtcattcctgaaccgtgtcccgagctgaagagagatgctgatgcttacggtagagctgcagtctagtgaaacagactgcaaaagaaaaaagaaaaaaaaagcaagaaacatttcttgggattctttgataggattcaattcatcaatcatttcatattttgtggagttagagaaggtcagattctttcctcaagtaaaccacattgtctttagatcatacatgttcctttcggttattctggtttcctatttttatgttgtttgcatattctgagataagaaatctgtacaggttcatttcttcattcatgtgtaaacaaagaaattttgtttcagcagttttccacaagccattaataataaaaaggagagatagtttcatttttccagaaattttatttgaattatctcttatcaagcttcaaagcttaatctcttggttatcagtgacttatcagttatcaatcttccaaacataacccaaaaagcggaccaaagataatacgaaaacgccaagaaaacagaatttattttggctctaaccaaaacgtactaactttttatttgagtcagcaaactttcgactccaacaacttttttactattttgaatatatgaaagtctcaatgaaaggaaagtactctgtttccggttatgcacataaaggttccaaggtacaaatgacaattatatatggatgcaactctgcatcctcttataacttacaatattttgcatcatacattgaaaccactcctaacaattccaacctgagatcctcaagtctcatgcaccaaccacaacaaggcaatggatttataacgagaaattagaaatcgtcttcaagcatggttgacaacaacaagcctcgcacaaactcactctttttcgccttctcctgatcttcacctgaaagtggagcttcttgaatgtctctgcataaatg

SEQ ID NO: 36473 - DNA, 3003 bp, Unknown
  misc_feature (1)..( 3003): 2750-1469P.txt file - cDNA_ID_3096471; gDNA_ID_2936587; Annot_ID_195135
cttgatcaacttctgccttaactccaatacttttctgttggggatgaatctcccgcttccatccacaaggctttcatacgacggagacacgtctctttgaactgcatccatatataagaaatgtaaaataaacagttatccttaacaaacttgaatctcaaagaggtcgattaccagatggagggtgttctggaagaacattttcacgtgcaatataacccaaggcagactctacaagctcattagcttgaacccctgtatttcgcgctctttcaccggcagaagcattcccctgcatgatcaacacaatgtcaatggctctacaactgcataataaagaatcttagaattcaaaaatatgcccggggaataccattaaccatctactgtacacccctgtgtagattgaagcagcccgaaataaggagaacgctacgtagaacttccagtttgcagcaggccatggttttccctaaagttcatttgccaatatgtcactacaacagaaattgagaaaatataggcaatgtacaaggaacacctgacttgattccttttaaagactacatgttgttgcaggacaataccgatgcagaacagtattctaagagaaattctggcatcgaaagcattccttctggaagcccagtagtttcaaaaccttcactaacatgctccttatcgagctgaacattcacaatgtaatgctgccaacacaaatgaactgtatatcagagcaggaagcaaagaaaactgctttatgagtacaatacaacaaacaagaataggttattaccatgcagctgtatgcaacatcacacatttggttcccaagcgtggacaattcccagtcaattattccaataactcgatcctacagtttaagatattttcagttaagtctccgagactatccaaggatcagaaaacaaaagatcttgaaagtattaagacctcagaaggatgaaaaacgagattgtcaatgcgaaagtctccatggacaaggcctgatgttgctccagttgaatcttccgcggggatgtttttgcgtaaccaatcaacaagctcaaacatctttggattcctttcaggtttaccttcacttgttgaagccaaatattgtttgaaccacctatctatctgaaatggaggtatccaaaagaaaaaactttagcaagagcatataagcattaagagaacatcaaactagtgagtagtgatttggaaattcaccagccccaaataaagaacaaacctgtcttttgcagtaattgcctcgccgaccatatttctcaagaccaatggcatccacatcagcagagtgaagagatgccaaggctttggcggttgcacgatagatcgcatttctcctttcaggtgctacattctaaatcaaaaccgatgaaacacacacaaatttacacctttcgtttacaatgagtcacatctcaagctaaaaaaaccgtacatacacattcacataacagagaatatcttaccggcaactttggatcaatgaaaatacgtccttccataaactccataatgtaaaaagcagtcccaatgacagcagggtcagtgcataagcagaagactttaggaacaggaacctgtgtatgttcacctaaagcccgaagcacctacataaaccaaccaccatcaaagtattaagcaaaaaaagcatctacctttagttgataccgtatctcttataagcagcatcacaaaaagttacaatgattctgcatttcaaaacggtactagaaacaacaaaatttcatcttcttcaaaaatcgagtatgaacagttacaatgaattttacagaggtaaagattattaattgattgatacctgaaactctcgatcaacagcatgagcagattgaagaagcttgccaggaggcttcttcctcaaaacgtatcgtttcaaggaactccctgagccaacctctatcagaaacgttggattcgactgcccatgtccgaactgtatgtaaaccaaaccaaaacaaaacacagtcagataaaagtttctttcttaccggagaaaaaacctcggcgattggaaaacatacctgtgagactttgaattgggaagggttggtcggaaagccagagacgttgtcggcggcaaaacgaaacaaggcatcgtgatcgaaacggtgagctgattggatacgtgtcacaagatcgcccgtgctgcttcccatgatgttccttcactctcctctatctcgctctgctcctcagagattcatcaacaagaatagctctctaaaacacaaatacacgcattcataccaacaattccatttacggaaagtcgcataacctttcttttggataattttctttttacttttgaccttacagcaatttcagaaatgtttatctacttttcttatttttggagagataattctatgttttctttttttataaatagtaaatacagtaaccattttgattttgataatcatcgttattatcgtcattgtgattttatatgcatccaaaaaaagccaaagataattactaattactaaccatatataggttggaaaagttatccatgaattaacttgatggacattttgctaactcaaatcaaaattttagattaggtgatttgacttaggacgtcatattcacattaagaaagctaatacaaaatgaatacgttttatagctaacgaggacgaaattttctttctgaaaacacttaagaatgaacaaacaatttgacaagcgataattgaaacatttttttaacactgaaagtgtttcaattaggagtgttgaagtatttgacaagaagatttaaagtatttttctgttgggaaacttttaactactaaactaaggaatttaatgtagagaaattttttaatagcccatctaaaaagtataaatcaaaggcccactaagcccatatagtttctcaaagcttctgcaaagagaaggaccgaagaagaacagaagccgaaaccctcaccggcgatg

SEQ ID NO: 36474 - DNA, 3003 bp, Unknown; identical to SEQ ID NO: 36473
  misc_feature (1)..( 3003): 2750-1469P.txt file - cDNA_ID_3096471; gDNA_ID_2936587; Annot_ID_143880

SEQ ID NO: 36475 - DNA, 3000 bp, Unknown
  misc_feature (1)..( 3000): 2750-1469P.txt file - cDNA_ID_3096476; gDNA_ID_2936587; Annot_ID_195134
tgttgtaaaaatccctaatccaaaactatttcgtggattttagggaaaaaagagaattcgaacaaggtcgtcgtcgtcgtcggatttgtagatcatcatggagttctctttgatcgcagatacagtcacagtttgcacggctaagcaaggtatcgcgtttgggaaatctcttcttcaaaggttggatttggccaatcacatttctttcgccgattccgttgttgatcatcaatctcccggtggaggaatcgttcaagcatcggcgattattttccccgtcgatgcaattgctcctccaccggtcagatctagctcttataagacaattcgccggatccgtaaaaagcgacgaaccaggcgagtttcgtttggtggagatggagatgacgcaggagattttggtcgttttctgttagaaggtgatttcggtggtagcgacggtccatttggatttggaggcggaggaaacgatggaggcggaaagggatggaactacggcggcggcggcggtggtttcgggagggataattgggatgggtcttcgttttcgtcttggtcagatccagcgatggaatttgtgtatgaagtgatttgctggatcgcgttgtctaattgtgtgcactttgcgttcaagaggatagtgaggatcgtgaccgacggtgaaagggagaagttgaacattgcattatctccggtatgctgacaaattcgtggtcgtggtgatgattcctggttaaaagtattcttaatctcggttccaattacatcatatgatctctcgtgtgtatatatattacattgtacatatttatttaatttctccttcgcaagttcacattagatttttataatttgttctgtttagagtagtgtttagtcatcattagagacatgaatgatgattgatttgtttgattaagtggataaaaactgaaaagtctctcacatgagtgtttaagacaagcatgtaaataccataatcctaataaactccatccattacataatgcattgttcatgtttaatattaagcactgggcttgttgaactctcccggatttactggagaatgaagacccatggatggctctctcctctcaacctgcattgtctcacggcgcctatcataccttggcctaggacggggtctagtatgacgctgttccgtgaacctgtactgtggtctgggtatgacctttccttcaacgtacaagtcacctgaacatgagagccaaagacagatggtatcagtattaagaaccatatctcagtacccaatcattcagacaaaatctacaaacgttacacacctccgtagtctttgtttggtacatcgagataggaatccggcagcacccagagaacaccaggcaatgctaatgaatcacacaactctagatcagatttctcaaacagtaaaatatgttctcattttatagtactagagacagacaataactgcgataaaacaaagatcaagagaagtttcctcctagctgttgaacagagcagtaccaaacagagaaagccttttacgataaatctcaacatcataagtaaacaactagaaaagctatgtcagagcaaaaaaggcttaaaaacctaattgcaaatatggagaagttgatacctttgactttgcaagagagctcttcagagatcaaagcaccaaagccagtgtaggtcgaagtacaaacagagtaaatcttcttcttggcctcttcctcactatagtttaaccattattacccacaaaatgcaaatccgtcaatccccaaatgcacaagaaaacatttgagagtcaaaatcaaatgaaaaggaacttgccagccaaggacggaagttaaggttttgacataagaattgatcatctcttcttcagtaggtttaggatcagtgaactccatgacgatgagccagtgctcataatcgcacccatcaagaagaatcgtctccttcggcggacggttgctccaattcggcgaaggatcattcagcggcgagtatccggacccggatgtcttgggtcgggtcgagatgtaacacgggcccaggctggttcgggaagaggaaaccttttcaattagaggcatggcgaatcgagaacgagaagagagcgtaggaaatgaagaagaatatgaagtagaggaagagagggttttgtttaggagtgtcgataatgttcgccgtgtgctgataagagccatcgccggtgagggtttcggcttctgttcttcttcggtccttctctttgcagaagctttgagaaactatatgggcttagtgggcctttgatttatactttttagatgggctattaaaaaatttctctacattaaattccttagtttagtagttaaaagtttcccaacagaaaaatactttaaatcttcttgtcaaatacttcaacactcctaattgaaacactttcagtgttaaaaaaatgtttcaattatcgcttgtcaaattgtttgttcattcttaagtgttttcagaaagaaaatttcgtcctcgttagctataaaacgtattcattttgtattagctttcttaatgtgaatatgacgtcctaagtcaaatcacctaatctaaaattttgatttgagttagcaaaatgtccatcaagttaattcatggataacttttccaacctatatatggttagtaattagtaattatctttggctttttttggatgcatataaaatcacaatgacgataataacgatgattatcaaaatcaaaatggttactgtatttactatttataaaaaaagaaaacatagaattatctctccaaaaataagaaaagtagataaacatttctgaaattgctgtaaggtcaaaagtaaaaagaaaattatccaaaagaaaggttatgcgactttccgtaaatggaattgttggtatgaatgcgtgtatttgtgttttagagagctattcttgttgatgaatctctgaggagcagagcgagatagaggagagtgaaggaacatcatg

SEQ ID NO: 36476 - DNA, 3000 bp, Unknown; identical to SEQ ID NO: 36468
  misc_feature (1)..( 3000): 2750-1469P.txt file - cDNA_ID_3096485; gDNA_ID_2936587; Annot_ID_195132

SEQ ID NO: 36477 - DNA, 3003 bp, Unknown
  misc_feature (1)..( 3003): 2750-1469P.txt file - cDNA_ID_3096492; gDNA_ID_2936547; Annot_ID_193915
cgataacaccaccaccttcttgtcttcttacgtgtcatacacgaaaaacacgaggttctcgaaccctaacaacaaaaacctactagccatcgtagtggcgaaagatgtatctcatgttcaggcaacggtggtctgcgcaaagtccaatggtatccagatccgtatccgaagcggtggtcatgacaacgaaggactttcttacgtgtcgtctgtgccatttgtcattcttgatatgcacaaactgagggatattactgtcgacgtgtcaagcaagaaagcatgggtccaagctggtgcgaccttgggagagctctacgtgaagatcgatgaggcaagccaaacgttagcgttccctgctggcatttgcgctacggtaggagctggaggacacataagcggtggagggtatggaaatctgatgagaaaattcggaaccacagtggatcatgtcattgatgctgaattagttgatgtcaacggcaagctcttgaatcgatctaccatgggagaagatctcttttgggcgattcgcggcggtggtggtgcgagtttcggagttatactctcttggaaaataaacctcgtggaggttccaaagatctttacagtgtttcaggttaacaaaacattggaacaaggaggcactgatgttgtctacaagtggcagcttgtcgctaacaaattccctgataatcttttcttgagagcaatgcctcaggtagtaaatggaacaaaacacggcgagagaaccatcgcgattgtattctgggctcagttcttgggtcgaaccgatgagctgatggagataatgaaccagagctttcctgaattagggctaagacgtgaagattgtcaagaaatgagctggcttaacacgacgttgttttgggctatgttaccagcgggtactccgaagaccgtccttctaggtagacctacggatccagtattctttaagagtaaatcggattacgtcaaaaagccaatccccaaagaaggactggagaagatttggaagacaatgttgaaattcaacaatattgtgtggctgcacttcaacccttacggtggaatgatggatcggattccgtcaaacgccacagcgtttcctcaccggaaaggaaacttgttcaaggttcaatactataccacatggttggacccaaacgccacagagagtaacctgagtattatgaaggagctctacgaggttgcagaaccgtacgtgtcaagtaacccgagagaggccttctttaattacagagacattgatattggaagcaatccaagcggtgagacagacgtggatgaggctaagatctatggatacaagtatttcttggggaatttgaagagattgatggatgttaaagctaagagtgatcctgagaatttcttcaaaaacgaacagagtattccccctcttttatcaagggtgaggagagacgacgaattgtaattgttagaagaaaattatgtttaccttaactctgcatagataaaaggttgaaatattggattgtatgctctaaattttactagaaatttgaaatgtacactacaatattttaaaatttgttcggtatcttattattctctcaaaaagactttttgcacttaattaataattaaaattttgagaaaaagaacaaaataaaataattaggaaacatagtttttacaaatattattaaaaaatctagaaaaactattcattttaaaaaaattatactcaaaaagttttttttttctttcttggtgaaaacagatgatgataaaactaaaactaataattatgaaataaactatgacttttaattatgtaataatttagataacgattcgtttaatattacaggctcatcattcgtcagtcattgactcgccataacaaatgcatatcctaaaacatttcctacgggtacaaaatttccaacatgaatatattttttcgtaattgagacacatagcttgtaatattcgaaaagtcttgaaagtttggcattctcacggatagatggcacagtacaaaaactatgtacgtagttagcgcaaaaaatcagctatcatacatataacataccgaattcacaaatgatataacatcgccatctatggtaggtataattttatgtatttttgtatcataaatctttttacaataacaatttatactgcattaatatatatttgtgtaccgtcatatttagggttataatatatgcgtatataatagtttttgagaattattatatataatttagttatgacattttatatatgatataattcactcttttaaaacaaatattttttgggtacggtagaagtattgaactgttttttattggctattatatgtggttttacattttagagagctatatatattgatatacctaatcttgtgatattgcatactataaacaaaaacatatcgaaataaaaatcatttaacataaaatctgattccaatctaacatacagtacataagtttataaaatcattcatcatacataacgcaagtgtgcatctaaaatacataatacaagtcatattgattagcttagtcttaaacttatggatggaccattagaaatcaaagattgcagttaataaatatattgggccatggaatgctatgactgggccgggtcataagaaaccaatccggaggaagcgaacagaaaataattttgtttcccgtattactgtaccggttcaaccgtcccggtatattgaatcgaaccaaaatgtggcaaaacctaatttctttttttcctaagagagtttttatttttattttctcagaaccagaataaggagacgaaaggagcacaggcccagagacccccccataaacatcgtctctgagaaaggtgctgttcgaattgagctcgatcttaactacttctgttgttgaatttcttgccccgttcggaaaaattgagcttaaactactttgaagaaaccttgtggaatttttggggatgccatcaatg

SEQ ID NO: 36478 - DNA, 3003 bp, Unknown
  misc_feature (1)..( 3003): 2750-1469P.txt file - cDNA_ID_3096522; gDNA_ID_2936547; Annot_ID_193909
accttctctgtttcagagacccacattgctttgagtactcaaaatctaacatttacaagtcatcacacaataatatctgaacttttctttacttaagccttagggtattctgcttattagtacccaagaaatatcataaagagtataaattgtcgatcatcatatcagaataatctcctctctctctaacaaactcgcaaactcacatttgtggtactctcagtgttagacaagtccgatcaagtttaagcagtcatggcggttttgcttcctctgtttcttctctctttcatgtttacctattcaagtaagttctttctatcttctttgaacatttctttgtcccttggcattaagactcaaaatggttccgacattttcgcttcttggttacgttttccttgtaatgctaatccgagatatctgttttgtacagacgcggcggtttgtgtgtgcaaggacgctaacgagctggatcttcagaaggtgatagacttcgcatgtggaggaggtgctgactgtgcacagattcagacgaccggagcttgttatcaaccaaacaccctcaagaaccactgtgacgttgccgttaacagctactatcaaaagaaagcttccaccggtgccacatgtgacttcaacggcgccgccgtcatctccacttcccctccttcgagtattccttccattaaaaccacaacttcttttcatcaaatgtgtatctttttttttttttgctgattctttatttactctgttcttgcagctacgtcaagctgtttatctagttctaggtatgtttcacatcaccttgccttagagtttagattagggttatttccctctgttttcgtttgcttagtgttttctttagatcagtaatgagctctctgatgattctagtcgttgaaatagttcagtcatttgtctactaatgtgtgacagaatctttattactgatttattaccaaaatattaattatatcttcttaaaaattgtgatgatgatttaagtgtgtttataagagtaacctttttgtagttccaacggaacccccactgccggatatccatccaccggaaattcaaccacagcaagtccaggcaccacaaatccatccacaggcaattcaacaaacagcacactacccactaatgataagccgacttcatctacgataacgtttcctgacagtactactatgggaccatctagcagcacgagtggtgatcccaacggtggagaagagctatccgtcagaaccacgacgatcatcttactgactaccatcgctgccgtggcattgagggtttaggtaagatcatctcaagatgatgacgaggacgcttatttgttgtggacggctgagataatgccaagttaattagagcctatctttcttcccaccgaattttaatctttaatttccaattaggattgtgactctcgctcgtcttcttaagtattttggtttatagaaaatcttaatcaagagcttttttcttgctttcttttgtaaatccagaaaaaatgagatgctctttgggttgtattatttttacttataattatgccttcgccaataaagataacatgtttctctttgatagtttcttggttgtttgctaagaagaaaatgttgctacaaggatttcaggttttttttttattttatatttaataacagatgtttggtgttagtgcaccacttatcaattctcaatactataatgtttaatatggtttgtggtaacaattaacacgatctttatcaaggtgttccagaaagcgcaaattgtgatgtttttactctctttttttgggtagttcaatggacttttagttaaaattgttttaaggccttcattccaatgcccaccatcatgatgattttgttctttttttcacctgctttccaatgtatttattactgtaatgtaaagagacttgttcattttcttttagtgaacattgagagtaacatctgcggaatagcagcatatggatcatacagttttaacatcttagaagcgtgtgacaaattctttattctaaaccaaataacaaaattttaacatattagagaaaatggtaattgtaatatctcatttttaaaaagaacagcaataatctttatccttcaaggtaggtttggacgtttggatatttgggttggcttttttggttttagatttagaaatataggacccatttatttatttcaaaacttcagattcggttcagatttaggtttaacgaagtatttaaatataaaaaaatatcaaaaagtatttatattcgattctatgcgaactactagaaaatattcaaaaatctacaaaacccaagtatttttatccgaatatagccaaaagtatttaaaatacccaaaaacatcttaacctccaaatattgtaggcacttaggttattataagtataaatagtactagtaatattcatgatgaaagctaagtgagttcataaaattcaatgttgaatacaataaatagggacaaaatcattgttttctttggtttaaatagtatttttgaatctgatttatatgaatcaattgaatctaacttgtatgaaattattgaatgggagatactagcatcttggtcgctaaatgagataatattttgtgatactttgtgtaacatccttcttataatatgaagaaatgaggtcaataagatttacacatcaagaaaaagaaagctacttgttgtagtgattaataaaaacttcgattatgtccttttttcttaattgataagcttgttgtgagtgatttgtacttgttctgaaatttgaatagatatgcagactttacaagctagtgaagtctagtggaataaaatttctgaagttgtacatttttcaaaacaaaatttacaagaaaaaaaagattaacaaatctttaactgtaagtgtatttctttgtaagttctttgttagcttaactaattgttatgttaacatcattttctgacaatg

SEQ ID NO: 36479 - DNA, 3000 bp, Unknown
  misc_feature (1)..( 3000): 2750-1469P.txt file - cDNA_ID_3096530; gDNA_ID_2936547; Annot_ID_193907
aaagctcttgattaagattttctataaaccaaaatacttaagaagacgagcgagagtcacaatcctaattggaaattaaagattaaaattcggtgggaagaaagataggctctaattaacttggcattatctcagccgtccacaacaaataagcgtcctcgtcatcatcttgagatgatcttacctaaaccctcaatgccacggcagcgatggtagtcagtaagatgatcgtcgtggttctgacggatagctcttctccaccgttgggatcaccactcgtgctgctagatggtcccatagtagtactgtcaggaaacgttatcgtagatgaagtcggcttatcattagtgggtagtgtgctgtttgttgaattgcctgtggatggatttgtggtgcctggacttgctgtggttgaatttccggtggatggatatccggcagtgggggttccgttggaactacaaaaaggttactcttataaacacacttaaatcatcatcacaatttttaagaagatataattaatattttggtaataaatcagtaataaagattctgtcacacattagtagacaaatgactgaactatttcaacgactagaatcatcagagagctcattactgatctaaagaaaacactaagcaaacgaaaacagagggaaataaccctaatctaaactctaaggcaaggtgatgtgaaacatacctagaactagataaacagcttgacgtagctgcaagaacagagtaaataaagaatcagcaaaaaaaaaaaaagatacacatttgatgaaaagaagttgtggttttaatggaaggaatactcgaaggaggggaagtggagatgacggcggcgccgttgaagtcacatgtggcaccggtggaagctttcttttgatagtagctgttaacggcaacgtcacagtggttcttgagggtgtttggttgataacaagctccggtcgtctgaatctgtgcacagtcagcacctcctccacatgcgaagtctatcaccttctgaagatccagctcgttagcgtccttgcacacacaaaccgccgcgtctgtacaaaacagatatctcggattagcattacaaggaaaacgtaaccaagaagcgaaaatgtcggaaccattttgagtcttaatgccaagggacaaagaaatgttcaaagaagatagaaagaacttacttgaataggtaaacatgaaagagagaagaaacagaggaagcaaaaccgccatgactgcttaaacttgatcggacttgtctaacactgagagtaccacaaatgtgagtttgcgagtttgttagagagagaggagattattctgatatgatgatcgacaatttatactctttatgatatttcttgggtactaataagcagaataccctaaggcttaagtaaagaaaagttcagatattattgtgtgatgacttgtaaatgttagattttgagtactcaaagcaatgtgggtctctgaaacagagaaggtgaaaagcattcctgtcgtctagtcaatgtgtgactgtggtcggtcgacgcacgtaatattgtaggctttatgtgaaaaactagctttgttaattgttattcttactaatttgtcacctaagtttacgtacatctgatgcattcttttttaggatttagataagagtctagctttccacaaagacaacaaaagatgcatgcacacgtttgcaaatgtaaaatgttatttaacatattataagataaaataagataaagatgtttttaaagtaaagtaatttgattttgaagcactaaccgatggaaaataatggagaaaaacagggaaaagaacacaaaacaattggaaatagtatacactctttaaaggcaaaaacttaagtattaagtactttttaaaggcaaagcggctaagcgagggagccatgtgcaggacaaactttgcatccgcattacaaaacgtgtgattgtgttacaacgtacaagtcacaaagtcacacaaataatccgaaatggtgttgacagggcgaccagaaatagctataaaccttacctagctctaacgtaagtaatcactttttccttctcagtaatttatttttattgcttctctttgactctggagatggactcaacctcttatacaagctccatggccgattaagggactttgttggaccgaactccatgaataatatgccgtaatcttagataaaaattccttcttatcattctatttaatttaaatggatgttttcctatcatgctgatgtcaagtatgaaactcatcaccaacaataaccatgagcgaaagatctcgcttaaatttgttgcaaactgaatcgctaataccgaataagcgaaaaatatcccaacaccaaccattaaaaagtgatttgacgttatatacatccttaacttatataaaaaccaagcgtttaaaactaaaaccaacaaaaacacacttgtaagaagaaaaaccatagcatgtccattgcacatatgaggaaggtgtctttagcaacatttaaaaaatttaaattacaaaatattaataattaaatgtgagaggtctttaaattaaagacatcttttcaaaaaaaggtcttcaccaagacatttagacacaatgtttttaatttaaagacacacctaaacattaaataatatatcttctgtttaaatattaaattttaattgtggaagactccctcatatgatgtatgtgtggtttctttgaaaaatcaaggtttgggctatatctattaatgggctgggctttatactaaaagactaaaacatgtcgaggagtcaaagacaacttctgaaaaaaagacatcagatttcttggataatctctaaaatgccactgccgtcatcgagaacagatcgtcacgaccggagttagtagtgtctaaaaactcatctgagagagaagaactcagaaaaccctaaacacagataaaccccaaaactcaaaaaccaaatctttccaacaatg

SEQ ID NO: 36480 - DNA, 3003 bp, Unknown
  misc_feature (1)..( 3003): 2750-1469P.txt file - cDNA_ID_3096538; gDNA_ID_2936547; Annot_ID_193905
catcattcccgtcgcagccttgtaccctaatcgcttccgccgctacaatcaggacttgccacaacttgccttccagctttaaatctaaggaccaaaggttgtacttcttctcatcgtcttcttcatcatcaactgtcttttctacgcgtttgacatgtccgttgtccccatatgataatctgatagagtactattatcattatgctagtggtttgataagcattggatgtaatcgaaagcaaatcgtaactaaccccagcactggtagattcataactttaccaagtgtcagaagaagaagagtggtcgtgaaaagttttttcgggtatgatccagttagtgatcaatacaaagtctcgtgcatgacggaaagacgtcatggccttcgacaagacccatcatctgaacatcaagtgttcacattgggagaaaaaaagccatggaaaatgatagattgtactagcattcctgatcaccgtccttggtctaacggtgtgtgcatagatggttttgtgtattacgttgctaaaactggacaaggtatgtcacaactgagcttaatgagatatgctctgagggctgacaatttgaatctttttactagtttacctgaagagcttcgaactctaaaactatctggtgacactttattgaactatgaagggaatgtagcatggccactccagttacatcttatatttaatgtgtgggttatggatcaggatggcgaaaaacatgaatggttgaagaaaataactttcaatattgaaccttggaagagttcatctcgctatctagacgttagaggcactactcatacgggtgagtttattcttgcaccatcgcactatcctgatgatgagttttatgtcttccattacaatctcggcaagaatagctttacaaagaagaaacttcaagttcgtatttacaatgttagaattgtgtctacgtcttcaataattggtctctatctctccttctctctcttgtagtcatcttctctccatacctctggaatatatcagccaaatcaaacaaactcacttctctaagtttcttagccatctcttcaaacataaccacaccttcctcattagaataataatgcaagaacttgctataatcaaacctaggaacttcaagccctctcttcaacgttctctcaatatactttgtagtttccaaccgtttccccgccttgatcatacctccaacgaatatcgtatcgaaattcactaacgggtccggccctttccttccccttctccccaaatgtccttgcaacaacataagatacgtatgcattattggctcgcaccctctctgtatcatcttcctgaaaacctctgttgcttcgcttgcccgtttaatcttcaccaacccttttatcaacccatgatagatactaatatccggattctcaaccccttccaccaacccataagcctctacaactcttcgtttaaccaacagtccatagattaacgacgcccaagttaagttatccacataaacacctctctcacgcatttcatcgaacaccttacgtgccatatcaatcctaccgtttttacacaaccaatcaatcatcaccctgtagaaacccccatccaaatcaccacctcttttcgaaaccataacataaaacaccttagaagcttcatcaaactgattcttcttcagaagtgtttccataatctttttaccagcttcgatatcaacatcaaatccttcatccatcatcaaattccaaagcttagcagcttcaatcaaatcaccaacatcacaaaacccttgtatcatcgtcctataagtaatctcatcaggtttaataaactccttcagcttaataaaaacaaacttagcttcttcaacaagcttctccttacacagagtctccactcctctattcatcgtttccacattatacaaatacccaaaaccgttcatcaaatggaaatagtttacacatttcttcaactctctagcagaagcaagtgttttcaacacaatccgaaatgtcttatcgttaaccaatccacgttttccgatctcttgagctaattcccagaaaagatccatgtttcttgagttcccgatgattgctagcatcttattagaggtagtggaagtgtgggtgaaatcagggtggtgagtttgagaatagaggaagaaacggtgtacaggacgccacgagagtgggaaattgttgcagacttggaggaagaactcgtgagttagttgaaatttggtggaggagagtttagagacgagacgtgaatcaggtgagttctgttgctggtagagaattgtacagactcggagaagatggtcttggtttatcggtgtgattgtggttggagttagctcggtggagaagaagcggtggttgagaatgaagcatcgccgaattgagtttccgatgttaatcatcctccgagaagtcacgacggccacagccataagtttcccggccaatggagaaaacaaaagacaagaactaaattaaataaaaaaaattagggtaaaattataagaggctacaaagaagcccatctaagcctatgtctaaaaatgagtgggaaaatggagatgcgggggatcgaaccccgtgcctctcgcatgcaaagcgagcgctctaccatttgagctacatccccgttgatgtttaaatacgtaaccaaaaacatatataggattagataaaacggtgtcgttagggagcgaaaagttcgttaagttagttagaaagaatagcgaggaaaaacccaggaatttcgcagacacagaggtgtgttcggatctcaaggttgagattcagtcttcttccgccatttgcgaaccatcttcgaaactctttttatatttctctctttccctcccatctctttcgattattttatttatctcaccaaggaaaacaaaacacaaaacaaacaaacaaacaaacccataaatcaagatctctgttttcagacagattattatcggaacaaaatg

SEQ ID NO: 36481 - DNA, 3000 bp, Unknown
  misc_feature (1)..( 3000): 2750-1469P.txt file - cDNA_ID_3096558; gDNA_ID_2936547; Annot_ID_193900
tttgctgcgtgtcttcatgatcaatcgctcttgtttcgaaaccctaaaaaaggctctccgtctaggcgtctactctttgctttgctcttttctagcaactagtaaaactatatatatataaccaatgggcttgttgagtcagattttacaagcccaagataaagtctcatcagaagcccacttaagtaagtagagattttgtgtcgagaacatcaatatatatatgaaattaatccacaaatcagctaaatcttggtgacagtttcttttcctcttttacatcttttgttcaacaaagcttcatatgacctatcttatttcttagcttatatatatctatcttattaagttattcaagatcatcaatcttcttgctttggatttgcttacagaattaaaccaggagtgtaaagacgttaactgaaacacctatataaccttacacacttgttatatattatacaaaaattgatcagagtattgttcatgacggtaaaacttggggggaaaaaaaaaaagaccaatctagttgtcactgcaagtttgctttttcatctagggtctgcaatctcttaatccgcttctgagaacttcttcatccagtttgtgtcctgcaatatattcaatgccttgaatcagtaagcgagtgttgggagcaataatgttaactatgatgcaaaaaggagatatgacctataaatactattttgtttgttcgattctcttcctcgctccattttcgagctggcactatctcatatatatctctaacggcctgcgcatattcaataacaaattctgagaggatcataagaccttactcatgttttaattcatgactacagactacattacctgcaaaatatgcatctggtctgagttttgaatgctcaacacagccttgcaacggtatacatccatctccgattttttatcccacagaatttcctccagccataaacgaacctgtcaaaccgagaacaagttggtgtatcacgaacaacaatatttcttaactacttgtccaagaatgttcaatacatttttgctaccttatcgaggtttataggttgcggttcgctgatgcatagagtccttactccactatcgtgaagatctgtcgtcgttaatgatttatttgcttccagcagggattccagacgactaacatgctaatttcaacagtaaacaaggaagataagttcagtttttacagtcaaaagcataattagtaatcaagacgagaagagaagtttcagagacttaacagttgaatcatatgcctggcagtttaatatattggacaaatcaacttggcacctaacagatcggatgacattggcgagcgagttgatggaatgaatctccttctctaattcatcagactcctcttgagaaatcaagtccaccttgttcattattatcgtgtcctgcaaaacgaattaaaaaagtcatgtcatgatgtagagggccataagtcagtgtacccattggttgtcagaaaatggttaccgcaaatgctatttgattaaaggcctcaggaaacgaggatgagtcacgacgctcattgagctgaaaacgaagattctttgcatccacgacctgttcaagcagctaggtcagtaaatgcatttggaacaagatacctaagcaataaattagtggaaacagggagacagtacacaacctgagacatttatgttacaaagagctaaccagaaaaaagaaagatcactagctatgttttactaagagaaataatggtgtcaatagcataattctatgttttacaattcatctgatgtgtacaagatgataggagaagtataaagagcagcttcaagcttaacaaaggagaagtgaataagatactcacagtaacaatacagtcaagcttgacttctgattctaactggtcatccaaccaaagaatagaagccaatggagctgggtttgctaaacctgttgtctccaataatatatgatcaagcctgcatagaagaaagaaaaagcagaacgtctaataagtgaaagatacattcttctccaaaatgcaagtaataatactacaatttcggcgatatatgtgcctatggtttgtaaagccatcaccaatcttagagctttaggcctaacaatcatcacgaatatctcagtgtgtctagaaattagatagaagatcataaatttgagctgaaccagcgtttaaagagagatagagaaacaaagcacctgtcttttctctgaacaagctgctcgagagcttgaacaagactatgcttgacagtacaacaaacacagccattagcgagctcaacccattcttcaacaatggcaccttcttctccttcgttaatcatagccctctcaactccaatctcttccccaaactcattcaaaatcacagctattctcttcccgtgtttcccgttcaatatataattcacaagctggtgcaaaatcaatcagattacacaccacaatcaaaaaccaaaacccaacacgtaaatcagtgaaaggaagggacttacagtggattttcccgcgccgagatagccagtgataacagacacaccaactgaaacagtatcgcttgatgagtgaacctttccgacagaaacatccggatggatttgaacagccatcggtggttcttcatcatcatcttccattttcactccctcagcttcttccttcagcatcgccggtatatgcagagacgccgtaaaagacagagctccatatatgggccgagctcacattagcttggttcggttcggttcggtttggttaaaatgtcaaacgactcaaaaccctaatttttaacaaacaaattcttagtctcctctgctcgattcttgcatctgagagaagagcaagaactaaagttctctcgttgtcttttgttttgaaagagagcattttttggccctttagtctccatttctctctgctccttctaaggttataaggttttttttagtctttggttaaacgatg

SEQ ID NO: 36482 - DNA, 3000 bp, Unknown
  misc_feature (1)..( 3000): 2750-1469P.txt file - cDNA_ID_3096570; gDNA_ID_2936547; Annot_ID_193896
ataaaatgtcaataatacccttatttaatttatggaattacaccaaaaaccacatctcatcttcagcttttcctcgacacaaaacagagaaaatcaaaattttgatcttgtgatctcgccgtcgtcgacgagaatcggtcgccggagatctcgtcggatccatcgctggagtgtaacaggtttgtgttgctctctctctctctctctctctctctctctctctctctctctctctctctctctctctctctctctctctctctctctctctctctctctctctctctctctctcgcttcctctctctcgctccatgtctctctcgttgtttctctttgtatccttcttgcaatcacttgttctagggtttgatcctccgtggttacattgtttgtttgtgggtttgctttgctttactccgtggctactttgattcttcgattagctttagtttatggctttgtgttgctttgcttgctttgtattgcttttgattcttcgattagctttagtttacagctttgttttgcttatattgctttgtgttgctttgtgtttttgatgcagaaagctaggatccagatttggcttgaaggatttaaggattgaaggaagaatcactgtaagtgattcatctttggttggtctctaagctcacgtctatcaatcacaatagtttgctcttgcttgtttcagatctttgcttggtctatgggaatctaatggtttctcttctccatttgctcttgcttgtttcagatccgttttctctttagggattttgctgcaacggcactgtggttcaggattcagaacttggacaggtaggttatatcaaaacactcttaacaacatgagacatcaaatgccacacacgctcacagaatctctcatataagaagaagcaatgccaattcgttagttttgatttttcgttagttataataacaaatatgtacattagtagagtaatcaagtatttactacaccgtgggttagttatagattcaaattaagtggtatttgtagccaatacattagttagcacatgacttcgaatccttttagtatttaatcattttctttttagttgatctgatgcaaacaagggtagataagtatcatattttcagctttcaaaaccacaaaccatttactgtgtcttctttatcattgagaccatgtagcttattgatatgaaatttttaacatctttctggaatgacaatcttctctgtttctaggctttgtttatttgtctctaaaggttctggattcaacttctgaacaaggtagtagtccacaagaaggatctttcttacgtgagttttttgttcctcttctctctgtctcttttctgatttcagtatcccaagtgtgatcttattttcttgccctctgttatataattggtgttattgattgattcttcattcatttatcgatgaagggttggttttcatttgtgttgaattggatctttgtttgaggcttctttttattgttcggatgattatgatttggtcatttactggaaattgagaatttttcgattcagttccatagagtaatggtatagactatagagtaaaggaaatcgaagaagtttgctttgtttaatggaaactgttggggaaaggatcattgtcctatttcgctccatggtgagtttaatggtggatgatttgctgaagcgttttattcgattcctttggttttgtatttggttctcattgaattcatataggactgatattgataaagattagtctgaggctttgagctagtgcatttgtttgattgatgaatgaaactgtcatgttgaatttgttggtatgatattaatttgtctgtgcaggtcccaaaccggaggttgttgaagctgaataatgttgtgtgcctcattgatctcttgatgtaagaagctgaataatgttgtgtgcagattgggacaaagcaatggcgttactatgacaaaaccaaactctctttttcaaactctactttgattaatatgagaatgtagctatttattatttgttacttaacagagggcattttagttatttacatatatatgagaatgtgaatgatccatccaaatgatcaaacaaacaaagctccatctaaatgaatcatttagatgaattagcaaataatcaaacaaacatcattaagatgaatcatccaaatggattatttggatggatcatttggatgataattccaaatgatcaaacaaacaggaccttaatcttgaaatcttccatgtattaaagttgagttattcttaccaatagttaacaaccccaaaatagtgatagacttttagttaaagaaatcaagaaaacaattgttcaatgcataagtggttccataccagtcatcaacacctacaaatactcttgattttcttttaaacaaatattagatatcctacatgaaaaattttagctctcaacaaatcaaaataaagaaaagttataattaatttggaatacaacaaaaaaaaattacaattatttaagcaaatttttatatttaacagtatttaaaattgactagattttttgttgagtaaccttatattttcatttgatcaaatcaatttaacatcaaatatcatccatataacttctcacttactttataccatacgtataattgaatttacttttcatatttgtttttgtctagcttcatgtatgcatctcaatattaacaacagtggttatcatattattatttcttttgtctaaaaaaacaaaaaatttgtcacttttttctttggctcggatcagaagattttaggtctctctttcctttcctatatatagtagtaccccttacatagctttttccacttgcactcctctttttctttctttctttcttgttggtctctcttacttctttcttattcatctaaaacaatttcgatccatttacacataaatatatgtaactggccgtagaagaaacacattgaaggaagagatg

SEQ ID NO: 36483 - DNA, 3000 bp, Unknown
  misc_feature (1)..( 3000): 2750-1469P.txt file - cDNA_ID_3096584; gDNA_ID_2936547; Annot_ID_193893
acaaggtgtttgatttaacgccgcactttcttatatagccaatcatcgacttgtagttgttgtaaattgtcactttgttgtttctattaaaggttttgtctttgtataattgactgatttacgtagactatatcttcttggctttgtactttaacaggagacgttttgaaaatcagaaatggtgaagatatgctgcataggagctggttatgtgggtggtccaaccatggcggtgatggctcttaagtgtcctgagattgaagtagtcgttgtggatatctctgaaccaaggatcaatgcttggaacagtgataggcttcctatttacgagccgggattggaagatgtggtgaaacaatgcagagggaaaaacctcttctttagcacagacgtggagaaacatgtatttgagagtgatattgtatttgtctcagttaacactccaaccaaaacacaaggtcttggtgctggcaaagctgctgatcttacttactgggagagtgctgctcggatgatcgctgatgtctccaaatctagcaaaatcgttgttgagaaatccacggttcctgtgaggacagcagaggctattgaaaagatactgacacataacagcaaaggcatagagtttcagattctctctaaccctgaatttcttgctgagggtactgcaattaaggatctttataacccagaccgtgtgttgattggtggtagggatactgcagcagggcaaaaggctattaaagctttaagagatgtttatgctcattgggttccagtggaacaaatcatttgcacgaacctgtggtccgctgagctctctaagcttgcagcaaatgcattcttagctcagaggatatcatctgtcaatgccatgtcagctctatgtgaggcaactggcgctgatgttacacaagttgcgcatgccgtgggtacagatactagaattggtccaaagttcttgaatgctagtgttggttttggtggatcatgtttccaaaaggacatcctaaatcttatctatatttgtgaatgcaacggcttgcccgaagcagctaattactggaaacaagtcgtaaaggtgaacgactatcagaaaatacggtttgcaaaccgggttgtttcttcaatgtttaacacagtctcgggcaagaaaatcgcgatcctcggttttgccttcaagaaggacacaggtgacacgagagagactccagcgattgatgtttgtaacagattagttgcagacaaggccaagctgagcatatacgacccacaagttcttgaagaacagatcagaagagatctttccatggctaggtttgactgggaccaccctgttcctcttcagcagattaaagctgaaggtatctcagagcaagtgaatgtcgtctcagatgcttacgaggcaactaaagatgcgcacggcctatgtgtcttaaccgaatgggatgagtttaaatccttggacttcaagaaaatctttgacaatatgcagaaaccagcttttgtgttcgatggtaggaatgttgttgatgcagtgaagctgcgtgagatcggtttcatcgtctactccattggtaaaccgcttgattcatggctcaaggatatgcctgctgtggcatgaaggtgccaacttcaaccaaactatatgtcttttctaaaatatagtatcttaagattccttataaattctgttgtaaccaagctgaaacaatgatatgtatttgctgaatctgccttagctggaatagtatatgaatttctttgactatttgccttaccataatagtatgctaaaatcctcaacaaattaattgaaattttggattaattgtgacattggaaaagataaggaatgaagtgtaaaacttacaaagcaataaggacttgataaaaaaagtgtattgcttttaaatttggggtccagctcgattttagggaagtttgcgggtcaaattcgaattagtgttttgggccggctttgtttagaaaaaatagatccaggaacctatatccactttttcgatattatcttctctcgtcttcttccccaaaagtttcatcgtaaatccaaatttttctgtctttttctttaattttattgggattttttctaaattattcttgctattgatatcatctaattctcgttcccctctatctattgatactaattttatttcgattgtcaaaaaaaaaaaaatctagggttagggtacttgatctcttctctagttgtttaatatcttgatctatcgttttctttcactatttacatcaattttgataaatattcctttcgattttgatgtcaatttcatgtttttcgcccccgattgagatctagggttcatattaatcgatctagcttagggctttccagatctgtaaattgttagagggttttctctgagtttgtataggtttgatcaattcttatccaattcatacttgatttggttaatttttgggtagttggagtctagggttagggtttcttctgatttggggattttttatttttccagcttaagcttttaaaagcctgaaattcctattggttatccctatttttagtctattggtggcgttctagtatggttctatctttttgaagttggcctaaaactttatctgagcttacttctttagagaggtgagtaatatactacatgttaactggacatttgttcctgtctgaactgttttttaagcattagttctttgttgtggtggatgtgtgttaaactagcatgatagtatagttattgtcttaataggaacgtttacagatagccatcctacataaggtttgtataaggtttcttgcatgcatttgctataactttgtggaggaatccgaatcttatcatttacttgtttcactgtcaagtgcgaatgttgttgttttactgttccattgtctgaattttcctttcattctcttattcgttcttagagtttattgcatttgattaccaattatgcaagttgaaaatg

SEQ ID NO: 36484 - DNA, 1726 bp, Unknown
  misc_feature (1)..( 1726): 2750-1469P.txt file - cDNA_ID_3096599; gDNA_ID_2936547; Annot_ID_193890
ttttaacaaaaacaattttatgcgtaatctctacatatgcataattatacaattatagttgatgtagtttaaaaactacaaaacaacaacgtccattaagcagttatgagtttcgatgttaggtataaatatctttatcttataacaatatatgatagagtgtaacgtttacaaagcagacaagatagaaggaaaagcttgtgtcatttattctacgactgcttgaatatcttgtatttgtagaattgatttgtaggttctaatggatgatgtgaaacacgaatggtaaaacaaggtttttgctttagatctttggataactgggtggtattttcactacatataagacaataattcaatgcttacaatgatttattgtctaattatcttataacttagtcaaaagtttctcgctcatctacaaggaaattaaacaaatgtaattcaaaatttcaaacgattaataccatatttactcttaatgacagatttactccaattcaaaaaataataagggaaccacttaaatgcatgcttaagaaaacataaacatgtaaagaaaatgattagatcatgaaataaaaaggaaagaaagaataaaaaaaaaagaaaacagagaagaagaccgagtgttgacaaaatatcatgtcactgttattagaagcctattaaattttttatttttattaaatagaaaaacaccaaatccgagaaaaattaatataaaaaaaaacaatataaaaggtcttattcttttatttacttcattcgttaaagaatctgagagatagaaaagccagagaaatatatatagagagagatagagagagagttggcccatcggatcgaagaagaagaagaagacggcttaagctttcttcttccattgaggatttttgattcatttggcactctctcttttttttgttattatttacttgagatttttctctattgattaaaaaaaaaaaaatcagagtgaatctaggaaacacttttcttttttaatttattgttcattttttccgataatctgtctctgatttagggagattttttatctgttcaaattgcgatcagaagatgtgggtctgaggtaatatctctatcaccagatttctatatatttttattttttggatatttaattattcatttggttcgtctctcttttttatatatatagttgatttgatttgccatttctgaatttttcatggattattgtttgatgaaattaggttagtcgtttaagtcaattgatccagaatctaagctttggtttttgattttgattatgattataatttataaatgtgaatttgtgacagtgaatttattcgattcttttttttttttgtttgttaaattctcgtaaatggttttggtttttattgggattagtttgcgtgtaatctggtttatatcattgatgattcgattaagatgcagtttctctatttgcagaatcttcttcttcgcttttagatacgacaaaaatatatttatactagcagagatgatcatctcatagtttgcttttatgtgttaatgttgtttcacgttgtgtttgtggttctgtgattgtacttgtatgttatgagtttgcatatgtatcagttagtggagtgtttattcaatgagggatctcagtgaagtgtttttttggtcagtgaatcgtggagatgcaacgtatgggcggcgatattagacgtgtttcgcaatg

SEQ ID NO: 36485 - DNA, 3000 bp, Unknown
  misc_feature (1)..( 3000): 2750-1469P.txt file - cDNA_ID_3096667; gDNA_ID_2936548; Annot_ID_193956
tgctgcttcatgattgcgtatgttttacattgtaaggtttatttataagcaagttgttacaatgagtgagtggtgctaacaagggcttgtttaatgatgttacaagtacagtatattcgatgtgcaatgagtgactatggatgttacaatgtcactgaaccacctattgatgcccccagagatccactgtacaaatctgagagggagatatccaaggtacatattggaccatgtacattgatgttaaatccattaggtctttgatgcagggagtcttgagcaacatgtattaacaaggatgtacttagttttgatttgacaacatttttggaaaccacaccaggaaatatgttttttaagcattaaggatgagatcaacacgaaactacttagtttagtagttacagtttctgatacaaattgtcttcatcgtgtttattttttatgcaggttttcttgacaaaacattaccggaacagaaggacaaacgatccagaatttgtgctagatcttgaagagatatatgttattgattccaagacaaagtcaatcaccagagccagagttctggtatgactaattcttatcttccaagttatttaagcattattaacaaagttctcattccgagtctgagcacaaacctcaaccgtagaccatagccaattgggttttttgacatattcttatagaatatttttcatgctataacactaatgaaatgctggtttatattagtgctatttatgcctctagttctgaatcagatatcttgagttatgagttctttaaatactgtgcatagctcaaagctatgaagacaatcttctttccgatgttaaggttttagattgtttcaggtgacagttccgggaggaagaaaaagggataggaaggatgacttgcttgtgatacgagataatggaacctcctttaagatcatacacgtggtacctttccatttccaaatgaccaaatccatttcatctggcagtcatttgtattccttcatctagctttactcatcttcactctatgtctatatatttccattctttcagggtgaaagagatgacccaacaacggtaatagaaagagaagagtggaccaagactagagaagacatggagaaacatctcaggaagctacgagacttcagtgtctcaaattggttctagaagaactcgagagacaccaaacgacaagtcagcataactttcttcctgagatggaaaacgagagcagatgatctaaatcgatgatatggtggagggtatacaattttggtgacctcaggtactgcactagcagcagagatggatgtgttattagatgaatatgggcctctagaaaaaagtgtgtagatgcaatagtttgatggactaacattcaatgactagagaagctagcttatttgcaagttttgaggtgtttaattcaagttttcaattgatgattatgatggcttgtattattcttgtgatgagatattttcatattcaagattggaacaaagtgtttgtatttgagaaattgggatggtgttgactgttgttgagtggactagttagaacttgtagccggcgtgtcgttttagttatacgaagctactaaaaacgacaggtagtctgttattctaaactttttgatgtaattaatgatgacatcaggaaaagacacgtgtacggtatcatgttcggtcgattggattttcacgtgagtgggattacaaatgtcaaagtcgccgacagagcagtcatgttgtgtggttggttccattggcccattctgtgaccaccgaacattaacttccctattcagttttttaatacaaatatctttatttattgccacacttgaaaaattacatgaatcacttagaatgacacgtaaaacaaaataaatgcaccaacagttcggtgatatggaattcgttaggtatataagaaattaagaatagttgtaaaacacgattgtgttcaatattatggaatgaaaattgcgatagaatggtcagaacgatcgatttgacatatgccaaaccaacaaggtagagaaggaaatgatcaaatcttaaaacaattcaattgagtcgaagaaacaaaaacatgtgcacgataaaatgaattgcacgataaaataaagaagattgacgtgagaaagaatagtcaaatggaataaaaataacgataaggtatgtgcatcaaccgttgaatttgtaagtaagtatggttttggtgggctacatttctaataagcatctttgatttgtcaatctacctattaaaatacatacacaatggacaaggaatgattcatataaaaacaaaggaataaaatcacataattatgataatttgttatctcattgccggaacctcatttatggtacttttatacatggcacaacattctattaatcgataacggtggaccatattccccgtatttaatacgtagatttcttcttctactgtttggtatggtaccaatctcttaagttaattatgtaacataaattcagataaaagaaaatgtttgtgttgcatatattttttttttgtataaaataatctacaatagggaataaataaagttaatttcatgaatgtatctgaaatatttttaaattaattaaaatgagcaaaaaaaagaaaagatatatctatatatattttttataatttgttatttgttaggttgataattaatgagagagtgtactgtgaagactaaatattaaattatgtattttatttatctaaatggcaacgaaatgaaaattctcatatgtctgctcctccattcttactcttctctctttctcagaagctgcaaaaccagagagtgagagagaatagagattcacttttgtgagcgttgcgatgattttgtgcctcgtggaatcatcacactacaacgtattcacctgaaattcagacaaaacagtttgaggaaactgggaagtgataagataagagagtgatagagagagagatg

SEQ ID NO: 36486 - DNA, 3000 bp, Unknown
  misc_feature (1)..( 3000): 2750-1469P.txt file - cDNA_ID_3096672; gDNA_ID_2936548; Annot_ID_193955
cacttgttcctgcaaaatttccagaagatttgaccccattcattacaatgctggtaaaagaactgcctgaatttagaccaggttggcctttgctttgtcgtgtagcttcttcagatgtattagcttctgctccgagaagttcttcgttccgaaagataccagttgtgcagtgggtgctgaagctgcccgctaggaccaattctgttgttggaagctcagacacaaagcagattggttttgattcttctgaatctgaagaaaatgataagttgtctagctcaaacgttgaaaggcaagcaattgttcctgatgaatctatgatcgtgaaatgttctcttgatcatagctcaggtagatttccagagaatgtagagggtcttcaggcaaggatctccacatcttgccagttttttacgtataaggaacttgtgtcggtgacatccaatttctgtgctggtttgttcctctcttctcataattaagctaccgctttgttttgaactttcttaagactcttgtcatttccttttgtctaaataagaaaagcaatgtactttcagataatttcatcggaaaaggaggcagcagccgggtttttagaggttatctgccaaatggaagagaggttgcagtgaaaattctcaaacgaaccgaatgtgtcttgaaggattttgtggcagagattgacattatcacaaccttacaccataagaacgttatttcccttttaggttattgctttgaaaacaataacctgttactagtatataattatctctcaagaggaagccttgaagagaatcttcacggtaagcctctgaccatttagccacttgcagattttcttgtgttctggttctaacaatcaaggtttgagattgagattaggcaacaaaaaagacctggttgcatttcgttggaacgagagatataaggtggccgtgggaatagctgaagcgttggactatctgcataacgatgctccacaacctgttattcacagagatgttaagtcatctaacatattattgtctgatgattttgaaccacaagtaagtttcttttagtttccaatgtttacatcgaagaggaaaaattcacgagatactaaaaagagaaatcttgttcacagctttctgactttgggcttgcaaagtgggcgtcggaatccacaactcagataatctgctccgatgtcgcaggcacctttgggtgaggaaaaaaaatatatatatgttgatgctgcgtgaaagttgtttaggagataacaatcttgaaaatgttctacgtttcttgttgcagctacttagctccagagtactttatgtatggtaagatgaacaataagatagatgtctatgcttacggcgttgtactcctcgaacttctttctggaagaaaaccggttaatagcgaatctccaaaggctcaagacagtcttgttatgtgggtatgtggatactaccggcaaaatgttcttacattgaaatgtctaagctttctttgttattgctaaacagacatgcatgtacacttgcaggcgaagccaattctggatgataaagaatattcacagctattggactcgagtttgcaagatgacaacaatagtgaccagatggagaagatggcgttagcagccactctttgtataagacataaccctcaaactaggccaacgatgggaatggtgagtcaattcttaatcctccatttcattgccagtttcatcattttagagatggctactatatcaaacaagttattaacacgatatgtcttttggaaatgcaggtcttagagcttcttaaaggtgacgtagagatgctaaaatgggcaaagctacaagttagtaacccgttagaggattcaatgctactcaaggacgagaaattgcggaggtctaatctgcagtcacatctaaacctagcattccttgacatggaagatgactctctttccatgggaagcatggagcaaggcatctccgtggaggagtatcttaaaggcaggacaagccgttcatcaagcttcaactgagccattatttttgttcactacaacaaatcacaattgcaatactcaacaatgtgagatggtgaaaaaaaagagttctcctgtgtgtgagtgagtgtaaagtgtatatttaagaaaatgtgtttcttttcattgtcatggtctcatgggtggtggatgagaggtggatttgtgtgggttttattgccctcctccctcccttggtttaggggttatagttatagcgttcaaaggtttcgtgtgttttatgcaatgttttttacttgggaacatcagagacatgtaatttgtattccttgatcctaatggatcaaagtgaattttcttgtcttgtaatgctcgaacgtgtctcactgttatcaatagaataacattatcttgttgaaatacaattttacatatattcgagagtgcctatcacaatcttaaagattttggcaatcttatcataactctataatttggaagacaaaaccatatgcgactgagtcaatctataatatgtggtaagagatgacataagtatttttttcttgtcctattcaaactttgattgagtttgaaagaaacatgaccggatgtaataatttttctgataactaattctttgataatgtacccacattttttttttgtgtcagcaacatgtgtatttggtagatttgaatctagacaattgacacagattttagctgaagaacggaaacttatacaatacggcccataataaatgcagtggcccaataagattagggaaaagagagagttacgaagaagatataaaaaccggttaccgaaaatcggaacgattcgagaactaaattgattcgtgtgtattatactatttttatcgccgttttcgtgttgcgtgcgttttcatcagaagacgaagaataagaagaagacgacgctgtggttcaaaagatctaaaatttctcaaggctaaaatccaaatcagccatg

SEQ ID NO: 36487 - DNA, 3003 bp, Unknown
  misc_feature (1)..( 3003): 2750-1469P.txt file - cDNA_ID_3096677; gDNA_ID_2936548; Annot_ID_193954
atatgtttatcaagttctgtagcatcacatatataatatcttgaagtccccaaaaatatttaataaccagttgtaccatgggaaccaagaaaaaccaattcatgtcggtttaacaagattagagaatcctaaaacgaaacaacataagatattcccaactaaaagcacacgacataaccatacgaaataaatcttcaattcatgattatggtatcaagcattatatactttgaacaaaactgaaataattagcagattacattgaaactgtttacaaaacttcttcacaatgatcatacgctaattaaacagtttttttgccacaaacttcttcacaatttttttgtaataaacagtttcactatattttctcttcatctctttcttggatttatttatgttagtgagctactaatctgattttgcagaaagaattaagaaacatatatacgaagccatttatgaagttagttttcatttgcaaattccgttttggtctgttaatatggctagtgttttttttcttcttttaaatgggtttgaagggtttattatatatcacgtgtaaaacagttgaccataatgctaaaaattatgcatcatacagagaaactactaaagaaacaaaatagtcaaatattcagctaattataacagaaatctagtcatatcgtcacaatgatcacacgctatactatttatcgccacaaccttttttctctccacatggcttgaaattgtcatagattatgttatttctgacgttttgtgcgttcatataagacttggattccctagaacttttaagtcgaacaatttgataaacaaacaaaaaaaggcaatcctttggacattttagcttaagctggattgaaactaatacactgaaaattgataatccatacatatatatctactaacggctttagtgagaagagccatttcattaccaaaattaataatttatcatagtataaaagctagacagtttatacatcaacacatcggataagcaaagatatactttacatatagtgattgcaatttgcaaataacacatcaaacatgtaaaaggactacacacacatgtcacatgtgtatcaccatcattagacatgtaagatcatgttcttgaattcttcaaagtcaacaaaaccatcaagattcttgtcatgaactcgaatcattctcccacaatcccaagcctttgcctcctcctcaaaccctagccgttccaacacatcacgaagctcctccgctgaaatataaccatctccgttcacatcgaacacattaaacgccctcgcaatcgcttcatcattatcagcaacaacatcaatattcttcttagatcctttgctatctaaaacagcgtcgtagtagaaccgaaggaactcgtctaaatcgaggctctgtttaccaacgatcagttcaagctcatcgggagtgtgttcggcccaaccgagtttatcaagaatccaaaggagctcgtcgagggtcacaagcccgtcttggttcttgtcgagcgtcttgaacattcttcggagatcgtttgtagttatgaatgaacaatccatttgatcagagaagggtagtttggatcttttggttatgttgaggaaatgtgtaaatctatttattgagaaattgtgcaatctttatcgtctataaaacatatatacacgtacagcaacatatttatatgattagtgtgtacggaagagattaaagcggaggaaggttcccggaaatgggttatgaaacgactaattttatgaaaaatgatgtttctagaagaaaagtcaataaacatgacatttagctaattttcttgtgtcaactatgacatatagctacttttatatgaaaatttgatagcgtatttaattatcatctttgattttttttaatattaagtaaaaacagtataagaatgaaaaaattaacttgataatataaccggataatctcatttactttctgccatagaaaaatgaaaagtctaacctaaatcgcaattttgtactaacaaagaataacacacctttgcgacattgcaaagctttctaaactatattattataccttgtattttgatagataaatagtattaatgtgctatggaaaaaaaaagttaaaaaacagtagattctaatactctatgtagtagagtggtgtcatcataatcttagtttgacatatggaatgttcggtaacgttctcgagttccgtggctaagtcgtacggtccccatttagtagatatttatcaccggccacatccacatacatacccatccacaattttccagtggatttttccctgtgaacagcaaaagcaaaacgataatgcttatagttttcatgtggattagataaataagaggaaaattatagcattgtctttgcatctccaaccaaatcctatttcctaccataattttttcatttaactatttatacaaaaataatgaacaaaagcctgagcccaatttacaaagttgggccttattatttatgggcctgaaatgaaataatcaattatgaccaaacacaaaagctctcttatgactgtagtaactaactgtcaatgtctctacagtagtacagtgagtcggaatgtgagctacggcgtgatgttcgatgagagaagttaattccttttctaaatttagggtttctcttcatcgagatgtttcttttaaatgatattcttcttctttcagtaatggaataatagcttctgtacgaaagatctttctggcatttgtaagtgaacccattccactcttcttgcatttgtaagtgttttctaaatttctactcctgcatgctctaatttggccccaacgagaatttgtgtgtttgagtggtcattgaatcgaactcaaatttagcatttttaggattttgagtcaattctagtttaggattcgtctctaatgtttaatttagtgaaggctatgtcattttcaggaatctgattgttttccgtttaaagatg

SEQ ID NO: 36488 - DNA, 3000 bp, Unknown
  misc_feature (1)..( 3000): 2750-1469P.txt file - cDNA_ID_3096685; gDNA_ID_2936548; Annot_ID_193952
gattgcgagggcgtttaatgtgttcgatgtgaacggagatggttatatttcagcggaggagcttcgtgatgtgttggaacggctagggtttgaggaggaggcaaaggcttgggattgtgggagaatgattcgagttcatgacaagaatcttgatggttttgttgactttgaagaattcaagaacatgatcttacatgtctaatgatggtgatacacatgtgacatgtgtgtgtagtccttttacatgtttgatgtgttatttgcaaattgcaatcactatatgtaaagtatatctttgcttatccgatgtgttgatgtataaactgtctagcttttatactatgataaattattaattttggtaatgaaatggctcttctcactaaagccgttagtagatatatatgtatggattatcaattttcagtgtattagtttcaatccagcttaagctaaaatgtccaaaggattgcctttttttgtttgtttatcaaattgttcgacttaaaagttctagggaatccaagtcttatatgaacgcacaaaacgtcagaaataacataatctatgacaatttcaagccatgtggagagaaaaaaggttgtggcgataaatagtatagcgtgtgatcattgtgacgatatgactagatttctgttataattagctgaatatttgactattttgtttctttagtagtttctctgtatgatgcataatttttagcattatggtcaactgttttacacgtgatatataataaacccttcaaacccatttaaaagaagaaaaaaaacactagccatattaacagaccaaaacggaatttgcaaatgaaaactaacttcataaatggcttcgtatatatgtttcttaattctttctgcaaaatcagattagtagctcactaacataaataaatccaagaaagagatgaagagaaaatatagtgaaactgtttattacaaaaaaattgtgaagaagtttgtggcaaaaaaactgtttaattagcgtatgatcattgtgaagaagttttgtaaacagtttcaatgtaatctgctaattatttcagttttgttcaaagtatataatgcttgataccataatcatgaattgaagatttatttcgtatggttatgtcgtgtgcttttagttgggaatatcttatgttgtttcgttttaggattctctaatcttgttaaaccgacatgaattggtttttcttggttcccatggtacaactggttattaaatatttttggggacttcaagatattatatatgtgatgctacagaacttgataaacatatgtatttaattttcgaacatgacatatgtaacctttttaactgaagctagaccatgtgggtaaacaagtactagtatctatctactcaagaaaaacctaaaagttttatctcaaatgagaaaaccatcatgatgccaaaattggcaagtaggttggcatttgattctgtgcatatgaaattaaaggatccgtatgtgttgggtgatgcagagattcattaaatgtggatataacttctaaactacccaaaatttatctacatttaatcatcttaccatccacggccaatattcatatctccttgggtttaaaagtttttgtgtacactcacagtcaggctcacaatgtcacaagaatcactcagcttttgacaattaatatgataagaacaaacttcttgatattcaattttggttacaagtgtacagttgtgtctttgtatatgtaattgttttataactaccaaattttctataaataatcttgttttctagtggacgatatatataatttaaaagagtttagagttaaatttaaattgttggtttacatatcctaagctagagtttgggttgatgtgttattcatcttgtatttttagggttcagggttaatcagtgtacaatgaaatatggttgttaaagatctattttttttattagtattgatcgtatgtataaaactataaaaatggttaactaattagaacaactgttttaatatttcatgtgatcaaaagttttaatttggaaaatattgcgtggatgagtcatatcatatctatatacttagttatttggagaagaaaaaaaaatcaatactcaacagtcaacactcaaacataaatatgagaaagtacaagtcgctcaaccaatcctcacaaatgcgtactcataaccgtacgcaaaactaacatcatgtggagtgtggacgttgacactagaaatcaatgctataagatatgtgtaaggttttcaaatagtttaatttaagatgctcttttttagtaccaaatgtgtaataccaaactaacatcacgcgagaatattttagattgattatccataaataatttactcgtttgatttgatgtatccatgcatgcatatataattccctatcatcttaacctcatatgaacattttttataatgaatgaaaaaaaaaaatattctactaatgaatataataaatattcggaacgatgaaacattagttcagttagctccttcgaccgtagttcaactaagaacttgtcgtcacaattttggaagctttataaaatagagagttcgttgggtccgtccaacttttgttagttgcctagttggtaaactttgtcctttatttattgcccacctccatttttatatactcacgtcactcaccaataaattttggttaaaagaaaaaaagagagagatttcttcttatttattaaccaaatttagtattttgataagttaagaaattaaagaagatttgtttatttcacttcatcaagctgatttcgtgggccagaagtgatcaattatagttaccaaaaataaaacaaaatgacctaaactccaacaccaccttcatgaagttgaaaacattttgaagatttttataaatacatccaaccccctaaccttttcacaaacctcatacccatacaatacaaaacattaacaaaaatcaaagtatg

SEQ ID NO: 36489 - DNA, 3000 bp, Unknown
  misc_feature (1)..( 3000): 2750-1469P.txt file - cDNA_ID_3096715; gDNA_ID_2936548; Annot_ID_193944
tgaggacacagtacttgacaaaggtgataaatctattccgccaaaagcaccacgtggcagagattatcaagacgtcatggacgtccgatgacggcaaagcgcagacatatgacatcatcgaagtcatacattacccaacaaacgaacggttgatcgccgacatagatatgtacgacgggcttcaccaagtcatggaaattcctgaaaacctcgagaaggatgtgccggtcgcgttcgtcggaaccggcgatgatatacgccgtctcgtagcaactatttccgacgaaggagttgaggaagcccttctatctaaatggcttgcccgtaacggtatctaagcccgatgggctgtttcctaggttattttagttacacattgtcgtttaaatttgcgcacgtaatatatagacaattccgtcgtggtttcgcttagtcatgtatagatacttccgttgtcgtttcactgttatagacactcttaactaattaatcagtaataaaaaaaagatttaagattaagatgtctctctctcttataattaataaaggacttccattttataactctctctgtctcttaatatttctgacttgtatcacataaacgacattaggcaaacagtcatatatgttatgatatatctcttttaaaatctgttgacatattcacattgaatttccaaaagtgggtcatgcaaaagcgtacgtacgtacaaacggtcagatactcagatatgttccaactatgaatctatgatctcaaccaatgtatgagtaatgaacgcttaacaacatgaacaccgctcatgcatacattaattgccatcgttatatatatggcgtggagatatctgaatataaaccacctttcgtaaagcttttttttttgtcaaagtacaaatatttctgatttgtataacacactacacacggctcctggttcctcaatggaggagaaccttagtagtgtatgatggtgacataaaacaacaaaaggtatacccaaatttggttaaataaattatcaattagcgtgtggaaaaagaagaagaagttaaggaaaaggcagagcagatagaaggtcacgatcacaatgcaaatcaaattacaagatgagaaaagagattcaattgcaaaatattattctttaaaaaaaaaaaaatggtatttagtagccaacaaccaatcgacgctgtataaaattgttttgccttatgaataacaacttaatcataatagccatctttagattaattaatgcatgttcgctatgtattttaattctttttgttaaaaagaaagtttagaacatttatgctttttttccgaaaacatttgtttgactaattaataacactatatatttacgtttattgagttttattagtgagtactagtttaatattaagacatctttaaacaatatttttttttgtttttcgataaacttagaaattatgtactgcatgtactcgataataataccgcgtttaaagcgttaatcacacctcttaaatagagttgaactagtgactttgatggctctcagaaacactaaatgttacaatcctttgtaaaatttgttggatagtgtagtagtaaccgagagaaaacgtcaaaatgatagcacaaattcatagactcttgtattttattttattttcttgtattaaaatggtttgtcagcaaaaaagtattattttaattcgtatgaaacccaaatttcaggtcgaataaattaagagaaatttatccaattgttttccaaaacttagtaggaataaatctatcaaagaacctaatttgaaagtaacttgacgaagaagaaacggaaaagaaaccaaataaactattatagtaagacataaataaaacaaattcgtttgtaatttattatttccaaatttgaatttacgatttttttcttctagaatttagttgtttttttgataaagaaaaataagtttcattgacattagaaattgttatgtaagctaaaataatttataacatagcatattttattttgtttttgttcttgttctaacgtttgaagagagagagaaagacagagagtagaaacctgcaagcgggcaatgtggatctttcttgcaaagcaggacatgaactgattctggagcagtggtaaaaatccagatcttctcctattaatcttgtatgatgtaaggagaaaaatttagtaaatctatccaagactcacaaaaataagaataagagatgatgaaacttatacttgaagttaccatcgaaatcgaaccagtttggattgaagtctttatcttcaaagaagagagtaacactagaacgcccatcggctaaagtttcaatgcaatgtgggagtgttttgactgcaccatagaaagagtctcaaacactcgaaaatctctctttcttattcatacacagttgtatttgtgaaaatgagaataagagattagggtttttgaatctttcctaatcttctcaatggttctctgtttactacccaacaaatacgaaagattatgaacactttttttctcccattttatcaataaaagttttttttttttttgctttgaacttgcacaaacgcctagattgtataacgtttgataatacataatgggtcgtttaaaattataaataggcctattatgggcttagaagtagatttagtaaacaaccgacaaaacagaagttataggtttaaatttaagacattaaattaaattagaagattgttataggtttgcggaaaacaagatcagatgggactgaccataggaacgtcgggccgtatacgaactcttcttctgagcccataatgggcctttctcagaaattaatttatttccatgagaacgttgccgtttcactaacaccaaacgttatgttctcgtcatctatcatctatgcaagatctaagcgaaaacaaaaaaaaatgccttaaaacatttgaagaagcaaaacgaagaaacagtgagagagatagaaatg

SEQ ID NO: 36490 - DNA, 3000 bp, Unknown
  misc_feature (1)..( 3000): 2750-1469P.txt file - cDNA_ID_3096732; gDNA_ID_2936548; Annot_ID_193940
gaaaagattttcactaggaagtgggatgtttggttctaaacgcatgcaaaatccggctgcgccatggaattttgttttggattcatatttattagtctccgacagcatgtcccatgatttcaaaagctctaataatttagtcattacttattagtatcaaatattaatattcatataaggataaaatgtcttaaggacaaaatctatatttcactaatattgcactagataacttaatttaaaaacaaaagattgaaatccccgtgttgtctacatagatttcttctatgatctaatttattctactagtattgtttcgtcttaactctcaaggtatcacggatgggaatatatcttaggacagggaataaaaaaagaagaagtaaaagttattagagttgaaagtaactaaaagaagaaggaaatccttgaatgatgatcagtggaatttgtaaagaaaagttaccaacaaaaagaatacaagtagagtattaatcaggatattaaagtcgtagtctatactctatagagaaaaacaaacaactccacgtttctacaaatcaaagagcttttgggcccgacgaagccgagacagagaaattgaagacaagatgtcgtaacctgtgtgtaaaaatcaagcccataattgaaattgggttgagctggtttgtagatgcaaatatacaaactttaaataaagaagcaaatatataaagaagcaaggtttaaagtaaaactttgatggaaaatccttgattagtggaacgatttttatcattttagatatttgtttatcatttttctatcaatttatgtaaatggcaatggcaagaaaaatagtggaacgatttttattcatattatttagtgatttactatttttatttttattttcaattataacaaaacaatgcattttagtataatagaaattcgaaatatcctgattctatcttctaaatttcaattctctagcttttctttcatttctcgaagccacaatcgtgaggctgatgagattgcaaagtttgctcttagaacaattgtaccggccggtttgtagtttttaattgaaggaaaaatttgtctaaaaaagaaattcgaaaatatacaaatttggtaagaaaaattcggatatttaaaattcgtaactttatatattgaaaaccttttatgtgtgtttgacaattgattttaaaaaaataaagataaatatttagaaacaaaagtgtttggtgatagagatactagaattaaaaaagaaaaagtaaaatagttgaggaaaattatgggatttccacataagtacatagactctcttttaaattatggaagataaactgtatttaagattttacattatcatgaattcactaacaataatcaacttaaaaacaagatacattacataagctagcagatcaacaaaaaaatcaacatagatttaaaaagtaatattttgataaagaaattgcatggcaaacatttaaataacatatttaacaatatattaaaataaaaacaaattaataaatctatcaatcatgagatgtaaaaaaaaaaaaacatgtgaatattattgtgtttagtcttgcaagtcattgaattgtttgagcaatttatgttcacaagtaatactagcattaatcatcaattctttgaaaaatttcatcagattatcatttgattatactatttgattaatgcaattgtttatgtggactatcatatttaccttaaaccgttcattatcttattctttttttttggtatcaagaccattcctcttcatggttgtcttgcttcctcaaagaccaagaatgattatgtgacaagtagacgatctaaaatactttatgtaccacttgataagatttgatcggttcggtttaatcggttctgtttaatcggttctgaccgaactttcagggctactataaagtcaaaaataatatgcaatataaacctttaatttatttacatttattataagtaacaataaatataatagatttagattaaataaatatttttaatatcttttgatgtaaaaaaaactttcatggctagacaccttaaatgtagagaaaactctttgagtatatatgtgatttatattgcatatattttttttatcaaccaaaattaattgtctaaatggttatctacttcacttttaactgaaagtaaatatataattaataatcatgattcatgagttttaacccaagtttggtaaaaataatcatgattcatcacttttaacccaagtttgtagagaaacgatagatttaaaatatagtaggtttctataagaaaataatatatgggttataatacaaaactgaaaatacaaattaaagttgataaagacgaaagtaaatgcgaaatttctgaatataatgatatttttggttgatatgcattgtataagtatattgaaattgaccataattttgtttataatcttttttcctatacaaaaggaattatatacgtcaaggtaagcttaacatggctaatacacacacctaataaaagggagtaagagaggatatcagtttcacgaacaagtctgtcctacatcaactccacacaagggatctcggtctaaatcccttgatcagtttaggaacatacttaccaaactcttctttaaagtataatgaggttgaattgaatcacaaacgaagttagggaagtagaattgatgaacgcataactccacgaccataactaaccccaataaacgtgcgtacctaaccatagtctctccttgcaacaatggtttttctttataactttcatatcaacacgattcgtttaaattatggattaagagcctcagtacaattaatagctaataatcatatgacacgtggatatcgttgaattaaagtaaactttctcttcttcttatttattacgattgatatatactgatctcttgtcttcttcactctccaacggttctgtactatcttcagagcttcgagaatg

SEQ ID NO: 36491 - DNA, 3003 bp, Unknown
  misc_feature (1)..( 3003): 2750-1469P.txt file - cDNA_ID_3096741; gDNA_ID_2936548; Annot_ID_193938
atcggagatgaaattcataccggaatcatcttcaaggaggattccatgttaccgggttcttgacgaagacggacgaatcatccccgatagcgattttattccggtacagaaatttcgagaatgtatatcaaaattgatatgagtttggtttagttctaaccgataataatttatgactgggaaggtgagtgagaaactcgctgttagaatgtacgaacaaatggcgacgctacaagtaatggatcacatcttctacgaagctcaacgtcaaggaagaatatctttttatcttacttccgtcggagaagaagccattaacatcgcttcagcagctgctctcagtcctgacgacgtcgttttacctcaggtaaaccgttgcgttcacctccactaatctcatttgcttctgtttgattgaaccgggaagttcaatgtttggtacagtaccgagaacctggagttcttttgtggcgtggcttcacgttggaggagtttgctaatcagtgttttgggaacaaagctgattatggcaaaggcagacaaatgccaattcattacggttccaatcgtcttaattacttcactatctcctctccaattgcgtaagaatctctgaacattaaccattttgattgttcttttgtttacatgtttttgctgaatctgttttctgatgttgattcttcagcacgcaacttcctcaagctgctggagttggttattctttgaaaatggacaagaagaatgcttgtactgttacattcatcggagatggtggcacaagcgaggtttataatctttattaattctcatttctttccataagaatcaacatttcaagaattgaaatttatttagtcttttggggtttggttgtttgggactagggagattttcacgccggattgaattttgcggccgtaatggaagctccggttgtgtttatatgtcggaacaacggttgggcgattagtactcatatctcagaacagtttagaagtatgaaactaacttaacttcctctgtttttcattacaaattagaccaaaacaaatcctctgttttaatgtgagcttatgtggtttgattacaggtgatggaatagttgtgaaaggtcaagcttacggtatccgaagcatccgtgtggacggtaacgatgcacttgcggtttatagtgctgtacgctcagctcgagaaatggctgtaacagaacaaagacctgttctcattgaggtaaaaaaatcacactagagatttatctcaaagtttacaactcttgaatttggtgaaataagattgttgttgcttttgttttgcggcagatgatgacatatagagtaggacatcattctacatcagatgattcaactaagtacagggcggcggatgaaatccagtactggaaaatgtcgagaaaccctgtgaatagatttcggaaatgggtcgaagataacggatggtggagtgaggaagatgaatccaagctaagatctaacgcaagaaaacaggtagagattctgaaaaccgctacgttatattgatgttgagattgaaattattttaaccgttttaatcggttgtgtgtgttttgtagcttctgcaagcgattcaggctgcggagaagtgggagaaacaaccattgacagagttgtttaacgatgtatatgatgttaaaccgaagaacctagaagagcaagaacttggtttgaaggaattagtaaagaaacaacctcaagattatcctcctggctttcatgtttgaatctagaggaactgtgtggttaaaatacctcatatagtatcatgtccatatcgacttctcattgcagactatttatattgtccacgtatcgaatagtaatcaagtatcaatgtagagaccagcatttggagcatcatgaaatggccttgagaatgttattttcatggtccggctgacccttaaccggttcaaactggagtaaatgagtgaatgttaatgctcgagaatgggtgaggctccgttaatcgttaagaaaaaaacgtgcctacctagccaaatgacatcttcctcttttgtgtttagcacaagtgaatgatccaaatatcatctacctaatatgacccataaaatagtatgtgattgtctttggatgttatcccataacataacttaaatttgggatgcatgcatatattatatacttcatataaaatgagtggacctcataagttgcggtttcgatttttatcaaaaacaacagttgtccactttttgattttgacacacccacattcaagcatctcctttcttctatattattactcaaagaataacaccccctaaggataacaccattacacaaatcaattctcagttaatcatttgtttcaatatatgttagtacttaagaaatattcgaatagttttacgtattcaaattttataaattcaatgaatgtttaattaccaagtcattttggcttggaatctattcaattattcaaaaaaataaataaaaaatactgcattttaacgtatcagccagtcaatatattacacgtgtcataaagcattacccacacgtttctcctgcctctttccctttcatttttttttttcattttttttgtttcttctcttgttgttgttatcttcttctagctagctctgtgaaacacttcaaatgaacaaatatatcaaataataatagtgtaattaagtcggaggaaaacaacaagaacccagaaagaggaacgaagaaactaattcaaaggtatgatcttttattctttgagagaattatgttttctttgtagcaaatcctctggtcttacgtttagtcactgaatttgttccacttctggaaaaatctagacaccagagcaatctatgaactttaatttccaatcactaccgtcttttgaggttgtaaaatcggtaaatggcagatttttcactctcattcctttgtggtgataggatcaagttcaccgcttcattttagtcattaaacaaagatg

SEQ ID NO: 36492 - DNA, 3003 bp, Unknown
  misc_feature (1)..( 3003): 2750-1469P.txt file - cDNA_ID_3096746; gDNA_ID_2936548; Annot_ID_193937
atgggaccactctcgtaccaattctttcacagcagctttctctttgaacaaaaacatgacactccttttaaggcaaagattgttattattggttttaggcttttgataactaaaggtaaaaaaaaaatcaagtagattctaaacactaaacaccactgtacattagaattcaaaatccaagagttgtgagagactaatcagtgcacaactgcacattaatctctatttacataacttaaaaccatatccaaaaggatacttaggcttttgcagaagcaaaaatttatcggaaaagtgatcatctttgtgtccgttctctgagctgttcctcctgaagattagactgcaaacactgactcgagtgtatgcgtttatcaagctctgcttcttaagccaataaatctttgtttcagatactgaggaattagtttcttgaatgtaagaaaagagaagcagctacttttttcatccctgcaaaatacagcagacagtttcaaacatcaaacctcgagagtttcaataaatggcaacaagatttgcataatgagactaggaatcattcagatagatattcttgaatcaaaacttcactaaaattgtagtctagacagtttcatttctaacggggaagataaagagcttcactcacaccattcacactctttcaaaaggtcatcaactagacaacaacattttcatacaaccaacaagatagtaaaagactcacgtgatgaaaaaacacaatgaaaaagtggaaacaatcaaaagtcagctttttcttttcttggcaaacaaaaactttcatcaaatcttattagcaaagcaaatccaagtagtattgcgtaagtaagatatgaaagatgaaaactttgattcttcagtttgaaaacataccttaagctgcttcggctcctaatactgttgttgctactgctactaccactcctctttgtgctcgattcagacattctattccaccattctttatcctctactttcacagtctcctcagagatcgaaggtctcggtgaaaccttacaagcctcatcctttttcttcttcttcttcttcttagtcgtatccttcatagctcctaaactaaccagaaacataattttgagaagaaacccactattatttcctcctccactcctattcggatcaacccgtttatcactcttcgtcttcctcacaactttactctgcctatttgctctcttaggcaattcatcgaacaccttccgttcattctcttgattcaccttaacttcaacaagatccttcaatgaaagctcgtaacacgactcaggcatcttactaaccatttccataagctcccgttgaccacgagcaatagcctgtgctttagaatccggcgaaagactccagtaatcttccggccggtgaaaaggaggaggactcttcgggggactggttctccacaaagtaggcgaacagacaccggaatctgagtgatcatcattgggaatactcggaaaacacaaatgggtattgaaggatttagcagaagaaggatctaacatcgtcgatgaatttgcaagactggatttttaaaaactcaagttttattgagaaacaagtttataacgattaacaagggaaacaaacaaaaaagatatcttgcttgacccgttctataaggattattgtattactaagagaaataaagtttcttttttctatctttgctattggggctttaatttaaaacgtcacgttgttctcagagtggttaaatagtccctatttaatatgaggacgttgttgttgttgctgtccaattttggggtttaatttaatttgcagatcgtattcgtaccggatttgaggaagtgtttacttaatggattagagttgttaaaagtcaagtgcttctagatcatcttcccataaaaagtcatcaactcttctagagtaattgattagtgtactcgtcaattgtcattaattgatgttcgagcatgctcacacttaaacaggttagaagagtatattttgtttcacgattatggtaaattcttagtattacaattggattgacaataaatagttgtacaattggtaaactttcaggagcgttgttggcctttgtaatgttttgagtcttttaatgtttgtgaaaagcataatcgacgattaagcgtgttttagacttttagtactagaagatgcgtgtttcattactttattccgttgcagatttcaagggaatctgatatactaatcattcaacgtgctcctcgtttatggccgtctatagttgtgaaagaaatagagaattgactttgggatgttgttccaaaataatgttatgaaatttagtagcgagaggcccaataaaatcttagaaaggcccaaaaaaaaatgggttagatccactcgaaagtggagagccttaaggtcaggacccgaaggtcaaccccgtctctgtcagaggagatgccaaccatctctcctttctatgaacacaatcgaatccactagtctttctatatatatacacaaaccaaaaactaccaaagttccgatgcggtattatttatatgagtttgcaagaaaaattccactactcatgccacttttaagatttcttttctgtgtcgttaattttggacacgtgaatatattatagtaggaaaaaatcatatcatataaatgaaaatataatagataatctagcattaaagttttttagatattgatgaattttttataattagtataccaccacttttaatatatttgtctaaatatcaatcatttagttagtttaaatatgaaaaaaactttcacaaattaaaatatggccaagaaatgatagagttccacgcgtcaactcttttctatttttacattatgcttttaaatggatgagcagtataaataatacatgtacatcttaaatcttaatcaatcaataatacaacctatagtatttacttttaaaaaataaaaaatacaagaagtagagaaaacaaaatg

SEQ ID NO: 36493 - DNA, 3000 bp, Unknown
  misc_feature (1)..( 3000): 2750-1469P.txt file - cDNA_ID_3096751; gDNA_ID_2936548; Annot_ID_193936
atttagattatgtctcaagctagaaacaagggttttggatctagcaaaccagatcgccatatctgtcaaaaaatggacaaagaagagaagaagagaagaaaatggagaagagtagagaagaagaagagagaagttgtcgtttttaacgatgtttaagggcaaaggattagaaggacgacaagtgcatgtatttccttgtcggacttgacatgtcatccgtatccatctccaacttctttttcttttcttaaaatgattatttatcttcctctctttttgggatttttagtttttacactaattatagtggacaaatactattgaaaaattaaaaaaatcaaaatgaaatattgacagaagttgtaacacctacattagcaaatcatttaaagattttttcaacaaccaaaccaaactgtacttgtgctttttattgaattttgatctttatccaacgatagcaaaattgtaaagtcacctacttgcgtgtcatttatatctttctttgaattttccatgacgtccgtgaaaaacaaagaaaaaaaaaagcttttttattgataccacgagaaaacatttttccatttatagtgtagttgaaagttacacaacaatcaccataaacgatttgatgatggtggaattggtatttaaagattcattggtatgtaacatctaacctaacagtaaagctttcttggacctaaactggtatgtatcatgtatggcttggactaacatcatcactagtagggggtttgttaaagattgtgtgtttcgtatctaaaaatgtgggaacagagttactgacttcagattgtcgttgattctgtggaagcatctcttaatcaactagtgtgtgtgatatgctctcctttgagcaaattccacattatttaatgacatactagtataccacacaattgttcaatttgttgaacaaaccaattacctcaaattcttgctcatttgtagcaaaactattttaccatccagttccatgccattacatctaattgtaccattgtattaaacactttttcagtctaacttaatgttcaacacttcatatctgagtcgaaatcaatgacatcatagctaactaaaataattatgttccaaagtgttcaagttatataatctaaaaatgttttatcaccgatttaagtacgcacgaatgtttgaaatttaggagtcgatatcttattgaaatggttaaatgggaatattgaattataagaattttaggataaagataacaatataaggaagcctagacatgtctcgccctatattataagataaaaatcatatttttgttatttgtgttcaccagaattcatggttccaactgcaaccggtggagtcctcccgcatattccaagacatttgagacactctgcaacaaaggaagtgggtagacagtgcttatggcacaacacttggcactctttgtccgactttgcttcgcctcccatcgtaaataacgccattagtagcatcgtgatccacaccacactcatgatcttcttcatcctcattttgttttctctacttcttgtattttttattttttaaaagtaaatactataggttgtattattgattgattaagatttaagatgtacatgtattatttatactgctcatccatttaaaagcataatgtaaaaatagaaaagagttgacgcgtggaactctatcatttcttggccatattttaatttgtgaaagtttttttcatatttaaactaactaaatgattgatatttagacaaatatattaaaagtggtggtatactaattataaaaaattcatcaatatctaaaaaactttaatgctagattatctattatattttcatttatatgatatgattttttcctactataatatattcacgtgtccaaaattaacgacacagaaaagaaatcttaaaagtggcatgagtagtggaatttttcttgcaaactcatataaataataccgcatcggaactttggtagtttttggtttgtgtatatatatagaaagactagtggattcgattgtgttcatagaaaggagagatggttggcatctcctctgacagagacggggttgaccttcgggtcctgaccttaaggctctccactttcgagtggatctaacccatttttttttgggcctttctaagattttattgggcctctcgctactaaatttcataacattattttggaacaacatcccaaagtcaattctctatttctttcacaactatagacggccataaacgaggagcacgttgaatgattagtatatcagattcccttgaaatctgcaacggaataaagtaatgaaacacgcatcttctagtactaaaagtctaaaacacgcttaatcgtcgattatgcttttcacaaacattaaaagactcaaaacattacaaaggccaacaacgctcctgaaagtttaccaattgtacaactatttattgtcaatccaattgtaatactaagaatttaccataatcgtgaaacaaaatatactcttctaacctgtttaagtgtgagcatgctcgaacatcaattaatgacaattgacgagtacactaatcaattactctagaagagttgatgactttttatgggaagatgatctagaagcacttgacttttaacaactctaatccattaagtaaacacttcctcaaatccggtacgaatacgatctgcaaattaaattaaaccccaaaattggacagcaacaacaacaacgtcctcatattaaatagggactatttaaccactctgagaacaacgtgacgttttaaattaaagccccaatagcaaagatagaaaaaagaaactttatttctcttagtaatacaataatccttatagaacgggtcaagcaagatatcttttttgtttgtttcccttgttaatcgttataaacttgtttctcaataaaacttgagtttttaaaaatccagtcttgcaaattcatcgacgatg

SEQ ID NO: 36494 - DNA, 3000 bp, Unknown
  misc_feature (1)..( 3000): 2750-1469P.txt file - cDNA_ID_3096755; gDNA_ID_2936548; Annot_ID_193935
caaaatatactcttctaacctgtttaagtgtgagcatgctcgaacatcaattaatgacaattgacgagtacactaatcaattactctagaagagttgatgactttttatgggaagatgatctagaagcacttgacttttaacaactctaatccattaagtaaacacttcctcaaatccggtacgaatacgatctgcaaattaaattaaaccccaaaattggacagcaacaacaacaacgtcctcatattaaatagggactatttaaccactctgagaacaacgtgacgttttaaattaaagccccaatagcaaagatagaaaaaagaaactttatttctcttagtaatacaataatccttatagaacgggtcaagcaagatatcttttttgtttgtttcccttgttaatcgttataaacttgtttctcaataaaacttgagtttttaaaaatccagtcttgcaaattcatcgacgatgttagatccttcttctgctaaatccttcaatacccatttgtgttttccgagtattcccaatgatgatcactcagattccggtgtctgttcgcctactttgtggagaaccagtcccccgaagagtcctcctccttttcaccggccggaagattactggagtctttcgccggattctaaagcacaggctattgctcgtggtcaacgggagcttatggaaatggttagtaagatgcctgagtcgtgttacgagctttcattgaaggatcttgttgaagttaaggtgaatcaagagaatgaacggaaggtgttcgatgaattgcctaagagagcaaataggcagagtaaagttgtgaggaagacgaagagtgataaacgggttgatccgaataggagtggaggaggaaataatagtgggtttcttctcaaaattatgtttctggttagtttaggagctatgaaggatacgactaagaagaagaagaagaagaaaaaggatgaggcttgtaaggtttcaccgagaccttcgatctctgaggagactgtgaaagtagaggataaagaatggtggaatagaatgtctgaatcgagcacaaagaggagtggtagtagcagtagcaacaacagtattaggagccgaagcagcttaaggtatgttttcaaactgaagaatcaaagttttcatctttcatatcttacttacgcaatactacttggatttgctttgctaataagatttgatgaaagtttttgtttgccaagaaaagaaaaagctgacttttgattgtttccactttttcattgtgttttttcatcacgtgagtcttttactatcttgttggttgtatgaaaatgttgttgtctagttgatgaccttttgaaagagtgtgaatggtgtgagtgaagctctttatcttccccgttagaaatgaaactgtctagactacaattttagtgaagttttgattcaagaatatctatctgaatgattcctagtctcattatgcaaatcttgttgccatttattgaaactctcgaggtttgatgtttgaaactgtctgctgtattttgcagggatgaaaaaagtagctgcttctcttttcttacattcaagaaactaattcctcagtatctgaaacaaagatttattggcttaagaagcagagcttgataaacgcatacactcgagtcagtgtttgcagtctaatcttcaggaggaacagctcagagaacggacacaaagatgatcacttttccgataaatttttgcttctgcaaaagcctaagtatccttttggatatggttttaagttatgtaaatagagattaatgtgcagttgtgcactgattagtctctcacaactcttggattttgaattctaatgtacagtggtgtttagtgtttagaatctacttgattttttttttacctttagttatcaaaagcctaaaaccaataataacaatctttgccttaaaaggagtgtcatgtttttgttcaaagagaaagctgctgtgaaagaattggtacgagagtggtcccattgtggacttatgagacagaatatttgttttggagttgttgttccatccaaacgcgcgtcttcatttcctgcgtttgggaaacgcgtttaccgtggtttgcgataagaaaagtcaacaatgaaagcgatttgggaaatttcttggtatacagttgctattggctaatgatcattacttacgacctaaacttattatattccactaatgttaacgaaaagaataattaagattcttattttaatttgcgtcaccgactgttactttatcatatagagagacaaaagccaaagcacaaaacttttgcattgtcttgcaaaaataatagaacaaagaagtcgcagttgattttatggacggctaaggctgatgatgacctgacacaaaactccgatcgtgttcgattacaagtttagatttttctgagaacccttataattgtttcaacttttggatcttcacacgcataaattttcgcttcgtctttcatcatctgttctcaagtttagagtctatagtcaggtaaaggtctttgcctttgttttagttcaattatgatttctgtttatgttgtgttctcttcttccttgttttccagatgtagacacattatgggtttaatttgaaactcttgccaatactttgattcatactttcttatttatgttttgtccttgaatttggatttggttatttgatggcttaatctgtcctgtgtatctattgaattgccttcttttaagagtctgttgtataattgaatgcttctggcttcgtgatctggtctaatttacaagctggtttgtgaattgtgatagcctttgtttgttttcagagtctgatcacagtgatattgataaagtgtttgatctttaacttgcatgttatatctggaattaagagattatgttaatggtttttgaacctgtgttcattaggaaacttggaactttaggatttgattgaaaaagcaatcttgcgatg

SEQ ID NO: 36495 - DNA, 1928 bp, Unknown
  misc_feature (1)..( 1928): 2750-1469P.txt file - cDNA_ID_3096776; gDNA_ID_2936548; Annot_ID_193930
gaattcatcttacaatagaggataacatctttaatcttctcatctctgtcttcctctaccatcgaactacaaccggaagaattagccggagaagattttattgagtggatggaactgctcttccttgtcactttcttagatcttcctcgttgctcaccttccgccgccacgtcaaagcacatacacagccgcataaatggtttcaggaatccaaaagttcttccacttgtttttggttgtgacattgttcaaagatgaaaactacaaagatcgctcaagaaatggaatcttaagaatacgaatccacgacggtggtgtctagagtcgagagatgtaaaatgtagaagatttaagtgtatcttttagtttcttacagattagggataatgactatatataaacatacaaaaggtaattacaattttgtgttttgattctttcgttattttgtttctataacaaaaagtagggcattttctgaaaattagaaagttttggtctttctagagattttttgaaggaccgtgatgtgtgttagtaatagtaatagttatttccttatttgaatgagcttattaatgtattttactaatttgttaagttttgaattgatgttaccggctaaatttgagaattcaattactgttaccacatttgtgggatacaaaatctgcggtataatatcgttattcaaaaacaaaaagaatgaacatttattgttgagaaaaatattggcgaaatcgatgctatcctttgattgaagcaatcttatagcattggtaagatttttgtttccaactactagcttttgctaagaataactatccgactttatcgctatcttttcgacttttttcgtttgcaatatattagcaaaataaatcatgcatgtaataataatataactgaaataatgataaatgatgttataagaagaaagaaagaaaattacataaatgctgcaagagtaacttgtctgtccaaaggtatgaaaataaaaaaggtagctagggcccaaaagcccaaaatacatgctgcaccatgtttctaggtcaaagcagcaacgcaatctcgagtctcgttatagtattccacttttcattgcttcatcacacgatcagatctagatcaaaggtttgggacatttaccacaacaatgtggctcttcctatatcaatcagctcaatgacggttttgtgtcttattctaataatctatatataaccgcttgccattccaatgatgaagagggtagaaatctcgaagagcaaccttttcgtaaacttgttgctctttagattttgatgaaccgcacctaagttcttagctgtcgaatctagcgcctaattaagcttgcctctcaagtcccaacgttttcaacccttcgatagatagcgattagcgaaccaacatgaagatcaatattaattggtggaataaattcacaaatatgagattttaatgattagtcaatgtagttaaaatcataaacccaaaacttttatgataacaaaacttgagtaacaagtaatattttttgtttgtatcaactaaatatacgcaagtactcctatcacaattaagtcaaaatcactttcgagtcaaactcgaattaataatacagctatgatgaataaatgccatccggaaaaaaagaattaaggtttgacttcctattatttcacaatttataagtaatttgtactcgtatatatattttaatcctaacagtactacattatcgtcaacccaaaataatattgggatcggagcttaccatagatctagtttttaaggctgcccaatcaaacttgtaggtggtgatcgacgatgataaaataacaattgagggttgttttaataataataaaatgctaaaaaataataaatacagaagagaattctacttgggggaataagaaagaatg

SEQ ID NO: 36496 - DNA, 676 bp, Unknown
  misc_feature (1)..( 676): 2750-1469P.txt file - cDNA_ID_3096788; gDNA_ID_2936549; Annot_ID_194000
ttccaagaaagatatggttaggtctcaactttatttacatttttagtatcctaagttatctcatgttttctttttccgcttggtattgcttgagtaatggtgtttagtaattgagtttggttgtgcattttattctttgaagtatattggtagctacagccctagttgagaagaatgagtgaataagtttgccactttggtatgatgtacttatctaaatctgtcagatggttaccagatcaatagtatttcttcttgatattgcttgagtaatggtgtttagtaattgagtttgattgtacattttattcttcgaagtatattggtagctacagccctagttgagaagaatgagtgaataagtttgccatgtacttatctaaatctgtcgaatggttaccacatcaataatatttctagtgaaataaataattttgataattgatgcatcgagatacagtaataaatgtggcattactctgtatggattttaaaatttttataagatacggtttctttgttttgttgtgttagacatcatcttataacttgcaaatccataaagctttcaagcacggaatgaatcatcttcagtctatgaatcctgcagatataatcaatatcagaaaaaataaattctggagcttgtttatgaatcatgcgtcagttagtaatg

SEQ ID NO: 36497 - DNA, 3003 bp, Unknown
  misc_feature (1)..( 3003): 2750-1469P.txt file - cDNA_ID_3096808; gDNA_ID_2936549; Annot_ID_193995
tacagcggcagttacagctgagtttagggtatgttgcgtttgactaaagacaaaatggctgagttatgacaaaacgacgaaattatgagtataatttagcctatagttatggctgatttataaaatatgtctaagttatgagataatccagcctacgttacggctgagttaataaaatttgtctgagttatgagaatttcaagcataacccacacaacgttatggctgagttatgagaaaacggctaagttatttcctcgacacggctaatttatcatttttcggctggctgagttatcaaagatgccttagttatgggatgtcgttatggctgagttattttcgagtgtcataaatcagccgtagagagctggattagcggataacttggccttgttaagcctgacttattagcaaaagattaattactataatatcatgcaattacaaccgaattattaaacgatacggctgagttaaagattttcggttgagttacgacattagaaggctgaattaacttggcatttttttgtttttaattactgtaatagtattcatcttgcgactgacttatagctttgcttgatagctgattgatttaggcaaatttacatgttcgtttggtggcttacttgccacttcatcaattaaaaaatgacgtctgatgcaacattccatgtcatcatcatcaacggaaatacaaaacatccctagttttttcaacttctctcttcttctttgtgttgtttttcacccgagttgtctttaacctgtgtctttcacatcaccagaacttttaattcgtcatcgtcttcctcatttttcttcattttctttaatccttctctcgatatgcttgcctccgattgttgtaaaccagcaagaaaggcccaagaaaattaggattacattatctttggaagtcggcattggaaataaacgccttagaaagcaacatgcatgttctctatctaaacaagttgggtataatgctaaaacttgtcggacatagtattgtttgcaagaattttctttctcttctttatttattagcagtaatatgtagttcgtgacaaatcacctatcattatagactctaagaaccataacacattataactcattgagttttaacctttcgtgacaaatcagccatacgcattataactcaactgtaacatgtaaggttcggtaaatttacatgtcacggctgagttatatgtttcagtaaagatgaaaggttgtgtaaattatatgttacagctgatttataatgcttcagagaagacgaaaggttcggtaaatttacatgtcacagttgagttatatgtttcaggaaagatgaaaggttgtgtaaattatatgttacagctgagttataatgcttcagggaagacgaaaggtttggtaaattaacatgttacgattgagttatatgcttcatgaaagaagaagggtttgtaaattatatgttacgacttagttttaatgctttggagaagacgaaaggttcggtaaatttacatgtcacagctgagttatatgcttcaggaaagacgaaaggtttggtaaatttacatgtcacggttgagttatatgcttcaaagaagacaaaaggtttggtaattacatgtcacggctgagttatatgctttagagaagacgaaatgttttgtaaattatatgttacgactgatttgtcacgatttacatattacgactgagttacatcacattacagctgagttataatacatatcggaaaataatatttttgggaagaaaatataaaatttattggtcaaataacaacaatcaaattaaaaacttaagaatatatttaagggagacatatgaggaagactaaactgtatgaattaaaacatagatagaagtagaagagtcactagtcaacaaaactgtatgaatcaaaacatcgatagatgtagaaatgtctccaaatagatcgattgagaggaagactaaaagagaatcatgtaaatccaaagaaaaagagtagctattactgctttcaactcaaacctgtaacaaatcatgtagaattccatagacctctttgatttggatttttatttttgatgtttttcgtgaacgaggttgcgtgtagatctgacgaagcttttgatttgggaccctatagcaagcgttgtggctctgaggtctaggaagatccagcccaatcatataatttgaagacctatgtccatgttgtacccaagttgcaattattagatctaaaagcttttcttggattttgagacaaaaaaaaagaggagggaaataaaatgattttgaggagtgtgagattggtgacgtgagttaatgacatggacagtcaaatttttatttattattttttattaaaaataaaataatcaagagtgttaattgtaattacacaaatactcaaaatatatgagtaatttttaaaacatgtataatatcactacaagaaaacagacaaacaacgactacagaaagcaacaacagatgtagtcgtcgtttttggcgactacgtcacgacagttttacgacacatatacgacaacctgaacattagtagtcaaatagtcgttattttacgactaaatatgttagtcggcaaatactcgtatagtaacgactatttaacgattatattattgaagggagacgtttgtcgttacatagtcgcaaatggacgactacaatttccgactgcgacagttagtcgccaaatcggcgactaaaatacgacacatttctgtaatcgtaaaatagtcgcaactgagtcgcagagtagtcgcattaagttgttggaaaacgttttccgcattgccaagtaggtacacctaatttgtttgttgtagtcgtaaattagtcataaaaattcgtctatataatcaaaattcacgacaatcttctttcaccaacaaatcaaaacaacaatcaaaaggaaaaaaaaacggaaaaaatagaaatttagtttattctataatg

SEQ ID NO: 36498 - DNA, 3003 bp, Unknown
  misc_feature (1)..( 3003): 2750-1469P.txt file - cDNA_ID_3096874; gDNA_ID_2936549; Annot_ID_193981
atctcctttgcataaagttatattctgtgtattagtgtctcatttctcgttgccattcaacactctgaattaggatactgtgtggtgttttgcaaaactgctcttgtgctatgactctggctaatgatttcggatattcgaccgctatgtcttcatcttattcagctcttcatactagtgtagaagacagataccacaagttgcctaactctttttgggtttcatcaggtcaggaactgatgaataaccctgtaccgtgtcagtcggtctctggtggcaattctggtggttatttgtttccttcttcctctggatactgcaatgtttcagctgtcttgcctcatggaaggaatttgcaaaaccagccacctgtttccaccgtgcctagagacagattggctatgcaggattgtcctttgatagctcaatcctcgttgattaatcatcaccctcaagagttcatagatccacttcatgagttctttgatttctctgatcatgttcctgttcagaatctacaagcagagagtagtggagtaagggtggactcatccgtggaacttcataagaaaagtgaatggcaagattgggcagatcagctgatttctgttgacgatggttctgagccaaattggtctgaacttcttggagattcaagttcccacaatccaaattcagaggttcagtttctctagccatatatggtctctatgtttgttggttgtccttatgttatttaatcagtgttttgcataattggtatcagatacctacaccatttttggatgtaccaaggctagatataacagctaaccagcagcaacagatggtttcatcagaggaccagctcagcggcagaaactcatcatctagtgtagcaacatctaaacaacgtatgcgttggacaccagaacttcacgaggcattcgttgaagctgttaatcagcttggtggtagtgaacgtgcgtaagctttctccttctattgttcctgaaaataattgctcaaggatgttaaccgtacactgattcttctataatttccatcataggagccacccctaaggctgttttgaagctcttgaataaccctggcttgaccatttatcatgtaaaaagccatttgcaggtttgttcttatccatatactattttgttattgtatctcatactgcttctctgctaagctaatttctcatttctcaccgtctttctgttgaacttcttttctacagaaatatagaacggcaaggtataaaccggagacttcggaagttacaggtaaggagttaaaatactttaacataatactactgcactttttctaagctttaaagtattggtcactctctagaagaacctaaactctcgacaaacagcttacgaatgtatgaactttatttatttcttgcacaggagaacctcaagagaagaagatgacatctattgaagatatcaaatctcttgacatgaaaacgtaagaatcttcagtcttctgactgcataacaaaccagtaatctttcttcgtattcttcagatattcttgtatgtatattttgctagatgattatgttactatttcttttccaggagcgttgagatcacacaagctctacggttacaaatggaagtgcagaaacgtctccacgagcagctcgaggtaatgattttacatgcctaactgctaaaaaactatccttctttacctgatttcgaacttagatagagtagtagttgtgaatatcatgagtattatctgattttgtctaaaccatatgccagatccaacggtcactgcagttacagattgaaaaacagggccggtacctacagatgatgttcgagaaacaacaaaagatacaagacaacaagagctcttcttcagaagcatcaccaaagcaatgcaatggttcatttgcagaagttgaagttggtcttgagacactaacaggggaccaaaatgaatctgcttcagcatcaaggaaacgtgtcagagaagattaaagcatgtttaatttgatctcgtttgacgaaacatgtttattgggaattaattgtggaaaccaactccagttttgttaaaagaatctgtttctttcttagctctgtattgttctagtttagaagcagttgatttggccttgcatggctgcaacactaactaaagagtaaagactaattgtgtatatctacatatacatttttggggacgatttgtgtcgaaaaatcctttttcaatttttgatattgtatgtttagtccctacaaaatcaatcagacaagatattttctttaggacaatgaccaaatttttgattaacaattaagatattgcactaactacttacctaaacatagatattgttaattactaccctaataaattgcacaaatcaatccctaaaactataccgaattcattaatgctaaaatcctaattaacaaaatccggaaatcaatcataactaaccatatttacaattacttgattcgaaaataattttagttttaaatgctaatgatatcttaccaaaatttattcttcttttatcaattgcaacacaaaatccggtaagtaactatgcattaatttttgttacctcaaataaacatacaatatactagagaaatctgtatttttgttcttaattggctttattcctaaaaatatttatacaaaattttgtttttgatttgaaaatatataaatcgtatatgtagttataacaaaaaactattttcaaatcaaatagaattctagaataaaccgtaataatattttaatgccatatctaaaaaactctataaattgatatattgttctaacaaatcaatatttaataagaataaattaattttattcacgttttaatttaatgctaataaaaaataatttattctaatggtttttagttatgacattaaagatttattgccaaaaatgaaataattcgaatgctaacaataaacataaatgtgatcgagttctttcctacaaaaatg

SEQ ID NO: 36499 - DNA, 3003 bp, Unknown
  misc_feature (1)..( 3003): 2750-1469P.txt file - cDNA_ID_3096878; gDNA_ID_2936549; Annot_ID_193980
taaacattttagctaataacataagagtgcaccatatttatttaataggggaatgtaccatatgacccgaatgcacttttacccaaatccaccaaaaaagtcttgcaaaaatactatactgataagaaacgatagtctgttttgataggtataagattagcaaatatattagttagcttaaattagttaaagaatacaaattgaaaaggtatattatactttattcgaatatagtatcaaaacttatataacatagtgttgttgtttatagttctgattcaatttcattggtttgattggtttaatcagactaaggacattggaccaggcggttatctccggttttgggatggctgagtaaaccgaaagatgatgaagtaaagaggagtctctaactgcagtggagggtcttcggttctcacgggataaggttttaaccaacccgagtttgttataaagtcatcatcactttcttcttcctttgtaattcttgttcttagagagagagagtaacagagagagaatccgccattgttgtaagctcaagtttgagcataactcttcctttgatctagtgaatttgccggattgattcggctccggacgtaggttagatcacaccaatctagctgaaccgggttaacaaattgagtcttgtgttcttctttacttgttcgttcgtgttcttgagctgagttcattgtgagaatcggagattgaatctataacacatagagatttgataaatttttaattgttgaattcttttttttgtgctaatttttatgtgattaagatttatttgatttcatatataaaatactaaattgttttacgaacttatttgtttataatttggtaacagatagatattcgaatattcaatatattttgcttcagtttagaaaatctttgatgatccgtctttagatccaataagccctataatctagatattaacctgcagtataccgcagataggtttatattttagttaaactaaaattttttattgtaaagatgatttaaaaatatataatattattttattttattttaaatgtatagtaaactgtgagttgtatatgttttgttgatattatctatattgtttaatgtttaagattatacacttgtagtttgattgttaatttaagagttccaactgtagtataccatcttgtattaatattgatctaaaccgtcaattctaggattttccagcttgtattaaaaattgaatcacatcatacacataaaaaaatctaatatattattaattattgtagtatataagattataaattttcaatataatatgtatgaaattgaatataaatatctcaaattatgacccgttactcagtagaaagttttcttaaatctatttttcatccgttataatatttattcatgtattgaacagtttatattcgtttttaaaaattcaaattatgcatatgcaaaaaaactctaattcttttttttttataatgatgatattattttttcgcaaaaatagaatcatataaagatgagaagtgaactataataattaataaaaaattaatatgataatttagatatcaaatctaatttgttgattttaattggttatttttttaaaaattaataatgtatttcgtttttctaattaaattaaattaattaaaatttatatatcaaatcttatatgttgattttgattggttattatttttggaaattaataatgtatttcgttctttaattaaattagtatttgactttctaatctttaaagagataaattaatttattctttaaatttttatttctaatagcatacctatgtaattacttacaaaaattaaggttacatttaaaatgtacttcccaaataatatagtaggatatgacattattataaattgtattctattgtaatgatatggttagaataactagttacttaattaaagtttttttttggttatacactcaaatttccgtatctaatatgcctaaatccgaagatctttaccaatttgtgcctattttaataagatactcttcaaacaaaacaacaataaaaatgtaggtcccttaattccttaattttgcactttgcacagccaccagtgaggcagagatcttctacgacagagataatacaactttcgtactcaacaaaaatctcagtcgttgataaaatacacgtgttaaaatctaacggtcttgataaattaaaggaaaaaacaaaagctggaaacaacagagacgtaaaaacgatagtttaggaaaacaaaacaaaaaagtgttctttgatcaatcaataatcattcatcagggccctgtgttctctgagtcaagtaagattcttttcgacgattccatttactctttgattagggttttatcattctcaatcagggttttagtttaaacatcgaattaagcactggattagctgattttgtgtgatttgatttcaaagttcacagcttttagtttctctgatcctaatttatgatttgaagtttctatcaaaaggtttgatttttatgttgactttgtgatgatgttaaaccccatttagctttggatcctagaattgtctttaggattgtaaagttttagtttttattgaatttgattctgttcatggtagcttcttctttaacacgtctctttggtttcatcaaaagccatatttaactttgcctaagtggacataaatttcattctctgagtactgattccatatcctttatgtaatgtcctttcactatccacatgtagatgcttctccatgtagagtttgtgatctagagcaaaacaaaaacgttagaaatattcttgagagattgtttcttttgactagatagtaagggaattgattcaatggttcatctcctttgcataaagttatattctgtgtattagtgtctcatttctcgttgccattcaacactctgaattaggatactgtgtggtgttttgcaaaactgctcttgtgctatg

SEQ ID NO: 36500 - DNA, 3000 bp, Unknown
  misc_feature (1)..( 3000): 2750-1469P.txt file - cDNA_ID_3096976; gDNA_ID_2936550; Annot_ID_194029
ggaaatctaataataacaattgtttgacatttcatttattataatgaaaaataaaaatatttatttctattcaacccatattgaaactcatgtgtaatggattcatggaaatatctaataaaagataaataaaaaaaagtttaacagtaatcttaaactattgaaagcaaattatcttaatgaaaaattttaatttgtataattcaaaatcatgaatcaaatgtattattaaacatgctgcgtattaattgttttaatataacttttgagggaaaatccagtaaaaaaaaatcttcaaggtgacaaattttttatttgctcttaattttcttacaatataatacaaaacaaagttaaggaaacaactcagtaatatgatagtttaactttaaactcctaattttattatgcattatatggatatgtaatatcaaatatcaatttctttttgttgttttaagttcttaaagagaatatttaatttattctaatttaacttacatgacgtctttcatatttatcaaattttatatgatttaattttccctttgaaccgatattctgagatctttagtcaagtaagagaattttccattgagagacatcttaaatcatatgctttaaattttcatatgtgaagaaggttcatttattatttcgacttccaaaaaatttcgaaaaaaaaattcccgccaaattttgttttcaaaaatatttttcccgccaattttttttttttttggcgggaaatagatttacaagggattttaaaagaattttaaaagatttacaagagattttaaaagcgtgatttacaagggattttaaaaggtttttaaaagatttataagggattttaaaaaggttttaaaagatttacaagagattttaaagggatttaaaagatttacaaaggtcttttaaagatttttaaagggtttaaaattgttttaaaaagattttaaaatatttacaagaaattttaaaagggttttacaatatttacaagggattttaaatggctttaaaagatttacaaaggatttgtaaagattttaaagggtttaaaagtgttctgaaagatttacaagggattttaaaaccttttaaaattacttgtaaatttttttaaacccttttaaaatcccttgtaaatcttttaaaattcttttaaaatctcttgtaaatcttttaaaactcttttaaaatcccttgtaaatctatttgccgctaaaaaatatttacaaggatttttaaaatcatttttttggctgaggaaaaatttgttacgaaaaaaattttggcgggaatttttttttggcgggaaaaaagtttggcttaaacttttttttaggcgggaaaaaaaaattttggcgccaaaaaattggcgggaaaagttcagtttccaattacatgtttctattagatgagggtaatttggtcattttgttcaagggaaagggtagtttttaaaaatggacaacataaaagggtattgttgcaaaagggtagtgaaaaaagggtagttttgcaaatcttccttgttattttagtacacttatcatattttatatgacttttgttttcctcaaaactgacattcttagatctttagttaagttggtagattttccattgaaacttatcttaaattataggctttgaatttttaaacgtgaagaaggttcatctattttttgactttcaagacaattgataatacatgcatattcattttcacaaaaagaaaaatacattcttgaatattttaagttcttatatagtaaaatataccgttttcacaacaaaaaaaaaaaatcagtttagtgcattgaacatttttaatcaactaaagtgtctttttaacacatcataataatttgtaaacatcaaaattgaaattttatttaattttgagcgatatattaacaatttttaaataaattatatatataatttaacgtctttcaatatatttatcagattttatatgacttattttttttgagccgacatataagatctttagtcaagttagagggtttttcattgaaagttatcttaaatcgtaggctttaaatttttaaatgtgaagaaggttcatctattgttttgactttcaagaaaattggtaatacatgcatttgcatttttaaaaaacaaatactgaataatttatgtttatttttttggaagaaaaacttactgtttcacaaaaaaataatttaaaattaagtgcataacttttaatcaactaaaatgtctttgtaaaaaacattttgtaaacatcaaaattgctataattaattattttgagcgatatattaacaattatagataagttttatatataatttaatataaatattattttatattcaaaactaaaatcgaatatataatacacgcatcgcgtggacaacttctagttaaaaataaattttagttttgtggtatttttggaaaatcaaaacttacagtgatatttctaagaattgcgtaagcggcaaaaaacacaaactttgacgtgtttgttttatttgcgggactttgcctcatagtggtccaccccacttaccaaaaaaatccatgaaacatacttattttcataagtatttttttaaaaatccacttatataagtatctaaaaaatatgataaatccacttatataagtataaatcgtcaaattaacaacgcttacttttataatttaaaacaaaaatcaagattagaaagcagtcgacgaacccccacacaattattctgattcatgtccggcggctagaattttttttgttttaaaaagattaatgagaaattgtaatactttacatatacatatgaagtacgaacagtacaagcttgttcccatctctttctttcttctttcctctttctctctcagtctcttcttatctccctctcttctcaatcgcttggtctctttgagaattgagattctttttggtttgtcccgagaagaaaaagaagagaaatg

SEQ ID NO: 36501 - DNA, 3003 bp, Unknown
  misc_feature (1)..( 3003): 2750-1469P.txt file - cDNA_ID_3096981; gDNA_ID_2936550; Annot_ID_194028
tgacccctgtgcaacgttgacaccctttactcgataattggtctaattttttttttgaaaattttctagatcgacgatgtgcaatttgtgcattgtttgcaactccgacgattggaaacctaaatttccggtacaaatttaattaaaccggatggtttggtttattatatgttctatattattctggtttggagaatcatttcttctcttctaaaaccctttgcgtctcttctctagagaatctctcggttgctccaatggctggcttattggttactattaatcactgaatctcacaaattgatttcgcaagctgactcctttgaagccatggcgattctgctcagatcaattctcaaaaatcaaactttgtttaagactctcttgaaacctcaatgcgcgcctttgattgtctccagaaactttacatcggaagaagcttataagaagccactctctgttttcttcgaagaggctgttggattgagacccaaatcagaaacgagcgaaatcgaagaagaagaagaagaaggcaacgagttgaagagaaagcttttggaattggaaaggaaactcatagaactgaagaaatcggaacctgtgagaaagaaaaaacagaagggagaggttgtgatatcagagcaaaacgagaaaaggcataatctttacaagttgtttaagggagatgaagagaaagaggtaaagaaacatagtaaggaaaaggaggacgtaattagggtttataaggagcttcctatagagatggtgtcgtttgtgaggcttctgcataaagaagggtatttgaacaaggctaatttcattactggagaaaagttggatatggggaatcttgatgaagagtatgctagaacttttgttaagtttgctgccgaaagatttggaaaggattaccaggagatagcaaagtgagaatctttttacttctgtattgatcatatattgtgtttattctgttagattgttaaaattttggatcagtgatcctccttaggcttcgtttagagaaaatgtatgtgaaaaatgttcatcttcagctgaaaaacttgtcagtgagtttgcattgtagtatatgtaacatttcgtgtggagtataggttggggttggaaaaggaggggttcactgctagttctttaggaatgaggaatcttttgtgatgaattgagctcttgtagtttgatcgcacgctacttgtagcattggttgagaaattctgatgtaagaagttgttaatacatttgtagatgctttaaatggagttatttggactgtcgagttttagaatctcttgtacggtcttgattgccataccctgcagcatttcattttatttgctcttagttaaattgttgtttggaaaattgatggataaagattagggttcgtttagagaaatgttcttcatgggtctctgatgaaaaacttgggcatgttctggtgaaaacttctcagtacgcagttcatttctatacagtgcgaaactgcttagcgtttgcattgttgcatgtttaacatttcttggggagtatagtggagttgggaaaggaggggttcagtgctagttctaatggaatgaggaatcttatgtgatgaattgatgtctcgtgtttcggtcataggctagttgtcgcattggtagagagattctgatgtaagaagtgattaatacattcgttgatgcctcaaatgtatggtcttatttggcttcatccctgaagcagtattttgttcgccccttagctattgttgcagctaggcagtttgaaattgattcaatcattctattgtctccacggctttttataacctcaaatttaacttacacaggtggttatcaggtagtgacctgaagaagattgtgctctttggttgcccgagtttggaaaaaagggcggtattcgctgctaaaacattgcgcaactttttcgatatccatgagaataatgtaagcctatcacacaccacactgtctctatctcattttgtaactcaccaacagcatctaaccaagtctttttttgttgcataataggtgtgcgagaaatgcgtgttaaaagagaagtgcaagtttccaaaccagagtgtatgggatggcaaaacaaagcacttgcacttgtctgttgtgatgaaagtcatcacactatatccattagacttgactcatccgaagctacaagttcctcaagaggtacaagactcagtttcaagattgctgacggagattcagaacctaagccgaactatctgtactcctctcgcatgagttaacattatcaaatatttgtttgtagtaaacatcaatctagtgatcttgcaaatggaagttgaaccaaaaaagactcttatgaagaaaaatccttcacttctactttcacttgcaacagctaagggtacagatcccataagtagttagttatgttttcagcttttatctcgattttgtgcccctaaatcatctgttgaagaagatattttttcactgagaacaaaggaatatcattgtgaaccttatggctgagccagaaactttctggataagtatgaaaggaatgggtcttgttcagaagagacaaaggcttgcctgaaaaacaagcctatcatcaagagccacaggcattcctatcaaacgtggcggtaaggtgattgatttgtttgcgtctttcttcactttaaagttcactctcgctagattccatagcatctccatacttaggattttttgttaaactctccaagagaaaaacataaagttccaacctttttagtttccaacttctcttgaaacctaattttgattacagtgagtggatatcgtaaatttgtggctttctcgagtttctgagattttgagctaaacactctgcttaaacctcaagttcttacctttttactcttagtagagttgcaaagtttaatcctttgataaaatctcccgagattccgagtttgtctcgcatgaggatttgaataccgaagaaaaaatg

SEQ ID NO: 36502 - DNA, 3003 bp, Unknown
  misc_feature (1)..( 3003): 2750-1469P.txt file - cDNA_ID_3096985; gDNA_ID_2936550; Annot_ID_194027
accaatctcccacatatcaagacaagaaccatcacttcccatttccatagagctaggtcccaaagtgtcttgccacgcaagtaaggtatgactaggctacaaatcaaactagcaatgatcaaaatcagaaatatccattctataataacccaaacacaaatcttctccttccttaaaccttcaggtaaatcctcctctgagaagggatcttcctcttcttccaaatccttggatcctccttggtttggagttcccggtttagtgtttctcccactaaacccgggatttagattcccggaccttggagtccgacccgaaaccatatccggatacgtcggagtaggaggatccatcaatctagatctagtcttcatcttcatcaaagtcttagtcctcatcgtcgatctattagaggtacacttcacaacctctgatccatctactctgttttcttcatcttcactactatcaccatctttaacagacggagaaagcgtgactctgttctgtctccgtctaatcgcatcaccggttccattacgataactcgccgtcactggcgcggttactggtgaagcagaaccggaaactgccgttgacgacagaggaggaaccgtatttttttgaagctcaggcatgttagcttccatgtcgagagagatttcatcaccggaagctttttgcttgttgagaaattgatttataagcttcgacggtggatctggctcctccgatttctcactactccgccgcatgaaatcaaagcttccgtcgtcttcttcacctccgggtggtttagagctcttatcattatgccagaagttaatgcttgactctctccaaaacttttctgagtcaccattgtcttcaccgtcgatccttacaacaaaatctcgccgttgatcagttgaatcaacggccatgttagaaggaatgaaactttctatagtaaaatctcgccgagatttttgtttttcttcaaagtaaaacgttcgtttatatatttttttgagaaagaggaaaaagaaaagttggttcttgatttctagatgtaatggtaatgttgatttttctaaatatttaaatctttttgattgattttgttttatttatttttggtaatgttgaaccatgtgagattgtgatgatcttgctagggctaaaaagacaatgtttaaaccaggtgatattatcatattttctattttccgcttctgaatcattttaaaacatttcacgactactcagaccaaaacatagactcgtgtctcgctctcacgcaaactacaaaacaaaaaaaacactcgattaaaaagtcaaaagtaacacaattggtgttggaacttggaagctcgagattttttatacaagaaaataatttttttttttaaagtaattttgttttattttaaaattagttatttgtaagctagttattttatattttaaaattgttgaagaaaaaatgggggccatgttcactgtcgagaaacgaagcagttgaagaagtaataaaaattgttgtaccacaaattaactaataaataaacctatcggattggtgaaactagcttacgtggtgagatcttacggcgcgaatgtgataatgaatttactaatggtatatgagtcaggcacgtggttggctaatctttggtctccttgtagtttttttttgttttgtttttgtgaggcgtatatacgaattttaaacgatacctaattcgaaacaagtagaaaacgacacgaaaatgacacgttttttgataaaacggcaggtcgattaggatacaaaatgcagcttaggtaacgtgtgaacagagacacatggttcaataagagtggtcacagaagaatttgttttcatataccccgataattgtctaatgtgaatataaaatgtaataattattactggccagataaaagaataacaatgtattgtgatttttttttttttttttttttgtgaaagggtttatattattgtgagtattattttatttgcaaatttaaatgcatgaatcagaagaaaacagtttgatacatgtgaccaaaacataaaataaaaagctgtttgatgcatgtgaatgatacaaatagatttcctagatttgttttccgaaaagtgaaaaaatcattaattgttttagatattttgaaaaaagaagatataatggttaactttggtctatggttacacaaacttgggaaggcatattggatcaatgatttgtatcaatttagaaacattctaaactgtaaatcgtctcctcgaatcatttgtaaattacttttgatattattttataaagaaggccttttaacaaaaaaataataatatgattttataacaaaatccatgttttccaattaggggagattgtaagtttttttttataaatgactaatccaatatcttacaccagaaaaaaaaactttccatatctcaacgggcctaactagttatcttattgggctcattcagttcattaaaatagcccaatattcaactcttgttctatcttaaagtcccatatcgcttatcttacaagtgaaaagagtaacatttatcattagagtcggtttgacaaaaaaaaaaaaatcattagagtcgaagatgagactgtcaccttcactaaagttggaacgatacagagaatattagcatgacccctgtgcaacgttgacaccctttactcgataattggtctaattttttttttgaaaattttctagatcgacgatgtgcaatttgtgcattgtttgcaactccgacgattggaaacctaaatttccggtacaaatttaattaaaccggatggtttggtttattatatgttctatattattctggtttggagaatcatttcttctcttctaaaaccctttgcgtctcttctctagagaatctctcggttgctccaatggctggcttattggttactattaatcactgaatctcacaaattgatttcgcaagctgactcctttgaagccatg

SEQ ID NO: 36503 - DNA, 3000 bp, Unknown
  misc_feature (1)..( 3000): 2750-1469P.txt file - cDNA_ID_3096989; gDNA_ID_2936550; Annot_ID_194025
aacaacttcttacatcagaatttctcaaccaatgctacaagtagcgtgcgatcaaactacaagagctcaattcatcacaaaagattcctcattcctaaagaactagcagtgaacccctccttttccaaccccaacctatactccacacgaaatgttacatatactacaatgcaaactcactgacaagtttttcagctgaagatgaacatttttcacatacattttctctaaacgaagcctaaggaggatcactgatccaaaattttaacaatctaacagaataaacacaatatatgatcaatacagaagtaaaaagattctcactttgctatctcctggtaatcctttccaaatctttcggcagcaaacttaacaaaagttctagcatactcttcatcaagattccccatatccaacttttctccagtaatgaaattagccttgttcaaatacccttctttatgcagaagcctcacaaacgacaccatctctataggaagctccttataaaccctaattacgtcctccttttccttactatgtttctttacctctttctcttcatctcccttaaacaacttgtaaagattatgccttttctcgttttgctctgatatcacaacctctcccttctgttttttctttctcacaggttccgatttcttcagttctatgagtttcctttccaattccaaaagctttctcttcaactcgttgccttcttcttcttcttcttcgatttcgctcgtttctgatttgggtctcaatccaacagcctcttcgaagaaaacagagagtggcttcttataagcttcttccgatgtaaagtttctggagacaatcaaaggcgcgcattgaggtttcaagagagtcttaaacaaagtttgatttttgagaattgatctgagcagaatcgccatggcttcaaaggagtcagcttgcgaaatcaatttgtgagattcagtgattaatagtaaccaataagccagccattggagcaaccgagagattctctagagaagagacgcaaagggttttagaagagaagaaatgattctccaaaccagaataatatagaacatataataaaccaaaccatccggtttaattaaatttgtaccggaaatttaggtttccaatcgtcggagttgcaaacaatgcacaaattgcacatcgtcgatctagaaaattttcaaaaaaaaaattagaccaattatcgagtaaagggtgtcaacgttgcacaggggtcatgctaatattctctgtatcgttccaactttagtgaaggtgacagtctcatcttcgactctaatgatttttttttttttgtcaaaccgactctaatgataaatgttactcttttcacttgtaagataagcgatatgggactttaagatagaacaagagttgaatattgggctattttaatgaactgaatgagcccaataagataactagttaggcccgttgagatatggaaagtttttttttctggtgtaagatattggattagtcatttataaaaaaaaacttacaatctcccctaattggaaaacatggattttgttataaaatcatattattatttttttgttaaaaggccttctttataaaataatatcaaaagtaatttacaaatgattcgaggagacgatttacagtttagaatgtttctaaattgatacaaatcattgatccaatatgccttcccaagtttgtgtaaccatagaccaaagttaaccattatatcttcttttttcaaaatatctaaaacaattaatgattttttcacttttcggaaaacaaatctaggaaatctatttgtatcattcacatgcatcaaacagctttttattttatgttttggtcacatgtatcaaactgttttcttctgattcatgcatttaaatttgcaaataaaataatactcacaataatataaaccctttcacaaaaaaaaaaaaaaaaaaaaatcacaatacattgttattcttttatctggccagtaataattattacattttatattcacattagacaattatcggggtatatgaaaacaaattcttctgtgaccactcttattgaaccatgtgtctctgttcacacgttacctaagctgcattttgtatcctaatcgacctgccgttttatcaaaaaacgtgtcattttcgtgtcgttttctacttgtttcgaattaggtatcgtttaaaattcgtatatacgcctcacaaaaacaaaacaaaaaaaaactacaaggagaccaaagattagccaaccacgtgcctgactcatataccattagtaaattcattatcacattcgcgccgtaagatctcaccacgtaagctagtttcaccaatccgataggtttatttattagttaatttgtggtacaacaatttttattacttcttcaactgcttcgtttctcgacagtgaacatggcccccattttttcttcaacaattttaaaatataaaataactagcttacaaataactaattttaaaataaaacaaaattactttaaaaaaaaaaattattttcttgtataaaaaatctcgagcttccaagttccaacaccaattgtgttacttttgactttttaatcgagtgttttttttgttttgtagtttgcgtgagagcgagacacgagtctatgttttggtctgagtagtcgtgaaatgttttaaaatgattcagaagcggaaaatagaaaatatgataatatcacctggtttaaacattgtctttttagccctagcaagatcatcacaatctcacatggttcaacattaccaaaaataaataaaacaaaatcaatcaaaaagatttaaatatttagaaaaatcaacattaccattacatctagaaatcaagaaccaacttttctttttcctctttctcaaaaaaatatataaacgaacgttttactttgaagaaaaacaaaaatctcggcgagattttactatagaaagtttcattccttctaacatg

SEQ ID NO: 36504 - DNA, 3003 bp, Unknown
  misc_feature (1)..( 3003): 2750-1469P.txt file - cDNA_ID_3096998; gDNA_ID_2936550; Annot_ID_194024
tttggttctttctactcgaaaaccaaagccatggtaataatagagtacacattatcaacattctcgaaaaccatatgtgtctttgttcataattgctctgtttttccaccaggttgaggagctcttgagagaatttgacaatgtatgtaccttgagagtccggatgccaatctcctcagacctaaacaacccgagaaacttcatcacgaagatctcgcgctacaacaaagtggtggacatcccgaacagcatgaccgtactagacgagcttctcccaatctctatcgagatggcgaagagaaacctaagaggcatatggaatttcaccaacccaggggtggtgagccacaacgagatattggagatgtacaagaattacatcgagccaggttttaaatggtccaacttcacagtggaagaacaagcaaaggtcattgttgctgctcgaagcaacaacgaaatggatggatctaaactaagcaaggagttcccagagatgctctccatcaaagagtcactgctcaaatacgtctttgaaccaaacaagagaacctaagccttcaatgaacatcacactcttccacaagtgcttactttaaactgttttgttttgtttttttttctttttgccttttcttccaacagatatatcttttttatatttactcatcgtcttatgatccttgtaggtagtttcactatattgattctactaaaatatgatttacgattattaatatttatatagacgagagtttttcttttcctcaaatactacattttccctcagatttttacttactaagtcagacagcttataaaaaagaagagtcacttactggttgtgaccattaggacttccacctaggcagtttcagaacacttgaacttgatccttaagctatagcctgagaatagaagcaacaaaatattttagaacaaacccaagtacatgatgtgagtttggtctattttaaggttatagttttctacttttcttacgtgaacagctgagggcgggaacgagagagctgagaacgtttaataggggagagaataaggtttcgtagagttgactggggattagcagtgccaccaccaccgtatacaggatgtcctctgccagctcttctgtttccaagatcggatggaatcgcaggtgagtcggtggagatgtcgaatggacctgagtttgaactgttctgtcttgctggccatatctcatctttaggtcctggtgttgcaggagagaaaaacgaccggtctgcaccaaataagtcaacttgatttggagatatttaaccaaaatagactcaggatcatatgaagcactaagctcaagacacagaaatagtgtagttaaattaacctttgcgaatggtctctctgttctccatcatattaactgctgggtttgagaaaaagtcgggttcttggtgtcgcgggtagaagttgtttgctggttggatggctgtacgtttaactgactcatactcacttcttagctggtcatacatctcatcaagcttcctcttctgtctggtaatttaaaaacaattaaggtacattgttattgtagttgagattaatatagggaacagaaccaggaaaacatatcttaagtgactgaccttgatttctcagagaacttctcttggagctcttgcttatccttggtcaagttttctacctcttgctccatcatctgacacctcttgcccatcttctgatatgctgtatggacctgctccattttctcgctaaactttgcttgcataccctcacatttctgacgacactgtgcaacaactctattcatcttgtactgcatctctaagtctctttgggcaatgtaaaacattacacttcggtatgcactcttcatcactagattcagttaagaaaaacaggaggtttttgaaccttaaactgttgttttaccaactcttacaaaggcaaaagagataaagttataccacttgagtttagatttgagatacagcgggacaattttcaattgaaaaaccatagttacaacttgaaaattctaccaagagcacatctatgaaaaggatacgtatttgtggagaaattccagccatcgccatctgataacacatgtaagcaacgaggagatgtaagatgggaatattgaaaactggaaaagaagaaaagctatagtatccttgcgtatttcagcttaaccacttacatttatccattcttcatttggattgatatccacaggtttcattaaactaagatggaaagataaagactaactgtcaaatggagaataaggcgactagagctaaactgaagctaggctaggaaagttttacctcttggagagtacttgatcacaaatgggacatgccccatcattactgagaatcttgctggcatcttcagtaccttttcatggtgttaaggtcatcttattcaagctcacaagtgttgctacgcaaaagaaaagtagaaagtgtaaataggatacataataagtgaccgcaagtggtggaaatggccctgccctccaggtccctccaacacgcgttgcatctcatgtcaacctctaatataagtatctcaagctgctacgcacctgcaaattaacttcatatcaaacaagatgaagaaccatgctctaaatgaaacttccattctccactgaactaactcattgagatcaccaattaactagtattcacaatacaagttttaattaacctatattcattctaactactgaaaattgttaaactgcaaacacgaatgggtacaaagtaagcattaagacctgtcaaacttcagtagttagcagttcatagtcatcggagaggtacaaaactaacagtaactgtgatgatcaactagtttctagtcataaaaacgatttagaaaacggaaaccctagaaattgggcatatgcatagatttcagagatcggcaaaatttcgactgcacagtcccgaaattaagggtttctacatcacagcgatg

SEQ ID NO: 36505 - DNA, 3000 bp, Unknown
  misc_feature (1)..( 3000): 2750-1469P.txt file - cDNA_ID_3097002; gDNA_ID_2936550; Annot_ID_194023
gttttagtttttataaaaccaaaaccaaactgaaaaaccgaatatccatccctattacataataattaagaatttatattatatagagaatgattaaaactatactataaagcaaacaatagtccaacattaaataagtattttaaattttaatttttacccgtgttgcaccagcacggattacaagttggttctataagatgtgttgtttctgtctttttttttttttttttggctcaacatcaactttccactaaccaattcaaaggtacaagtcattcgaccaaaacatattttaaccaaatacaatgaatcagtctattatcaccttgaaacactatgatggattcaacgctacccaaccgaaattcactgtatttttccaaccacaacgagatgaattacaccacgactctaagtgaaatcatcttttaaaccaccaaaattcacccaatgacacgaaaacatttctagcacaaagaaaatcaaatcctatcctgagatccaatccaattccaagctattagtccctcatgatccgagtgtagaacatgtcctaatagcatctacgccaaaagcgcaacttcagaagggttttgactcctctgctttcactatttcggtcctaagcctaaaacggacatactaatccgactgatactcaaccggatcaaccgggctgagacaaaaatttcttgaagtcgaggctttattggagagctttccttcttcttctacaatccaaatggttttcttttctcccccatttctcattaattctccatcaggagtcgttgacggcagcatagctaatacgccttgaatcatgtaaatctgcccgggatcgataggatcttcacaaccaagctcgaaaaccacgatccgcctacctctgtaccttcttaacactgagccaccactaccaaggaggttcatcggaggagaggtacctccgcgaagagactgacgaagaaatccaccagatctgctgccgtcgtcgagagtcatagttccccattgtagatctaccaacgaacctccatctgagagaactatctccgctcgccgtcgacttaaaactctttgattaagccacaaagaaggaggagccgccgccggctaaaaaaaatcgacacaaaggaaaaaaaaaactaaaaagagaagagaggccctctcacggtgccggccgaaaccgaccaccaaagaggcaaaacggcgtttgaagatttgatctggtttgcggcggctaactagagagagagaactagggttttttgtttagtttgtgtttttgttgttgtattttacttaagatgttgtttttgtttaaatgaaccaaaaaaaggaagtcttagcttaacaaaccgacgccgtttagcgatgtgcatttcaacaaactgcgatgtcgttttgacattttattgctcactcaagtcattttgctactgctgattatctctggaaatttgaaatcttcgtttctcgcgccggcattgaaatcagcgagagaggtaacgatcctggaaactcttgtgttttctctcggatttgcatctgcctcttcttcgattttcaatttttgagatccttcgctgctgtttttggtgttatacttcagatcggtaagcttaatcgccgtttgttgttcttcaatcactttctgcgacgcgttctctctctatcgctctgtcaaaatcgcaggtaagcttcttcaatttcttcttagatcttcacattcctgctgcgatttcgttgctatacctaagctctttacaatttctaaggtttgtgtcaatctcgaatcagggagattgataaaccgatttgtctccagtattctgaagaatcgtaagtcggaatctaactgttgagttgagttcatcgctgtgatgtagaaacccttaatttcgggactgtgcagtcgaaattttgccgatctctgaaatctatgcatatgcccaatttctagggtttccgttttctaaatcgtttttatgactagaaactagttgatcatcacagttactgttagttttgtacctctccgatgactatgaactgctaactactgaagtttgacaggtcttaatgcttactttgtacccattcgtgtttgcagtttaacaattttcagtagttagaatgaatataggttaattaaaacttgtattgtgaatactagttaattggtgatctcaatgagttagttcagtggagaatggaagtttcatttagagcatggttcttcatcttgtttgatatgaagttaatttgcaggtgcgtagcagcttgagatacttatattagaggttgacatgagatgcaacgcgtgttggagggacctggagggcagggccatttccaccacttgcggtcacttattatgtatcctatttacactttctacttttcttttgcgtagcaacacttgtgagcttgaataagatgaccttaacaccatgaaaaggtactgaagatgccagcaagattctcagtaatgatggggcatgtcccatttgtgatcaagtactctccaagaggtaaaactttcctagcctagcttcagtttagctctagtcgccttattctccatttgacagttagtctttatctttccatcttagtttaatgaaacctgtggatatcaatccaaatgaagaatggataaatgtaagtggttaagctgaaatacgcaaggatactatagcttttcttcttttccagttttcaatattcccatcttacatctcctcgttgcttacatgtgttatcagatggcgatggctggaatttctccacaaatacgtatccttttcatagatgtgctcttggtagaattttcaagttgtaactatggtttttcaattgaaaattgtcccgctgtatctcaaatctaaactcaagtggtataactttatctcttttgcctttgtaagagttggtaaaacaacagtttaaggttcaaaaacctcctgtttttcttaactgaatctagtgatg

SEQ ID NO: 36506 - DNA, 3003 bp, Unknown
  misc_feature (1)..( 3003): 2750-1469P.txt file - cDNA_ID_3097006; gDNA_ID_2936550; Annot_ID_194022
gtcagcaaatctcgaaaatggagtttgaatttgagaggcgaaggttgacaaaggacgacattagagaactaatatacagagaaatactggagtaccatcctcagttgctcaaggactatatgagcggatctgaggggtctaattttgtatatcctaggtttgaatttcttcctaccttttattattatttaccaaatgaaacatttcttgtttctttctcccgttgaatttatgtccaatcgcgtacctctgcctggctttttattcatgtttttactttttcacttgcagcgccattggacatcttagacagcagttcacttacttagaggaaaatagcagtagaaatgggccggtcatacctctcgagaggaaacacgcatcactaccgcggtatgttttctcattctttatatacaagtcgactgtagggaatatgcttattcttttgttctttcttctgctactgcttagcatttgtgaagcatatggtcgaaggcctcaagcaaactttcatatgttctctactcttctaattctaaaaactttcatatgttctctactcttctaattctaatagatatgattgttttccacaggtctacggttcactcaactgtagtccattccacctcgcaacccaacttgggtgcaacagatagtagacgtgtttctttcgagccttcaaaaaatggagcttcttctgcaggacatccatcaacttccgcgtatcctactaaatccatcggacctccaccaagagttccaccatcaggtctcaatcatatctccaaatattatttcctaaagttagaaacttcaactaactttcaccctatgttttacaggtagaccaggtcgtgttgtggaatcatctgtatcttatgagaatggcaggaacctcaaagaagcttatttcagaagcgcggtttcatctcctcattgctacttccgaccaaacaccatgacaaacccggagaaccgcaacatagaagcttcgtcttttccaccaaagccacaaaatcctgtccaccaattcagtcccactgagccaccagctgctacaactaaccaagcagacgttgagactatgaaccacccaaacccttactttcaaccacagctcccgaagacagatcaattaaacaacaacacacatatggccattgatgctaagctgttgcaggcacaatcacagtttggtccagcaggagctgcagcggttgcagtagcagcacaccggaacataggcacaattagttacagcgcagcatcatagacaacacttcagacagatctttaaccaccacatcttcctccaccaggtgattctctagtttttatgtaagtattattcagtccaggctctgatatgaactacgttgcaatgatataagaaagacttttatttagttgtaactctccagaacaagatcgccttggattagtctgattgcgggtcagtcccggttattgtttcggttatcttgttggctccataatctttgaatttgccataagcgtagttcaccgtagagaagaatatcgtggtgattatatacttcttaaacttcttaatcggtcccattagtctttattgttcttcaacaaaaaaaggaatctctttggttattggaaaatatggtcttgattggttaatatagacaacattatgccgaagaatgtggaagtaacaaaataaaacattggtccttagatttttcttctgtaaaccactctttctcagattatataattagtcaattttattcaatggttacaaaaagaaaaaaaaaaacttgccaatgaaaaaaaggaatgctcttgacctcaagactcatcatggttaacaatgaaattcgccttaacttcgaaattttgacgccgttgaaatgtttataatttacccgccaagtttgtaggcctgagtttagcccattaaaggtaatattaggcgtccattaatcataacgaatatcactttctcaatttaacaagtcatgagaaagtgtacacatttgatctatttaatatttattaaccaaaaaggaagcaaatcaattatttcgttacgtgacggtggcattaagcatcttgcattgaatgatccgttatatataatctcaggttttttttgggttgaaatgatgatattaaattttaggttgacatgtacttatctttgtaatcaactaattaaatatttgaactgacatgtctacgttatatcataaataaaccaggtgttttaattaaataccacgattaaccttctaaaataaggaaaatcatattttattcgtcaatcactataatttggaaaacgatgcaatatatttatttctttctttatacacatacttaattaattatcaaaatttcattctattttaattgatctgaaatgtcctaatttagtagagagctaataaatagactcacatttatgttgaaaaacaaaacaagaaagagaaaaagacatgagtttaatgtcggacgctagactcacgagaaatccgtaatatctaagacgatcaagggtaaattagtcaatttcctcctacggttctccgtaactgtctcagaatataagaggcacattgctgagagaagctccgtagaccgtagattccctcttcttcttcttcctcttcctctctactgttttttcttttcatatttctctctctctctctctctatagttggtgaagtttctatctttatctctcttaagatctctttctctcttgggttatctgactctaaccagaattgtgtcggtacgtgaaattgtttctctctttctgtttctatttctaaaactaattttgtgaaatgttgtacgtgagtgacaaatacatctctatgttgtctgtttatgatcccatgtgacatgtttaagatctgttgctgaattggagatctggatctgacttctttttcatatgatccgcttctgaattttccatttgatgttttttttttgcagatttcaaggatg

SEQ ID NO: 36507 - DNA, 3003 bp, Unknown
  misc_feature (1)..( 3003): 2750-1469P.txt file - cDNA_ID_3097011; gDNA_ID_2936550; Annot_ID_194021
aggattaccaacgaatgtggatgcaacgatcgagtcaggtaatgttacatctgctctgtttgatgtgttctttggggattctccagtttctcctacattgaaatcctcagtggctaaccaattagccatgaccctagtgtaaaagtaaagaccatgttgtaattgtatatcatgaatcttgcaatgtgttaattaatctctctttatgctgtcttcttaaccccttaaagttagctaccatgctcaaattaaatactagaaatcttaaaatagtatcaaagcaaagtaaactataaaaatgggttttgatccctaatttttacatgtagtccaaacagttggaagttaggtaagaattaaaattgaaaagtttaagtcaagatcatagtttctacttactacaatgggaaataaatatgattgtggaggacaagagaagatgaatgaaattatgttgttttggccaagttgatcaaagtgagtccttttcttggtgtgtgccctttaccacatgcaacttcttctctcactggaccacatttacacattatattttggtttattattaggatgcattgtcttttattcatcaacattattatatttgcactaataatatagagttgttggcaaccaaaagttaagaaaacaataatatatagttgtgcacaaattatcattatttatgggtgatcccttttttcttctatcattatatatggttcatggaattttaataagatgtaactcaaataaataaacaaacaaaataaatctgcttggtggagatattttggctcctccagtcaaaactctaaaacatacatacacgaaaagcatgattcatgtgatgaatggtaatattgtgtccactctgttgaattctgactcatgattatatatatatatatatatatcttcgaattattaaacttgcaattcaaaatattatatatatcattttgaaaaaccattaaaactattttaaaaatagatatgctggttatatatattatgcagagcctggtctaaatagatagaaccagtcaaccatcatttatatttatctttggccgataattattttaaaatgcgcacttagtcaaaagagagtaaaattatgattttaaaaccgaaagtagaagaaaatgaaaagcaatgaaatatgcaaaaaggatcaactttagttataagttataacgccttaaaatattgacaataaattgacacatgcaccacctacatcgtcgtatagtgtgaaattatatggagtatgataatttgaaattatgatattttgtactttagataatgaaccaactttggatttgaatgcctcagatacaaatgaataataagatgttggatttgttttaatcaagatcagttataatattatcataatcttcacctttttgtggatttgcccctattgtgataaacttttaatatgagccagacactaaatatgttggtcttttcaataaatacaaaagccaaattgtgtaaattgacatgtgaatattagtttcacacgaattgcaaaattattaatctatttattttattttattttctatcaaatactaagtcatataccaatgaggatggcagtttttttttttcttttgattttgtttttatcatcccatagtatcaagcaaacaacttgacacttggaaggtctttttctcaaggttagttgatttacatggaataaatgttcatcaaagatggtattttatcctaatatattaatcgtgtatcgtctttaccaaaataaattaaaatctaagacaaatatccttcaacaatatttatttacatatgaattagtcaattgtatatagatttttcaatcttaaaaatttaaatcaaggaatataataagcaaaattgagataatgttaataatattcctttcagtggtacgagaaatactatcacgtgggggttaaattgaccacttatcaaaaagaatggttagaatcaaaacaaaattaagataggggtcaaaatcggaatttaagaaaaataaaacggtccaagtccagcaacaggtgtctaaaccattgggtcattttccaaaaaggtcgtccacagaccacagtgggagaaaaccaatatttactttaccctcaaatgttgtctaaaactacgaaactgccactatctgggatttgtcacacccgtacgcaataagtaccacgagaaattgctagaattagaaattatttttattcaaatttagaaaaaatatctcaaattcggtatttttaaaatcctctctcgtcttcttcttcttcgatcgctggatctaggttttgctcttctctgtatcgtcttcttcacagactgggcttgattttgagttcttctagttttcggattcttagcaatctaggttttttttttttttttacttttcgaaaagccgatccagatttttgataattttgaagaagaagatgcaacaaaatcaagtgaagaaggttcgcttcttgctctctatctctctcaatcatgctttgattctaaatgtgggaaacagaggataaagtcttatccttttacaaatttaaagacaaaaaaaataaaatctttcctttttcaattgcaattaggtttggttttgttgcatgagcataaataagatgtgtggataaagtttgtgttttgtctacttttgtgattcactagggcacgaaagagatggagtttttcacagagtatggtgatgcaaacagatataggattctggaagttattggtaaaggaagctatggagttgtgtgtgcagctattgatacacatactggagagaaagttgctattaagaagattaatgatgtctttgaacatatttctgatgcgcttcgtattctccgtgaagtgaagcttcttcggcttttacggcatcctgatattgtggagatcaaaagcattatgctgcctccttctaagagagagtttaaagatatctatgttgtgtttgagctcatg

SEQ ID NO: 36508 - DNA, 3003 bp, Unknown
  misc_feature (1)..( 3003): 2750-1469P.txt file - cDNA_ID_3097015; gDNA_ID_2936550; Annot_ID_194020
acacaccattttccatactggctttgatttcctccatcttagcattctccggcagcctaaacctcctcgtgaacttcccactcgaccgctccacacggtgccacttgtcattcttctcttcattctcattgctcctctctccacttatctgaagtatgttgccatcctcaacctccactttcacctcttccttcctcagtcccggtaaatccgccttgaacacgtgcgcctcaggtgtctccctccaatccactttagcgtttgtgaacgctgccacatccatagcgggtgcgtttgccaatcctgacggcgtcaagaaaccttcgaacggatcgaaaacatccagcgagaacggatcgaaaacgtttgttcttcttcctccgaagatgcttggaattagagacatcgtttcacttcctcttgtgattgctactctttgcgtttgctctgttttgaagctttgctttgctatgaactctttgctccttgttggttcgtacagctacgagccttcgcatatttatagggagagagtatggaaagtaagatagaacattctgcgagtttcttgaaaattattttgatcgatggtatccttgaaaaatcagggatcttcgtttctttcttttaacgacgttaccagacttctcaggtgctttcaagaagtttctggtgttgagggctgagacgacgtgcaatgcatcaggtcggcgagtgaacgccttgccgtttttttgttttttcttgggctataatatcgaggcccattaatgatttcgtctaaatttatttttttggtgaacattgaacaattggcttgagtcccccaaatgaatcaaaacatctataaaactttgtatcaaggacacaattatcatcccataacgcaccagctttttcgataccaacaatatgaatcttaacatttgatattgaagttcgggtttcagaaacaatatcaggaccatggcttttcttctattactgccaaaaaggagagtagacgaaaatgcttatcccacatgaatgatacattactcgcatgagttacagtgcaacaaaatcgttggagtgatctcttgacgtatacagtaggcagacaacctgattacctgaatgtgtatgtgtatataatcgtcatctcaatgacccaaagtattctggtggccagacctagacaagcaaacagatggttactgatgagattattgtcattgtttcataataacttcacagctagaaattttgagaaaagagttacccgtagaagagcttttccttcaatgagactgtaaggtacaggcccaaaatgacgtgaatcagttgaagcatacaagttatctccctgaatccaaacatgacctttcggaacctattgaagaagtaaacacataaccttttattagacaagctttagtgctgcaaaaacagagattggacgcagtgtagagatgtaagatagcaaaaagcataagtttttataattactctgaaattgagtttcattgaaaccaataactagcaatgatccacaatctagaccatcccaaatcatcaatcatacacaattgaaacctagctctagatctagaaatttgcaaattgcatcgttttaccttgaatcagtaactagcaatgctttaccttctagaccatcccaactcgtcaatcatacaccgcttaacccttaaccctaagtttgcaattccatgttgttttaccttaaacggtttaagttaaacccttaatgctataactactctgaaattgaatttcatcgaagcaatgctttgtatcctagaccatccaaaattatcaatcatacacagacactctaaaccctggagaaacttgcaatttccatcttcatttttacagtaaacccttaatgctataacaactccgaaatcagctatactcgaaacagtaactagcaatgcttcatcttctaaaccatcccaaatcatcgatcatacacagataaaccctaaaccctagaaataagtacatcccatcttataagccctaaaagctactctgcaatcgacttaaataaaaaccagttactagcaatgattcatcttctaaaccatcccaaatcgttaatcacacacagataaaaaccctaaaccctagaaatttgcaaattctatcaattgttttaccaaatgcaacaaaagactgaatttttaagagagagattggtcaatgttcataccaaaacgctcactgaagcatcaccgaccaatgggtcagcagaaaaagtgagtctatcgccttctaaacccaagattcgctttgtcaccatcctttttgggtctctaggagatcgaaccaatacaacgtcaccgagtccaatcttaccaaaccggtgtgataaatgttccgccaatattacatcgccggttagattaagcgtcggaagcatgctcggcccgtgaacctaaaacccaaatcaaacaaaatcagattccttggagaatacgaaagagaaatagattcagtttcgttaggttacaaacaattacagacgtgggtcgtggagattatgtatcgatcggtgacatgaagcaaacagagaaacttggcgacgattgatacattctcgaatgcttctttcgctgttccacgccattgcttcagataactcaaaaatgtcattctcatctctctctctctctggtaaaagcgaatctcgtcagaagaagtgaagaaccagaaaaaggccgaaggcgagacgaaggtagcgaactcggtccagtctagagttaaaacgacaagcagttggttattcgaaaccctaaacgacaccaaggtttaaccttttaaagtgttttttccatatcaatgtcaaaactgtaagtagttgagtcgcgaaaattacaaacgacaggttttcttcattaattacaaccaaagccacaactgtataatttgcagagtggagtggttcttcttctaaagttcggacacttaggatttatcgccggagttttgaacatg

SEQ ID NO: 36509 - DNA, 3000 bp, Unknown
  misc_feature (1)..( 3000): 2750-1469P.txt file - cDNA_ID_3097018; gDNA_ID_2936550; Annot_ID_194019
aatccaacatcttattattcatttgtatctgaggcattcaaatccaaagttggttcattatctaaagtacaaaatatcataatttcaaattatcatactccatataatttcacactatacgacgatgtaggtggtgcatgtgtcaatttattgtcaatattttaaggcgttataacttataactaaagttgatcctttttgcatatttcattgcttttcattttcttctactttcggttttaaaatcataattttactctcttttgactaagtgcgcattttaaaataattatcggccaaagataaatataaatgatggttgactggttctatctatttagaccaggctctgcataatatatataaccagcatatctatttttaaaatagttttaatggtttttcaaaatgatatatataatattttgaattgcaagtttaataattcgaagatatatatatatatatatataatcatgagtcagaattcaacagagtggacacaatattaccattcatcacatgaatcatgcttttcgtgtatgtatgttttagagttttgactggaggagccaaaatatctccaccaagcagatttattttgtttgtttatttatttgagttacatcttattaaaattccatgaaccatatataatgatagaagaaaaaagggatcacccataaataatgataatttgtgcacaactatatattattgttttcttaacttttggttgccaacaactctatattattagtgcaaatataataatgttgatgaataaaagacaatgcatcctaataataaaccaaaatataatgtgtaaatgtggtccagtgagagaagaagttgcatgtggtaaagggcacacaccaagaaaaggactcactttgatcaacttggccaaaacaacataatttcattcatcttctcttgtcctccacaatcatatttatttcccattgtagtaagtagaaactatgatcttgacttaaacttttcaattttaattcttacctaacttccaactgtttggactacatgtaaaaattagggatcaaaacccatttttatagtttactttgctttgatactattttaagatttctagtatttaatttgagcatggtagctaactttaaggggttaagaagacagcataaagagagattaattaacacattgcaagattcatgatatacaattacaacatggtctttacttttacactagggtcatggctaattggttagccactgaggatttcaatgtaggagaaactggagaatccccaaagaacacatcaaacagagcagatgtaacattacctgactcgatcgttgcatccacattcgttggtaatcctcccgacgaaacagaaacctaacaaaaagaaccaatattaaaacaagcaacgataaaaggtcatgtgcaacggtacgattagccttaaaaaaatgtgcttacaagcatattagaagtgttgatccaagtcaagagtatgacacttcctttgttgagaggtctgttttggaaaatcccacggaatgtagagagagcagttgtatcctcagaagatggagatttgattctcggtgaaatggcttcatccaatgcatcccagaaggttttaccatcaacatctctcacaagaacaatctgcaacgatttctctgcttgagctgcaacgttgagaggaaaaagattcagaagaaaaagtgagagatcaaatgttgataaacaaagctatcatctttagcatttcgttaaccttggaaaatggaaacaaacagtgatgaatctctttggatctcatcagcagatcgccctgtccaagcgcttaacccgctcaagatagattcattcacataataacccgcagcatagactttgacaccgatgatagcaaactttttctccctaaaccctgaaaaaaattatgcattttcatagataaattcattaatggaaggctaagagcaaatttatacgtatttcatctacacaagatcccacattgatgtataaaaccgttgcaaaaagtttacattttcgaggctaaaaatagtgcagatatagtcaaaactaaccagtgccgagcaaagacaacgggctagaacaacccggtaatgtcactgatctcttaaactttacacttgtagccgtttcttcagcgtagtcctctgcatttccaactacacaagccacagagaccaaaatgaaagtgggctaaaactcaaatgcattataattcttttccaaaacgattcctttgctaactctaacactgtttcttcaatctctacaagaatgaagcacaaagatcttgtctgtttcagtttcaatctacaaagcaaaatcagctaaaatttgcaaaatcaaattctgtttttctgaaacaacaacaagaaaggttcaacctttacctgaagaagcggcggattttacgatcacacgggaaatttcaccacaatgtcggtttttaagcaacgaattgcctttacgagagacgtagttcccagtttgaagcactgaaactcgattcaaggatttgccgggaaaatgatagatggattcagcattatccagattccgacaagaaatgcgtagagagacacacactgcagatggaacagctgcaagaatcccatccatgttcaaaactccggcgataaatcctaagtgtccgaactttagaagaagaaccactccactctgcaaattatacagttgtggctttggttgtaattaatgaagaaaacctgtcgtttgtaattttcgcgactcaactacttacagttttgacattgatatggaaaaaacactttaaaaggttaaaccttggtgtcgtttagggtttcgaataaccaactgcttgtcgttttaactctagactggaccgagttcgctaccttcgtctcgccttcggcctttttctggttcttcacttcttctgacgagattcgcttttaccagagagagagagagatgagaatg

SEQ ID NO: 36510 - DNA, 3003 bp, Unknown
  misc_feature (1)..( 3003): 2750-1469P.txt file - cDNA_ID_3097029; gDNA_ID_2936550; Annot_ID_194016
ttatctcctgcaaataaaatagagtggttcatactttcgttttaattctgacatacacaaaagatgaggcgaattagatatacctgatttagttgcttcagacattcttttgatgtttgatcgtcagaaatgaccttgacctctttaatagcacacattttccctttctcactgtaagttggcgaaaacattatacgatggaaacaagcagtttagagttacaatgtaaagagctagcataatagaaactttttctttctattgcctttatctagattgcaggtgaagttaaccttaaattttgatcaagtaattgcagacatgaaccatcagaattgtccacacggcccacaaacataactcaacagcatatcacaagtaagccctctcaggagtcaggagtcatcacatatacacaaacccatcacatgtaagcatctctggttaaagatagctattgacctagagatatatgttaatggcctctggatccacacgatacaatattgtttccacctatggagaaagctagtatcaaacgccctatctatctggacatcacacattacgtgatctaaagaagtgtgaaggctttgctacaaccaaggttagctatctaactaactcttgtcacctagaaactaagtcaactcactcacttgataagatgttccttatctaaaactatgacattcctttaagcgaatcagagtagaagaatctgattatctcacctgttgaaaccaagatagacttgaccaaaggtgccactcccaagaaatttcccttttttccacgtggaaaaccccgaaggagaggtctcgtagcctcctccaatcctggaaccatgcacagcagaagggcttgtaggagaagtaggtggtcgaggcaaaggatgacactcagaggaggaccttccatcatcattcctccctgtagaagactctaagctcacaactccagacaaacgctgatgccgtggagacgtgggcctagtagtaatagtagctgcctttggagaaactctctcaggactacgtggtgctgctgctacattgaatttcacatcaccacgacccctgctatatgactattgagttataaccacaaaacccacaatcaaagcagcaaaaagacgtaaactttgattgattaagaggttctggatccatacaagtagatgcacagatactaataaaggggaaaaagcgaacctagaagcaacaagttgactctgatcatcagctgatccagatgagctaacgctagaaacagatgtagatccagaagtggatccgcttacatgatcttgatgatggatcgaaacaggagagagcaaaggacgaggaagagggtgacctttcttctcggtagaatcagagtcaaaaccagagaaagcagaagaagctccagcgaattcacgactgcaacgaggtgtaccaccacgagtaggagtgagaggaggatcaacaacaacagcagagctcttgatatctctatctgtggagatgattcctctgtgattatcgtccttgttcttgcaggactttcttccccaccaagtaggcatattaatcacaaaaatggaaggggttttgaattgaaaggtgagatttttaacagaatcaatacaagagaggagatgaaatttagggcatgagaaggaggagagatacgaaagatgaagatttcatcgggagagaagagtggacagctaagctcgaaagggtagttggagaaagagagacacaacaagttgcgacctttttcactttttttttctatcttctcgccgtcggattaaaccacctgctctgccctggtggtaagttacaatatgttttgcttcaagatgggattttttccggtctttttttaaaaaagttttcttacctataattggtatgtgtaagaaatttcgagaaatgtatatatattttcataagtttatagaattattaatttatgttattaatggactatatgtttctataaaacttttaaaacaataatgtcaatttcttataccggtcccaaaatataaccaaatttttttattaatttataaagattattattgtatatatgtttcttttttctaaatcattcaagggggtttattggtttagaaaacgaaagtaaaatcataaactagttttagataattggtttccaaaacatcatcaatttagataattagtctttggttaattagtgtgctaactcttttcttcatcatgttttttctactttgtttatcggatttttctgattctattgtgttatatagcaagatgtgttacatttgtgactggagattaaaattgataaatgagtttaggcttaaagactatctatgttatgaacactcaatggaagtggacttcttaaggtttgtttctgttggttgatgtaattgtttacatttccactgtttgctttactatgttaattttcctcggtgtttcagggtagaagctcggatcaactctacaactacgagtttgtacattcacagcctgagtcataggcaagagtgagtccatatgcaaagtcactcgtactgttcaaaaaattcaatctaaaatgctattgttgatctttttaccagataatctacattgccaaaagacacattgatctatcaagctcatgactagaaaggttttgcggtaatacaaaacacgcaaaattcattatgtcaagctaggttaataagataagatcgttagaagaatgtgtaaattagattgaacaatgaacatgtgggatttgttacgaagattcgatgaagacagtaattgcgtgttcaacttttgtttggtttgctgattgatggatgtgtcaactacttcaatttaacaataccataatctaaatgagcttttctaacaacaaccactcgtccatgtgtctgctgccacgtgtctaatttgccacaaccttaaatctgattaaacaataatgagatagagagacagagagatagagagagagataatg

SEQ ID NO: 36511 - DNA, 3000 bp, Unknown
  misc_feature (1)..( 3000): 2750-1469P.txt file - cDNA_ID_3097034; gDNA_ID_2936550; Annot_ID_194015
acggctggaggaaacgagctacttaaaatgtgctggaatgattgcaagtggtgaaattttgttgtacccaatctctagtgctaacacaagtactgatgcaaggtatcctttcatctactactacaatctcgagaggaacattattacaagagtaacacttcaagtaccaatacttaaacagtttacttatgctagattattttacacattttcaaattttttagagaatgtgacgcttatctaagtgtttactttctcccaaacataactaatcacatttatctatcttcttcttttttttctgtttctctttgttttcttgtgcttctttttaagtttttgtatatttctctgtttagttactagctcaagatacttgatgaagaatgtatttatttgcacacttaaatcaacaagcactcccacacttaaatcatccccattaaaaacaccaaaaaggtttctcctatacaagttcaagatacttgatgaacaatgtatttatttgcacacttcacgaccaaactcctcttcctcccatgacaccaaaaactatggtaattgtagcaacaacagcctgtgaaagtataaagtgttaaaaagtgattaaatcacaagattaatgtattaaacacgattatcttttagtgaaagactcactgcaatggtacaagctacgtatcctggtttctctcgtggatcgatcctagcacatactagaatgaatacgcctacataccatggaattgcaccaaggaggaaaccaatgatgaacctttaccaaaaaaggattgagttttttcagacaaaatgtattgaaacaaagtctaatttgagattgctcgggaaaaacaagaacttacaagaaccaaccgaggccaagaccacaacaaggaagacggttttgtcttgcaggtcttccttgagaaacagggtaacctgcaacatttagttacacatttacttttaactttttgtgtagtactaatgtagaaacagagagagcttcccaacattgaatatagttttaagcttttgcttctggaagagataaactctgatatcatttgttaagaatcttacaactcttgtcaatgagaagtaactttactacagagatcttattttgcgcaattgatccaaactaaagtgaatccagctcagttggtttataaagaaaagaagaggcaactttagtatcaagctcatgcatagtctcagtttcatctttagtaaaccatggagatactatcaaaagggttgacgaaagatgaagcaaaatataaacttttcatttcgaagatcaagattccaggctagctctaacaaaggtctttaaagattcggagagttagttaccagcaacggtttgatgttcttgaatgtattgatgaacggaaatgtcgtgatgaggtgatccgggaggtggagacggctgaggaattccgatgactggatgatgcgacggaggatgaggataggacggtggaggataagtagggacaccttgaaacgtgccgtaagatgaaggagaagctcctctgtttttgtctttttctttgcccattatctctctctctatctctctgtctctctatctcattattgtttaatcagatttaaggttgtggcaaattagacacgtggcagcagacacatggacgagtggttgttgttagaaaagctcatttagattatggtattgttaaattgaagtagttgacacatccatcaatcagcaaaccaaacaaaagttgaacacgcaattactgtcttcatcgaatcttcgtaacaaatcccacatgttcattgttcaatctaatttacacattcttctaacgatcttatcttattaacctagcttgacataatgaattttgcgtgttttgtattaccgcaaaacctttctagtcatgagcttgatagatcaatgtgtcttttggcaatgtagattatctggtaaaaagatcaacaatagcattttagattgaattttttgaacagtacgagtgactttgcatatggactcactcttgcctatgactcaggctgtgaatgtacaaactcgtagttgtagagttgatccgagcttctaccctgaaacaccgaggaaaattaacatagtaaagcaaacagtggaaatgtaaacaattacatcaaccaacagaaacaaaccttaagaagtccacttccattgagtgttcataacatagatagtctttaagcctaaactcatttatcaattttaatctccagtcacaaatgtaacacatcttgctatataacacaatagaatcagaaaaatccgataaacaaagtagaaaaaacatgatgaagaaaagagttagcacactaattaaccaaagactaattatctaaattgatgatgttttggaaaccaattatctaaaactagtttatgattttactttcgttttctaaaccaataaacccccttgaatgatttagaaaaaagaaacatatatacaataataatctttataaattaataaaaaaatttggttatattttgggaccggtataagaaattgacattattgttttaaaagttttatagaaacatatagtccattaataacataaattaataattctataaacttatgaaaatatatatacatttctcgaaatttcttacacataccaattataggtaagaaaacttttttaaaaaaagaccggaaaaaatcccatcttgaagcaaaacatattgtaacttaccaccagggcagagcaggtggtttaatccgacggcgagaagatagaaaaaaaaagtgaaaaaggtcgcaacttgttgtgtctctctttctccaactaccctttcgagcttagctgtccactcttctctcccgatgaaatcttcatctttcgtatctctcctccttctcatgccctaaatttcatctcctctcttgtattgattctgttaaaaatctcacctttcaattcaaaaccccttccatttttgtgattaatatg

SEQ ID NO: 36512 - DNA, 3003 bp, Unknown
  misc_feature (1)..( 3003): 2750-1469P.txt file - cDNA_ID_3097038; gDNA_ID_2936550; Annot_ID_194014
gacgacgtcgtcctcacgactatactggaaatgtttcatactgtcattacggtttgacattagaaaagggctattcttttggttaaagtcatttagcttaaaaacattgtaaccacttcaagttttatttttttcatgttcttttaacgtttttacgcatagattaaaacattacttgaaatgtaaatagatgtatactcgagggataaggaaagataatgaagcgttaatcaacggttttgtaaaatctaactatttatgttgaatggaattgaataaatattccactccaaaattcattaaaaaaaaaagttcacttttcaacatattcatttcaattttaaccctatttttgtggacacgggtagaaaagaagaaaaaatcacttttctaatcatatatctcaatcgttcttagtgtactaatcgtatttgtaccgcggtatttcccaccatattatttgtttaatgttgtagtttttgtagtttatgagttatgaattaataatgttactagatcctactatattatttgggaagtacattttaaatgtaaccttaatttttgtaagtaattacataggtatgccattagaaataaaattttaaagagtaaattaatttatctctttaaggattaaaaagtcaaatactaatttaattaattaaatttaattaaaaaacgaaatacattattaatttccaaaaataataaccaatcaaaatcaacatataagatttgatatctaaattttaattaatttaatttaattagaaaaacgaaatacattattaatttccaaaaaagtaaccaattaaaatcaacaaattatatttgatatctaaattatcatattaattttttattaattattatacttcacttctcatctttatatgattctatttttgcggaaaaataatatcatcattataaaaaaataattagagttttttcccatatgccattatttgaatttttaaaaacaaatataaactgttcaatacataaaaaaatattataacgggtaaaaaatagatttaagaaaattttctactgagtaacgagtcataatttgaaatatttatattcaatttcatacatattatattgaaaatttataatcttatatactacaataattaataacatattagatgtgattcaatttttgatacaagttagaaatcctagaattgcatgtttagatcgatattaatacaaaatggtatactataggtgaaactcttaaattaacaatcaaagtacaagtgtataatcttaaacactaaacaatatagataatatcaacaaaacatatacaactcacagtttactatacatttaaaatcaaataaaataatatcaaatatttttaaatcatctttacaataaaaaaattttagtttaactaaaatatatactgcaggttaatatctagattatagggcttattggatctaaagacggatcatcaaagattttttaaactgaagcaaaatatattgaatattcaaatatctatctgttaccaaattataaacaaataagtcaatttaatattttatatacaaaatcaattaaatcttaatcacataaaaattagcacaaaaaaagtattcatcaattaaaaaattatcaaatctctgtgttatataagttttgatactatattcgaataaagtgtaatataccttttcaatttgtattctttaactaatttaagctaactaatatatttgctaatcttatacctatcaaaactgactatcgtttcttatctctatagtatttttgcaagacttttttggtggatttggataaaagtgcattcgggtcatatgatacattctcctattaaataaatatggtgcactcttatgttattagctaaaatgtttagattctaattcagagtcataccattaataaaattaatattaacaaaataaatagctttttggcaagacggatttggagggacgggtttttgaatcaacattaataaaaaagtaaaatataattaatcgaccgtttcaatacgggttaaatctttaatttattattttttaagaccactaatattaaacatatcaaatcatcctaatttagaaaagattatataaaaccaaaaatgttatgtggtatgtataatgttactatatataaaattaaactatagatataaatgtattagagaatgatacaatttgcaaaacttttctatataaaaaattattcttaaatgttaaaaattactatttaaaaaaaaaaatcatgggacggtaaaaaaattacagaatgagttctattttggaattgggttatatggtggatgtatttgaatcaatatttataaaatttaaaaatattattaatatactgttttaataggggttaaaacttcagttttttaacaattatctcatggattcgtggtataccgttacttaataacaattataaactgtaaaatataaatatttaataaaaataaaatttgcaagttttaatatatattacttttaaaaaataaatcgtcccgcgatataccgcggttaaaatctagtttgatatttatgaagttgtactcaaactcaaaggtcaaaaccaaatgctataatttcatctttgtaatggacctacaaatagaatcataacgaagatcctgactgttgacctaaaccgtggagtccaccagacatatgacttgttgtcggcaacactttggtttttagttaagattaagcccaatagcccaatataagcccattagtgtaggccctattaagtccatctacactcgaaaacttcatcatcatcttcaaggtttaagattggcttcatgaatctccaatcactgttctcagatgattgtttaatcttatctgataaaaatcatttgcttccataattgttactgaatcgtgcagaactgatcaatcacgggtcccaccacattgtttgtttcaagaagctattaacgtcggctgattccaaatg

SEQ ID NO: 36513 - DNA, 3003 bp, Unknown
  misc_feature (1)..( 3003): 2750-1469P.txt file - cDNA_ID_3097088; gDNA_ID_2936551; Annot_ID_194066
ttaattttcctaatattataaacttttattgattttaaatacatcaatcataatattaataataatttaaatgaaaaattatagaaaataaatcgtgattgtcaagttttcacttttgataattttttcttgtaattagtcaattagtgttatattgtggagagttgaatagtctcattttgcaattttagaagatcaagggtatatttccaaaacattgcagttttgaggattcaacttgcaatttacccttttcaaaaatcactttcgacaattaccaaaaaccagttcccccatttcatttcacgctttcttctcttctcatctcagagctccgtgatgaagaaatggttagcaatcgcagcgacggtggcgataattgcaataatcgttagacaaggcacgacacaatacggatggaacaaagaggcggcgttggaaaagctaaaggaatggtcagatcggctggggatttgggcgattccaacgtatgtagcggttcacacaataaccttagctctttgtctccctcacgccgtcttctttgaagctggtgcttctatgctctttggtttccttcctgctcttctctgtgttttctctgctaaagttctcgccgcttctttctccttctggatcggcaggtctgcttctcaattgcactgttatgtgattcaaattgatctgttggatcgttagtttgtgtcgctaatgtacgaatttgatcgaaatgatttggatttagaacaatgattctcacatggcttatcttggcttcgtagaaagtatatgattcattagtaatacactctggtttagtttatgttatcgtgttttgtgaatgcttaaggttttacttggagatggtttagatttttctttagtgcaccattgttgaaaccttttgcagaacgtttattgaaatccattaaattgtaagcatgaatgataggaagggaatgtttgtgtgaagaaatggtgtcattgttggttattcagcggtaagataacaccgttgttcaccaaaaaggcggagaagatgcatgatattttcttgcgagatttagatggatgtcttcagattctataatggtgtttggataagagtggttgttgtcttgtgtatgtgacggagatgtaaagaaccgttagatgcttgtcatttgcttgttaatatatgctagggaatgatttgcaatattcacatttatgctggatttttacatggcttcatagaaactatatgcttcattagtaacactctgatttagtttaagttatcgatttctgagattttacttggagatgtagaataaactcttttgttggttttgattgtcctgctatcgctgaaacctccgtatacagaagttttcacgaaaatccattctactctaagcattataggaagtggatctttgtgtaaagaaatgatgtcattttggctgttcagaggaaaactaacaccgttattcgccaaaaaggcggagaagatgcatgtcttcctattctataatggtgtgtggatgagattggttgttttcttgtgtatgtgatggatatgtatggactaattgttaaatgcatgctgtgattctaattgccaattaatatatgtaggagaatgcaactaggatgttgattaaccttagcaatgtgatatgcagttttatttatttatctatctattgggagcacttgcattctctcatacttttttgaattttcaggtttgtttttaagagttccaccagagctacagggtgggcgcatagcaacaagtacttcaatattctctcaagaggagttgagcgcgatggttggaagtttgttcttcttgcaaggttctcgcccattccttcctatgtcataaactacgctttggcagctactgaagtccggtttgtagctgattttctgttccccacggttattggctgcctcccgatgatcctgcagaacgcatcagtcggtagcctcgctggtatggctgtggcttcagtagctggaaaacagaaaagtcaggtctggggttatgttttcccagtacttgggatactgtcaagtgttctgatttcattgaggatcaaaaagtactcagctggaattacagaggcatcatcagatacctctgctaacaactctagtttagcttcatctgaaactgcgaatcccgcttatggaaccgatggatccaagaaaagtgagtgattatacaaaccatgatggtggtttttgatcgccggtattacactttgtttggtttgcagctatcagattctcaacatcatggcttattttggacgagttaggcagtatcttaatagtaacaaagcattagtttttgtacttcttaagttaaaagcttagaacaaaacaacagtgttattttctataccagacacaaaaactgtgtcgttgtaataacacttaccataacattttctttcagtgtatgtttaaagccgtttatatggttgaagcaatgtgactaaaatttttgtagcattgaaacaagctatatttgcattgctatggtcttgttttgtgactaaaagacttggatgcagaatggatataagttaaatgtctgattttgtaaataacttatgaagagaaaatctttattcggtaagagttgttttctcaatgtagcagttcactcatcattttcaaacttcaactctcagagaacacaaagaggttagacagtgcagatgcttatggttgagaagctttacctaacaatggtacaaggcggttttgttgggatcacatgtgaagttaggcacatggattcgttcttggagttggtacaaggacttctaaaagacaacaatgaggtataataaggacaagttgactatgtctctctcttttatcttaacattctaaattaggatttggtaaactgagagcagttagcttcttgaatctctaaagtataaaaaccctcaccgttttactactatctcatcttaaaactcccaagtaacaaaaatg

SEQ ID NO: 36514 - DNA, 3003 bp, Unknown; identical to SEQ ID NO: 36513
  misc_feature (1)..( 3003): 2750-1469P.txt file - cDNA_ID_3097088; gDNA_ID_2926302; Annot_ID_205736

SEQ ID NO: 36515 - DNA, 3000 bp, Unknown
  misc_feature (1)..( 3000): 2750-1469P.txt file - cDNA_ID_3097096; gDNA_ID_2936551; Annot_ID_194062
ttttctttccttacaagctggtttttagtttgttaaagaaaagacaactttcatatatggtcatgttcgtttgctcatctcactgatgcaactagccgtagatgcaaattgatgttcgtttcagtacaattttgcatataagttgggtggagtatccagatgcgtttctcagactcatccaaaaaatgtctattttataagatgcattcagatgattttagatgatgcatagtaaaaaattgtaaattactaaaatacccttattaaactaaaaaattacatcataaatcaaataatgttaattattttctagttttttcattttatattttaaaacctctaaaaattgtaaaatcacaaataccaaatttaaacaaaaccgacaattataattttggcggaaaaattacggaattacgtttttccgccaaaaccataaaattatattttcccgtcaaactataaaatcataatttagtgggaaaattacggaatttcgtttttccgccttaaaatgtaaaatcatattttctcgccaaaactataaaatcacgaattagcgggaaatttacataattgcgttttcccgccaaaaccataaaatcatattttctcgccaaaactataaaatcacggtttagcgggaaattgcggaattgcgttttttccgccaaaaccgtgaaatcatatttttccgccaaaactataaaatcactgtttagcgggaaaattgaaaatttttgttttcccgccaaaaccgtaaaatcatattttcccgccagaactataaaatcatggtttagcgggaaaattacagaattttgttttcccgccaaaagcgtaaaaatcatatttttcgccaaaacaataaaatcgcaaattagcgagaaatttgcggaattacattttcccgccaaaaccgtataatcatattttccctccaaaactataaaatcatgattctgcgggaaaatggtggacttacgtgttctcgccaaaaacgtaaaatcatataaaatcactattttaacgaaaaagttgcataattgcgttttcccgccaaaaccaaaaaatttgagaatgacattttcttccaaagttataaaattgcattttttcatcaaaactataatattttctttccgaaactaaaaagtatgatttaaatgaagatatgtcatttttagtcattttaatacaacatgcatttagatacagatacaaattgtaataaactaatcaaacgaacaaagattcatttagatgcttcatctagatggactaccggattaggaaacaaagaacactcaaatgcatcatttaggtggatcatctggatgcattatccaggtgtacaaacgaacatggcctataacctgaggactcgatctcttcaatggaaagcgacaatgagccaatcttcttttaagctgcacaatagtgatgagtgttatataaaaaaaggaaaggcatcggtcttgtgaaaatgagtttttaaccgagccagccaccaatgaataagaaaaaaataggaatatgatttgtaaatatcttttttaaaaaattaatttttctcaatgggcattacaatattaggtttatacaggctaatcggtataaaaagagaaaggaaaatttagtcaacacaagcacaaaaatctgaaaaagtctgttaattctgcaacaccggctccacctccaactccggcgatagcaataggccttcgttgctgctcctacacgactcgagcgacatgaccaaagttatcgattctcgccactaacccgaagccaacatcagagccgacctgaaaattctcacaataaacaatagacccgcttaaccagtccccacccaagtaaccgaaaacctaaatcgaactctcacctccatcgccgaaaccagcacaagtttcctctatgaccgccacaacctcaaatccggtcacacgaaaacaatgattagagcggttgactcaaataaaatcctaaccgcctctgcacacctagccacctcagatccgacaaatctggcgctaatcgtctcgactcgtagtgaaccccaccaacccgtctttgacttccgccgccagttgcaacagcccttccgacaagtgagctgacaactttctttagtccctcttttggtgtctttaaatcagtggtacgactagaaggatgcgtaaagtcgtcgggaagttcaccacaactcgcattagaaggcggaacaaccgcacctcattatcgtcagagaaacaagaccgtcaccaaccgatataaccgtttgccccaccattaacgttgaaaatctgaacaaaaaataaaataaaataaaataaaactttttttagaactatctttgaaaaaagaaaaaaataatcaatggaacgattgttcaaaattgaatctctaaattggtaaatactaaatatctttttggaaaatgtcaacaatttgatgcgccaacgtgaatattgaggataaattataatttgtgtagactccatagtatgcatattaatttattttttgtgtatatgatcgatcaaattgtaacatataatttattacttcagtcacaagaacactattccgatcttttcgaagaaataaaattttatttttctgtttcataatttaaattgttttagttaaaaaacacacagataaaaaaatttacttttaaaaaatcaaccaatcataaaaaaaattatatgatataaatatttagaatatattaaaataatatatagtttgcataaaaatttagaaacaaatttatattgtaaaataaaataattaattcaaaacaatttataatataaaacgaaaggagtattatttatatttatagtcaccacaaagcaaaacacttttttattacactgtcataatttttatttttttttacataaaaaaattaaattcgttatactgataagaaaattgatgatatgaatatgagagtgtggcggacgattggcttgacaagatacaatg

SEQ ID NO: 36516 - DNA, 3000 bp, Unknown; identical to SEQ ID NO: 36515
  misc_feature (1)..( 3000): 2750-1469P.txt file - cDNA_ID_3097096; gDNA_ID_2926302; Annot_ID_205732

SEQ ID NO: 36517 - DNA, 3003 bp, Unknown
  misc_feature (1)..( 3003): 2750-1469P.txt file - cDNA_ID_3097100; gDNA_ID_2936551; Annot_ID_194060
ccagtcccgtgaaattaaacataattttgtcattttcttataaatttcaatattataaaatttgaaacttaaaaaaaatacaatatcgaccttgattatatttaagatttttcatgtaatatatcgtctcgtattaatatattttatatatatttataatgtttaaatttcttgtaaaattcaatttataatttttaaaactttataagttttaaaattataaatattttaaagcattttttaaaattataatatttaaattttgataaagttataatatttataatttcttgaaacattttaaagtttcaattctttaaaataaaaaaacccgagtaaatcggataactattttaattttggacgcctgataaatcaagcttcctgctcattcgtaatcagaatcattttggtccttttataatatggatctgaaccattatccaatttttctaagcgatgtgggacattgtacacatattatttcttcataggttgaataatatatgcccgttttaaaaaaattgaattacatcatatgcagaaaaaatataatattttattaactatatatattttatataaattcaaaataaataaagtataagatcaaataaaagtgaaagaagaattatatatttatgtttaaattaggtagaaatattttaggaaattagttaaggtaaataacaaatatggttagtttagagatattgtttatattaaatttggtaattaaatcattaattttcgttttaaattattaggttttaggtaacttttccaaaaattaatgttatctaagatgagaacagaattaaacatgttatccaagatccgaacagagttaaaccgggtaaaacccacccatttgaattaattgttaaattatggctcaaatctttaacattatcttcaaaaaacgtctacaaaaatgtatatatagattattttaaagaagatttttgatcctattgctagttatctaagtttattacctttttagaaatttcacgaaatcttattataaccattttggaagttttaaaaaccatgttgattgataggtgatatatgaacaatctatcatctttatgtttaaagagatagaaagagaaaacttttgagttgagaataaagtaaaagctataaggatttttattgtatttcaggttggggaagatctcaaaaaagattggcaactattcaaattgatcagatgcatggagactaactcatagacgggacatgtaaccaaactgaggcagcggttctaacattgagtattgatagatgagttggaaccatagggaaaagaatgtgggacgttcaaaaatttcatggaagaaaatgtgcatgtacaatactagaactagcgtatatacctctcgagtgtctgtgcatattctcatatccctgaccctcgaaacccggggaagaaaggtgtggattgtacttctccttgcttcataaaaactaccaagccaaattatagagaaatatataatttggtgttagactcgagattgtttactataaagctttttgatacacgatcattgactctacaaaaacaaaaacaaagtagaggagcatcaatcacaatccccatgacaaatacaaacgcgaaagaaggcttttgtattagtgtgagcctttttcatgaccgagagtgcatgcacctgatagacttttgcatcattccaaagttacaacaatatttaacacttccaaaactggacaacatgagacaagtgtgtagatagtagattcatcaggatacgaattgttgtgtaaatgcgtagtcttcaaacaaggtaatgaaacaaacttaggattaaccaaggccaaccaagagagttttaagtataccagtgtcgcacagacgtaaaacctttggggcatcttataataagaagtcatttgaggacacaaaacaacatctagatgttggacgcttaaccgcaacatcaatccacaacgttagataagaccattatctacactatacttttataataagaaaatttcactcaagtctaaccaaaaaaatcatatttttagttctttttagggttttgtgcaaaaaaaactcaaagtcgcccatttttgcaactatatcctccacgtccaaaaatataaaataatcctatgaagtccaaaacaatacgtaatataaccctttttgcaattttacatatattgtaaacgttttcacgatcatatacatttgtttaaaatatataattgaactcctcatctcgaaagctttgatttgatatattatttatcaaaattttaaaattttgacaataacgaaaaaatggttattttgcttattattttggatttcatcggattattttgcatttttggatgtaaaaggtaaagttgcaaaaatggacgactatgagtttttttttgcacaaaccccttctttttattggttttaggtatttcccgctattcgtttaattatttaattatgtagtttctctcaaaattttgttaatggtataactatttgatacaaagataaaataaaaatcaaactcaaatagaattattattattttttgttgctagaaaagacaaaacaaaaactatttgacatgttatgcaatttatacaagttatgaaatgttattttttgtcggtcaaatttttattaatttagcatgttgacccaaaaaaaactctttgacatcctatagcaatgtcaaactaaaataaaattgcataactttcagaagtatattattttggcttaaaacattaaacaggaataaaatttgataaaatatgtctatgggccataaaactattataagagataattgcgttgatttaaacacttgggccgaattagtgaaagcccatacgatgcatatgccaaattggcgccaatatttcccgcctaatcgacgagagaacccaataaacgagtgtattgtgccctgattctgtcgccggaaacaatacacagatagagcgagagaaatg

SEQ ID NO: 36518 - DNA, 3003 bp, Unknown
  misc_feature (1)..( 3003): 2750-1469P.txt file - cDNA_ID_3097143; gDNA_ID_2936551; Annot_ID_194052
gcatctttactaattgagctaatgagacttggttaattatctttctaattttatttttatttttgttttttgcaaaatctttgacccattaacaaaagaaattgatagatactagtatactcaactaatgccataaaaaaaaaatcattgcaatttgtatatatacaaacaagttgtaaattgaccatgcctatatgttttctttgccgtcatttgattgtcttcgagcagataaatatcactgaaaaaaacttactaaaaatactgtaattagaaatttgggtctgagtttctgacatgggcttgtggttatagttggtcccatgaaaagtgccttacattcatttttctttcacctttcacatgacatattctccggatcgagacgagttttttcttttcaggggatatcttaatgatctcccaaaacacataacatggcattatttttctcaatgatttatgtttaaaagttttagagaacattcatagaacaatatttataattttgattcggaaaaggaaaaccaaacactttttggtgttatgtagctaaatacaaaagacaaagaaacttggtgttgctaaatcactaggcagtatttgaaatagatccaacattggtcgtgaaatcatgatctcaattatatgtttatgttgtctcattataacgaatattaaatcgtgtaatgttaattgatttgtcatttgtcaattatactaagattgcgatttcacgatggctagacaatccattatacgcctattttagttattgtaagtattttatggttccaatatgcgaaccgggggttgttaattgtttaacatactcggactaatgaactctataaattcttttttcctatactaattactttagcggtttagcctagtaaatacatacacgaacttttcaaaatgaccataagctaaatgctactagtctatctcattatcgacttagcaggagaaagcaatcttaattttcctctcttcctgtttgtttctcataattagggtttcgttttgcggacactttacctctaaaatggcttatagcatctccaaccctactctattttagagtcaaaatgcaaaattcttctccaaccctactctataattgactcaaaaatagagatttctacagattgactctatatatagaacaactctatcctcaactctatttttgagttcaatttttttatttatactttagtccctcaaatttaaactttttttatttaatgcatataatcattttacaaacaacaattacaacacatagttttataaacttaacaaacaaacaaatactaattttaatagttttataaacttaacaagaagcaaacaagtactaaatttaaaataaacaacataaaaaactaaaacaaatattctaatggtgttaaccgtgttatttataataaatattctaatggtgttaattaaaataaaatttgtaatgttttattatttttatatgatgtaatgatttttaataaataataagtgtttaatttaaataatttcatattttatacgaattttgcaaatctataatatatggggtcaaattttaaattatataattaaaaagtattagtatataaaatagaaatagaatatttctaagaatattcttttttagagtagaaaatagagatatacattggagaaaaactcatctctaaaattgagttactctattttagaacaagatatagagctatacattggagatggtcttaatacatagtcaaaattgattacttatttgatgaaaaaatatggatttcttattttattttctcataccagtgattgttttgttgtattggggctgaaaagtgttctttcagcacatcagagaaaaaagttaagaatagtgtgttaagcagtaaccatactctttaaagccgtagattaattattcaagaaattaaaacaactaattaaacaaaaatcctagcaaaatctatttgaatgaaccatatccaaatccacaaagtcagtcccccaaatgttgaaacacgtaaattaaacacacaacaacaaaaatataattaattaaacataactaatgatttttataatttacacaaaaatcaatcaatatttttttaactattttatattcatttctaactacttttatatttatatgttattagaaaatattaatatatatatattttttatcaaccacacatatattaaaatataactctatgatcggctgcccaatttagaggagaagagtttacaaaaataacatcagacaacaataaacgagaaaaacaggttaaacaatatgctttagaattacataaacggtaaaaataagaaatcgaaccaagcgtcgttagctcaattggtaaagaccctagacgaaccttagaggtcgccgattcgagtgacgtttgggacgaaactaatattacatgctgtggtttcgggtctgagagattacgggattcggtccagaacctcctaatatttataaaaaaaaaaatttttaaaataagaaattaaagctcggaacattcaaactcgtctaataggttggagaaagctggtcaatcatcaggcgaatacgccaccgagactaaactctacacaatcagtttcaaatatctacaatcaatccttcttgtaaagatatttttcgtagcccaaatttatgatgacttttttttatttgtggtgcaccatttatgacaacttaaaacagtttaattttaaattaaaaatttgtattttcttatgacctgtggttatatgttgggccttttaggcatttgcaagttaagtatggtcgtggattgaaaagcccaatgtgtaatcctctagtttactaagaaggtttaatgtttttcaatccagtactgcaaaatctgcaaaacctaaactttcgtcttctcaacaaaatctgcagttccttgctcctttctcagtccaaattctctgatttttgattttttcgattcaatg

SEQ ID NO: 36519 - DNA, 3003 bp, Unknown
  misc_feature (1)..( 3003): 2750-1469P.txt file - cDNA_ID_3097154; gDNA_ID_2936551; Annot_ID_194050
aaattaactgaaccataagaagacaatttcaagacaaaattaaagaagaagaagttatagatagcaattttacccaaaaaaaaaaaaaaaagagttatagattagcaaacaaaatttggttgggcctgactttaatacacaaaagcccaaactcttaaacccaactgttgttctgttcttcaccttcttcccatctagggttattacgtaacttctctgttctctctcactctctctgttcttcatcacaccgagaattcgaaaattccgatgaacaagaaacttctcaaccctcttgaagatccaccaaccgcttcttcaagcgaagacgtcgacgaagagatttcatcaggagaagatgaaaaagaacatatctccaattcttcttcttctgaagaagaaaacgaactcaaagatctctccactcaaaccctaaattctccttccaccgaggctccaactctcgattctggatctgagacaaattccgactcagataagccaatcgtcttaaccagtcagaagaagaaagaaggtactgattcatcagggacgaagcgagctagtgaaggaactagctcaaaggacatcaaaagagctaagaaagtttcaggagatgacgataacaaaaaatttcagagtttatggactaaagaagatgagatctctctgttacaaggtatgattgatttcaaagctgagacaggtacaagtgctcatgatgatatgaatgggttttttgatattgctaagagatacataagctttgatgttagtaagatccaattcggtgacaagattagaggtttaaagaagaagtattttggtgtaaggaagaagaaaggtttagacttggatcatgataagaaatgtttgggattggctaagtctatttggggacttgatggtaaggaagtggtggttcttggaggagattcggagacgtcgaattggtttgagaagtcgtttttggttcgggttgttgcgaggcttggtgtggatgagtgtattgtgaagtggaaatggagtaaggtgtctaaggagactaagaagaggattgaagagaagatgaagatggtggaggctaaggaacttgagttgttgtcgcagaagatagatgttttgaaggaggtggcttctgtgattgctgaaactatctaagaagaaggacttggattgtttaggtttaatggagatgtaatgcctcttttgttatttatcgtaggatatatgtttctcatctatgtttctggttcttattagtcttctttttttgtttcttgtgtgagaattagctaaggaacttaagaactttggactttgtaagccttttggtcgatggttgtaatgaacttaagactttgtaagctatggctccgactggtaaaaggtgttttcaaggttgaattgcagtcgaagttataatttgatgtaaatattatgtggtataaactgcagtttgatattgccctattcttttcgttatcgttgcgtcagcggtccgcggccgaaaattataacttatttgcatgtaatgtatatggaaactaacataatcgttcttgtgaaaagagccgcaacgtctataatgtatatgttagacttttgtccggtgacattttatctttttgacaacgtaagactggccctcgttctgacactgcccatttctctttacggtggtggtcggcttgcgtctagatttcggtggcttctatagcaatggtgggctagctaagatctagagtttcaccgcttatcttcggtgtctcttttatttttggccggattgtttttcggtttagatttatgctttttccctcgatttctttatattcgatgtgattggactcttttgcgtttcaatttttacatttagaattgtaattccttaaccctcttttgtttaaaagctctagcggtttccggtagttttgaaggttccttaggtcgctttctacatcgacgatgaccggcgtcgacatttgattcatctacccacgtgtctcaacattggttaatagcctcacacgtgtctcttagtctctgcattggattttttcagcttatttcctcaaagagtaatagttttctggattgggatttctttactttgggcctaagtttatcagatggacttgatggtatcttttaggcaatattggatgattatattgtttagaaatagttcaatattgtgaagttaatgtgtcaagccctgttggacctcctagcgcaagatatgaggtgagccattcatcccttataacacttcaggcaatctacctagctaaaaaattggcttttggtgaagagaggttgaaaattacttccgccaattttttttttccggccaaataaattcccgccaaaacttgtatttaaaattttttgtaatttttgaaaaaactcttaaaagtccttgtatagttttttcaaagcattttaaaagctttgtaaagttgttaaaaacacttgtaaatcattttaaaatctattaaaatcattataaagtctttcaatacacatgtaaatactttcaaaccccttttaaatctttcaaaaaatccttgtaaatattttttaaaagggaaaaaacctaaaaaaaactcaactaatttttatttgaatatttaatatctaattatttttgattaaaaaaatacacgaaataataaaactgtgcaatttaatacccaaataattaaatgctttttttttgttttttaattaaaaataacaatatttaattttttaaattttaaattacataattttattatttcgtgtatttttcttttaaccaaaataattggatattaaaaattcaaataaaaattagttttttccgttagactgtaattaaaaaaatattcattcctcaaacatgttacttcatgttttaattcattttaaatacatttatattacaaattaaaactttcagaaaaaaatttgaactttggtgtcacagaaaaaaaaacctttcaacttccttccatg

SEQ ID NO: 36520 - DNA, 3000 bp, Unknown
  misc_feature (1)..( 3000): 2750-1469P.txt file - cDNA_ID_3097162; gDNA_ID_2936551; Annot_ID_194048
gaagggagcatatctgaaaatctaacaaatgttgttcgtccgaatcatatctagtaagcaaaaaagtaatacatctatgaatagttgattatgtgactaaaactaaaaccaaaagatcaaagtgactaaaataaataaatgaaacacaaatgttttactgaattatttacacaaattatgaaattataagggagcatatatgcaaatctaatgaatttttgtcgtcgtattcgtatctaatatcttatgaataatttaagtgactaaaactaaacccaaaagatcaaagtgactcaaagaaataaattaaaaaatcatccaagggaacaatgattaaacccctttatcatttagacagtatggaatccactcctcgcaccaccaccgaacgaactcttccattttgtcttttgcttaacctaaaagaaaaaaaattatagttgccaaatcaataatatctaactatgaatatatctaacaaaattaatttctttttttttgcagttagctagccttctaaagacattttggatcacatatacacgttttctcccgaatataaaaggataatttttgattattggttatttatgtcaattcaaatactttctttaaatggttaaaaagagattttaggaaaataaaagttggaataacaaaccaaagtgaatgtgagaatgaaaaggaaattaattgcgtcacggagaagcactaagactataaagcatttggtggtcaatgtgtcaaaaccccacttcaatattaaacatatttaaaagggcaaaataacaacaaaacacatttccataaattcaaataaaatttggaaaacaaatttaaaattgaaaattaaatggcattgtattattgtttagcaagagatccacttgagttaaacacttcccctctctctctttcttctccctctttaatttaaatttttattctatttcgtaaccattcatttatagaagaagagtctatctaattcttaaacatgcatgactatacatatgataaatctaagttgaattggagacacattaatcaatgattaactactttaacgtctaaacctctttttttgtatgtaggcaacattattcatctatatcatttagttctagcaaaacattagggattctaattcacacgaggtagatgtatggtcgtgtacttgtatttaacaaacaaatcataatagtataagattataaagggttggtataattttgtcttcaatgaataggggaatctccttttatctattttattctaaaaaaactattgaacgttacgaattggacatgcattaatacgcattttgcgtctaaagatgtgatatttaatctagtcggattaagacaactaattatagtacacatatcaaaatcctaattgctttagggtttgacttacgcggcttacctttgtgtagagatatttatgattgttgtacctatttattaacttgaaaggaaatatacgagaccgttaggattaggaaaattaatactagtacctagcaaacttctaatttcttggcacctgacttaggcatcatacttttgtgtgtgtttatacgtaatgttaatgtcatgtctataaacctgaaaaaaatacgtatacgataatacgaatacgaaatactttcttgttttcttttccaattaggtcattttcttttcattttaaccacgagtgattccataaattttcgtggccggcggaaaaagttgcatgtccacgaatgaaagtaaaacacatccaaagtaaatttgtagtcagtcggtagctaactaaccacaaatagatttgtagtcattgtgttgctaactagtcacaaattttgctctgacctatctatcattcaatgatatataatgtcatatttaaagttgtgataaatttacggccatccatgattctacaaaaaaaagtattttccaaaaattccaaattttaacgagttattatgtagaaattatttggcccttgaaccatatatatatacatatattcatttggccttcaaagccccataaatcttagaaccagctctttaactacaaaatattgtttcccgatcttccgccaaagtcatagacaagtctggtttccaccacaatcgacccatgatgatgtgcatgtgatagtaaaccaaatattcatgtaatttataaaaactcgatgatctgcaaaatatgcaaccattcttcgagttttgcttatagcattagttatttttatttggtatgatttaaattacacgcttatgttagaaaacatcctgactccgtaaagaactgagaaaatgagaagtaacttgtttctgaaaaaaaagatcagaaattaattatatattaatgtggagagagttacaaatatattcttgtactatattgtaaaaagttacaaatgtgtatgcacacacaatcaccttaccacctactacttgatatcatacaaaactatgtgatatatcaactttaatataatgcgaacacgtgttacgcattgaaataaaagaatcacaccatgtatgtatacaagatttgcaattttgattatatttctctactttgaaatcgtctaaagggaaaagaaaaagctaataacaaattccaaaatgaattcttatataaatgatatgctgacatgcatatgtaaaagtaaataactatgtaagacatatttttctgttaacttattcatatctctaaagtgtaaacactagttcattaaaatattccaaaagatacgtagacgtattattgagttaacaaaataatgagtgtattttttttattctaacttttgctcgactataaaaaggagtcatctcccattaggttttgcctgcctcaaacaaatagagcttatctcatcactcaccaaacaactctcatcaatataaagagaagagagtggtagagttatatattacacacataaacttagatatagtagtgttatattcttgattaagtaataaagatg

SEQ ID NO: 36521 - DNA, 3000 bp, Unknown
  misc_feature (1)..( 3000): 2750-1469P.txt file - cDNA_ID_3097167; gDNA_ID_2936551; Annot_ID_194047
attaggcccaagatgacactagcaatattctggaggcttcttgctcttggaatattagagtaagtctctttcattagaaaaccatcttttctgctttacaattagaaagttcggttcatacaacttttaaaggttttcgtaatatttatcaaacaaaaaaatttggatatagtaaggctttgtatatagaaaacattgttttcgtacatgaagaaatcttataactaattaataataaatacggtgtaaaaatcaaaagttactttttatagttgtgatggcaaattcatgtgttcgggtacgttactttatcatgctaattcgggtacgttacttatggagatggaatacatactcacatatcgtacccaaaaaaaaactaaactcatataaaatatgattttggtttaggtattcgtcagtcataattagagttatagtcagagattgtttaacgtttaaacaattctactattacgataaacatataccaaaattcgtctagagttgaacatacaaaatagatttttttttcttgtttgaaaaattgatttacaagtaaaatatataattatctattatcacatagtatttattttgattaaaaaatttaccgtgaaaatgtagaaacaaatgaatgaaattggtaatatagtattgattattgattgggaatgagatcagcacccacaacaaacatctttaatgtgaatgtttggcctacatgttatcctacgtacacgtttaccttttgatctttggaaaaagcatctacttattattgcacaaacaaaaagatgatgtgaaaaggctatgtaattaaaaaaacaacaataataatttgtatttatttgtgaatgatttcaggcccctcatggaccagaatttgtactacataggattgaaaaacacatcagcatcgtacacttctgcctttaccaatgcacttcccgccgtcaccttcattctcgccctcattttcaggtacttactttcactcaaaaacattttcttctaatgacttacttaatcataatattgctagacattagtaaattattaaccagattatttaagactttctagacatgaattgccatttaatccccgagtaatttatattattttcaaatgtttatacgtagttatttaaaatgattagttggccaaaacattactattagtgaaccaaccaatttagtagttgttctaacacaacttctcatattatttaggcttgagacggtgaactttagaaaggtccacagtgttgcaaaagtggtaggaacggtaataacggttggaggagcaatgatcatgactttgtacaaaggtccggccattgagattgtgaaggccgcacataattctttccacggtggttcgagcagcacacccaccggccaacattgggtccttggaaccatagccattatgggcagtatctctacatgggctgctttcttcattttacaggtaattaatcaatcataaattttttacattttgagaaaaattatattgataaattagaaaaccattttttgcagtcatacacattaaaagtctatccagctgagctatcactagtaacgttgatatgtgggatagggacgatcctaaacgctattgcttcgctaataatggttcgtgacccgagtgcatggaaaatcggcatggattcagggacactcgccgcggtttactctgtaagttaatcatctatactaatcaagttaataaacactaacactaattaatgtgttcactgaaacttattatgttgtatatttttagggagtggtttgttcgggaatagcttattacatacaaagcattgtgattaagcaacgtggaccggtttttacgacgtcgtttagtcctatgtgtatgatcatcactgccttcctcggtgcattggttttggctgagaaaatccatctcggaaggtagtaaaagtcacattaaccaaatcttcataattcaagattaaattaagtgatacattactaacgttttgaatggtataatattgtaaatttcagcataatcggggcggttttcatagtgcttggactatacagtgtggtatggggtaaaagtaaagacgaagtgaatcctttggatgagaaaatcgtagccaagtcccaagagcttccgattactaacgtagtcaaacaaacgaacggtcacgatgtctcgggagcaccgactaacggtgtggttaccagtacctgatccaagtcccaaaagagaagaaagatacttaaacaaagatctcatctccatgcattggaggtggaagttttgattatctttcttgttgtttttgtgttttttcttttacattttctaatcgatctacgcttaacttttagtatctttttaccttatgtaatgattttctgcttctactttcttgtatttgaaatttccaaaacgaatgatgaatgcatcatttggtaaaatttgagcctacttaacaaaaaaaagggtaactcttataactccaagaaactatggtcgaaatttggatgttatacataataaagaggttagtttttgttgtgtataacttgctaaaataagaaacatgtactaattgtgtaacgtatctcttaaaattacgcctacgaaaacaaacaacaaatagtcaaaatacaattaatccaagaatcttagggtctaaatttggatattacacaaaataaaagggttttatatttgttttgtaacttgttaaaacaagaaacatatattaattgggtcacttgtctttgtcgtatcctaatgatggatctcactttctctcaccatggtcaaatttataatctcaaaagtttagggtcaaaatttagatgctaaacaaaatagagggatttgttctataactcgttaaagtaatgacacgtgagaaacatgtggtaattggttcatttatccttctttctttcttctccaatcggatctctcactttctctacatcaccggtaaaaatg

SEQ ID NO: 36522 - DNA, 3000 bp, Unknown
  misc_feature (1)..( 3000): 2750-1469P.txt file - cDNA_ID_3097175; gDNA_ID_2936551; Annot_ID_194045
ctagattcacagcttcttttcgatttatccgaaaagaacaaaacccaatttttaagagatgcattttgcatcccccaattgaatctgttatcactatcaatcaactctcttctttatcatatttgatcacatcattgagtgggtatcaaaaacattcagtgattcggcataagattcctcaagttgtaaccagagtctgggattcccacttagttatcactatagttaaaagtttgacatattacctgcttaatattcatcctaatcttgaaaggctaaaagaacaaaatggttaaatcattcgctttcttctccaccaatcactgagtcagagataatcgttaattcaatcgctttcttctccaccatcatcctcttctgcaaagaaagtcaaggatcatcagtttcaaaatttgacccgttggtcatttagatgtgagatatagattctcaccgctgtttgattcttcttctacttcttcgctttggcttcctctctcagctttttcattactttcctcttcattctcagaatcttccggttcatcactctcgctctcgctttccgctgttactttcggttttggaggaggcgcgaaacttgtggaggatcttctccttgagttccatacaatgttgtttgtatcaataccctcaagctctcttgatatattcttcctcttttttacttctttgatctctgtcagagtaaagccagatagtttgttcatagtatgttcatcacacatttaccagatagaaaacaaacatcagcatgcttattcgggttaacatattcagaagttgaattaagaatcattcagaaaaaaactactgaactctaaagatggaagatataagtttctctccacgcaaaagaaatcaattctgagcgaaacactacctagcgctgaaggatctgaagacagcccttctttggcaagtatctgctcaagttcttctattagcatagcctcacgtttctcttgaggagcctgtttggctttcttgtaaatgtttggaggaacactgccacgaaaaaataataaaacaataaaatgcatggaatatgaacaaatacagaacttcttaaagatataccaagtttggtagaaacctcatcccacaagatttgatgactgatttgagatgctcaacacgctttccatacacatcagttgcagtctccttagtctgctgttgtataacataaaagcagaaacacattagttttaatggaaattgagataaaaatcacaaccaagatgttataccttcaaagatttttcactatcccctgaatcactgtcattctctgaatctatttctgtatgttttgctttctttcttccagatacttgtttaccattttcacttttccgttttcccatcatctctggttttgataatttaacttttcgggccattgtcttctttacagctacctcctcgttgtccacattcccctcagtatctgaatcagaattgtattcactgcttaccatcttagatggtgtgctcttgacctttttcttcacatttttcacaatagactcagtcgaacatttaggagcatcaggaagttgtagtacctaattagccaataaaagtatcaaaaaaacttgaatctcacttatactcaagagattacataaccaacttaaagtactcacttcatccaattctttgttaatgaacttcttaaatagatcaagagactccttctctaatttaagatcttcctctagaagtcgacgaagtgaagccattgtaattgtcctgaaaaataaagcaagccattactaaacagaaaagtttatttctcaagtcatgaaagaggaaacttcagaacttcatttattaacttactctgaattagccttaatatatgaagctctcttccgaagggctctctttatatccctctgcagggtttctttatttcccttgcccttcacatctttagcttcccttttcgatgtgttctcttcaccagcatcgttcattggctcgtgctcttcagattgttctgctacttctttagttggaatctcatcgtcttccctctcagtttcttgagaattctccgaagtatcattattcccagcttcttctaaacactgacatcaaaaaggaaacaacggtgctttcaaaaaggaaacataccagaagaattattatcttgcttcaaccatgaaaacacaaagataccttaaccaaatgctctttaacaaagctcttatacacatccaaatcacatttctccaatccaatatcttcctctaacatcctcctcacactcaccaaggtgaagcagctgtgaaatcaaaactacaaatcattccactattcataaatcttctgacgaaatgctttatacagatacatcactgaaatcaaaaccctaatccaaatcagaaatgtatatcaccaatgcctttaaaacaatcaaacgtacacaatatcacacagagaatttacgatgttagggtttagagaaagaggttgagagacaaagatttctactctgcttcatttctgaggtaggttacgcgtgatcgcaaagccgccagaatcttgaactcgatctccgttgcatcaacgttcttcaaattactcttaccggaattatgattcatctccgccgtctccatcgccgtaaccgccgagtcaccagatatttctcactctgaaagtgtgagtgaaaataaataatattctcgttaatgtaaaacctcagcgagaaaggaaaacgccaagatgtttctaaaagtaaaaccaaaacggtaagcagtctataaaatggtagaattctgaaatacgttagtagagaaggacgtatttggtaataaaacaaaaaattatattttaatgattaatatataaagcttgcttgtcgtttctaaacacgcaaacgacaagtagtttcctttagaatttatcattatccagattttcgagaaggagacggtgaagaagaagaagaagatcaaaaccatg

SEQ ID NO: 36523 - DNA, 3000 bp, Unknown
  misc_feature (1)..( 3000): 2750-1469P.txt file - cDNA_ID_3097178; gDNA_ID_2936551; Annot_ID_194044
atgggttagtacttaatatcatagaagtctgcgtgtttgaattggatttattatttgaccatctaattggtcaacatgtttgaaatattacattattcgagtacctttaatgttgtcctattttagtcataaaatatgcaactctcttcatgaattggttacaataaaataagtttgtatttgcatggcttgttaaaatcatgattttatcaaacgaaacttattagctactcatatttatacatacatggaggctcttggttggtgcactaaattaaggttatgaaatgtactaatgttgagcccttcgatcttatttgtgtgtgattagcttgttgaaacactagatatatgaggacaaaacaaaaaagcaaaaaagtccaaaggaaaaatacaagtgttggacgatgaaaggggagaagaggacacgagatatgaaagcaaaatgtgaatgaggtaatctgacacatatatgaaacccataaatttacgtacgtataaagtaaccgatatacgtttaatggggttagagataagatcctttcttctcattttctggaccaccctatataatatgacttacgtgtattgatgtattgtcattgatgtatgatttgatatgttaacaaatttccaatttatataattcaactttgcatgaacaaacccgtgttctttataaataaaacaaaactaaagctcgtgttggttcactttttgagtggcattgtggcaacatccaaacctaccggtcaacaacatataacgagtggaaaaatcggatacaagttcgtgtgatactagtgtggttcgtttcaaccccaaatggccaaatcaatcaatgtaaacatattaagacatagaagaaaataattaatgagatttcacaatgtagatattttctctattccactttcaaaactcaaaaacaagagatatgaccattctttatctaaaaactaatatggttgggaggttctctttgaaaattttggaggctaaattaaatataataatttgatgatttaattaagcatataaaaatttgaaactatatggttagggtgcatatatatatatatttctttctatttgggcaaccggatgcataaatttctaaaatgttactagatcatagagaaaactatgaaagatgaagcaagagctaaggtaagcaaaattaataaaactatcataagtcagcatggaaattagatcaccatgattgatttgaatgacgatatgcttcaccagcaccatgattgtttattttctagctatttggtgtgatctaatattatgagttacttttccaataaaaaaaagaattagggtaatggaatagtaaaatattacgatatactaacgttttgaagagatctaaagtgcaccctagaaaataaaaatgtaactaggacacaaaagaagtccatgagtgaggctgccaaccaagcaaaaaggacaagttattttggcgaccaccgacctcccttctatagaacgcaacatgccttttcgattcttgaatacgtaagatgatttttttatataaatgtactttctaaaatgaattaaggagtaatgtatcaccatatcaaagtttcgggtgagtttagggtagagccgcagccgctaatcgtaggttccaaagtactccattgttgataatggctttgaatggttatagcggttcaagcggacaaaaccgtctatacaccggattgctttttatttaccatttacaaactatagtcgtaatggtacggatccaaaaaaataaaacaaaaccaatgcaaactaactgcgaactaactgcggattgtctttaaactaagtccgcattggtttgttctccgccccaaaattagtatggactagaccgctgacggattaatccgcactaactacaacatccattcaaagccaatatgtattgattagattggtttgagttaaatgataagatttagaccgaatcttgcttttctagaaaagaaagtgatcataaacccttaaaatcgccgaatctaaaatttgctaaaatagttataagcatccaaacatagtcgaagcaaaatattcttatttgaacaatacttcttgttccttgcctttttttctttgtaatcttgtatctctaaggtcagaagatagaattgatatcaactctatgtaacgtattgaaagtcttagtgaaattgtgaatatgactcatcgagacgtacccttaagaaaaatagggaaacttgtaaaagtcttcatgtgtaattgcttccaatttcagctccatattagtcgtattcatacatgcaaaaaaattaagaaagccaagatcaaaacctaaccgttatcgtcgtaaaaacatcattcattacaaaatcaaaatcgactaaatatgaagtcccaccatttgcattgactatatatttcataatagttgtgctccattattgtgttttggcgactgtaaaaagagtgacattgttgaaatggtaaataaaaaatgacaaacttttaaaactattttgaagaaaagcctattctctaggtctcttactagttgtacttttagcccaaataaaccaaacgaatccaaaatcttctaagttctaactaagatttttatttcggtttacataaaatggacgttttagaattgcaaattccaattccaaaaactaaactaaaccaaacaaaatttttattaaaaacaaaaaaatgttggttgcttaaagtttagcaattaaataacacactttattgtgggcacatgattcacccttaatgccctgtcgctcactctttattagctactaccaattaaatctctctttttcttctcttaccattttcacattttcgagttttacaccaaagcctcttcactttctctctctctctactatagtctcctactacctactactacttcttctctctctctttcattcactacataaaaagcttcgagctcccatcactatataccctccaaagatg

SEQ ID NO: 36524 - DNA, 3003 bp, Unknown
  misc_feature (1)..( 3003): 2750-1469P.txt file - cDNA_ID_3097183; gDNA_ID_2936551; Annot_ID_194043
aattgatgaagatatattagataagggaatgttactaattaagaatattaattaattgaaaataattaatgtcaataacattttttataaataaattccaacttgaggatttatttcataaaatggctgcaaaaatgtatatgtaaatatctagcggttagacggaccggcccgcgggtatgttgaagtgtagtcggcgaatcattatacacttctctctatgtatcaccactgaagaaccttccttcattcttgaaactaataatacggctcacctattggctcctcttttttatagaggaacaaagtcagtgcttgggtttaacaaaccctaaagtcttgtcacgtgtggttaaatgaacctgtgacattctgcatcattttgaggtattgctacacttttaaaagcttaaccaaactcaaatctgcaacttcttaaacctgctacaaacagatgccttttcctttcctttcaagattaaatcatcaaccaacagtctccaccttgattctagcttgaatgacctgatgtgagttatttttaattcttgtttgaacacatttaatctcagctctatgtattgttgaatgttccacgatggttacaagtgggactaacctcttgaacttgtgtatgacggaagaataactttagacacccaccatggtttgaagcaacttgtgtacgcacacacatattacatgttgatgtttgcctttgtttcaagcatttttttagtaaatctgaagaatagttcgggtttgatcaactcttgaatttaaacagaaaacaagaatactaaaaaatacctgaaactgaaacataaaactaaaactgaattattgaaaaaaaaacttgaaactcgaacataatcacaaactcaagtactaaagataaatttaaaggatggtagtgacatggtgttgtgaacgtatggtttatacgttttgattccacatcaaaaccaaaacatattcttacaacctatactccacaaatcaacccaacaccataaaagttgttagttaagtctgcttgtctcaatgttagactagttttgaaacattatatagtcacttaattgttaaaatttacctttttaatttttaccggtaataagaaaaaattattactaaatcgatgtaaaacattttattatgtagaataacgtaatttgatagaatcaaatttcgatggaaaatatcatttttaaatatactttttaatgacaatcatattaagaatttaaaagaaaacaaaaatatctcaaattcccgatatcaaaattatattatcttcttcttttttgtttagaccatttttcaggtccgtctctaactcatggcagtgtatgacaaatgcaatgagtccattacaaaattcagaaaaattcttaaaggaaaaaggcttattttctaaaaaaaatattaaaaggttttaatcgttttttggattttgccaaaaacgcataaatatattgagatggagctgccatttcttcaataacagtgtcaaacatataacgacattcattttctagaactttagttttaaatattcagacaccacttacaaaaaaagaatatattaattaaataagaaaaagtaaacattgaacatccccatttagtcggtacgattaactcggctaaatattaaatgggcttaactagttgggcttattttaacactaaattggcccattaaaacttcccaaaatgatattggttcgagatattcgatgacgtgggcaccaataaataaacacacaggtctgctttcataccttcacgctctctcactgatcattcacaatctctctctttttacaccggcgataattttccgatcccgattataagatggcgaaggaaccagttcgtgttcttgttaccggagctgcaggtaatttcagattttaccgatcttgtttcttctatctctcgttatcgattcgtatcgccagatctttatatagcaccaatttttcataatcagaaaatttaatcgatccttgaaccatattttggattcctatactgtgatctgaagagacaaatgtattcgatcaaaatttcgctttagaaaagtagagttttggtttttcttttacttttgagtgaatcatgctataatgtgagatctaattgtttaattttttttttaaatcattgtttcataatagaatcattgttttatttttaaaaggaattttggttaaatatatttaatatattaattaattagattttaaaatgttaacttatgagtggttactctgtattagttgtgtaaaattctataaattttggtttaatattacataattataattacttatcttccttttttataagtttaatattacataattataattatttagtttcttatttttataagtttaaatttaatatttgttatttttcttttaacaagaaaatagaaaataattactctttatgttcctttttgtttgattttctaggaaaaaaattgttttaaaaagattgattttttttaagtttttaatacaatatttattaggtttttaataaaaaataattgaatattatacttttaaaattatagaaaattataaaatacagaaaataatacacttaaaattaactttaatatatttactttaaaatttatgttttttctaaacaataaaggaacaaaaagtactattttcaaaaatattaattaaataaatattaattatcgatgtggcaggataataaatcggattggataaccggccaaacatgtttcacatctcatgggtcgaatctccggtcccctccggtttaaaaatgatgggctaataacaaaagtcaaagactcaaaaaagttgttagttaagtctgcgtcgaatcacttgcaaacaatcaatagcttcatttcaatcttcggtgaacaatcaatctcgaagaagacgaacataaaattttcaatttctctgtaatcttcgcttcttgcgaaaccaattctctatg

SEQ ID NO: 36525 - DNA, 3000 bp, Unknown
  misc_feature (1)..( 3000): 2750-1469P.txt file - cDNA_ID_3097316; gDNA_ID_2936553; Annot_ID_194132
tattaagatttttcaacttttctagataaaattcacaaactttatctttttttgtttttctatagattcttgtaattttttattttatcaagatttgatatttaataaagttaaattataagcttaacatgtgttaggcatctacatcggtagattctaaataaaaaaaagtttctcatgaataaaatattgtttattttaattgaattcagttaaattaattttaattaaaaaataaaatcaaccattcctgaaaaacgagttggccagaaacgtctctcaaagtttctgaaaacagagacgattctcaattctctctcttctttttcaccactttgtattattttaataataagtatctcttctagatacttttgatggaggtgcccttaaaattgatccaaactaattttggataacaaattcattaaaataataatatatatttctttttttcttcaaaatattttaaaaactaaagttattttttggtaagaatttatatttgatagttatatatacatatgttctagtgataatgaattttttctgatgaatgtccaaagataaaaatcatcgggtttagactattttatgtagtgaagagatcgttgctctttgtgatattgacggtgatggaaagataacggccaaagagttccatttgaagatgacccggattgggaatacttataggagttctgatacatataatgatggttattgagtttgaggaatttaaggctaatattgtttagttacttattaaaaggtaatatacttgttcaccaagtagtgtcttgcttatattcattgtttagaggtttctcaacttgctatcaatgatacattcggcccaaatttttgtgttgtggtggacctggttgcatttgttgactttagtcagcttgggcatttatccatttgtggacatcattgttacattgtagacctatgagattgataatatttatggttaaacattattatatcgtttttcaatttccagatgcgccaaaccatcccaaaaggtagaagtcggatatatgtaacagaatgatttggagttattgagatttggacttaagatcattcgttaggctgaatagagcagtccatagaatccctgaacatctccaattagcgtaatctcaagtgaagaatagagacttggccctttagatgtcatgcttattctgcacaaactcaaataattcgtttgttttcttccaaattgctctagtaaactcaaatatttgtttcctcctccaatttttgttatctctaggattctatgaatatgcgttttattcaaatattattaagaatgtctcatagttaaccttttgagttgaacacttataataattggcacacacatatatatatatatatatatatatatatactgtaaccagtagtttttgttttgcaactttgcaaaaacacaaataatcatcggcgaataagaaatgattaaccgtaggaacagactgagcgatgcgtatgctctcgatgccaccatttgtttcaactttgatgatcagttgacttaaaatctctgcacatagaataaaaatatatgaagacaaatcatcgcttttgtcgaattctccatgaaagcttccaattttcataggaagtgccatttacgaggacatagtatgagatggtgttaatgttcatcataatccaaataaatgttaaaacattaagaatatgaaaaaatgatttgttataaatgtagataatgaaattataaatcttattctagaaaaattttaaatataaaaaatgaaaacttttttgaaaactttcaaaattagataagaaaattgtttatatataatttattatggtacatgaatagagaattagaataacaaaacaaaaagttgaaagaaacacaaaatgaaaaggctatacaagagaatttaaatcagccatgacgagagagtaacccaattagactatggtgatttaaatctaaactttttattttagaaagtttatattaaagaatataaatttgaatgtttgtggtgtgaaaaaattcaacttacctttattggttatgtatatatggattgaaaaatgaataaggagttcaaatatattttctgagcttaatttttttaaatcatattagtgtcattttgcgtagtttaacaaagaatctcgatgaaaatttagcgttgtaaatttatttcgttaagcaacttaacgaagtgtcttatttcaaaaagtcaataaaattagctattaaaaatttaaaacaaaaagtgaattaaaatttgagttttattttacctaaaacagtattaacgtgtttataatagcactttttaactgttggagattttctttttcttttttttgaattagagtgagatagtgatcaagaaaatgaagaaggtgttagtgcacatcatataatccaagtaaatgttaaaacataaagaatatgaaaaactgattggttagaaatatacatttttttttgtaaaccgatattaagtagagaatttagtataaaaaatcttgttctagaaatttattagtataaagaaatgaaagcatgtttaaaaactttcagaattagaaaaaaaatgtttacatatagtttaatatggtacttgaatagagaagcagaaaaacatataaaaaaaattgaaagaaacacaaaactcaattttaataacaaaagcaaaaaacgccacgtcatcgatccgtgtcgtaaatcagcaccaaaatacactttcaacggtcagattttaactatctcatctgtcgtcattttcgatctctctcttacactactacacacactctctctcctccaacctaactattttttattttttatcttctccttccacaaaacttttttaattttatctgaaaaattaaaacaaccgaaacaaaaaaaaaaaactaaaaatcaaaaatctcatcaccttccttgctctgtattttttctctctcactaaatcctccatg

SEQ ID NO: 36526 - DNA, 3000 bp, Unknown
  misc_feature (1)..( 3000): 2750-1469P.txt file - cDNA_ID_3097321; gDNA_ID_2936553; Annot_ID_194131
ttgcttctactcctcctcctcctcctcctactagtgtagctcctagtcttgaacctcccagatctgatttcatagtcaacgagaaccaacctttacctgatccggttttggcttcttctactcctcagactattaaacgtggtcgtggtcgacctccaaaagctaaaccagatgttgttcaacctcaacctctgactaatggaaaactcacctgggaacagagtgaattacctgtctctcgaccagaggagatacagatacagccgccacagttaccgttacagccacagcagccggttaagagaccgccgggtcgtcctagaaaagatggaacttcgccgacggtgaagccagctgcttctgtttccggtggtgtggagactgtgaaacgaagaggtagacctccgagtggaagagctgctgggagggagagaaagcctatagtagtctcagctccagcttcagtgttcccgtatgttgctaatggtggtgttagacgccgagggagaccaaagagagttgacgctggtggtgcttcctctgttgctccaccaccaccaccaccaactaacgtagagagtggaggagaggaggttgcagtcaagaaacgaggaagaggacggcctcctaagattggaggtgttatcaggaagcctatgaagccgatgagaagctttgctcgtactggaaaacccgtaggaagacccagaaaggtaaaatatcattcctttttgtctctgcgattacacagtgattatagagaacttgaatatttctagtcaaatagataagagaataaaagttggaacttttgtcttgtgaataaatgtcactttccattctcaacattgtctctttcgagcgtgtgtgtggagactagagagtatctaactaaataaattctagagtttaatttatattcgtgtctctgcttttggcctatacttaatctggttttgtggtgtactattaatctaagatatctctttgtttggtaatcaagagcaacttggtaggtggctcgctttagcaaccaataattgttcagttgaagtgtgagaattacatatgaacttatcttttgagacagacatcttatcaagttttgtctgttttaagcagaaatttagttaattcagtcaaagttcaagagtttgtgtatttccaagtccactagaatttctttgtctattatattgatgagttagttatctaattacatttatattattgccatttataaacatagaatgcggtgtcagtgggagcttctggacgacaagatggtgactatggagaactgaagaagaagtttgagttgtttgtaagtaatctaatgaacagaaacacaatatggtccgtccttggttttgatacttaattgcttatgcttggttttgatatctcatttatgcagcaagcgagagctaaggatattgtaattgtgttgaaatccgagataggaggaagtggaaatcaagcagtggttcaagccatacaggacctggaagggatagcagagacaacaaacgagccaaagcacatggaagaagtgcagctgccagacgaggaacaccttgaaaccgaaccagaagcagagggtcaaggacagacagaagcagaggcaatgcaagaagctctgttctaaagataaagccttgacataaaaagctagcaagtggtgggtttacttgttgtgtgttacatgaaatttttaatcttataagggtgtttgcaggagaaaaacaaaaagaacaatgtgatgaactgatgatgatgattgtgtctctaaccaaacaacaaggagaggtagggtaatgtctgtaaagtgaattaggatgttaccattgttcatgcttcccatctctctccatcgtccatatctgtgtaggcagctttgttctttgttccctcgtgttttttttagactgttgtgtctcttattctattttgtctccttaggctttttaggagttgttgttgatgtttatcaaaaacgcttatgtaatttttatgaccacttctactttttatgatggtttcttcaagtctcttacgttatgtagttagaaaaccattaaataaaagttgcttatgtcagttgctctgttttaatttgaaatccggttttaattttaagtgtacttattgcagaaattaggtagaaggtatagaacggttttactcttcactcacacaccatttaaccaaatttctaaatttattactcgataaacacttttttaacaagttttcaatacttttctccaaaaaaattttgaatttgaaataaagtagtgtatttttcgattttggttttataaatcaacttttttttttgaaaaagttaaaaagaaatcaccaccacatttgcatgttatactataataccaaaaaattaatattcgtgatttattttaaaaatctgtgaattaaaaagaaaaatgaaatgttgataaataaaaataaaaacaaggagtaaaggtggacccatatcggttgacgcaactgattctgaacctctcggtcgttcgtttctactctttccaagctctagcccatggtggtgaccttcttcttctaaccgcgaaaaccatctctatctctcttatctttcttctccgccaagtttctctttgtaatttctttcttcttcctccagattcttcaagcttcctttaccatctcgcgaatccttctattaagttgaacaaggtacgtacattgcgatttgcgaaccctagtttttctcaaaacgaaatctctacgcgtgagagcctgaatctgtgttttacagtcttcgtttctagattctaggtttgtgacatttgaaatttcgttaaggttttagcgaaatcgagtttctggttgtttagtttaagtctagtctccgttgatgtccgtttttgctagggttttgattccgattaaccgccgttttctcacattttgctttctcttttttttttttttttctgattcgcatctacagatctcatg

SEQ ID NO: 36527 - DNA, 3003 bp, Unknown
  misc_feature (1)..( 3003): 2750-1469P.txt file - cDNA_ID_3097324; gDNA_ID_2936553; Annot_ID_194130
tccttacgttgtcgtcaaaatggcaaaacaggtaaaccatccttaaccatactttgttaaaatggccctacttcttgagatagtatgtcgggtttcttaatcctctcaatatcaaagacactatttgatgatgttagatactttttcaactttatgatggagaatataatttgttacttttagtggatggaactatagcaacgtaataatagtgaccttttaaacatcttggtcattaaagcgtttcggcttcttgtatgatcattgttaaatttactaataagacgccagtttgaaagatcacgagtgttgaagactttagatgtgcattaaacaaaatatacatatggctaggttgattcggtcagttttcgtaaagaatatacatgttgaatttgtgaattttaggtatattgaagcggctctcagaatattttaggaatgtaatagtttagtagttaagaatctagctatttgtaattaatttggttgttcgagtgttttggaagtactttaattaaggtatctgaatattatttatacttgctaattgatctgaagcctcgaggtccggtggctggagaccgtaatctatctttacgcatcgtagaatttatctaacaacaaattcttagtattttatatatttcgagaatcattatttaacgcaaagatagtagttatgataaacgaatgagaaaattgaatgtgcagaaattgaagactcgagttatttacaaaaatgtaaatcctgagtggaatgaagacttgactctctcagtttcagaccccaatcttaccgtcctcttggtaaggaactaccaattctacgatcatatttttcattttttattttcaaatcgccataatgttacgtaaaaaaaaaacatgattacggtgtcaatttgcctagacggtgtatgattatgacacgttcaccaaagacgacaagatgggagatgcagaattcgggattaagccgttcgttaatgcgttgaagatgcacttacatgatctcccatctgggaccatcgtaaccacggtccagcctagccgcgacaactgcctagccgaggagtctcgggttatatggtctgatggtaagctcgttcaagatatagttcttaggctgagacatgtcgaatgtggtgaggttgaggctcaacttcaatggattgatcttcccggaaagggtctatgatttgttttctgtgtattggttatgggactttaaacctgaatttaatttaaaagtccaaattaatgtaagcaaacaaactagaaagaaaaaacgatagtaggaatgtctttgtacaaaaaaaattattatttgtttagtaaatgacgtgtttctagaatcattgggttaagcataaagttgaagaaaattacggatgttataagaagttccaatttttgtttcacacattagcgatcgtggaggtcatcaaaaccaagcccttatattgtataatgggaatcattactttaactcgtttgaaatgttaccacacttcaaccatggaatggaattatgtagtattggtaaatttaattaatcactagctgccaaaaatttcattaagtaacgtagtgtatacgtcaaaatttacttaggtagtgataatatctcgaaccaaggcacatgagcagatctctttcatatatgacacaagtatgagtacatgcatgagcagcacaaaccctatttgttgccttttctaacgtatacgcatcagggacccaaaagttatcaattacctttactctttttatttgtgaattttgtttgttgaattaatataagataaagtacaaaggaaacatatgagaacgctacaaccataaaagaagatagagacctgcagcaacaagataaagagaaggaaccaacctaccacaaccccttcagcacaatcaacaagagaagagaagagaataaggtgttctctcactcccacaaaaataacctaagtagatctcagtttttaaccttttgttaaatgataagttattaatcaattaactttaaagtttattaagtgcattgtatttataagatagctgcagaatttacatcaatgtagattttagaaaacagtttggacttttcgttttatcttataataaccttttatgttagaagattgtgcgttatctaaacaaatatctgaagtatgaaatgactaatgagaaaactatagtataattctaagctcacttctataattctaagtttatgagttaatgagttatataattcttacatcaatttttcacccaaaaccttatatacttcctacatagcttagatgaaaaatgtttttttcttcttctaaaacttcgttgatttcacaaatgaaagttgtatatatacaagtctaaaactttgtttatattcaaagttattcatttaagttcctcaaaaggttagagagattaccatagttacaaatatttcataattattattttttctgtataaaactcacaaaattacaattttaaaattaagttaagtttttcataatttcgttttcaatttcatattttatctactcactattttttttcttgcaatagttattgtttgatactttgatcagttatgcaaaagagttcttgatagttaatttatggtaatttactgtgttcaatatacactgccgaatataacaaggcccaaagggccagtaacaccatttgggcccaaacccaccatcactctctctctctctctctctctctctctctcgaaaagcgctcaacggtctccttgtgaaccacaaaaccatcacttcccggagaaatctgagggaattgagtctcgaggagttcaaatttgtgaaattgatcgacatgaatcaaagaggaagatccaccaatcgtagatcaaggagcttctctagatccagactcgccgttgaaggccattgaaatctcccatcacatttctctatcgtcttcttccttttgagttttccgacgacctctccaaaaatg

SEQ ID NO: 36528 - DNA, 3003 bp, Unknown
  misc_feature (1)..( 3003): 2750-1469P.txt file - cDNA_ID_3097329; gDNA_ID_2936553; Annot_ID_194129
ttttaggagaggatttgcttccctctgcaggattaatatctaccatttctatgtcatgcagtgcttcactgcttcctttagcattttgtctgagattgttcatgatgccttgagtagtgctttgctcaacactaaacacattgggttgcagtcgcaaatattcctcgttttctgttagaccaagtcaaaggttcgagtctctatcaaactgtgaaaaaaaaatcgaaagaaaatttgatcacttaccattcaccggaacaagattcttgccactcatttcagaatcgttctgctttggtaaaccattcacagaaacatgattcttggcactcatctcagaatcgttctggtttggtaaaacaggagtatcctttgtgataacctgttaatggaaactctctagccttaagaaattttcatatattccaatgaatataagaaggtggaacttgatatcctaagaaaaactgccagagaaatactaccttggagatgttcttcagtgttatgttaagataggttgatgaacgtgagggtgcgcagactgcaacctgaaaaacactatatcttagtccatgatttaccaaaagtgactgagaaacaaagtggtaatgtcaaaaccatgcgatttgttttgtctccttaatgaaaaacagcaaacctgcttaagtatcaccactgcgccaactcgtatatctctaccaaactcactctcggagataacttttctgtgcacactggcatcaattgttccagtgggatcctaccagcaatacacagatttgagactcatgacaattggtgcgtgacaaaaacaaaaaagtggaaaccattcacattgttaagagttcttgactgttcatttttttaccttaagagtcaccatgacatcacctagaccattcggagtgcaagttttgacaattgccacgacctacaaatgaccagccacatttcaagtatgtcactacatttcacttattagctgcaaagataagatgtggagcattatgagatcatcagcacgtggcttggcaaaaaaatccagcatttggctttccactaccccaattattctacaacatatacaaataacttgtggccaaatagcaaaaaattgggtgaagacattctttcagaatattccacctttctcctcacaaacacaaagcgaaagccaataccagcagactattatagggtgtagatttccattaatactctaactggatggtcactagatatcttggtgtaatgggaatggactagaggatacagctaaactgagtaggttaatcatacctgatcaactttaccccaactgtcacatcttctcttaatctcgctcactggtgtccctatagcatttccaccattgctcaacaaacctgccaaacaaaaattgaaaatggtaaaccacaacccctagagatttgacaatgtaaaattctaagagaaaaggtctaccttcacttcgaatgtaatcaacagtagagacccaggggtcctcagagaaatccttgtcttcccaatcaggctcttctgctgccttacgtaagaactcttgagttggaattggttctccatgctcattaaacgatttaggatccttattcatctttctacggattgcaacttgaacaactccagcaggtcctggaatcaaggagcgagaataactctcctcaagaaacttatccggcgaggagcagcgccgaagagtgggacggtgattagtgttactattaaaacccgcctttggattctgttgttgcgcatgcggttgcagagacctcgtcggagatttgcgtttacaagggcggagaaaagacgggagttcagaatcgccgagatcaagagcttcccattggtctacttcagcttgggagttcatatctctcatcacacgaatatgacgaaaaaagattcatccgcacatacccagattctgtagcaattgcattagcgataagccgataagtgaacttcaatgtgtgagactaaaattatgaatctcactaccattacacttataatttcattttcatgaaggtacgaaattaccaagattgagaactaaccggcggtgggggcaaatagggacgacgacgacgacgacgacggcggtgaagcgaggaggcgatgagagagagagaggtctcggtgacgtgaaaacggtttgattcttggaagagattctttacgagtcatgggaagagtatttatgtcattagttattgggcctttttatttggtatgatatgggccgcctcactctctactagtttacttcttttcgttactaactttttttttttttcccgctaactctattattttcaaaccaaactaatgtttcccgctaactctattattttcacagttgactaaaagaacggccgaaaaaaaaaactttctctctcgcatctttcagagagaaaaagttttttcttccgattaaaatcggattttcttcgattttcttcgattttaatctggttttttgttgtaaatgttttccagcctagtctggatcgcctaagtgcgagttctctttagccaatttggctattatcttttgttttgtttgatccttttcttttgcagtaactaaatctctttcatgaaacaaacgccgagtgtgggaaacagaagttccagagatcatcaactgctcaatcccttgcatgaaaggataaatccttcaactcctattaaggccgtaatcggctttgtgtgaaggtccctcttctttgtttgtggatcgtgatgtttggaaacttgatggctggtgaagacggattcagaagagcgtgttttgcgactggatctaatctcttcccttttcatcttttctggcgcttcaattttgttggtttatggatctagtgttctacacatcgggagatttctgcaaaagaaattatggtggtgatttagagaaaatagctgataggtgaacatccatgtcagaaaacagaatttgatcggcggtcagctatg

SEQ ID NO: 36529 - DNA, 3000 bp, Unknown
  misc_feature (1)..( 3000): 2750-1469P.txt file - cDNA_ID_3097338; gDNA_ID_2936553; Annot_ID_194127
ggtatgtgcggatgaatcttttttcgtcatattcgtgtgatgagagatatgaactcccaagctgaagtagaccaatgggaagctcttgatctcggcgattctgaactcccgtcttttctccgcccttgtaaacgcaaatctccgacgaggtctctgcaaccgcatgcgcaacaacagaatccaaaggcgggttttaatagtaacactaatcaccgtcccactcttcggcgctgctcctcgccggataagtttcttgaggagagttattctcgctccttgattccaggacctgctggagttgttcaagttgcaatccgtagaaagatgaataaggatcctaaatcgtttaatgagcatggagaaccaattccaactcaagagttcttacgtaaggcagcagaagagcctgattgggaagacaaggatttctctgaggacccctgggtctctactgttgattacattcgaagtgaaggtagaccttttctcttagaattttacattgtcaaatctctaggggttgtggtttaccattttcaatttttgtttggcaggtttgttgagcaatggtggaaatgctatagggacaccagtgagcgagattaagagaagatgtgacagttggggtaaagttgatcaggtatgattaacctactcagtttagctgtatcctctagtccattcccattacaccaagatatctagtgaccatccagttagagtattaatggaaatctacaccctataatagtctgctggtattggctttcgctttgtgtttgtgaggagaaaggtggaatattctgaaagaatgtcttcacccaattttttgctatttggccacaagttatttgtatatgttgtagaataattggggtagtggaaagccaaatgctggatttttttgccaagccacgtgctgatgatctcataatgctccacatcttatctttgcagctaataagtgaaatgtagtgacatacttgaaatgtggctggtcatttgtaggtcgtggcaattgtcaaaacttgcactccgaatggtctaggtgatgtcatggtgactcttaaggtaaaaaaatgaacagtcaagaactcttaacaatgtgaatggtttccacttttttgtttttgtcacgcaccaattgtcatgagtctcaaatctgtgtattgctggtaggatcccactggaacaattgatgccagtgtgcacagaaaagttatctccgagagtgagtttggtagagatatacgagttggcgcagtggtgatacttaagcaggtttgctgtttttcattaaggagacaaaacaaatcgcatggttttgacattaccactttgtttctcagtcacttttggtaaatcatggactaagatatagtgtttttcaggttgcagtctgcgcaccctcacgttcatcaacctatcttaacataacactgaagaacatctccaaggtagtatttctctggcagtttttcttaggatatcaagttccaccttcttatattcattggaatatatgaaaatttcttaaggctagagagtttccattaacaggttatcacaaaggatactcctgttttaccaaaccagaacgattctgagatgagtgccaagaatcatgtttctgtgaatggtttaccaaagcagaacgattctgaaatgagtggcaagaatcttgttccggtgaatggtaagtgatcaaattttctttcgatttttttttcacagtttgatagagactcgaacctttgacttggtctaacagaaaacgaggaatatttgcgactgcaacccaatgtgtttagtgttgagcaaagcactactcaaggcatcatgaacaatctcagacaaaatgctaaaggaagcagtgaagcactgcatgacatagaaatggtagatattaatcctgcagagggaagcaaatcctctcctaaaaagggtgtgacaaagaatcactgtgaagttagaatggagcagactctcttgggaaaacatgattcaatcagccaaacagagcagcaactgtacgaagatgtagctactgagactgatatagctgattgcattagacccgcgaaacagatcagaagaagttctcaatcgcagattgatgagcaagagagtgtaatggggaaccctgatgaagtcacaactcgaactacaatccacaaatctcaatcgatggcgtcaacaatctcgttgccacaatggacggacgagcaacttgaagaactctttgcttttgactgaaatagacagtttggctttcttttgatataggaaggaatccacttttctagatagagagcaatgaaatagaatgtaaagccgtgacagagatgctgaaactactgacagaaattttcaaccaccaagggaatcaaatacccatcacgaccatacgtggaagtatggaagcgactctcctatttgaagttatttgttaggtagaccttaagctaccaaccatttgtttagtttactagtgtgagagacataagctatgcatacaaccattaattaacagcattagtcagaacaatggttactagttattgagatgatgatgacatttcaccttcgggttcccactgttctctcttcaactactgaaccatgtttcttgggacatgattttgggctcggacttttgaggcttttcagaatcgtgactttgcaaccccttaatagctacaacattgccaaaccttgccacctctgtcccttaaacttggatgatgagcttcttagtccacatctcttgagtcttgattcaagcttaataaaagaatttctagtgagttgcaaaattgtaattttaaaactaaagggacaaaaaagaaaatgcttatataaataaaaggtcatattgcaaatagtcaaaacttgaaaagccttctcctttatccactcgttcgcctgccaaaaaccttactaaaacctcacttatagtcgtctctggtgaaatcttgccggagagatctcaataaaatg

SEQ ID NO: 36530 - DNA, 3000 bp, Unknown
  misc_feature (1)..( 3000): 2750-1469P.txt file - cDNA_ID_3097347; gDNA_ID_2936553; Annot_ID_194125
tttagtaatttgttatcttcatatcctaaaccagaccattttgttcccgtggctcattttaattttgcagatgcgacttcgtgaactttaggagaaacgatgcttgcaagaaatgcgagtgcaaacgacctagccaagccaataacgatcaagaagaccatacatggaaacgacccgccttagtgtaaacttatgcttttgtacttgcaagattcactgcttgctatttcctttcaacttgttgtttcttcttctcttgttgagttcccaaatttctaaacagataacaattttgaagcagaaaatggaaacctagtttgtagtcacattcatgattcatcgttaaagctatattttatgtagtcaagtacaaactatgtcatctctaatacaaaacaagccatgattatacaaaagcttcaaggccaaaaaaaggtgcaagttcttcgttaggaacagaccgtagctacattacaaaagcttcccgtgagagctacataagctaaaactattgagatgatgatgtcatcggattcatgagttggtctccatttgaaatttcaccttcatattccttcttccctcttctttatctaccaaaccatgttccttgagacatgattttggtgatggagcagacttttgcggcttctgaggcaaaggaactttttttacttcattgtcttcctcaaagggttcgaggcggtacgtaaccttagactttcctagtctaaactttttgctcctagcaaattgataagccgtcactgcatcgatgctctgcatgaatactactttcgcagagctttcccctgggtttacatcagttcttgaagcatctattttcccaaacacactgaatctcttcaacagttctgctttggacgggagatccccatgtctacacaaaaacttcatccgcaaacattttggattagcaagccgcatatctttcatcaggtgtagattcagcgatttatcagtagaaatagattgttggcctgctttcttctttctcttggagtaacgtgcagatgctttgtctcgacttgccttccttttgacaccaatggatctgacattatcaactgatctcgtctggttttcaacagttgttccagcttccaaatcttgtaattgttctgcaggtgctcctgcatcatcagaactaaattctttgtttgaagtgcctgtactaggtagcgaaacctgtcccacctccacaatatgtgactccaacgtatattcagagcagttttctcgtgttccattaagactattcctacctaacgactgctcattcaaggtcttggcactgatgatagagctatcaagcttgtttcttgggctagcatatttttttctcactgaacaagctagagtgtgacaggctcctggaacaacaaaagaaacaggctttgccaaataagctttgtcgttgctcgaatcaagcaagggtgacagttcatttgtcgatgtcacaggtccatcaaccaaaccaatgatgtcatcatgagtttcaatcataacatcaggaagtgcttctgatacatcaactcttgaggcagcaacggaagtggtgtcttcctctatcatatcttcaatagaaggttctgaattcaataagcagatattctgctcaacttgacagcattctttactcttggacaggtgaccatcatcctcatgaacagctcttctaaccatggtttcacaagctttcatggtactagaattagaactggttcgagggctcctcgtattccatgtgcaaatctgaactactttatcaacatgctgctcagaagaacaacaagggagatccttcggcaatggatctcttagactcaaatctctactgttgtcgatatccgcatccgcagtctcaggaaacatagaacacaggtccatcttctttgagtattcaagacaccaacctgattcttcagatcgatcatttagctctgcacctgtacacatattcatagaattatttgagaatacaaatcatagcaatatctgtcaatccatacttcgccttgttctattgtaaacagagcatatagattcacactcaaattttgaagttcctataaacctaatagagcgaaacagtagcaatcatctctatggagcagttctaaaacaccaaatggggtttctttcctaatcgtactcagcaaaacccaaaaataagaattttcaaacttacttgctctagtctcctcatagacagattcggagcgcttaaaatcgacaatgtaacgccgaaaactaaggatctgagcactggaactattggtctcagctaatctccagaggggcattcgtatcgaaatagccatatctctaacaaaccccagagccgaatccgaagtggcatgaaaccgtgggagagagttttctctatccaagtaaggcgaatcaatacgcggctggcaagaacaccataacccaaacgagatgttccaaaagtaagctcgcagagctcgattcacaaagcggcgaatccaccttgaatctgaaatcaaggttttgaaatcgcgatcaaagcttcgtagaaatggttttggaacgtatcgcggatccattaggccgaagaacgagacgagaactcctaacgattcggatggatcgataatccgacccggaatccatgtattcgaaaagctcacgcttacccaaactagctcccctttcttccacatctttgaatattagggtttaagctttctctctgatatcatctctgtgacaagacaagagagaagaaagtgtagcgttgcctgtaacgtctcctctagaactttttctactttaattgaattacacttcatgctgttttcaactctcagatactaactacctgccatttaatcaacgttttgtcttcagtaaagacatcctgctgttgtcctacttatagagaaaacttctgccgtttcatttactccgccgttgccacaaaatccgctgtagctaagctcggtgagtaaaatg

SEQ ID NO: 36531 - DNA, 3003 bp, Unknown
  misc_feature (1)..( 3003): 2750-1469P.txt file - cDNA_ID_3097350; gDNA_ID_2936553; Annot_ID_194124
attgaagcttcagcattgacagagttattgctcttgaaatagacattgaaatggtacaaagtgatttttgctcgttggttattgctcttgaactagaatgttcttgtacaaatcttttcctttgcaaatgtgttgttggttaaaacataatctgttcttttcaaatacctatcaattacatcttgacgctgcattgtcgaaactagattccgggtccatgcccttcgtactctcggctttttaatgtattccagaagattcatttgtgaagactagttaaaccatgagacttacctcttattgagcagttttcctcatggtatccttagcttgtaaattagcacttctcaggtttattctcaaaaacaatccaaattcagtatgagcattacttcctataccaagtttctgataaatgattgacactttgacagagttataggataggcaaaactcaaactttacttctgggaacaatacttttacgtaaaccaatgtttttactctctcatattaccagaattcttctaacttcaaaggtcaagactcaagtgcaaaatgcatactttaaaacattcatgtagcattgaacgagagattccagactacaccatagatgactcgttatcacatcatttgtcttacatattacattactctatcaattctacttctgaactattgaactgaacaatacaactagtaagcatacagtaattgtataaaaatgtacaaggtaaaagatttagttactgttgttatatcgtttggaagcgaaagctaaacaaagactcaacgataaatcttaacattgaacatttttcctttattcgaagaattcaaagtcctgttataagagattcacttatactccttaacacaattcatccaccaggtcgactggaacacgaaaacactatatgttctaggaagaccatgtagttattccaacataatgtctaggctcttcatttagtctcagagctggacttggttgtagtggaaacagtatttagcttacacaaaatctcactcttcaactcagtcactaacttgtcaaaattcttgaattgtgtatcgtaatcgccttcctcgccggattcatcaatataattcccaactctaatataaaaaaagaaaagagatagaaagcttcagtaccttgagattcaagcaaaagtaaagagataaagagaaaccatgacatactcaatttggagatggccaaattcttttccatcttcagctattgcatcaacaagaagtttatcattcattgccaagcacttaaccagatatctcttcaccggacatttataaacaaacgcatactcctcgtcgaattcgttccacccttcaatcccaaccaaacctaaaaataaaaaaatcgatcaaatccgaaccctaattaaaccctagaaaaacttgtaaaaaataaaaaataaaccctaaaacgaagccaatactaacactgagtggtcgatgaggacagagcgtcgtgggcgaaggcaggacgtccggttgaagtgagaatgaaacccgaaacggctaaagaagcgtgaactacgaaagcgattttgtcgtttttattgcgaaaagcaggcataactgacctgatcacacccatcactgcatgagtagtcgccattgattctgtttgaggagttctcgtcaagttcatatgttatccctttagagtaaagagtaatatcgaagttgtaatcctctcaccataaaggtcgggtatttttttttttcgtcgttttcttttcgggtatttgttatgtaaacaaaaacgaattgataaggagattgtgtatacatgaaaagaaataaaataattggcataattatacccataacacgataaaaggaaatatttttatgataaaaggaaaatgcctttttcaaaaccttctgtacttttgtattgaacttgtgtcattgctgcaacatacggttaaacgacttgttattacttcattattgagatgtggtcgcaatgtagtgacactgataagtctaccgagaaccggaaaccacttaatccgggatcaagttctctcctataatgattagtccgttgtgctctatatagatgaaaaaaagaaaactaaattacttattgttgaagtccgggatcccttgaaagttggacgtttggacgtctttttatcatgatgtatgggattgggaattttctagccctaggatttcggtggaaaccgttaaatcgacccgatcaaacaaatttttttggttatcggcataaaccgaagatattccttctatccgatcgatgaaattaatttgggaaatttgatttcggttcgggtcggttcgataatcggaaccgattggttttgcctaaaccaagaatttgcagccatatctccctgccatgactttatgaaggcctcatcgattgtggtgctaaaattcacaaaacaatctggccagatatctagaccggcaatcctttgaaaccagtatacggaattcaagtgtaaatcttgcatccacattaacatcgtaagatggatataagtttttgtttggatatgtttaatatgtagcattggaatgtgatttgtagagatatgcatttttgacggtcaatcattcacggaaagatatttacaaacagcaatactcctataaaaacgtcgcacaaacaaacaaagaaagacatcagggttgattcttgaaaggaggcatgtcagccaggtgtgtttttattgaaatctcgcgcatgtgacaaaaagacaaatataccctttaaaccattttatttttttaatcattttgttttctttctccaatcattcgtattcctctccttgttgctgctgctctctctcgcatcagccatggcggtttctatgtttatccctccaaaacctcctttcttctaccctctctagaccttcctctctcttgattcctttcttcgtatctctttcagtcgaagccaaaccccttgaatttccccgatttcaaatg

SEQ ID NO: 36532 - DNA, 3003 bp, Unknown
  misc_feature (1)..( 3003): 2750-1469P.txt file - cDNA_ID_3097360; gDNA_ID_2936553; Annot_ID_194122
cgactcattgtttttaaaatctcaagctaatcgatggaaccgtacggaaccgtctcagcacaatcacagccactagcaaccatcgttacaaggatggcctgcagctttggttctccacacgctcgtcctcttagcccgagtgttctgtttttctatgtcaaactctgtttctacttctcttctaaatttcagcatgaagtagcatttattgtataaacgttttttgtttgaatataattttacattctttcaaaaaaaataaaatctcaattattttgtgtgatcttaacaaattactccagtataaaatctatgatttatttctccacaatgttcattaaatcaattttatataaactatttattactcttcaatatcagattggtaccatattccttaaaaaaccactacatatatttattccaatttagttatggtatcaaatattttatgtttggctaccaagagatttgagacataactcaattgcctataaatactcttcacctttaacgtctcatcgcatcatctaatcaaaggttagtcttatggtttttcattagatatttgatgttttttcagtgtccaattattttttttaatacatggacataattcttttcccaaaattttatggttaaaaataattttctttttgagagttctttttttcctcatcatataatgttttttttttataaagtttcatgtttaatgttttctatgtatgcttttccttctgattttgtttttaacaaatataatttataagatcgttaataatttttgtttgatttcttgcaggaaaataaaatatgtaggatcctcctttttctatttgatctcatcttccaaatttttataaacatttgagcaattgatgtcaaagtgaatacaaaaacaggaaatatagtagtcttatataagacaattgtttactatataacaactatatgcaaacaagaattaatctacggatttaaacctaaactaaaaatgatcactaacttgatgaacaagttaaaagcccaaacctatctctggatcagaaagaaagagaagctaatcagagtctcagagagagatttgggcttaaaaagacataacaggcccaataactcaattaagcccaattcggataacacccctgcgcacaagatgatgcgtgaaaagataagtcgacggctcttctccgataagattccggtgagaaacgagcaggtcctgtcttcttatgaactcaatttcttcatttctgattctataaaacatccttaaaaacatgtctaccacattgttgagaacaattcagctaaaccagttctcacttctcggaactagcttgttaagaaggagaaggagtaacaacttctccgtgaggtcttgtggaagccaaacaacgacgacccatgaagctaaacagtcttctccaacaagggttgctccaaaaaaccacaaaagcaaccaacttgatgagattctgagagattacgaagctgtaattgggatagagactcatgttcagctctctacattgacaaaagccttttgtagttgctctaacaattacggttcttatccaaacacaagtatttgtcctgtttgtatgggtttgcctggtgctttgcctgttttgaattccaaagttgttgaatttggtgttagattgggtttagctttgaattgtgatttgtctcttaagtctaaattcgataggaagcagtatttttatccagatcttcctaaaggttatcagatttctcagtttgatattcctattgcatctggtggttatgtggatgtggatattcctcttgagtttggtggtggacataggagatttggtattactagggttcatatggaagaagatgctggcaagttacttcattcagacacaggagattactctcaggttcatatggaatttatgacacgtttcagtttggttttatcagattcttgtaagggttttaggtttcagatgcaagatgtttgtgtttcttatgtgttagttggttactctaatggtgcaggtagatttgaatagagcaggtgttcctttacttgagattgtttctgaacctgatatgagaagtggtatagaagctgctgaatacgcttgtgaaatgcaacggattgcgaggtatttgggagtcagtaatgggaatatgcaagaaggctctcttcgctgcgatgtcaatatctcaatccgtcctattgggcaagctgagtttggcaccaaggtcaacaagtttctttctctctatatttctttgtcatttatgtgaagggatgatccactcattaatctcgttgctgattcgagttacaggtagaaataaagaatttgaacgcgttttcagcaattagcagagcaatagactttgagatatcaagacaagcacttctctataatcaggggaaagcagaccagattgtaacggagactcggctatgggaagaaggcgctcaggttctaagctaaaactctttcatcaggtgcttcctttttccatcagcaactaacttgagtagatgttcagaaaacagtaacaatgaggaaaaaggaagggcttgctgattaccgctactttccagaaccagatcttccagaagttatccttacccaagaatatgttgatagcattcgtgcttctttaccggaactccctgaagcaaagcgcaggagatatgaggcgatgggtctaggcatgcaagatgtgcttttcctcgcgaatgacgtcagtgtaagtcctatttgctcaatgtagatgatattttagatacataatgaacctacttatgttatcttcacaagaagacaatggtgagagctaaagagtaaactttctgatcaatttggtgagaatatagatttttttttgtataacagcaagacgagtaaactgttgtttgaatgaatggcataggttgcagaatatttcgatgcagtcattggtaagggtgctgaagtgaagttggcagcaaattggataatg

SEQ ID NO: 36533 - DNA, 3000 bp, Unknown
  misc_feature (1)..( 3000): 2750-1469P.txt file - cDNA_ID_3097376; gDNA_ID_2936553; Annot_ID_194117
caccggagaagagaagaaatgagagatcagagagaattagtaacaattgaaggactttggagagaaatgaaaaacgtgagttgaagttacacacaccgccgatttatgattcctctaatgatgtatacatatatttttttaatataaatcatccgatgcggtatgtgtatatcccacgtctgctttcctgttccggaataaacttccaatattagaaattcaatcatcggatataaatatatatatttatttttattttgaacaacttggatataaatatataaatatataaatatgtcgttaatatcaaacttaaaataatgttttacattatttatttttatatttaaagctgataagcattataataagaacccttattctcaagttaaaagagagcaattatttgtagtgcattgagtcattgactcattcattctacacaacaaaacatggtaataatgtggttgagaagagctttcaccgtcgtctcgatccctcttcatacaaagtttgaattcttgctttgggtcatgcagtgcctcattattgatttatctttgattaatgttttttttagataagaattaacctatagatcgtagccatcccggatgaatggccttcttttttatagagattgatggtttttctcgtttaaagttttttttggtatgctcatgtccttgttaaaaaggctagatttcatttgttaaaatctagcatttatgcttcgtattggttctcccatacggagaacttcctcttttactgttgttagatttcgtttgttaatatatcaaagtatttttgtttttggataaaccctaagagttcctaagaaagaggttattttcggaactgtaagagttaatagtcatgaggttaaattacaagtacatgtacactgctgagctcccatgttcataccaagttcgagtgtatggagcttacccttggcattatgaatttatgagcaagctgcaaaacttgccacatagaaccagagccagaccaaaaaaatataaggctccatacgaattatggaaaaaacaattcttcttgagattatataagtcattaccatataatatttttaaaattaaaaattaaagtttataaatatattctaataagctgattttatataggttccagattttaaaaagaaaaaacataacaaaaagagaacgttgaacacaagttttagcaaagttgtcgatagagggacacaatgagatatggttcccatacgttactccaaagtatccctttttacttggttggttgtgaaaaacagaatttgagtagagagacaatgagaaagtggtatgtaatgtagattcgagttgcattttttgcaatgaacaggtagagagacgaaggaacacttatttttccactgcgcctactcaaaaaagatatgggaagacttaacaaggggaattctctcggacagatattcggcgagttggacagaggttatgaaaactttatctaaaaaccttctatacaaaacgaagagctacatacttaggtatgcactacagacagaactctatacactcaatttggaatgaacaaaataggaggaggcatcaggcatggggagcaatcatcaccgacggaaatacttgtgaagattatagacaagaatcttagaaaccgtttgagcacaattcaaggtagtggaggattgaagttcaaagatggcatccaagtttggtttaaaactttgaatcaaggcaatagataatagacaattagaagttccttttctttaaaaaaactctcaaaacaattagcatttcatatgtaacaagtttatttttctttttaatataatttaacattaaattcaaaaagaaaaagttttaacatatttttattataaaaatctgaattaatttagtaagaaataaataaaaatacttgttattcgaaaaatctgaattagtttaattagaagtaaataattacaaaaattatctattaggtccatatcaaataatttatatagatattatcttctaacattaaatataactataactattcaaatttgtatctaacaattattactttagtgggtgcaaatatatcaaattccagcagtgttgaaaatttgttagatttctttattcatatataaataataatatgcccaaaagtttctaatattaattaaagctaaattttcgaaagaaaaaaaaatgttatttgactgcaacgataatgaaaaattaaaaattagttggattgattaactcaattataaacaaaaatacgaccgaaatatcttttattaatcaaaaattcaaaactataacttttgtacatacataataaattattacacgatttagtatgaacatataaaatcacaacgataattaaaattagttagatttattaatttaaatatttaaaattacgcgcgaaaggcgaaagcttctatataatatcaaaaaattcaaaactatgtaatttctttctatttttctccaaaaatttaaaactcttcaagtcacaataaattcatttatgataaaatcttcaagaaattatattcatagtcttatcttttttgttttcttcattcatagtcttatctactttactcatttatgcatataaaataagaaaatgcagtccttagtacttaatcttcagtttgaaagtcattaacgtttaatcatagtcaagtttcgtctttaacaggtttgactatttgtttccctaatcttcttcgttttaggctttaataaaagattagtgtcccacttaacagttacgtccgtcgtcttcttcgtccattcatcgaaagcttggttttgaattttcttaagtttttgaaatcgtaacggagattgaaggtaagagacatagcgagaagagattttgcttttgaattggatatggcgttttggaattttgccgtaacgtgtttgttgtggtaaggtttgaggtttggaaatctctcgagagaagtcaaatatg

SEQ ID NO: 36534 - DNA, 3003 bp, Unknown
  misc_feature (1)..( 3003): 2750-1469P.txt file - cDNA_ID_3097382; gDNA_ID_2936553; Annot_ID_194116
tcgtggagcatcggtgagagtaggaagagatacggagaaagaaggtaaagggtattttgaagatcgaaggccttcgtctaatatggatccttacctagttacctccatgattgctgaaaccaccatcctctaagctttagacttttcttcgttttggttctttgtatgttcttcgaatttcggtttgatatggtttaatttcgcatttagacttttctttcaaataagttacgaaatgttatgtgatttctattgtttgatccggttacggttcacttttaagccaaaaaatctaccgttatgactcgaataatttgtaaccatcatcctcggctaagctttttagttacatttgaagtcattcagtgaagggcgtttgcattgtaccatagcatccatattagattatgtttgaataagggcattgaccaggaaaaaaacaattgaacgggcctgactttattagcccatatatcaaatttaccgtccgttattgttcttttacttttctagttacgtgttggtccaaaagaaaggattgagaaacaagaaacttgtatacatatctagaagttagaacccatttcgtttcaagcctaattaacctctaccgttatgacttgaattcgaagccgtgtctatgcaaaagttgaccaaaacattgatttttcttttcttatattcaagattcaagctatgtcatagaagctaccctaaagctacatgcctacattatgcagttttcgtccattgatgattgatctgtaacgtttaattatcaggttataagcatacacacattttttcctcgtctatgatacggtgaaagcattaatataagctataagattatatatctcgtagtcgaatgtataagtatttttttgtttttactgaacgatgtatatattatacttggattaatatgggcttatagagggatctaattaagaattagacgtatcttgtggtcaggtaaagtcagtagatacgttcacgaaattcatgtaaaatatataactaaataaactacttgattggtccacctgcacgcatatactcaactacatatatgtatatatatgttcatgcatgttacgtatagtttattattgtaagccggtattttcttcatcacagaaataaatcaatatagacgccaagaaaaacaaaaccaactagaaaaagtcatttaatatttgaatcttttacgagaaaaatagaattataagtttctcgaaactatctaacagaaattctctccgaccaatgaagaataatcaatctttttgggtatttgctctggtctttcacgagcaaatgaaacttataattaatggtagtatttggtgagaagaaaaggagccaaaccacatgaaagaaaaaaaatgtaaatattaattgtagttgtcgtttcgtttcgtgtaacgcccaaccatgtatcgcagcacgttacagcttccttttgttgctgtatgtgtaaatgatctaacctaataccatactattgcaaagaaataaaactattcctttgtcatatactactaaattctaggaatagttgacacataaccataaacttaaaagaatttgtagatttcttacctccaaacggagtaggacatgtagtacatcttaaaactaacagaaaataaaaacgttacaaatcatgatcttggccccttatagatagtcatgatagttatcgacaaataacgtctaagcatgcatgcatattattgacaaattacacttgagaaagttgtatattttgagatcaaatatttgataatatgcgcatgcacaacttatatggcatctaacaaatggtcccggactatagtaaaggatgatacatattatagggccaatgtcgagaatttcttagatacaaaacaaaactaaaggaggtcttgtttacagagtggccgagacagacacaaaacgaagaagatttattccaaaaactttaatgtaatcaaatgtggttgtgaatttgtgatcatcttctaacatgttacggtcctaccaactctctacccaccctttttctccttttttaattctatattaatattatcaacaacttcaatcttattatactccataacttaattctctatgttccttaataatccattttctagagaacaaatggttaagaaaatgtatatttttttaatgttgtgtatgcatttttatcaggtattgatgatgaatcgtaaatttcaaaataaaataaaataaatactattggttaagaattatagaaaattgtaatttccaaaaaatatatttataatcaatttttaatatgttttttcttatgtgtcaaaaatctaaaaaaatagattaattaggaacatataactagggttctcaattatctaggagtctttatgctaattacagaatttagattaatattagtctgttattttactacttaaaactgatattttaattccatttactgacagtaaaaaaaacagaacagaaaaaaaacaatgaaagatggaaaaaaggagaagaagaggattaggctgttgactgctttcactccttttacagctctcttcttctctctttaataataaagttttcatttttatacctttctctctctctctctctctcttcttcttcttcttcttcttcgtcttcttctctgaatagtcacaatgcgagtcttcttcttccccaactcgtccatggcgattctctctgttttcctctccctccttctcctctctctccctcttccatcaactcaagatctcaacgccgacagaaccgctcttctctctctccgctccgccgtcggaggccgtacatttcgctggaacatcaaacaaacctcgccgtgtaactgggccggtgtcaaatgcgagagtaacagagtcaccgctctccgcttacccggcgttgctctctccggtgacattccagagggtattttcggtaacttaactcagctccgtacacttagccttcgtctcaatg

SEQ ID NO: 36535 - DNA, 3003 bp, Unknown
  misc_feature (1)..( 3003): 2750-1469P.txt file - cDNA_ID_3097390; gDNA_ID_2936553; Annot_ID_194114
ttttgtcttctgtgaatctacaatttttttaaaaggtttttcgtttttgctaataaaataagaaaaacggtggcgatgatgaaaaaaaggccggacttacggctactaccaccgtgaaagtgtggtgggtagtagaatgatgctaaagtatccaaaggttacagctgagcctcctctttctacaacttcacccatttttatccgatcttcactattattttgcctcaacttctttctcaatcaaagttcggtttaacgtttcggttcggttcggttatatcggttttcgttttttttgttaaattttttggaaaagtatgctgaattgatccgatattaggttcggttcgggtaggttcggttttcgggtaattcggtttttaactgggtatgtgcaaaaaaaaccgaaataaccgaacagaaggaaatacataaaaaaaaattgggtttgtgcaaaaaaaaaaattcaactgggccaagctaaaatacataaaaggcccattgtaaaaccatagaaaataaatgcaatcagaaggacagtttaatttttaacccatttcaaagaaaacaattccaaaaaataaaatgtcagaaaagaattttcttttagaataaagacagtgaagagatttatttcaaagcctgggtttaagctgctgagagaacacaaaaaaccctaacaaaaatggaatcgaaagcaatttgcttagggtttcttcctccaagacttcgattttcatctccacgtttactctctcttcctccttctcctcctgtaagtgaaatttaaccatcaaaatttcatttttttccatttcgattcttccaaaaccttatcctaaaatttgtcaatatctcctgattctataggcttcttccacatttgcgacgcgtcacaaacttgattccagacgtaagtatctctatcttaaatcctcctacttcacccagattgtagcataaagactgatcctttttctcattttcattcttgtttaagaaaccctcctttggaacaaaccgcaattgagccgagttcgtgtagcgtgttcttcttctcaatctgactcaagacctgagaagaagcaatcggataagagtaactatgctcgagctgagctgttccgtgggaaatcaggttctgtttctttcaatggtctgactcatcagctggttgaagaaagtaaactggtttcagctccgtttcaagaagagaaaggttctttcttgtgggttttggctcctgttgttttgatttcttcgttgattcttcctcagttctttctaagtggtatcattgaagctaccttcaaaaacgacactgttgctggtaggtcaggttttactactgctttaatgtttaacatcggattatgacttatatgaatcctaggaaggaacaaatggagtagaagctatctatcttagtggtgttacatctgctaactcattatgttttagtgtagtaggctttggctttgaggttttgataggcttagtacatgttttctgatgtgcaatattagaatcctttttttcactattatcaagaacacatgacctgagccttagaaagtacctaaacgagatctcataactctcctaaagctaagagacttagcaaatgatctatctcttgttgtatgatactcattttgatgctctctcttattataatttcttgatgcagaaattgttacttctttttgctttgagacggtgttttatgctggtcttgcgatattcctgtctgtgactgaccgagtgcagaggccgtacttagacttcagctccaagagatggggtctgatcactggactgaggggataccttacgtctgcattcctcacgatgggtttaaaagttgtagttcccgtatttgctgtttacatgacttggccagctcttggaatagatgctttgattgcagtgcttcctttcttggttggctgtgcagttcaaagagttttcgaggctcggcttgaaagacgtggctcatcctgttggcccattgttccaatagtctttgaggtaaacttatattctgattttgaccattttggtcttaagtttgtctgcccatcttcttgtggtccatgatgttgtagtcttgttttgagtaactatggttgtgtatgtcatggcaggtgtataggctgtatcaggtgacaagagcagcgacttttgttcagaggctgatgtttatgatgaaagatgcggcaacgactgctgaaataacagagcgaggagttgcactagttggtttggttgtgactttgcagtttctagctgttatgtgtctctggtcgtttatcacttttcttatgcgcctctttccttctagacctgtaggtgaaaactactagatctcagtgtttagtgattgttagatgtagccaaatcccatcggttttgttttgtttctgtgttcatttcagtagtaatgaattgtattaagtcactttaagaattggttgatcatgtgaaatgagaattggctggaaatgttatagaacgatcctacttaacttcagtatttgatgagatttcttattggagactcttgtgaccccttctctaaagtttcaatgtgtgaaatcacaacataagtaacacaacaatagatgggtctggtctcagcttgtgttttggtcctttgtatgcaacaatagagaagctgaatgcttatccacgtggaagatttgtgcctccgataggtgtctttaacagtgtgacgtgtctgtattgtttcattgatgaatctgttacaccgttgagtgattgattctcaaataaattggtcccaaagctttttatcaatatgtgatggttattaatggatacttaataaaagatgccattatactaatcaacgattattgttgagaaaacaataaaataggatctcaagagaaatagccgcttctataaaaatagtgagagtgactgagatcaatagaaccaatctcagaatcatcttctttctctttcggaacaaaaatg

SEQ ID NO: 36536 - DNA, 3000 bp, Unknown
  misc_feature (1)..( 3000): 2750-1469P.txt file - cDNA_ID_3097401; gDNA_ID_2936553; Annot_ID_194111
ctccaataagaaatctcatcaaatactgaagttaagtaggatcgttctataacatttccagccaattctcatttcacatgatcaaccaattcttaaagtgacttaatacaattcattactactgaaatgaacacagaaacaaaacaaaaccgatgggatttggctacatctaacaatcactaaacactgagatctagtagttttcacctacaggtctagaaggaaagaggcgcataagaaaagtgataaacgaccagagacacataacagctagaaactgcaaagtcacaaccaaaccaactagtgcaactcctcgctctgttatttcagcagtcgttgccgcatctttcatcataaacatcagcctctgaacaaaagtcgctgctcttgtcacctgatacagcctatacacctgccatgacatacacaaccatagttactcaaaacaagactacaacatcatggaccacaagaagatgggcagacaaacttaagaccaaaatggtcaaaatcagaatataagtttacctcaaagactattggaacaatgggccaacaggatgagccacgtctttcaagccgagcctcgaaaactctttgaactgcacagccaaccaagaaaggaagcactgcaatcaaagcatctattccaagagctggccaagtcatgtaaacagcaaatacgggaactacaacttttaaacccatcgtgaggaatgcagacgtaaggtatcccctcagtccagtgatcagaccccatctcttggagctgaagtctaagtacggcctctgcactcggtcagtcacagacaggaatatcgcaagaccagcataaaacaccgtctcaaagcaaaaagaagtaacaatttctgcatcaagaaattataataagagagagcatcaaaatgagtatcatacaacaagagatagatcatttgctaagtctcttagctttaggagagttatgagatctcgtttaggtactttctaaggctcaggtcatgtgttcttgataatagtgaaaaaaaggattctaatattgcacatcagaaaacatgtactaagcctatcaaaacctcaaagccaaagcctactacactaaaacataatgagttagcagatgtaacaccactaagatagatagcttctactccatttgttccttcctaggattcatataagtcataatccgatgttaaacattaaagcagtagtaaaacctgacctaccagcaacagtgtcgtttttgaaggtagcttcaatgataccacttagaaagaactgaggaagaatcaacgaagaaatcaaaacaacaggagccaaaacccacaagaaagaacctttctcttcttgaaacggagctgaaaccagtttactttcttcaaccagctgatgagtcagaccattgaaagaaacagaacctgatttcccacggaacagctcagctcgagcatagttactcttatccgattgcttcttctcaggtcttgagtcagattgagaagaagaacacgctacacgaactcggctcaattgcggtttgttccaaaggagggtttcttaaacaagaatgaaaatgagaaaaaggatcagtctttatgctacaatctgggtgaagtaggaggatttaagatagagatacttacgtctggaatcaagtttgtgacgcgtcgcaaatgtggaagaagcctatagaatcaggagatattgacaaattttaggataaggttttggaagaatcgaaatggaaaaaaatgaaattttgatggttaaatttcacttacaggaggagaaggaggaagagagagtaaacgtggagatgaaaatcgaagtcttggaggaagaaaccctaagcaaattgctttcgattccatttttgttagggttttttgtgttctctcagcagcttaaacccaggctttgaaataaatctcttcactgtctttattctaaaagaaaattcttttctgacattttattttttggaattgttttctttgaaatgggttaaaaattaaactgtccttctgattgcatttattttctatggttttacaatgggccttttatgtattttagcttggcccagttgaatttttttttttgcacaaacccaatttttttttatgtatttccttctgttcggttatttcggttttttttgcacatacccagttaaaaaccgaattacccgaaaaccgaacctacccgaaccgaacctaatatcggatcaattcagcatacttttccaaaaaatttaacaaaaaaaacgaaaaccgatataaccgaaccgaaccgaaacgttaaaccgaactttgattgagaaagaagttgaggcaaaataatagtgaagatcggataaaaatgggtgaagttgtagaaagaggaggctcagctgtaacctttggatactttagcatcattctactacccaccacactttcacggtggtagtagccgtaagtccggcctttttttcatcatcgccaccgtttttcttattttattagcaaaaacgaaaaaccttttaaaaaaattgtagattcacagaagacaaaataactttttttaaacgaaatcactgagaaacgaaaaatcagatagaaacgacgacgacattcttacacaccgattggggtaaaactttttagacgcgaaaggcgagagaaaccctaattgtcttgatgggtcgtattctgggctatatatgtttcccataatggtctaaaatcccgcttaatgggctttgagaaatataaatatgagcccaacttctattgtgtcaaacatgaaaaattacgaaattaatttcccgtaattatcaaaagaaaaaacgtgagtgggtattattggaagagataagagtcataaaccatccacactaaccggtttaatcactatttatcgacatcatcttctcctacattctaggtttcttcttcatttctcctttctctggccaaagttccgactttttgcttctcccagaggctaatcatg

SEQ ID NO: 36537 - DNA, 3000 bp, Unknown
  misc_feature (1)..( 3000): 2750-1469P.txt file - cDNA_ID_3097413; gDNA_ID_2936553; Annot_ID_194109
cattgttctctacaggtttgtcatatgctgatattaattaccactcggctattatataggtttggatattgaattagattgtttcttgggtctttaggagaattgctgaagttaaggagaaagagagaagaagggccttggaagagattttgtatgcgttagtggttcagaagttcatggatgctaatgttacacttgtaccatccataacctcttcatctgcggatccatctggtcgagttgatacttggccaactctagatggggaacttgagagacttcactcgcctgaagtttatgagatgattcagaatcatctttccatcattcttaaaaaccgcactgatgatctgacagcagttgcgcagataagcaaacttggagttggacaggtatatgctgcttcggtgatgtatgggtatttcctgaagaggatcgatcaaaggtttcagcttgagaagacgatgaggattctcccaggtgggtcagatgaaggtgagactagcattgagcaagcaggccgagatgtagagagaaacttctatgaagaagcagaagagacttatcaggctgtttcctcaaaccaagacgttggttcgtttgtaggagggatcaatgccagtggcggttttagcagtgatatgaagcaatcccggttaaagacatacgttatgtcctttgatggagaaacccttcaaaggtacgctacaataagatctagagaatcggttgggataattgagaagcatacagaagcattgtttgggaggccagagattgtgataacgccacaaggcactattgattcctcgaaggacgagcatatcaagatcagcttcaagggattgaagaggcttgtgttggaggctgtgacgtttggttctttcctctgggacgtggagagccatgtagactcaaggtatcacttcgtactgaactgaaatggcctctgtggtttatgaggatgtgccacattctttgagagggtttggggatttgttgtttgtaatatatgcgactgtgaactgaccaactaatatcaatacccattttatggtaatactacattcgcgatcagtttgtgttattcttctcgtttacatcttgaagtgcatcgttgttgtttaacaaaattagtgtctgtaaatgataattctggacatgaaaaattaaggttgttcttgaaatatgatcaaagaaatggacactgatgatatacacatatagtgtgcaaaggctgttcacgatactcttagtttcattcaggtccaataatattagaacgtaaaaatgcaataaaaaaaagctttacttatataatggttttgaggaaccaactccctatactcgtgaagattattactcttccttgaatctcttctccgttgcctccaagcgctccaggtctttgttgtatttgcagatgcggtagatgcacctgtcaatgaataaaagagatatcaataaaactacgcgagaccctgtctgtgagtgactgataatagctgatgatgttacaacttaccagtagagtagaattcctgcagcgcatagaaccacgttcctctgagccttgtagatctgtggtacaatgcaaacgcacaactcgttagcaagcaagctgagacatttcagggaaagagaaggaactaaggggtgaattaaatatccaagtgtttgattttcagtttttcactatgtataattgatcctggcgactcgcaactgcatacccaaaaaggtttgaatacagtgcatgaccagaaaactgagggatgaactaaacatccaagagtggtgatgaagcttcaccaagaatcaattgccaacaattcacaagagcaaagtataaactgaactatgaatgacaatcgtgccgatggtataaagaaagtcacatgttgctatttgacagtagctagaactacgattaaaagatatatgagtacatcaatgaagggtaagacctaaaaaaatgcattgacactaacaagttagacagtgttttgtagctctaatctatgcaacttcctcagacaaagaaagccaattctcagaagttttactaacaaatattgatctttagactaaagatgggagaaaatgacaaggatgaaactcacaaatctaacaatttactattcaaaaaaagattcatacacatagaattcagctatagaagaatcaaagacaaaggtgatcaaggaatggtacttacagatttctcgtagcgatcacgttctgtagcagtgcaaacctcagatgaacaagatagtctatgctcagccttccagtaaatatctgaatgaaatcaaaaccaaataagcaaaagcacacaaaggtaccaaatccacagaatcactcgcggctcaaaaccctaactatacatattccgactacgaaatagatagatagagcgagagagaggagaggaggttaccgaggagctgaaatccggcgaaggcgacgatggaagcagcaggttggagaatcaatgagacaagctgaactacacgtttcttaagaagcatagggtaagggagagtcaacacgagggtgattactacttcgacggccaccacatacgatagaatcagccattgcaacgccattgttgttcgtctttttctggatctctctctctctctatctctattccgtgtgaagtagacgaagaataataatagacgaaccgtgtgcgtggaacacgtgcctatgcttaaccattttttctttatcttactaattaagttattttcttacttaatgggctctcacctccggcccaatatctccatataccggttttattgtgctgattatcggtttatttcgatttaacggttagctttcaagaacaaatacagaaactagtcactctcttcttcttctctgccattgttgactcttgaagtctcaattttttctcttctttatttctccgtatgaacttctccgattttatggtttttatatccttgaaagctagctagcaccatg

SEQ ID NO: 36538 - DNA, 3000 bp, Unknown
  misc_feature (1)..( 3000): 2750-1469P.txt file - cDNA_ID_3097417; gDNA_ID_2936553; Annot_ID_194108
atgagacaattgttaaaaaactgaattttaacccctattaaaacagcatattaataatattttaaaattttttaaatattgattcaaatacatccaccatataacccaattccaaaataaaatccgttctataatttctttacccgtcccgtgataattttaaagtaataattttaaaattttaagaattattttttatatataaaagttttgcaaattgtatcattctctaatacatttatattttatagtttaattttatatatagtaacattatacataccacataacatttttggttttatataatcttttctaaatttggatgatttgatatgtttaatatcagtggtcttaaaaaataataaattaaagatttaacccgtattgaaacggtggattaattatattttacttttttattaatgtttattcaaaaacccgtccctccaaatctgtcttaccaaaaagccatttattttattaatgacatgactatgaattataatctaaacattttagctaataacataggagtgcactatatttatttattacgggaatataccttataacccgaatgcacttttacctaaatccaccaaaaaaaagtcttgtaaaaatattatagagataataaacgatagtcggttttgataggtataagattagcaaatatattagttagcttttattagttaaagaatacaaattaaaaaggtatattacactttattcaaatatagtatcaaaacttatataacacagagatttgataattttttaattgttgaatactttttttatgctaatttttatgtgattaagatttaattgatttcgtatataaaattattaaattgttttacgaacttatttgtttataatttggtaacagatagatattcgaatattcagtatattttgcttcagtttaggaaatctttgatgacccgtttttagatccaataagccctataatctagatattaacctgcagtataccgcatgtacgcttatattttagttaaactaaaaacttttactgtaaagatgatttaaaaatatatgatattattttatttgtttataaatgtatagtaaactgtgagttgtatatgttttgttgatattatctatattgtttagtgtttaagattatacatttatagtttgattgttaatttaagagttttacctgtagtataccatcttgtattaatatcgatctaaacccgtaaattataggattttccaccttgtattaaaaattgaatcacatcatacacataaaaaaatctaatatgttattaattattgtagtatataagattataaattttcaatataatatgtatgaaattgaatataaatatttcaaattatgacctgttactcagtagaaagttttcttaaatctatttttcacccgttataatatttttttatgtattgaacaatttatattcgtttttaaaaattcaaattatggcatatgcgaaaaatctaattctttttttataatgatgattttattttttcgaaaaaatagaatcatataaagatgagaagtgaactataataattaataaaaaattaatatgataatttagatatcaaatctactttgttgattttaattggttattttttcggaaattaataatgtattttgtttttctaattaaattaaattaattgaaatttatatatcaaatcttatatgttaattttgattggttattatttttggaaattaataatgtatttcgttttttaattaaatttaattaattaaattagtatttgactttttaactcttaaagagataaattaatttactctttaaatttttatttctaatggcatacctatgtaattacttacaaaaattaaggttatatttaaaatatacttcccaaataatatagtgggatgggatcctttgttttgtttaaaagtgatctttagaattagcctaagaaaataaaaatgtaagaaaaaacaaatgattggaaactaatcttataaatcattttgttctttatgacaaatcttgttaaactaacattgcttatacatgtgaaggacaagatctagtggaagccaagtgccaaagaaacgatgagtgccatcttctgccttgtgccaaaggtctagcatattgcaacaatggaacttgtgagtgtactcctcctcctaagtcatacaccgtggaaaaatctacaaacataccatgtaccacaaccaatgagtgtagacagaaaaaatgtagagacatatattgtcacataaccaataagtgtatatgttgtctcccaccaactgcaatacttttatgcgtagatcgaagatgtgagtgtatccatgatatataagtggtgtaaacttatatattggatatgaaatttcaaaagacattaattatgaaattgttattgtttttgaataatgaacttagttatactattgaagtacttggtacttaaccaatttttatcaatttggcaaaattgaccaacttttttttattgtaactctaatccaaaaatgggaaaatatcgttttatacttgaacattaaaaaaatagttattcaatacgtggactttgctaacgatggttatcggattcgttaacgccagttaacatcttgggaattttggtctggtcaatatttggttttgtgttaaataccgggtcaacgtttttatcatgttttatttgaccgacctaaaagttcacgtattaaatgatcattttttaaaaattcatgtataaaaaaatatttttctctgccgaaaattagcaaactttaaccaatatttcatcaaaataacataactaaccgaaattcgattaccggtaaaactgaaaaatgatttatcataaaagtattgatccgaattacccaaaccgacccgacccgagtatgaatgggccgaggcccataaaagaggaatatttgagagtcaacaactgaagaagaaagaagcaatg

SEQ ID NO: 36539 - DNA, 3003 bp, Unknown
  misc_feature (1)..( 3003): 2750-1469P.txt file - cDNA_ID_3097417; gDNA_ID_1971786; Annot_ID_57998
tcaatgagacaattgttaaaaaactgaattttaacccctattaaaacagcatattaataatattttaaaattttttaaatattgattcaaatacatccaccatataacccaattccaaaataaaatccgttctataatttctttacccgtcccgtgataattttaaagtaataattttaaaattttaagaattattttttatatataaaagttttgcaaattgtatcattctctaatacatttatattttatagtttaattttatatatagtaacattatacataccacataacatttttggttttatataatcttttctaaatttggatgatttgatatgtttaatatcagtggtcttaaaaaataataaattaaagatttaacccgtattgaaacggtggattaattatattttacttttttattaatgtttattcaaaaacccgtccctccaaatctgtcttaccaaaaagccatttattttattaatgacatgactatgaattataatctaaacattttagctaataacataggagtgcactatatttatttattacgggaatataccttataacccgaatgcacttttacctaaatccaccaaaaaaaagtcttgtaaaaatattatagagataataaacgatagtcggttttgataggtataagattagcaaatatattagttagcttttattagttaaagaatacaaattaaaaaggtatattacactttattcaaatatagtatcaaaacttatataacacagagatttgataattttttaattgttgaatactttttttatgctaatttttatgtgattaagatttaattgatttcgtatataaaattattaaattgttttacgaacttatttgtttataatttggtaacagatagatattcgaatattcagtatattttgcttcagtttaggaaatctttgatgacccgtttttagatccaataagccctataatctagatattaacctgcagtataccgcatgtacgcttatattttagttaaactaaaaacttttactgtaaagatgatttaaaaatatatgatattattttatttgtttataaatgtatagtaaactgtgagttgtatatgttttgttgatattatctatattgtttagtgtttaagattatacatttatagtttgattgttaatttaagagttttacctgtagtataccatcttgtattaatatcgatctaaacccgtaaattataggattttccaccttgtattaaaaattgaatcacatcatacacataaaaaaatctaatatgttattaattattgtagtatataagattataaattttcaatataatatgtatgaaattgaatataaatatttcaaattatgacctgttactcagtagaaagttttcttaaatctatttttcacccgttataatatttttttatgtattgaacaatttatattcgtttttaaaaattcaaattatggcatatgcgaaaaatctaattctttttttataatgatgattttattttttcgaaaaaatagaatcatataaagatgagaagtgaactataataattaataaaaaattaatatgataatttagatatcaaatctactttgttgattttaattggttattttttcggaaattaataatgtattttgtttttctaattaaattaaattaattgaaatttatatatcaaatcttatatgttaattttgattggttattatttttggaaattaataatgtatttcgttttttaattaaatttaattaattaaattagtatttgactttttaactcttaaagagataaattaatttactctttaaatttttatttctaatggcatacctatgtaattacttacaaaaattaaggttatatttaaaatatacttcccaaataatatagtgggatgggatcctttgttttgtttaaaagtgatctttagaattagcctaagaaaataaaaatgtaagaaaaaacaaatgattggaaactaatcttataaatcattttgttctttatgacaaatcttgttaaactaacattgcttatacatgtgaaggacaagatctagtggaagccaagtgccaaagaaacgatgagtgccatcttctgccttgtgccaaaggtctagcatattgcaacaatggaacttgtgagtgtactcctcctcctaagtcatacaccgtggaaaaatctacaaacataccatgtaccacaaccaatgagtgtagacagaaaaaatgtagagacatatattgtcacataaccaataagtgtatatgttgtctcccaccaactgcaatacttttatgcgtagatcgaagatgtgagtgtatccatgatatataagtggtgtaaacttatatattggatatgaaatttcaaaagacattaattatgaaattgttattgtttttgaataatgaacttagttatactattgaagtacttggtacttaaccaatttttatcaatttggcaaaattgaccaacttttttttattgtaactctaatccaaaaatgggaaaatatcgttttatacttgaacattaaaaaaatagttattcaatacgtggactttgctaacgatggttatcggattcgttaacgccagttaacatcttgggaattttggtctggtcaatatttggttttgtgttaaataccgggtcaacgtttttatcatgttttatttgaccgacctaaaagttcacgtattaaatgatcattttttaaaaattcatgtataaaaaaatatttttctctgccgaaaattagcaaactttaaccaatatttcatcaaaataacataactaaccgaaattcgattaccggtaaaactgaaaaatgatttatcataaaagtattgatccgaattacccaaaccgacccgacccgagtatgaatgggccgaggcccataaaagaggaatatttgagagtcaacaactgaagaagaaagaagcaatg

SEQ ID NO: 36540 - DNA, 3003 bp, Unknown; identical to SEQ ID NO: 36539
  misc_feature (1)..( 3003): 2750-1469P.txt file - cDNA_ID_3097417; gDNA_ID_1971786; Annot_ID_175473

SEQ ID NO: 36541 - DNA, 3000 bp, Unknown
  misc_feature (1)..( 3000): 2750-1469P.txt file - cDNA_ID_3097423; gDNA_ID_2936553; Annot_ID_194107
atttatatgggccctagaaatgaaatttgtctgaaaacaaaagaaatatgtttgtagaaaacttaactatttctctaaatagtccataggttcattattgttttatttgtaattattcattttcattgatatctatcgtcgtgtcaacatgatgtatcgtccgtatacgaatactcaattaccaaaacaatgataagaattcaaatgggttttctatcaagtagctttctgttgagtataccaatttgaggtaaagaccaaagtaaccagtgaaaaactaaagagccgtcaaatcaatttagatgaagaaaaagtaacattgaatactactattaaaacaaacaaatcattccacgtgatgactccaccacattcccaaagtttagaaaaattatcaaaccctgtcataaagtaacacttgcctaaaatcgcaggtctttttttctacgaaaacgaaagagagttttgtaaagtaaattcatatgatctgcccccaccaattcatcatttatctctttttttttaccgcttgttaaaactcataatcaatgcatcccttgaccttagaacaaaacctgatgagtcccacacacatgtcacttcgctgtccatgaagttttttgaccggaggtcaaagtaatttaattgacttgatgttaagaaatgatatgtgcagagaatcgaatgtttctttgtgtgtgtggtgagtgtgtgatggatataattattggaattgaaatgtaatttatgtaaacttctagatttcgaaggcataataactctctaaaataattgagaattggataatatccgatgattaagatagcatttacttacaagtaatgttttcgatagaattaatggtcactatccaaattccaaaccatacgctaatggcttccaaaggaaaactaagactttatggagttttacataaagtcttcgttcaaacatcattttcataagtcttttgtaactttcttcctcttaacggcttcctacaatatctcgatttagaactccaatcaacatctaatattttgtctacaactttatgttttttcaccttactatatgatctagacaatcttttgttaggtaaagtgtctagatattctttcacctaattaacacggaaacgtaaacttgtacaaaaacatctattgattatagaagagaaccgagccgtgagagtcgtttctcgtcaagaccgcaccaatcgactcaaacatgagccaaactgtacgtagttcttataaggaacacaaacctccatcgtaaaccaacgttttcgatcggttctagctagactcgccatgcatgcatgtgcgttggtgcccgtaattacgtacaccaatcttgattgatatcaatgcttatatgccgttaatcttcatctcgactctcgaggtagtagtacttgacgagttctaagttcttcttccgttatgagaaatcatatataagttcttctatacatctcgcttgattattataatctttcgccttttaatttctcgtttgattattataattaatgtttataatgaaaagaatcattatttcccaaagcaaacgaatcattttgagatagacttacagttatcacaaaaagaaatctaaacgttttccccaagatttagcctttcgtcagcatgtaattactcgtgacatattctctagctcatatttcttcttcacgcacgagcaaccaattttgttatatatgtataaatcatctttgacaattatatataatacagatttgttacgagtatatgaatttttttgaggtacagaagcaaatcaactagtgaaactaaattaaagagctaaccatcaaataaagtaaattgaattaaacaaacaaatcataccacgtgatgacagccaccacattcctaaagttagaaaattggcaaacctgtaaaaaagcatcacttccccgaaatcgcaggtcatatttctatgaaaacgaaagagagttatctatatagtaaatggctatattcatatttgccccaccacccatgacccatctcagttaataaatagttcttctattcacctctatactataatcattcactttatcttatatatagtctataaaactaaacgtaattcgcatgattttgcctttcgttgcatgaaaaatcctccttgacaatgtacaattcgttagtactactcgatcagtcgccttgactcacgacattttctctagccactgttttatcttcacacacaagtaccaattttaaactgttgtacttaactgtataacatcctttatacgtaacgtaagccaaaaattatgatctaatcagttactacagattaataataagattaataacggccggtctactaattttgaacacttgtgcatgcattatctctcgttgaaatagtaaattaatgcaactaactttacaagattaatcgaggtatattatagtctaaaacaaatatttaaattaatgcaactaactcttgaagattaatcgaggtaacgcatcacactaatcatatttaatcggataatacatatactgttagtaaaataaattaaaaaagatttggtagataaacgacaaaaatgtttttcgtcttgttgttttcgagaagcttctttttccggattaaaaaaacattatgcaattccacgtcatcagcgcattacaaacaatgaaagactacacacgaccttgggtcagcattccaaagacccaaccctgactcgccacgtcgacatatgccagctattaatgaagagggtaattccgtaacttactctaaccacagaacccttgaatttaaagtgtagcagtaaaatctcatttctttgagttatctcgtttgttcggagttagagagagagagaaagatatagagagaacacagagaggcgagagcgacgtagggttggtgtttcgtacggattttctcggtcaatcttagtttctccggcgagagattgcttttcaggtaaaaatg

SEQ ID NO: 36542 - DNA, 3003 bp, Unknown
  misc_feature (1)..( 3003): 2750-1469P.txt file - cDNA_ID_3097423; gDNA_ID_1971786; Annot_ID_175474
attatttatatgggccctagaaatgaaatttgtctgaaaacaaaagaaatatgtttgtagaaaacttaactatttctctaaatagtccataggttcattattgttttatttgtaattattcattttcattgatatctatcgtcgtgtcaacatgatgtatcgtccgtatacgaatactcaattaccaaaacaatgataagaattcaaatgggttttctatcaagtagctttctgttgagtataccaatttgaggtaaagaccaaagtaaccagtgaaaaactaaagagccgtcaaatcaatttagatgaagaaaaagtaacattgaatactactattaaaacaaacaaatcattccacgtgatgactccaccacattcccaaagtttagaaaaattatcaaaccctgtcataaagtaacacttgcctaaaatcgcaggtctttttttctacgaaaacgaaagagagttttgtaaagtaaattcatatgatctgcccccaccaattcatcatttatctctttttttttaccgcttgttaaaactcataatcaatgcatcccttgaccttagaacaaaacctgatgagtcccacacacatgtcacttcgctgtccatgaagttttttgaccggaggtcaaagtaatttaattgacttgatgttaagaaatgatatgtgcagagaatcgaatgtttctttgtgtgtgtggtgagtgtgtgatggatataattattggaattgaaatgtaatttatgtaaacttctagatttcgaaggcataataactctctaaaataattgagaattggataatatccgatgattaagatagcatttacttacaagtaatgttttcgatagaattaatggtcactatccaaattccaaaccatacgctaatggcttccaaaggaaaactaagactttatggagttttacataaagtcttcgttcaaacatcattttcataagtcttttgtaactttcttcctcttaacggcttcctacaatatctcgatttagaactccaatcaacatctaatattttgtctacaactttatgttttttcaccttactatatgatctagacaatcttttgttaggtaaagtgtctagatattctttcacctaattaacacggaaacgtaaacttgtacaaaaacatctattgattatagaagagaaccgagccgtgagagtcgtttctcgtcaagaccgcaccaatcgactcaaacatgagccaaactgtacgtagttcttataaggaacacaaacctccatcgtaaaccaacgttttcgatcggttctagctagactcgccatgcatgcatgtgcgttggtgcccgtaattacgtacaccaatcttgattgatatcaatgcttatatgccgttaatcttcatctcgactctcgaggtagtagtacttgacgagttctaagttcttcttccgttatgagaaatcatatataagttcttctatacatctcgcttgattattataatctttcgccttttaatttctcgtttgattattataattaatgtttataatgaaaagaatcattatttcccaaagcaaacgaatcattttgagatagacttacagttatcacaaaaagaaatctaaacgttttccccaagatttagcctttcgtcagcatgtaattactcgtgacatattctctagctcatatttcttcttcacgcacgagcaaccaattttgttatatatgtataaatcatctttgacaattatatataatacagatttgttacgagtatatgaatttttttgaggtacagaagcaaatcaactagtgaaactaaattaaagagctaaccatcaaataaagtaaattgaattaaacaaacaaatcataccacgtgatgacagccaccacattcctaaagttagaaaattggcaaacctgtaaaaaagcatcacttccccgaaatcgcaggtcatatttctatgaaaacgaaagagagttatctatatagtaaatggctatattcatatttgccccaccacccatgacccatctcagttaataaatagttcttctattcacctctatactataatcattcactttatcttatatatagtctataaaactaaacgtaattcgcatgattttgcctttcgttgcatgaaaaatcctccttgacaatgtacaattcgttagtactactcgatcagtcgccttgactcacgacattttctctagccactgttttatcttcacacacaagtaccaattttaaactgttgtacttaactgtataacatcctttatacgtaacgtaagccaaaaattatgatctaatcagttactacagattaataataagattaataacggccggtctactaattttgaacacttgtgcatgcattatctctcgttgaaatagtaaattaatgcaactaactttacaagattaatcgaggtatattatagtctaaaacaaatatttaaattaatgcaactaactcttgaagattaatcgaggtaacgcatcacactaatcatatttaatcggataatacatatactgttagtaaaataaattaaaaaagatttggtagataaacgacaaaaatgtttttcgtcttgttgttttcgagaagcttctttttccggattaaaaaaacattatgcaattccacgtcatcagcgcattacaaacaatgaaagactacacacgaccttgggtcagcattccaaagacccaaccctgactcgccacgtcgacatatgccagctattaatgaagagggtaattccgtaacttactctaaccacagaacccttgaatttaaagtgtagcagtaaaatctcatttctttgagttatctcgtttgttcggagttagagagagagagaaagatatagagagaacacagagaggcgagagcgacgtagggttggtgtttcgtacggattttctcggtcaatcttagtttctccggcgagagattgcttttcaggtaaaaatg

SEQ ID NO: 36543 - DNA, 3003 bp, Unknown
  misc_feature (1)..( 3003): 2750-1469P.txt file - cDNA_ID_3097476; gDNA_ID_2936554; Annot_ID_194178
gttggtacaatttttatgtttgcttgacagcaaagaaattattaggtcttcttaatagaaaacaaacacattttatattataaacctaggaaaggaagaatgtttattttggaacaaaatcaatcagaatatcatatgactgattaataatattttctgatatcacctcttaaataatagaaccctccataataggtctaggaaaaggtatatattcagtttacatttctaataagtatcatttctttctgtcgacagtaagattatttctacatgtaatagtactataataaaaaacgaaattttaaatagtgatatgaaatttgttcccgtatataaggtgatttcttttgagtaataatatgcgaaatctagtgcaatattcctaaacaaccataccaaaaacactaaaataaaataagcaggatcctaaacaactaaattatactaagaaacagccaatattacatgtctggtactgtccaaaatcttgtattttgacataaaataaagtaatatatatgatctcacagagtcacagcagatggcgtaaaagcatgtgaagattgatgcaaatgatttaagttgtttcccgtgacctgcagacgaaacggaatgtccatggtccatataaaccttttcgtcgttcgtggaaccgtcctccaagaaaacactactcttttagataaatatgtacttgttttatcgtcagagaaatatagatttttctagaaaactttgtttcaacaatttatggaggaattatgatatgaaatagacgttatacccctattttaaaggaaatgggcaaacactatatgaattttctaaaaaaacaattttgcttagtgagtataaaaccgaaattaatatggattaaccttataatactgccatgcatgtctacatttttcctaacattgatacaaaaaaaaatgactgaaatttttcacatatttttatattattttatctgaaaactatgaacttggtaaagtttgacatcataactatgattacgcctcaatttcacaagattggggtttaattattatcagttacatctaatatatcttacattctaaactttctttttgaataattgatgttaattaaaaaacattattctactattgaactcagatatatcatgcgacatttataaggtctcgtatgaaacatctaccaactaataattcatggtagagaaggtttttaaatcttttgacaactaagacctattttaaatttatttaattcccacagaaagaaaattgaggtaagtcttaaaatatgataagtgaataatgttttgaggttgacgaagttttagagtccgatctctcacgttatgttaagaaaacaattttaaacaaagagttctttttattcatcttttaaattgttgaaatttattcatttaagtacttaaagttttaaatggatgatgtggagctaagtagactaaactgttaacgaattagaccactctatttttattaaataaacaactatttattatagattaaatttatttatatgtaaaatttagtctatagttggtacaagcggatttttttgtaattttctcaatcgacattactacattaaaactatataatttatgaatgataaaaaaccggtataatccgtaaacaaatttgtttgctttaaccgcaacaatttaaactcttaaaagaaataagttgtttaaaaacatttttagatacttgctacaaaatagaaaaacaaaagagttttagattccctaggaagacaaagcctgcactactttccactcatgagtctttcccatatccttccatgatctttctctgtgccatagacaaacccatacacatgtattatgcataatgtacataatccactactcaacatacgtgttttcttcatgtgatctgtgtacccacgacggtgaaaactcatatttgtcttctactctaaaatgtgattctgtctttttaaaacagttgaacccaaagttttacatgaactgtctatgccgtttataaaaatagactgtcgatgccgactattatcagatccggaatgtcttttcctataacattttaatatgattatttgtcttttcctataacattttgatatgattattcatccctagccgaaagaaagttagcacttgtttaagttggtaattagtattagaagcttgacatatacttgcatgattagtcttttaatttaatattaccacatatagatgcattatatgtacctaattagcttatattaattactttgctttcgtctcatataaagtaacatttatagtgctgatttaagactaaaactaatcattgagatggacttaacatctttcggatgtcaatttaatgtcattctctacaaggaaaaagattagattttgttgcgtaacaagaccagcgacataatgcaagtttgtgaagctttctaggaacatactttcacacctaaaaaacgaacaaaaaaagctaattaagcagttattttcttaataattcttattatcatgtgttatattcgtcgtcaaaataatcttgtaatagacatgtattaagactttaagaggtataattttccatttttgattcaaaactcaaaattgattagttagaaatagatatatttaaacaaattttgattttactggaacatcaagtttttaatgtacacggtaaaatcggacccaaaactacaacaaaatactattgtacgtccgtggcattagagttgagatcacctaaccgtgccactagcttgggtttcataattgacataattgtgtacattaaaatataagtattatttaatcacattaagaaatatgcacagaaactttttatcataattatatgtatgtacatgcattagtgcatatatacatacacaaatgagtgtataaaagcttgaacccatcgaacaagcttcatcacaaaaacccaaaacctttgatatttgtctaattttacaaagatg

SEQ ID NO: 36544 - DNA, 3000 bp, Unknown
  misc_feature (1)..( 3000): 2750-1469P.txt file - cDNA_ID_3097486; gDNA_ID_2936554; Annot_ID_194174
gtcacatgaacttgttcctcctcctttgatcataattttcttgtaaagtatattgtacgaccattgtagctaggctaagatttgagcagtgaattataagctttgccaatttagcaacagacgttatggttatagctcaagagttaaaagggtaacctaggagaatgcattaaagtcattttggatttgtctgggtcttgattctgagcagtgtgttgagagtttggtattgtatggtgagttctttgggtaattaaaggaaggagtttaccggttccaatattatcagcttgatacactatcaaacctataatgtcacattgatcaaaatggtgttgctgtcttttcaggtttgtccattgcgtttgatctcagcagtcaaactagtggactgaatggccagagacgcagaggccttgtggttagagctggaaaagctgctctgtgtcaaactaagagaagcagatcaagaaaatctctagctaggactcatggtttccgtagaaggatgaggaccactagcggtagagcaaccataaagcgtcgacgtgccaagggacgttggaacctctgtcccaagtccaaccctagcagcggcaaacgggcttgaagtttgtttctctcttcactctatctgtaatcttgtttcatgtgctttttttccaccagaagatacaatgagaaacatggttcgttgagctcttttctgcgttttaactctcttgcatccttgattcgtttataaatcaatgttcttggaattcatcacatgtactactatactacttgcttcattgaatttgttactactcgaagtctcaacttcaaagccataattacttaaagatctcttctggccaccaggataattctggtgtgtaagaattgttcagattccaagtagtgttaatggttgctgaaagttgatgtatatagtttggggttcaatccctgaaggattttactttcatttactagttttatttcaacctaacaattacttttaagtactaaccctaaattatattccccttaaaaagaaaactgcaccaaaaacaaactagttaagaaaaatgaaaccaaaactaaaaaagaaaagttccttcttattggaaattagggagggatcagattgtgtaaaaaagagagcgcccaatagtcgtaacaggctttgggcggaacgctcttctcgcaatataagcgagtttttaccattcatcatatcccctttaacttgcctgaaggatcatgccttttacgtaattagctctttcttttttataggcatgttactaccatcactatctctacctaaacgatgtgggacaaaataaactattctcttgtttgaaataaggtttcttatctcaaattcatatatctttgttttttaaagtgggtctataaaaggcctctgtagctctctttttttaaggtgggccgataaaaggcctctgtatccttttttttttttttttttttttttgtctacaatgtaatagtctaaagttttaaacctatctagatgaatgagctatttatcaaatattcgatccgtgtcactcctctactcatcaaactcttcataggaaggaaagtctccggtcataacataattcacatacgttattatgtttaaaaggtgtatgatgtgatggactagctagtagctagtaaaagccgtgagtaggatcttaggacgagatggcatgagaattccatttctattgcatattgatgttcgtgaaatggttgatatatgtttacattgagcaaaacacaactaaactcagctaaagtccaaacacgcgattttttttttttttatatagtgaattctatccatcatattacatggaaaatatctgtaatttttccaaacttatccaaccaccaaaatgcactttaaaactgatgaaaagtgcaaccagactagtgacacacattccatcgaatgaagagaaaagaaaacccaccaaaaacagattatccaaaagtgatcaaatccaacagattgttggttatcccgacacgccaacaaacttgtccttggggattgcattttaagagaaaacggtttctcataaccgttggaaattatatatagtctatatattcatatgatagtttctaatatataataatattattatttcaaatttacattataaataagagttatctgacacatgatgtgaaagtcacctaaaaagatgtttaaaaaaaagggtaaattgcgcacagtagccgttgactcacttttaattttagattttgacattgtgggctgggcctttcatttcttagccattcagccaaaaactgatcaaaatgcccctgacgaaactgaacccggtttgtacgtacggaccgcgtcgttggaatccaagagaaccggatttgtacgtacactgttcatcgacgagaaatgcattaaatgttttctaggtttcggcgaatttgacacttgagattgaaattaaaaattttaaaaattggttgggctcagaagtttttcatgctaaaaagttttgacaaaactaaaactcatgattacctattataatagagattatattgtaagatatttacataattgagattagaattctgagaaaaaaacgaaaatcgaaattgtgttacggtgaagaatctgaagttttcagttgctgttttacaaagtttgaaggattgaaggagagacaatctgtgttctgggtaagaaattcgtgttaatcctattaattacacttgagaacgtgatatgaaagtaatgatacgtttttaaaaatttctgggttcataaattgttttgttggagattctttttgtatttgtagatataaatgaaagctctatgatctgttttgttaaatttataagtacataaattgttttgttagagattctttttgtcttcgttgatataaatgaaagccttcaaaaatatcttttgtatttaatgttgttctgacctgaggaatttatgttgcaggtatg

SEQ ID NO: 36545 - DNA, 3000 bp, Unknown
  misc_feature (1)..( 3000): 2750-1469P.txt file - cDNA_ID_3097516; gDNA_ID_2936554; Annot_ID_194166
gaaacagattcgtcgcaattctttggtcggaaaacaatatacgtacgatatagtaaacggctggattggtcatttaattaatgtcaaaattacattccacatacaaaaaaatacatttcgctaaacttaatccccaagatagggttattttaggtttagggctaacagatgatttgtttactaacaaaatgaagtaaccaatatatatatacatgggcaggaagttgttgggcgttctcagcgattggggcgatgaaggtttgacaaagatatctggcaaaaatctattaacactgtccgaacaacagctaatagattgcgacatagagaaaaacggtggttgcaatggcggagaatttgaagaagctttcaagtacataataaaaaacggaggcgtttctttagaaacggaatacccttaccaagtgaaaaaggagagttgtcgtgccaacgccagacgcgccccacatacacagattagagggtttcaaatggttccaagccacaacgagcgtgcgttgctcgaggccgtaagaagacagcccgtctcggtgttgattgacgcaagagcggacagtttcggtcattacaaagggggagtgtacgctgggctggactgtgggacagacgtgaatcatgcagtgacgatcgttgggtacggaacgatgagtgggctcaactactgggttcttaagaactcttggggtgagagttggggagaaaatggttacatgaggatccgtagagatgtggagtggcctcaaggaatgtgtggtatagctcaggttgctgcttatccggttttttaactaatttacttaggtggttttttatattgaagtgatcatacattttgtagcctggtttatgattgtttacatgtggtaaaattgcaacttaaacttgaccttaaaaactgtaatatgttcattttattactccatataaacgtatttccctcactttcataataaataaagggatgtgtttttcacttaaatcgtgttccataagaaacattgtttgaattttcaatgcaaattttaaaaccaaatttaaaattatcgctaataaaactaaaattatagtgtaagacgtgttaattacaagtagattttgattttatttttcatcgaaaatgaacctttattaactttaatcgaatatcaaactagtacaaatgatggcaaatccatggggctggattagagacatccaaatagaaaggtgaatctacacatccatattagctaaatggtaagcggcaacattgttgcaacgttttgtgaaaaggaattggaactctttaaatttctgcgaccaataatggatatcttgacatgatatccttatgattaagataccttaggcagtattataagtagattagcaaaaaaacaaaaaaaaattatatatgaatccatcattaagcttgatttgtttttttaacttgtccaaataaaagtttagtttcaatataacaacatctacaacacccggttacatatgatacctcgaggtccacgacgacacactagtacactacatatacataaccaattcgcaccatatgatatttagatacccctttgacaatatcatgtaagggcttttttggaaagcatcactaacaagttaacaattggatttttacaaaaaccataaaaattttactcggtttagtagacaaatatattttggtgttatcttaccatttacaccaaaaaaaagaaaaaaaaactactagcagtattgattaaaaatttaaaacagaaaatatatatatatatatataccaaaaaattgtaaatagtattcttttgacctttgttttggagtgaattggttgatgaagaagaagaagaacctggtccgattctaaacctttttttgaatataaaacggaataaaaatattctgtgtttgagtcgcctaacaacaacacgcaccacccgaaattataaagtaaaagtaataaaatcaaattatataaattggcaaaagtcgaagaagatgatgattgaatgtttatttggcagtgaatggaagagatagagaggagcatgggtctctgtgaagaagataacgtagagagagttattatgtttgattctgaagcgtgacgtcactcagaaaccgtgaatcaaggatctttcttccactcctttctctgattttgactttctctcctctctctatatataagctcaacatcaatatgtctacggcttcttcttggattcaacaacctccttttagatacttaccggatcgtggcggtttctctaagccaagctctcgcagcgcgcggcagttttcctccggcgttgtttcagcttccgcttcttctccttcgccttcatcctcgtgctcctgtggttattcggagattttgaatttcgatttcggtaataggctttgatcttcgaatgatgtttgtcgtgtagatttagggattgattactttgttcatgtttatcgaatgatgcgttgttacatctggaaatgacctgacattgtactgcaaagtttcatagctgaggatttctcgatcaaagacgttgtttaggatggtgaagaatagtatcgcctaatttagattgaggaggagctcaattacagtgtctatatacacagatttgtccctgtttctgcaagagatagaagattttaagatgttagatgattgtgatatgccaagtagaattagtgatagtatggtttgtttggtcaagaatcggctctgtttttcttttgatttagagctcacaatttcggtgtctatttaaacagatttttccctgtttctgcgatcgaaaataagcttgaacatgttaaatgattgtgagaagctaagtagaaatggtgatagtatgatttgtttggttaagaattggctctgttctttatagctttttccgcgggttcatttgtttgatttttctttaagaagggtcaaacagaagctggaaccaacagggacgcagggttcaggcaatg

SEQ ID NO: 36546 - DNA, 3000 bp, Unknown
  misc_feature (1)..( 3000): 2750-1469P.txt file - cDNA_ID_3097520; gDNA_ID_2936554; Annot_ID_194165
tggcgggatcgatggagctggaaaacgactagcagaagaggtgagttttaatatcttcatttgcacctcgtgtataggtaggtcttggttttctagcccttaacttcagtacatgagctgatttctgttcccattctggatgtgagagaggaataggttagacaagttgtccaaaagagcaagagcttaaagaagatttcgtttttagcccactccctcggtggcttattttccagacatgctgttgctgttctttactcagcagcaatggcacaagtaagtgatgttgctgtctctcaatctggcaattcaaatcttctgcgaggtaggattgcggggctagaaccgattaatttcatcactttggcaacacctcatctaggagtgagaggcagaaagcaggttctcttcttctctacttatcataattggaattttggaatcaaagagtttcatatatatctcgcagtacctgtacgtagatgtggtgtatgcgtaattaagaaagtagttagtcgtttttcacatgtaaatttcatctaccttctccttgtgttcagacagatatcataagtttcatcaaaactgtcttgcgttttttgctatttggtcccctaagtgtctagactgatgagtgatgaatattaattgataatccctgtaaattctatctcattctctcctctttttctggaaccccttgtatcagctgccttttctgttgggagttcctattcttgagaaacttgctgcaccaatagctccattctttgttggtcggactggtagtcagttgttcctcactgatggtaaagctgataaaccacctcttcttttgaggatggcatctgatggtgaagatctgaaattcttgtgagtaatgctcttaccaatttaaatcattcgaccccttaatgacttatctgtaatcctaatgcatttcattgtctggcagatcggcgctgggggcatttcgaagtcgcattatatatgcaaacgtatcttatgaccgtatcctgtgcatttctgttgctgtttaactagtacagatgtgcctagctgtgtctgcatttgttttctgaactgtttcctttgacatcaagtagacatggttggttggcgtacatcttccattaggagagaaactgaacttatcaaggtacgtttcatgctatatgaagcaatggaacctttctatttaatattaccccacttgttttcatgttccttctattatgtaagttgatttcgactctgaaacgtgtagcacacactagctagatgatggggtcatcgatattgatagttagcttgctgtgaaatgctaacggtagctaacttatcctgaattttggaattatgagtaatcatagagggaaagtttcatagaggtaaagagtctaagaaatgaaacaattgtctgtagagaatcaccaaaaatactttcggcaattcatttatctcaagtagcttcgtgcaagaagctctctgtggcttgtaaccagtcaaatgaaactttgaaaattatttagctgtcacgagtgagatctgatagatatgtttttcccctgttttaatatagccttcacgccggtctctggatggatacaagcatgttgttgatgttgaatactgtccacctgtttcatcagatggtgcccatttccctccagaagctgctaaagccaaggaggccgcacaaagctctcctagccctcagaacacacttgagtatcatgaaattgtggaaggtgtagaattagcccaaacatttgattgattcttctaaatcggcatgagatttacaatttatacaaatattggtgcagaggaaatgatccgcggtctgcagaggttggggtggaagaaagttgatgtcagcttccactccaccttctggccttacttagctcataacaacattcacgtaaacttccaacatcttcactttggagctttttaattctttgaaacatggactaacagagattttgagtcttgtttcaggtgaaaagtgaaagactttacaaagcaggagctggagttattgcacacgttgcagatagtataaaacagcaagagtcttccacgtttattaccgccagcttataaatcgtgagcatttcgagtgtttgacccgttaatgctgagtgtgctacgacatttgaaccattcctgtgttttgcttttaccatacagtttgggagatcggtgcagatcaagaatgttcgcatctttgcttcttctattttttttcttggcgaaatcagaagaagtacaatccaattcatctgtacatgattttcttgtattagcttgttgatgatacaacacttgaaagatgttattatagattaaggtttcttaaagagaaaagttatatatgttcaacctctactcttcaaaataacagattcagctgaagacatttgtttctagtcaatttgtttttggaatttttcttaattcaaagaaaattgtgcaaaagctttcatgtgcggctcagattaattagtcatttactactaataaaactttcactttggggtctagtagataattctccacccccattgaatctttttagtggaggtctaaacatacataagattctatagattgacatttgggaaaccatcctcatacaaaaaagacctaaacggaatctatgaagaattattaacagaaaagaaaaacagatggcaatgagaaaagatcgggttcaaggaaaacacagccgtacaaaactcaagaacaaaaacaccaaaaataaacaaaaaaacttccaaaaatagatatagaatcacatggttttgttgttttgtctatttgttctctataaaaggagatatttggttggatctatcatagcgtctcctctcaaccaaagcttacaatttgttctcccttaaaaactaaattttacaaataaactctcaaatccaagagaggagaagaccgaagtaaaaacacaagaaaaaaaaggattaaggcataatg

SEQ ID NO: 36547 - DNA, 3003 bp, Unknown
  misc_feature (1)..( 3003): 2750-1469P.txt file - cDNA_ID_3097530; gDNA_ID_2936554; Annot_ID_194162
aaaatggtcgagacatatgaatatatgattgtaggagcaatgagaccatgactctaggtgttaacacaaattgtttgtatcatatctacttatttgctatctcttatatgattatatattacagtcatacatacccttattatcaggtttgagtttaatatttgttttgaatttaaagcttcattgtttgataaattaaatctaaacactatatggacgtaagccccgtcgaaagataacagaagtctaaagcaaaattaaaatttgttttgttctaatttctttcatttcaaaattataaagatattaattctagaaaatccatatagttatctcatatatgacaataaaatatttaatcagtacaactctaccaaataagcaaaatataagcaattataaaaaacttataacaaaaggataaatattttgtattcagtttaagaatttaaaacaaaaatagattacctgtttatggaacttcggtttttgttatggtagaaggtagattacacagaaagagaataagaaagatgatacaaaggattttaggcagaaagaaataattatgaaattgcatggcattgttaacatagactagaactctgttttgaatgcatagattattttttcgaaagagaaaaactttcatatcacatgatttttttatttttttttggatacaatcatacatataatgtttgatggatgaaagacaaagcgaacgccaagtataatttgttcataaaagatcagattttatgatatctggtgtttacgatatcgccaccagaagtatccgtcattttgaagaccaagttgaaacaccataaggggttgagtttgacagcctccctgtatggcttcctcccacttctatataacaccaacaactcttagttatgcttcttcttcttatattagttgagaatgaaattaagattttcttcaatatcaaagttggtgttttagatacaattgagtcttattatgaggttttgggttcttttgaaatcctttgatgtctcttcttccatgcaagttcgaattgtaggatacaaaaaaaaatgtctctcttctcttgtcaacttgaacaaaaccacttggaagatgattttccgtgttctatatgcttaatgacattactgcttcttgatttcctcttgtttttaacccaaattggtctctccccaaagtataatcttctgggtctttttcttgtaaaatttggcatgctccaagatctatattagtagctatctcttttttttttggtttttggtggttgtttgccttgttcactcctccatatatagtaactcttaaactgtcgaaacattaccgtataacatgtttgtttgtagtgattattttaatcgatgttaatatgcatcagttgcaaaaaaatgatattaattttgcatcattgaatataagtgatttattatttgtatcaatttatcaaaataacgttaatatttgcaacatttataataaataattttaagtgtttatattaattataataacttataaaataatactaaattagtttttatgaaacaaatatctttattaattaatattaagcgaacacttaaatttagttgggatagtaactttacactttttggacaccatctaaaaccagaattatgtaactttacatatataaaaaaattatggaggtttttttttccttctgtgggagatatgtggtatgtaaacaaattgaataaacaattatatcagttagtgcaactgatgctaaatctgtaattagcatcggttattattgatttaaattttgtatcactttctaaatgattaaaattcacatatttgtattaatattgtgaaagtgaggcaaatagacctagatttgcattaattttaatgaactgatgtcacacaaactaatacgacatcagttattgcaattgatgttaaattataatttttgtatcgattgtaaataagtaattcaaattagtattttttaaatttttgttgcaagttaattgatacaactaaccttttttgtagtgagattcttgagacataatatccctgcctcttcttcttcttcaattgttggggttgttctcccaatcataaacattctggtggatgtaaacataaagagcaagtgattttaactcttgtatagaaaactaggagtcttgaatgcattggagaaaccactttgcatcggatatgcttaactaatttacctagttccaagaattataaatgtggaattccacgattacaattaaaaattgtctacatttattgtatcatactagaacgtactatttgtaatatgtccatctcactcgttggactttgtttcaacatgtaaccaacccaacaattttatttattgacaaacaaacaaatccttactcaaataactacaaaacttgacgaaacatttatttgacattgacattctctcactttttttccgaaaaccacttcatttttaaattacaaaatcgaacatttattctgtaatcaaaattagaatttaatgttcatatcgtgcgaaccaataacctttctttgaaccaaaaataaaaataaaatccttcttttctcaaaaccccatcacgtaataacacacaaaatacaagggtaatttggtctttctacttttctgtaaaccccccactggtaaatgaaattggaaaggaatggcttgcgatattggcaatgtcaatgtctctctctctcacagtctctttccctctctgcctccaaaatttccctctctgtttttgagcagttaagctgcctcatcaatctcactcaccagaaacccatcaacaatcattaacctttttctcgttttcatcaaaacccattttctcaatttcttcaaaaaaaaaccttttgattctttctcctaatccttttcccagctctcttaatgctttagccacaaaactttttgtatctcaatgtgtgacagttttgtaccttttaagagaaaaaatg

SEQ ID NO: 36548 - DNA, 3003 bp, Unknown
  misc_feature (1)..( 3003): 2750-1469P.txt file - cDNA_ID_3097564; gDNA_ID_2936554; Annot_ID_194153
attaaatgccaatggcattgggttgtaaataaatcccaacttgaagatttatttcataaaagtgttgcaaaaatatatatatagatacaaaataaactaaaccataattactaaccaaactaaaccataactaaacgaagtatatacactctaatacaatctttttattaccatcaccgttcaacaccacctttccgtccgggtaatgcgaacgtgttaacattattacaacaccatgtaaaaatatagtttcatgttcggtaaattgatttataaacaactaaccacaaatgtagtccatccatataatttttgtcgatgtaagcgtgacttatctaatattcatcattatcccgaaaaaataacaatcacccaacattttgttctttattttcgcaagaatcaagagtcaagacttacctcctggtcctcctctcatgaagatgttataagttaaaacatgtcgtacataattttatcgacgatattctataagatatagcgtgtaaaacaaattaccaacatacatgattaattgattatgttagagggttaagtgaggaaaaaagagagaagaaaaaattgttactaaatttctagaaactaaatttcatcaacctaatttcatcttgtctagtgttatttttttccgtctaaagatttcattcattagctgcggtagagatatacaaaacagacaagaacaagatcttttcggagacaacattgatgggtacatagaaacctccaaagactaagacccaaattaaagggcaaacaaacataaggaggaaaagctcctaaaagataagctaatgagagaacatgtaaaaggactccataatagcaacacaactcttcctcacaagccaccgacaagcatttccaaagaatttgtaagtctagtgttgcctaactaattttattttgatttttaacaattagtaataaataaatgaaatcaatagttggtcaaaaattaaaaaacaataattggcatttggcactgttagcatgcaaatacgtttatgagggcaaccccgcaacggtgttggaaagcagcctgctgacaagagtgttcgttagccaaccgtttaatcccttttaattagtaaacacacaaaaacaaattgaatttactaatctctcttttgtataatggaatattcactggttaggtgagttttttgtaaagatgataattatggttctgtttatatgaattaaatatttttatatatcataaaagaaaaattatatacatattttgcattatgtatgtaagcatactttagtatgtcatacttataacataacttcagtgtaaacaaaatccaaactttcagaagatatgaagacaaagaaaactcctggtataataacagcataattattgattgaaataatatgtgagctaagttggtatttgtgtgtatttatttatccattctggagttattataaaataaaaggtttgaaaatgatagattgagttggttgcgccaattttttttgctttcccctatcaaaatgttgtcattctctaatcggcccacacctaaaatgatgatattccacaaaaatgcaagtgaaaagtgaaaaggtatctcataattgtttagttatttaacaatcacgctaccatactcagtcgtggtcagcttatataaactttataagtaacgcatagatctatggattctagatatgccaccaaaaaatcaactgtgtatattcttttgtaattgtaaacgatcaatcggtgacgaacgaacaaaactgtagttaaaagcagtacaaaataaataaataacgaatagagagcgcaacaccaaaacaaataataagaatattgctctttgcatcgtttttgctatcaattttgtgagtggtacaagattatactaatcagtaatcacgtccaatatttgtttgattttacaaccgaatttggtttggttcggtacttcggttaaatgttgtcaaatacactattcatgttgatcattgaccaatagaagagaaaataaatgagagaaagcgtaaatacaagtaaagaggaagaagagtccaaatgtaccaatcagctcgtgactactttcagcttacctttttcttctccaagtcccatcttcgtctccgtcatcttcacggcacatcctccaaaaacgcttagcttctctctctgttacgtttactcaagtcttttttagtctcctccttaactctcaagccttttccaagtttcaagcggctccaacggttcaatttcgcactttccgatttgtggcttcactttccggtaacgtactgatctcaatccttgtagctctaaaacgactctcctagtttcgcttattttttttcttgaaatttctactgtagaatgaattaagcatgtcgacgaggttattttagttgactatcgattagaatttttcgtgagcgttactttctccgtacattatcctcagttctgcatctaaatcttgcacttagttcttcatttcttgagatttgttatcattattctctactctacttagttataacgattatgacatcgtcacagtcttctatatgtggggtttctggtactcaattgcgcaaatccttgtaatgattgatgtcacgggtctgaaaattttgacaccgtcactagatttcataacttttaagcggtgttggtgttgcgttaaatattattattaaaattgaagtttctagtagtaaaaaagttcacagagagatcttttctttttgtctgtatctacctacttacttcagaattcagataataatcctttatacatagagaaagagatcatctactatatgattattatatggtttttatatggataatattcaagattactgaaaaatctgttgttttgttttgtttcagatctgttctagagaacttcaatatatatccatatatggtttcattggtctgtgagccatatcctaagaactaaactagctagctctcttactatg

SEQ ID NO: 36549 - DNA, 3000 bp, Unknown
  misc_feature (1)..( 3000): 2750-1469P.txt file - cDNA_ID_3097583; gDNA_ID_2936554; Annot_ID_194146
gcgtgggaaagatgatagatagaagaaaaagagaaggtcgatcgtattttgttctctttttcttttgaatactttatatataactatattgtttgtttttttaatatacgtttgtatattaatttatttagcataatgtggttgaatagtaagacacttaattgaataacattcatgtgtagcagtgtgagtaagcttctttcacaaggattttaaattgagaaaatttgtggtcgggtagagtttgtcggagattaatggggttaattataagcacttatacgtaattatgtctagatttattttactttttattatactaaggtgatcaatgatcataatttgtttttattctatatatatatatatatatatattctcatatatatgtaaaaataattgaagaaataaatatttcgaagataaggtaccttttttgaagtgagtgaacatactgtaacattcagttagataaaaaagagaaacaatgttagaaaatgggtttcttgattaagagtttagatgtaaaatactaaagttaccaagcaataagtgaataactaatggttcaataacatagtcttcattatcaagacgtaatcaattgggtaaggtcttcctttccgcttacctaatagactcaatacttttagcaatttgattttgcaacttgattatgagatgtggaaagaaagaactcaaaatgcatcaaatgatttttaagccatattgatccaacatatccataaaacgattcacaacaagtttggatcgatcctcctttagctaatcggatatctcatattgcatgcttgctctgaattggtctttcttttgctcttcacgtgtgtatgattttatccatactttatttttgtgcgtgtttttatctgtttcaatgtaaactccaagtctccaaagtccaaatgatgtctctgtaaacgaaaacaaaatgatatagaaaaagtagatttaattaaaaaaatcaataccattcgcatttataaatatgtttctaaattaggtcttagtttgtttgaatattttattaatctattaaatatatagatgtttgaatgtgtgtgtatgtgtgttatgattacttaccataccgtatgataattactacatcttgagctttaagaaacaatcgatgtcgcttgacaaaataggatgtttaatacttatacatttttagagacaaattggttaactggattctattccgaagattaacacaaattcagattaaatagtactaggatttaagtaaagcaccgcaatctaaggatggctctaatagtttgaaattgcacattacttataaacactttttggattaaaatttaaagtgtaaaagaattagtacgctgttttaggtataatagtttaggctaagccatagtccattgaacgatatagtgggtgggtccaaaattgtttaaaactcgtgaagccaagtaatctaaatcatcatgatatctgtcttttaagttcaataaaaatgaatttgtgttcacaatgccattacaagaaaagtttaaggttgcgcttcgaagaagacctcatcattgttactttctttttcaaagtcacctgcggatttaaagcgtcctttttttactctttgttgttttgttgttgttgttgttgttgtcgtcatttataactttttttagtattacaattaacatcatcatataattgacaatcaccatatactgaaaaagtgttgggccttaactttttttagctagacaaagtgggctgaattaatttggtctctttgaatagtcttggttgagttctctttgaggattatagagaatgtgtggattctgctctgtcaaaatcttttcttttggtgtgaaatggacaccttaatagttaatattcaggcagttgagaactaaaccctcctaagatcttttttgccatctatttttatacatctttcatttgagttattgattttgaaatccgggttctagaataagattaagtaaccagtcctgtaagtagtaactactgacatattaaaacaagaagaagaaagaatcacaaaaagttcattgtgttgattaagcaagtgtacacaaaatagaatagtcaaaacccccaattgattgagcttggataatattaaatactagatttaaaataaaattattaatagaaaaattaaatattttgtttatataattaagttacttatggtagaaaagcttttaatatctaaggtttggcaagactaaatgtaagagtgtgagtgatggacagtgggtttacaagcgagaatatataagatttgtataatcttttacttgttgataacatattttgttagaattattatatagaaatcataaaaataatatattggataaaattgaaaattctcacttgaaataaacaataacgtatttttaaaagaggtttggatatttattaagttgaatcaaaactcattagtcaatcttttcataaaatttaataagagtgtatttactatttagtcatgttttcatcacttaatcagaaacgaatgtattttgccacgtgtatccgtattattggttcgatgacatgtaattcgtgtaaaacttcttacaaaaaaagcttcaacatcagcttcaagatcaatcaaaaacgaaaaaaaacaaaaaaaaaactttgaatccgtttgttgcttcttcgcaacgttctctctcaaactcgcagaggtaaagcttcttctgatcctcctcttagccccagttttgatttcgcattccttctgtgatttcgtttctagtagatctgtaatttcatgattatcaaattcacaatgcggatctgagatttcgtggataattctaggtagatctagtttccggagatatatcgtgaattgcttttggttgaatatcaagatacatgtagctagtatgtatagattcgcattttgtttcaagaatttctcaataggctctaaattttgcagtaacagattcgataatg

SEQ ID NO: 36550 - DNA, 3000 bp, Unknown
  misc_feature (1)..( 3000): 2750-1469P.txt file - cDNA_ID_3097588; gDNA_ID_2936554; Annot_ID_194145
ttcgcaacgttctctctcaaactcgcagaggtaaagcttcttctgatcctcctcttagccccagttttgatttcgcattccttctgtgatttcgtttctagtagatctgtaatttcatgattatcaaattcacaatgcggatctgagatttcgtggataattctaggtagatctagtttccggagatatatcgtgaattgcttttggttgaatatcaagatacatgtagctagtatgtatagattcgcattttgtttcaagaatttctcaataggctctaaattttgcagtaacagattcgataatgggaggaggatttagagttttgcatttggtgaggccattcttggcttttcttccagaagtgcaaagtgctgacaggaagattccatttagagagaaagtgatctacactgtcatctccctcttcattttccttgtttgtagtcagcttcctctctatgggatccattctaccaccggtgctgatccgttctattggatgcgtgtcattctcgcatcgaatcgtggaacggtgatggagcttggtattactcctattgtcacatctggattagtgatgcaactcttagcagggtcaaagattattgaggttgacaacaatgttcgtgaggatcgtgctctcttgtaaagtgttcccttttggtaattttcttgatcaagtcgagaatcgttgtctcatgtgttgtttgtgttgtaggaatggtgctcagaagcttctttggattctgagtgctattggtgaggctgttgcatatgttctttcgggaatgtatggtcctgttggtcaacttggtgttggaaatgctattctgatcatcctccagcttttctttgctggaatcatcgttatctgtcttgacgagcttcttcagaagggatatggtcttggctctggaatctctcttttcatagcaaccaatatctggtatgttaaaaagagctcatcttttacatcaaagtgcttgtctttgtaagggaagagagttttagatacagagattcttaaacgttttgagttgattgtggtgatgcagtgaaagcattatctggaaagcatttagccccacgacaatcaacactggtcgtggagctgagtttgaaggcgctgtgattgcgttgttccatatgctgataactaagtccaataaggttgctgcgctcagacaagctttttaccggcagaaccttccaaatgttaccaacttgcttgcaacagtgttgatcttcttgattgttatatacttccaaggcttccgtgttgtgttgcccgtgaggtcaaagagtgctcgtggccaacagggttcatacccgatcaagctgttctacacctccaacatgccaatcattctccagtctgctctcgtctcaaacctctacttcatctctcaggtacttgtgctttcttttgtttcctcattaagggacaacacagctgagaacataaagttgacaatttgcatttcctcttcaacagcttctctacaggaaattcagtggaaatttctttgtgaacctattgggacagtggaaagaatcagagtacagtggacaatctataccagttagtggtcttgcatatttgatcacagctccggcaaggtaattcacaagtaacgtgtgtccccatcaatataacaatacttgatttccagttctctgaatatttgttttccacggttacagttttgccgatatggcagctcatccattccatgctctgttctatatcgtcttcatgctcactgcttgtgccctattctcaaaaacatggattgaagtctccgggtcttctgctagagatgtagctaagcagctaaaggtaataatccctaaaccttttctccattgctaaataatttaaacatttcgacatggaaagtgaatttatttgtaaaatatgattaggaacaacaaatggtgatgccgggacacagagagtccaacttacaaaaggagctgaaccggtacatcccaacagcggctgcatttggaggagtgtgcatcggtgcgctcactgttttggctgatttcatgggagccattgggtcggggactggaatcttacttgcagtcacaatcatatatcagtattttgaaacctttgagaaggaaaaagccagcgagcttggtttctttggattctgattgtttctagtcatataaaggggtaaattttgctaagactagtgagaaatttgaaagcctaattaagaagtagctttcctcttatgtgttcattcaaaggttcaatagacgattaaaagagcattttggtagacactttttgattaaccaacagatttttctctattagttgttactttgtgttagaatttttttcttcaaaaattacaccaaatttctccattggttactagtctgtgttttattttgctaatttggactttaagagctcatgttatctttggattgaggaattgaaattcagcaaatcgtagaatagtagtaattgtgctaatctccaaatagaacccgagatttggcaactgaagcaccatccatccaaagacggtttgtttagaaacaaggtggttgaaggttcaatcaaaaccctttagtagaaatttacatatatatacactagattaagatcaacagtaattaaaaatttcatgattagcagaattcatcaaaaaaaaatttactaatcaatttatgaacataaaaaaaaatcatcaattaaactgacttttttgttttaacacaaacactttagcattttgtttacaagaaacgaaaattgaatgcaaactataaacagagacaaccaagtagtatttattaactgtcccggttcaggtaacccgaattgattttgattttgtacccggtttagaaggagggatacgacaacaaaagcggtgaccaaaatcaaaacgtagggttttaaaaagggtttctcttctcttctccgtcgtcgagcatctgcaaattatacggcggcgataaaaaatg

SEQ ID NO: 36551 - DNA, 2486 bp, Unknown
  misc_feature (1)..( 2486): 2750-1469P.txt file - cDNA_ID_3097593; gDNA_ID_2936554; Annot_ID_194144
gaattcactttccaatagatcactcatttataaattgcttcaaatcaaacacatttaattataaaattgtttaaaaagtttgacctaaaaaaaaagtgtattttagtgacatgatcaaatcaattattttaaacttttcttatccaccaccacatttctagattttggaatgattaaaaaatgcatacatgatgtttttataagatttttacggtgttggttctattttgtttttcttattgccattttttcgattattagtgttttgtatgttaaacttgccgattgttccaattactataatataacaaaaacaagttttagctatcgatttttccaaagttttacaacgaagtttttataagttaacatgaagtaataatagtatatgttttaaaattatacgtttttttgtatgaaattaaatgttacattacactattaaagattccaataattaaaacacatgttacaatgagtaaattttattatcagacaataaacatctctttgctctaagaagaaacctatgctagtgaagcgttgactctggaaagatgcaagtgcaacgtgtcgctgaaacattgaaggcgcgtgtagaaaaatgttaagctaaagggaagttcactttctttaaccaagttttgcgttttgcaaattacaactaaagaatccactaaagctaacccaactaaattcaaacatttttctatgtgatcagtttaccatcaaactatttcatatttttgcaatgtgtagtaaaaactttctttgttacattatatgcttcttttataagcaaaaataccatattacattacatgttcatttcatttttgtttggtatttgcgcttacaatttacaaaatgattttgtttgatactatttacatttacatgtgaaattattgtgttcatcgtaaaacgttcaaaatttctaaaaattgtaagaaattattgtaaatgtaaacaaagtcggtttcctataaaaccacacgtctgaaccaccttaatcatcatcacaacatgaaattacaaaagcagcgactttgtcgattgccgtagtttcattgtagcatagataatcccgtcacgtgatgttatctatttttaactgtttcaatgtagtcagaaaagctatttgtttgatttcagaactgtttgattagtggccattgaaaaattctataatctatagtcaatagtctatacacaattgaaaatggtatagttgattttttaaaatacgccattaaataaaattatatatagaacttctctataatcgataaagtcgaacactccaggcaacaagcggaccgaccacggagtctaacgtaagagtattattagtgatactgtaggttttctttgactaacgataaagaaaaaacaaacatgtttaatttctcgtgtcctctatattcatgagtcatgacgttcatacaatttattcttgttttaaatgacgttcatacatcattttcatggttgtctattagttcactagaaaaacgaagtcttgaacgttgaagcgaagcattgaatatcattttataattttatggactaaactatacatttcaatcatctttgcaaaaaagaaaaaaaaaaatgagttagatcataaggagtcaggacaacagctagcacaaaaatctcaaaatcctatactgtttaacccaaaacaaccgtagaacaaatattattatacacccaaaaaaaaaaacatatttgcaatcacattagtttgtaaacacttctatttcgttccataaccaaaaaaaaaaaaaaaaaaaaaatcaacattcaattttttattttaaaacatgtttgcatatgttcatggtatgacattgggtattaatctatcacagagagctaaagcccatataaataataacagaaggcccatatctattaataaccaactcttaaccggtccattctaactgtttttctcaaatacaaaacacgtggataacacgaggaattaaaattgaagttaaacaccacaccatgtcgcgtacgaagctgccacatcactgttctattaacacgtggcttaatatgatgcaatatagacccaccgatagctggcgctttctagtttaccaaggtgcgacgtaccagataacaccacctctccacttttgaaaattaaaacgctctcttttggtaattatttagggaaacttcgataattaatcgaataatgaaggactaatttgcagttttaaggaaataagtaagcacacacgttagagaagaaagaccgttccagattgccacgtcatcgtctcctctcaacgagtttctgcaaaacctgaaacgtgctgcaccttgcctctctttctctctcttccttcgtttctctctcgatttgaagagagaaaattcgttcgatttcgttttctcttcttcttttggattttcccggaaaattttggaatcggtgagtctctatcgattactggtcaaccatg

SEQ ID NO: 36552 - DNA, 2846 bp, Unknown
  misc_feature (1)..( 2846): 2750-1469P.txt file - cDNA_ID_3097634; gDNA_ID_2936555; Annot_ID_194232
  misc_feature (1)..(760): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcattacttttaaaacagaaatagtaaggttagaaaatattcaaaaagagtgcatgtcttttaaagttgatgggtcggtcttatagattgcgcatgtcctgtatctctcccaaacattgtggaccggtctatgtatttgtgaaaggaaatatgccaacttttactagtctctctctcgcatgtgtgtgagtgaaatagttttaatatttcaaatttatttccaaaacaattcttacaaggattatcaactgcgcagcttaaaaaatccaattatactcaactagtattatcactctatagttcagaatacttttcttgaaaatatgaaatatatataaactataaattttatgtttttatattatttaatgaagacaatcaatgggattaagaccattaacgtgtgaaacataagacatatatgatttatcgtaaggttgagaatctatgtatgctttttcagggaccaaaaggaatatataacatcccttcagaaaaaaaaagatttacatgatttgggttgttacgtttcaaaaagaaaattaaaactctagtttaaaatctggtagatgtttcagccccttgtttaataaatctgaaacgagattctcaccatcatttttttgggataaattatcactattattttcatatatatgttattttaaattgattattaattatttagtagaatggtataatcatgaattataaacaaatacgtggaataaaataactaaatcgagatgtttaattaaatcaacttaattgtcaaggaaaagatttattttagttttatcattaaatgactaaaccaaaataaactaagcaatataaaaagcctaaagcaaaggaattgacgaaacatgcctaaagtgtatgacatagcgtatttgaatgaaatttgttcacgagaaaaagatcatcttctccaaaccctctcaggcctcttttctctctgttcacatctgtttcctcgtcacacaagacatatacattaacctaattcaactgttccatgtcttttaaagttttcttgatggaattaagctgatgcatgttattttatgttgtaattatcatcatttatggttagttagtcaattggtctatttatattatatgtatatcaacgtaacgaccctatcatatgcatttggatctgcatcaccaagatgatgactttataatatccaagagatttaacaatcttaacaatccttctctctcttaatcttgattgccataagtcaaacttgagattatttaattactatatggagcccaattatcgcatgtaaatgaggttaatataaataggcagatttaaactaacatatatgtcaatggaatttgaataactaagagttgtttagtatttcacagcaatgcaaatatacaggttttaagaacaatatgcaaatgaatttaagggatatataaaaagttcttaaagaaaattccatagccacatatataaagaatttgttaacttaagctatcatatacttctttttagtataaactttatttgaaaaatttgcatgtgagttcataaaggtttcaacgagttcctaaataaaatctagctaagaggcaatattagatgagtatagtgaagaccaagtgagtatatcttttggcagacatatgcaaatcttgtgaatatgattggattgatattattcaacggatcataaagaaagagcttgattggaggattaaacagcatataaacaaatatgatattaaacaaaaaataacatataaaattatagggaaagcctgcacaggtaatattgaccaacaatagcttctttctaactagacaaggccatgtgtgttgtaggacctcccaaatatatattttctaataattatttcatcatttgccaatttattatataaccatttctcatccttctcctcataccaccaaaaaccaaccttcaagaacagagaagaagtgattctctaaacaacaaaaataaaataaaactcttctttctctatttctgttgaaggtacctcatcattgcaacacaaacttaaagctttgtttgtgtctgctttcagacaatg

SEQ ID NO: 36553 - DNA, 3003 bp, Unknown
  misc_feature (1)..( 3003): 2750-1469P.txt file - cDNA_ID_3097639; gDNA_ID_2936555; Annot_ID_194230
tatgaatcgttatctttttttctacgtcttccaaaatcggtttatctttcgccattttggttttaaaataattttggcaatcaatttgaatcatagaggcatgtaacttaaggtaaagactatttccttatcatacatgtatacatgtggtatttacctactcattggttgagttcgaacatgacaaaattacttcaacgtgcttaccttcaatacacacatgcaatagttaccttcaaatacacatgcaatagttacttcaactatgtatagtttctatttatcaaacagaactatatttttgtttttgataaataatacacagtatatatacttctataggtctacaattcaacaacgatttagtcatgatataaaaattttaatcaaaaatcaggaagagtaaacttctcaattcagttcttttattaacggtactaattaatatgttatatcatatagtatgtgaacttcctagactcttttcggattcatttgttttccttgaatatatatgtgccacttgatcaaatgatgggctaatcacatgctttacaatactcatgattgcaaagtctcgcaatctttcggatccaaatgattaatttcatttcgtttaatcatgatttattagatatcaaattatatacatgatttcacactgaaggactgaaaaggaagcgatatttatatttctaatatagaaactttgctatataaaactactccttatcgtcttcttaattatttttttgtggcgtttcatatgactaatctcaatgcttttataatgattagtagcatgagcatgaacatgttcgttatccaagaaagaaaataaacaagagatatatcgtgtgaatatgaattacttttgtgtataattattactgaataatgtcataatatatatatatatatatatatatatatatatatttttaacatcttcattctttattaatttgaaaacgataatacaaaatgtatcaatgaacatacacattaaagctccacaaaccatacaaccaatacttaagtagcacgaaataaacgagaaagtgaaaaacactagaaaatagtatcatatgattgaaaaatactactgatattcaatgaattttcaatttagtcgagtttttccgggttttttaatttttgctttaatgaatgatagtacacaaagtaaaaattaactaatctataatatatagatgatttacatatgatattggttttggtcttagagttttaatctaatactagattttaacccgcggtacaccgcagaactatttattttattaaaagtaactaagaatatattattttataaattatctatatgtaacatattgttttgtatttataaatatataatctaatttctatatattgtacaatcccttgattttatcatggaatacaccgtaagtcgatttttaaaatttaaaatttaaaattatatatgatttttgttaagattgttttttttgtcatatattttaaattatatcattgtattttaattgttagttataggatttcacccgttgtataacgtgtcgtattactataaactcaaacccgtctgaccatctaattccgttcaatgaaattaaacatatttaatggatttcatcctaggtatactgtctcatattactatcaactcaaactcgtcctaccatctaaccccgttcaataaaattaaatattattttattatttttgttttaataatactttaattttaaatatatataattcaaatcaatttcaaactttttattttaaatggttatttaattgttataatttataaagttcatatattttaatattctaaacctgtcataccatctaatcccgttcggtgaaattaaacattattttttttgttttgtttaaataatatttttattaaaagatttataattcaaataaatttaaaatgtgtctttcaaatagttatttgatttttataaatttcacatttaaaatatttctctatatgtaacatatagttttatattttataaatattataaacgttttataaactttaaataattacaatatttaccttttaataaagtataatattaataatcatttaaataatcatgtgtagctaattttaaggaatttgatttaaagttagttgtttggattaaatttgaatgaataatgtgattgatatattaaatcaaaaattaaaaatcaaatcaaataattaaggaaaaaaaaaataatgccaatggcatgccattgtaaataagtgtcaagtagaggatttatttgctaaaatggttgcaaaaatgtatatgtagatattctgaaatttaaatttagttagttttttttctttcaactgaaatatattatataaaaatttacacatttcaatagaaaaaaatatctatgaaaactaaacaaacaaacatattaaaatccccgaaaacaataacccttagaaagaaataatgttgaaaaagacataaaaatacaaaccaatgaaaccattagtttacttaatcccgttagatgagcttctctcttggagttttggaactattatatagaaaagcaaaattcagttacgaatgcggtttatgtataaaagaagtcacaaaatatcatcactgtaatattatagattgtaaacagagaaatacaaatatataattgtccgaccttatgatatacactactaagtactaacctacgcaaataataccaattaatcttcagcttattcggaaaatttcggctaattcatgttagatacggacaacgtcggatttaacccaaatcctcaatgcaaatgcacaattttctggtttgtttcgtttttattttctggttaaaaaaattcagattaggtttgattaaattaaaaataataaaataaagattgagaaatcactgtggtcttggttcagtcttttgagatagagataatttctgagccgagccgaggaagaagaagaagaagagatg

SEQ ID NO: 36554 - DNA, 3003 bp, Unknown
  misc_feature (1)..( 3003): 2750-1469P.txt file - cDNA_ID_3097654; gDNA_ID_2936555; Annot_ID_194224
caaaacatcattttattcattagcgtgaatgcaaaaaaacaagacctgtagcgtgaatgtatcgctcgaacaacggcttctgagaccctgcaaagagtcaaaacttccaagtaatgaatgcatatttcctatagtctgtagataaacacaaacatcaactggaaattccctcatgcccctaatgttagctaccacggagacctcgagattacatttcgattctttaaaatcaactcttgagttacctttaatagtgcccaatactttgataccccttcctgataaaccctaaaaccccatttcagctaaaattatcactacattagaaattctaataaaccccaaaaaacttgacattgtcgttggtctgttgcatatacacctaaatcagctcagagaaggcgataaacctcgaagagcatatgaatgtcagtttttgattcctttttgaaacaagcaaaaattgacgaaatcaataaccctagtttaacaacttttatacattaccttgacgcaatccgatcgcggaatcaaaagttcttcgagcttgtacatgccgcagaacctacgatataaacataaattacaaaatgatttcagctctctcgaggactcaatttcaaaattgaaaggaagaagaagaaaacgatgaagctaaatctagagagggatgaagaaaacaaacccagttgaatcttcgcatgactcttgtgaattcaaagctaaacagagaggaaaaaacggagaggtttttgattttgagagttaaacccttagaccatttccatgataaattccaaacaaacataaatcaaaaatattaaaataataattttttaatcagttttttttagaatattttctgaaatgagaaacttggagaaattttatctctcttccaaatgtcatcttgtcattaatttcttttctttgttataaataaaatcatttatattttataacatcaattaaatactttatatgtttatttttttttttttttttacttttaaaattcataaaattaaattatctatataacaagctctattatatatatgtttaaattatatacgaatattatttaattggtgttagttaagcattaaacataataataacttataaatacaatagtttttttttaattagaaaacaaacatttaaaattttctatttttattttacaacatttttggcaatcgaattcgacttcgtgatagagatatgcaccaacaactaaaagatgacctagttgagcatatatgacaaaagtttggtgcattatcaaatgaagagtaaaaccataatagataatatagttagttttgatttatgttatcatggttttatatgtaatttctgtgtaatttatatattttttctatttaatttatgttatcatggttttatatggaattttatgtttaattgatatattttttattatgattttatatgtaaagtaatgtttaattatgtttaattatgtttaattatggttttaaaaataataaaactatttaataatataattgtaaaaataataattgatatgtttgaaaatattgtagagattttaaatttaatataaaaaacatataataatatgttaatgttaatgagatactcataagagtatttcaccaatggaagcacaattttagtataagtttctctacttaaattaaaatattaataatatattatgaggtactcatggagtatctcaccaatggagatgctcttacgcatatgctgacgagagacgagagaagagacgttcgctaaatcttttgctttctcgccactacgtccagagtctctctctggttcagaagactcgaaatgggttaaacacgtattctctcattctccgtagttaattaatttagtgaaacggtaaaaacaaaatggtaaaaaattggcggtcgttattttgtagcggtaaagaaaatagtgagttagactatttacaagttaactgtttgaattaaaagttgaaagtgatttggaaaaagatgttgtagaatttcttcaacaccgttaattttgtgaataaaatccttgtacacatatagtcttagaaaatttggaaaaaggtttgataaatgtaacttagatgctgcttggattataaaaagtaagctttatggatacggacttgagttcccaagatcatttaggttcaatctgattttgaggtttatataagaagcttcatttaaaccgttgagtgtttgagctatatgaaacttcaaaaaaatgtcattcgtttaaataccatcaagaagaatgtgaatcaacttttctttttggatgaaaactagttttttgatatggtaactatgttttcaacacaacaaaattttatcgtcgaatgtccgaaatgataaagacactcttaaccttcatcggaaaaaatagcaattttttgtggtatatcaatagcggttacaatctaacttgttttgttgttgttattatgattagaactgtcaattgggtggaccgcatgtgggtttttacagtccaaatacacacggacggattatggtctggactccaaactaaaaaacataaaccaagcaatcaaaaagttagaataagatattttttagttaaaacaaaaatcgtaagtgaagaaggtctgaatttcttgaggaagataaacgggcacaaaaccggtgtacatacatggattatggatatgttctagaggaaaggtataattgaatactagtatccgttacagaaactaattgcattaagtttcgtctactgtttaagaccgcacgagatatatatgttagaccgactttgggaaagaggctacttaaattatttacgattaataatgccaacgtaacgcggacagacattttaattcaattattatttgttgcctgcgagattcgaaccatctcttatttcattacttaacccaaaccaaaaaaataaaaagttcatttcgaaagaagaagaagaaaacatcaaatcatg

SEQ ID NO: 36555 - DNA, 3003 bp, Unknown
  misc_feature (1)..( 3003): 2750-1469P.txt file - cDNA_ID_3097681; gDNA_ID_2936555; Annot_ID_194217
cttggcagttattaatcaatattcaatcatatagttgaaaacattctgcaagatattaataaacatatgtttctttcaatgtaaattaaacagtgtactttcaatttttaataaaagtcatactaactggtgtaatttaaacattgtttttttttgttttttcttcaaaatatacttatatgtgattcatattcgataacactatatttatatataaacttaggaccacatttttaaattttgacaaaaaagggaccacatttttaatctcatttagttatgtgtcaagcgaggtaacatatatactgattgtcaattggttcacatagtataaaatcagattattgatccaaaatagagaatgatgcggatttaagattaaattcaattcgaaatagactagacaatataattcaccgaaaaaaccatggaaaatgttaataatttcactattttgaattcaaatgggatatgaaccaatatataaatgatacatacatatcaatatatttactaccagttaattttaaaattataagtacatcatctttataaaaaaaacagtcaaaccatttataatctcatttaagaactccattattgaatgtacaataatgcgatgtagtactccataaaatgccatgaagagcaaagacgagagctgcagttagtaaaacagtgtaagatgtcggactaaaagtttcgtaaaatattttcataatgataacaatgagagaaatgggtcaaatcacgtagcgaacaactactacaacgttcgttgcccgcgtgtaattggttcgaatgtctattgtcattaagaagttaatcatacaattattctataattcgatatagaaaaagtcaataccaaagccactattctagtctcgtacttatcgtcgcaaatcgatatctatggagtagtataaacactagcgagatttaagatacatattataacgcgaatacagtttccagctgccgttttgaaatgtctatacatagacaccatcatcatggcatcatgggatgcttttgaatataattcccaacaataacgtttttttttataaaggaaagtcagtaaaaaataatatgcatgtgtatctatcatcaaatgttgacaccaatcatcaaagatatttcctctctttagtcatttatttttaaatgataaatatgaagaaagttgtgttggtaaatttccattcaattacgtgtattgtttgtctttgtttttaatacgcattgggtccatccataaccaaaaagacaagtcatcttttgaggtgatgtcaagtgacaaacaattgtagctaatctgtgatttgtgggaatatcaattccttaattaaactagttaaattatgactaaggtgcagatatcttggaacttttaaacttttatcatctttttacacctaatagtttagattatcatatgtgagtatatcaataaacacacccacacagtcacacacacacacaaaaaataataatttcttgtggaaatatttctagcaaatcatggagttacgcaattcatcaatatattaaaaaaaatgttatgtcccacaatatatacacaaagtgtatgtgtttgaaccagagtctattctcaataaatgttttgtttcagtttatttcatattaataagattatctattttgaaagttggaaggcgatggtgcatgatcatattaataagattaacagtttttttgataaaatataataaaattagcacttgaatttcatacaatttttagaaaacactcggataatcaaggtattttttatttattttttggacaaaaaatcaaggtattcttatttactattttccacatcaatttacaaatcctcttaaatatttattttgttatgtttttataacttttttgggtctttgaacaaactattttcttcgattaggttcagccgttgataaatttatttaattttcagtcgtgatgatatatattcaaattctggtcagacgaaattttcttttactattgagtctgaaaaattcaacggatgttttattttgaaagatcactataaagctcatattgatgcttttataattataggtatcattacataaattaattcgcataggattactatatccctaaagtcatgacatagttaggactttaggataaaggaaggtttagcttaaacgtcaaggaatattaagtagtgggtaacttttgtttcctctaaacttctttttacataggattaatatgcattacattgttaaattaaatttaaggagaaaatgtaaaaaaattagtttagaggagaaacaaagcaataggtgggcgcacttagaagaagaagaagtgagataatggattagatatgtatccacctatgcacctccatttctccatgatcatgatcatcatcatcattaattcatcaacatcatcatcagctacctttctaatttgtccgtttcacaactgagcaatctctctcttccatgtgacacacttcccttggcttcttccttcccctttgttgttccaatctccgtacgtcaaggtttcttctggtaaagtctctcttcctcttcgtcttttcgttttccataaagactcaactctctccttcgattttcttcttcccctctctactctgcttctctgattgtgatatctcttgtgtgttcttctttctctgttttttcttccattgttgcttttgtctctgtacttcttgaatttcatcatctgggtttcatggttttcactcaaagcttgtggctttgagcttattcagatttcttgtagaccaagcactctgctttataattgccacagtgttctggtcctgaatctttgcttatgccatcaatgaaatgctcatcttcttcctgtttatgagaaaattctgaatctctgttagtttctcaggctgcttttgtgctctgtcttcaaatttcgaacacttgtctgagatatatttgtctgattccaaagatcatg

SEQ ID NO: 36556 - DNA, 3003 bp, Unknown
  misc_feature (1)..( 3003): 2750-1469P.txt file - cDNA_ID_3097687; gDNA_ID_2936555; Annot_ID_194214
tatatgaatatgaaaattggcaattaaaaaacttatacttagaaaagtatatagatataagccaataatacaatcaatcactaatgaaatttcaatcaatcactaatgaactaccatgtattaacgacttggaacgaattttcaaaatgtaaaattttctcttcgcacagcacaaacaagttatctaataaagtactgtatatcattagcccagatatatgaaggcagatcttgggccaaaacttgtatatataaaggtagcataatatcaccagaattaaatccaaacatttcaccaaagtagtataaagacaattggtcatgattagttttaagagattgttgggacttctttttgttgatgtgaagatcccacaactatatcggacactaacaaacctaaccgttcatatggacgtgggaacaagaacatgaattaaataggataagatgaataatataattaaaacttaaaaactgttactaaagggtacttgtatatttcatatatgtatttgtttgtctaagagtttatttcttaattatatttattttcgttttattcataataaatcgaataacggcaaaaatgtttacacgtacaatttataatcttaagagattggggaaacaaatcaccaataaatttgcaacaatgatattatcctataattatagactaatgaaaatttatatatacacaaaaatgtaagggcaaagactaccacgaaagtagccatatttcttggagggaaatgtggtaagttcacgatgcatacttttttgggcgtatttattatttttattaaattcagtaaaacgtaaaagcaaagagaatcattccaacgacaagaatgattagtctactatgtaaatgtaatgatacatcatcgcgttatcggatttaaacatttaaacaattatggcccataattgtgttatatctctagtgagacgtttagaccaaagcatccaaagataggttttatttgaagaataaaaaattgatagggtgggtgggtccaatattgggtccatcattttttttccatacttttgcaggtaacacgaaaatgtaacatgacatgtctctctccggacaaaaacatttctcccacaactgtaataatttaagttaccagttcgtgaatattactgatcattgtagaaatggtggggtaagacctactcgtgaatcgatttagaagttttaaaattaatctttacacagaaaaaaacaaaaaaaacattcagacaaacaacaggaaaaatatctaagcgtaatttgtttaactatttgaagaacagtaatctcaataatgatggattcaaatttgaatatatttggcttgttaagagatgagtaatttttgtattatagagttgtcttatgtatttagtatgttatcagcagctgacttgtgtaagaatattagacttacgtgaccaaactttaatgtattatgttacttgtttttagcaaaaaaaaacattaaatcgtattatgaaaataaatgttctaaagcaattgagcgacatgtgctattcaatgcagcaattacgctcaaagtctcccgaagatctcattcagtgatctattataagaaaatagtgaaaaaaacacatcagatttacataaatgtggttccattaatcacaatgtatcaaatgaaagttttgtttgctcttcatataagtaatggcaaagtcacttcgactctctacttagtatatagaaaataattgaatactacatgtttagtaggacaattgttgaaatacttttatagaatggtagcttaacctgtgtcacaaatgccaatcaaaatgttatacatactactttcaaaacaaaattgtttgacataatccaaaaaaaattcaatcaattatgcaaaccagatttggtaatttataacttcggattacaatcaacatcgatagtatacaatcacgaatcagatgcctgactactatatcaaagttttttactatctcatatgtgaattatggtactaaattcctttaaaaaaaattaatgcctgttattaccatcacttatgatttttctaaatacatagataaaaattatcaaaaacttttgcatgttagcttggatttcaaaacaaaattgctttctttgatataatgtcaaaacaaaaagttcacaaaacaaattataatgacaattcaaattcaacattactattactcatgctataaaacaatttcctaaattttatagtatcccaatatcttacttttgttaaagtatttactaatgttcactttatatggatcaccagtgataatagtaaagttattgtgtgtgactatatatcttttttttttttttgtgactatattattcaacaaattgttttttttttttgataaaaatacaccaacttgacatatcttagacgatctaaacacacatcaactaattaataggcgatctaaatcttacttatattaaatctaattttattatcataaaaaaaaaagatcttacacttattagtccttttttatatattttagacgacaaatgtttactagatgggtaaagattttttttttggtaaaattgggttaagatctttttaacattggttcaccagggatgtgacttttgtttggtcgtaatagtagaaaatttgcatatcacattttttcagatgtgtaggaaacaatgaccattttaatgttgttggataactaaagttttccatcttgaatatctatcagaagaaaaaaagagtaacaaaaaaaagagagtaacaaaatggtactagtgactttttttttttttttttttttgggcacaaaatggtactagtaactaataatggggtaattcatgtcgatcgattttgatttactatttacaaataaaagggagtaatttcatgacactcgaagcgtgaaccttccacctatatatacacccatttcataatctcaaaacatatcactaacccaaaaacaaaacaaaaaatg

SEQ ID NO: 36557 - DNA, 3003 bp, Unknown
  misc_feature (1)..( 3003): 2750-1469P.txt file - cDNA_ID_3097711; gDNA_ID_2936555; Annot_ID_194206
agccggtcaaggaggcttacatatgcctgatttagatatgtataccacaaacaaatacatgaaaaagttaattattaagatacctagacaaattggacattccacttccttgcgaatttcggaatcctgagaagtccatgatcctgagaagttcaccatgacaaatctacaagcacaaaaaatgcaagaattaggtaagttgtagcatataatcattattgtaaagctctactagtaccaaagaatcaaacaaaaaatacaagggcactgtaaattcagaactgaattttactttctactagtgatatatcaaaactagcaagtctgtatctacctggaaattatcttagttttcatttgtttactattgttccgagtattgtagatttaatatggagggaggataatttcaggtccgtacgatcaaagcgaattcttgtagaatttttttttcttgctttgaataaaaacgggagacagagtctcccgcccagttaccaaagaaaaaaagtctcccgcccagttactaaagaaaaaaaatcaagcaaacataataaatgtgaagaatcgagcccaaaatctaaagacttcatccataattgacatatccaaaccaaattcaagcagccaaaatataaaaaacaaaaagtgacacacatttacacaatatgcacattcattatgttcaaactaaaattttaaagtgcacggtaaattacatgtagatctgttaaaacatcgatgtcaatcacaaagaggaacacaaaatatacgataggaaatcacaaaagaaaaaaacaattggcttactcctaaatttctgtctcctcgcttgatggtgagttccgattggtatctgataaaaaaaaaattagaaagaaactaaaatgaaataaaggaatagcttttatttgaaagaattttgtttaactcttaaattattttttccttgttgaaataaagtcaaaagaaagaattaattatatacctttttattattatcccaattaatgttattacgtgtttcgttttgcaccatatatttttttaaaatatgttaaaatagcatatcaaattttttacttaataatatttaagatgtgtttgaatagctaatatatggtataaaaatatacaaaaaaacgaatcattgcatgcatagcctaccctgaaatttggggcctaaatacgttttaagagttttatagaaagttataaaattggaggcctttttacaaaagtaaaataaaattggggacatattttataaacaaaaaacgtcagaaattttggatcaattatgggatcggcacaattaagtgatggacattataagataaaggcttttttaatagcttatgggattgagtacttatactgaattctcaagactgttttaccctcttcttcagaaaagctaaaacaagatccttcaaaccaattaaacaataagacatcatgtctttttttttttttgaacaaagagatcatgtctctcatatacactaacaaaaggaaatccaaaacccagaattcgaaacatacacaaccaatgaagaagaacaacccgtgattgttatcgttcaaagaacgccataaacatttcaatctatcattttttttcttttttccccaaaaccaggccaaaggtttcatgaatttgatttccaaactccaatttgagatttgaaagttgcagtttgaaggccaaatcgacccgcctttgaaattgatttcccctttcaagatcatgtgttacgaaccgcgacgacgatggtaagcttcatcgacactaacaattagattcggtttcgaattatagatgaattaaagattaattgattcgatctgcatctaaaattagaatatttgggttccctaaatgttatcctcttagggtttagattccttgcattaacaatcgtttaattagttccatagagttcatcagaggaggttgatgaaagaattgtattgtgagtcgtcggaagtgaaggaaacgatattgatggagttgaaagtggtgattttgaaggagtgtggagtttaaaaacagaagaagacaaagtgatatttcatcaacaaattgaggagaagattgtcatttcacaaacaaaaaaaattccctttttataagcccaactaaaatgtgtctattttagagtttctggcccaaaatatgcttatatctataaaagcccccaaaaattttaggggccataacaaatgcttcatctggttatgctcatgaccggtcctgtttacatgctatgtaatatatgaactagtgtgcacgttgacggacttccctaagtatcgatacactttttccaagtcatacataatagagaacactggaaaacaagttagctcatacaacaaaccgaagtttgtaagtatttcatgataagtttaccataatttttctccgacgatctaagctctatcttctttttgggatgggcgatcgaacctcggtggctaatactactcgaatccaggtggtggagacttttctctcttgtactaccggacttggtttcaaagagtttttttttttttcaaacatgtactgatataaagtttctcaaaaaccaatattagattaagaaaatttattcatgtagcttacaagagaaaaaaaatatactgcaaaaatatgaaacactaatcaaaacaaaaggtataataattgtagttgaactgaaatatttttaatagtggtaaccaaacgagttctgaaagaaattgaagaccgaaccatatcacattatcacctaattaccgtttggttcggagaaccgaaccgaacccacccgaagacttcaattgcccaatcctagccaaaccgtagccgccatttccgtgaatgttgtgattagcttattattatcttcgttgcccaaaaacttaaaagatccaaacttcgaacaattttggtgtctgctatacagaatccaaatccaccttctccgattaaaaatcccttctctttcgatcatg

SEQ ID NO: 36558 - DNA, 3000 bp, Unknown
  misc_feature (1)..( 3000): 2750-1469P.txt file - cDNA_ID_3097753; gDNA_ID_2936556; Annot_ID_194256
ttctcgacggtttctaaatgtttagctgagtttccaccatctgccatccaaagtatcccaaggtttttcttctgaagacttttaattaccaagtgaggcaagaggatcaaattttcttaaagtgggtttctcaatcttcgacgaaatctctgacgcctgttaattttacgatcttggtttatttggttaaagagagaactatgtttatgtgtaaaatcatcactcatgttttattttctctttttccgtcgtttccccatgtaggggcttagtgtttgggggtttcattcctcgccagcttgtgttccggaagattatatcttgccggctttgtcgtcccgtaattcactcggacttatgtatctgatcatggtttgtgataataataaaactagctttgtgaagaaaaagaaaagccaaaacattatgttgctaagttagtcaaagctactcataaacccacctgtctagctaaacatcacaaactaaaatgaaaagaatttaaataaattaaaaaaagtacataacttaagcaatcttttacttccaaacaaggcatgccaatcattatctgcgttaaatatctagtatgctgcctattcttaacatatttatcatgcaaagttatattattgagcgaaatatgcgtttttgttgtactcaataataaatataatttacatttatatatctattcccattaataacatcttatcatatactacaagatgatttatctataacgaactttcgagaaaagaaaaaaacgtaatattttaaattttgcgctaaaaattaaattttaaaaacattttttaattttcatctaaaaagttcctatgaacattacaagataatttacacataacaagccccacaaaattgaaactataattatctacatttttagaaattctttacgcgtagtattgaggtttgttacacaatccaagtaattaataaaagaaacaaaaaacgtcaacgtatctttatctttaagggtaatttgttaaagaatatcccatgtgtacaaaacaaccaaatatttcaaaatttaactaaaaccggctacagtaagtaatcctccaactaaaaccgccacctgtccaatctaatcacatgccaatagaataatataaagtattctaattttcaaaaagtatccaataagatcaaaggcggtacttgattcaaatattccaccagtaagaatacagagagacagagctataatcctctgtgtcacagtctattataataatataatatacacacagagagaataaaaaaaccagtatttgaaatagaagaagagtagctaccactccactcttttcgtctctctctctttttctctctatatacgtcgccattgttgttgcattcgaagcttttatagaagaagtaatctctctttttctctatttctctgtattactttctcttttttttttcgtgatggagaaaaacacaccggtgaggaaaccacacatgtcgacggcggatctactcacttggccggagaatcaaccgtttgagtctcccgccgccgtatcttctcgctccgccgccagatcgcaccaggtaacttactaattccgttaatttcgcgatctacgaattcgaatttagggaaacaatctcagccgttggataaaatgtttataccaactttgttttttgtaaatttgaaatttaggggaaacaatctgagccgtcagattgatttctttaaactaattactactagtttcactcaatttgttaatttcgcgatctacgaatttgaagggaaacaatcttagccgtcagataaaatatttaaactaatttttttgtgtaattttataatttgattcgttgtgattattaattttttgtaaatttggaatttaggggaaacaatctgagccgtcagattgatttctttaaactaatttcactcaatttgttaattgcgagaattgattcgtttctgatttaaatttgggggaaacaatctcagccgtcggatggaataagcaaagtcgtatttggaggacaagttacagatgaagaagttgagagcttgaacaagaggtgagtgatagagatctcacgattttttttttgtattcgaaatttagaaaatagtagtattaatcaggaagaaaacaaaacggtacgataatttaataaatgcgaaacaacagtaagtacgaagaatctgtcaatttgttaacagatgatgatgatcctgtcgttatttggactgaccctatagaatgttttttttttaggtaggaaagtgtttgattgccataattagtgtccttaattatgaagcatttttggtatatcttcaatttaatttccgtttttgatcttctttgtatcgttcacgcttctctaattttgtttttttttcctcctaatttattctttttttggtaaccaatgatccggtctaattctgattcaaaaacccaaaattttagtatttttaccatttttaataattgttgcttgattggttaggaaagttatataaatattttggaaccatgggttaagttttaaccgcagttagtgctttcgttagtaaagttaacagacgttaacttgaatgtatgattttaccaattttcttaaaacgaaggttttaaaaaacaccaaaattaaatgaggtattttagttacaaatttaatattacgcttattaaacggccaaaaataaattagatggcggttttttccccaattttttgttgttagtgtttttggcaatgaatttgatcgtaggaagccttggttaattgattcaatctccaataaatctttggttatttctggtttagattggttattgtacttggtttaatatgggtgtatttaagctcatctttgtacacatgttacattcaatgaaaacgttactatgacatgttatagatagattcattgttaatttttttggttgagtacacaatttgtaggaagccttgttcaaattacaagatg

SEQ ID NO: 36559 - DNA, 3000 bp, Unknown
  misc_feature (1)..( 3000): 2750-1469P.txt file - cDNA_ID_3097756; gDNA_ID_2936556; Annot_ID_194255
acattcaatgaaaacgttactatgacatgttatagatagattcattgttaatttttttggttgagtacacaatttgtaggaagccttgttcaaattacaagatgaaagagatcacagggagtggaatattctctgtgtatgaagaaaatgatgattctgagttagcaagtgctaattccgccacaaacggcaaatcaagaactttccaggtttgtgtctgtctctttcttgagagaattggatacattttgtagtttgttttgatcacttttatgtgtttggattgtttcagcaaccaccagcagcaattatgagtcacatttcatttggagaagaagagattgttacaccgaaaaagccagcgacggtgccagaagttgcaaagcaacgtgagcttagtggtacattggagtatcaatctgatgctaagcttaacaagcaattctcagatgcgaagtgtaaggaactaagtggtcataacatctttgctccaccacctgagatcaaacttcgtcctactgttcgtgctttggcttataaagacaacttcgacttgggagaatccgataccaaacccgtaaaaacgcctctctaaacttctacttactcatattagtatgtctcagtcacaccaatgcactaattcttgcaggatggggaactaaagacggccaagaagattgcggataggaagtttacagatttgtcgggtaacaacgtgttcaaaagcgatgtttcgtctccctcttccgccacggctgagaggcttctaagcacggcgaagttgaaggagataagtggcaatgacatatttgctgatgcgaaggctcagtctcgtgactactttggcggtgttcgtaaaccaccaggcggagaaagcagcattgcattggtctaaaccccaataataattatatagctcaagattaaaattctctacaaaacttagaaggttctaactatttatcttcattaatagattatgtacttttggatgtttttatttctatattttccggttttgtgtgattgaatggttatgaattgatctgagtttgttaaccggaaagctaatctggtctcttaggaatttgtggagtttgtttgttttttgtgagttcagactttaactatgagtccattgtttgggtctgtctctgtatttgttgggtacttgattgattttgttgattattttggggctaatctgttatttaagaaaaagattgtggaccgtttcgacaaaagctgtcttacacgtttggtgcagtggataggactgagagcagatacataagattgggaagtctgtttcttttttggaaaggaacctttggccatggtctgtcccaaatgagaaatctatgtatataatataatattttgaaaaatgagttgctttaataattctgtctttgcttatatgaaaattactttcttgtattctgtattgaaagcaaaacttttggaagtgtgtgtaaatatttcaaaattgtaaaatattgaattaataaacttgttatcaacatccatacctaatacttaaatatttaatagttcaactaaaaataatattataccattcttcaaatttcttaagaataaatgaattaaattttgagaaatttaaatggcaagaatttaaaatttaattaaattagagagaaaatatatcaaagaataccattgaaactgtttgttaacagagatatttgatatctgcaagttttgttgaagatttgtgtaaatttgaatctttgagattgttagtgttacttatgcagcatataattgttttgatgatatgtgagcattacgatgatatttagaaaaatgataattcaaacttaacttatttgatagataacaacatgagaaatatgagagtggacatgatttttcctaacaaaaactatcagcagatatgatttgaatctttgatagtgttactatatatcaatgatattgatttgttgttacgtgagcattacaatgacgcttaagaaaaatgataatttaaactttactcgtttgatagataaccacatgagaaatatgagtagagataaaaattttagaaaagtctatcaacattgtcgctcacactacttccatataaagaggaagtattgcaaaccaatatatcgaactaacgtgactacgattaggaaaagagatgctcaatccatttcaaatcgataaatttgaattgatgtcaaagaatgtagataatagtcacaatatatctgagtgagatttaatattgttgagttgtggagaaaaatctcaatctaagaatgtataatatggagcgtttgttctatttcaatgaacgtatggttgatattgttctattctataaacatatggttgatactgttttatctatgaacatatggttgacattgttctattctatgaacatatagttgatattggtctactctacgaatgtctcaaaacgttctagtgagagtattttctgtccatgtttgtttgccctaagctttaatttatagagaaatatcattccatatgcatagaaaacttgttatttagatcccttcgaaattcactattaccctaacactgttaacataactttttacgcatgtacccctacgttatcgttttagtcagttgtagagtataggcgaattattgcatgttgtaggactctaagattttattgggatattgtgttcgggagttatgtttttttttttaatatgttttcttctctcctgctaacgaacagtcgtgtgctttcattactatatgaaggagaaagactgcgattgaggcggaagaacataacccttgtcttaaaaatttcttgtgttatctgggttgattgtcaatcgatatcatttccttccgatccgagggttcttcattcgttttgggtaattgatttgagtctcctctctttgattttgtttcttcatttgttttatctcgctgtgtcttactagggttttttactttgtgtagacgatg

SEQ ID NO: 36560 - DNA, 3003 bp, Unknown
  misc_feature (1)..( 3003): 2750-1469P.txt file - cDNA_ID_3097798; gDNA_ID_2936556; Annot_ID_194246
gccaggagtagcaaactcttcacatctaactaccttgatacttgacaccaacaacttcactggtttctttcctgaaactgtttgcaaaggtaggaagcttcaaaatatctcattggattacaatcacctcgaaggtcctatcccgaaaagcttgagagattgcaagagcctgatcagagcaagatttctaggaaacaaattcactggcgatatttttgaagcttttgggatttacccagaccttaacttcattgatttcagccacaacaaattccacggtgagatttctagcaactgggagaagagtccaaagctaggtgccttgatcatgtcaaacaacaacatcacgggtgctatcccaacagagatttggaacatgacacaactagttgagctggatctatctaccaacaacctctttggtgaacttccagaagcaattggaaatctcacgaatttgtcgaggctacgacttaatgggaatcagttatctggaagagttcctgcaggtttaagtttcttaaccaatcttgagtctcttgacttatcctcaaacaatttcagctcagagatcccacaaacctttgactcctttttaaagcttcatgacatgaacctgagcagaaacaaattcgacggaagcattccccgactatcaaagctgactcagttaacgcaacttgatctcagccacaaccagctcgacggagaaatcccatcacaactaagctccctgcaaagcctcgacaagctcgacctctcacacaacaatctctcaggtctcattccaacaactttcgagggcatgatagcgctgacgaacgtcgatatatcaaacaataaactcgaaggtccgcttccagatactccaacgtttcgaaaagcaacagcagatgcattggaggaaaacataggcttatgcagtaatattcctaaacaaagattgaaaccatgccgtgagttgaagaaaccgaagaaaaatggcaaccttgttgtgtggatattagtgccaatcctaggagtactcgtcattctctctatatgtgcaaacacattcacctactgcattcggaaacgaaaactacaaaatggaagaaacacagatcctgaaacaggagagaatatgtccatattcagcgttgatggcaaattcaaataccaagatatcatcgaatcaacaaacgaattcgatccaacacacctcatcggaaccggaggatacagcaaagtctacagagcaaacctccaagatacaatcatagccgttaaacgactacatgacacaatagacgaagagatatcaaagccagttgtgaagcaagagttcctaaacgaggtaaaagcattaacagagatccgtcaccgcaacgttgtgaagctcttcggcttctgctcccaccgccgccacacatttctgatctacgagtacatggaaaaaggaagtttaaacaaactcttagccaacgacgaagaagctaagcgactcacttggaccaaaaggatcaacgtcgtgaaaggtgtggctcacgctttatcgtatatgcaccatgaccgaataacaccgatcgttcaccgtgatattagcagcggaaacatccttctcgataacgattacacagctaagatctccgattttggtacagcaaaacttctaaagacggattcatcaaactggtccgccgttgctggaacctacggctacgttgcaccaggtaaatctaaatccctaaatctgattttgagcttatgaaatttaaatcactaaattcgaaattgaacttgatttttcgcaacagagtttgcttacacgatgaaggtgacggagaaatgcgatgtgtatagcttcggggttttgatactcgaattgataattgggaaacatccgggagatttggtatcgagtttgtcttcgtctccaggagaagctctgtcgctaagaagcatttccgatgaacgtgtattagaaccacggggacaaaatagagagaagctcttgaagatggtggaaatggctttattgtgtttacaagcaaatccagaatctcggccaacgatgttgtcaatctccactacattttcttagaaactgaacttctccatcaatttctatgttatcattgtgtttatctatacagcaacagtaatctctgttggcttttgttctctgttcttgcttgtgtttgcaggaaggggtgtcgactctcgtttcagcttttgttgttgttgtttgggcttctcggcctgcttcagcttttgtatgtattgggctgcgcccttgttggtctttgggccttgtttgtttttatctttgcggcttgcgtgccatgttaggccttttggtcttgtaatgtgtttggttaatggaaatctatgaagttaaaaaaatgaaaaaaaaaaaaaaaaaaaaaaaactgttaaaagcatttttagataatggtcattgtgttactcctcacatatgaacattcaaataaagttttggatactgtctatctgtatatcgccagaattagtaagagatttcttatgcatagtaggagattaaaaaaaaaaatgcatagtaggagatttgtaaagaaagaaataagtttttttttgtataatgagttctaatggacatcacgtttgcaagtgataataaaaaaatcttacactcttgtactctgtaacgtgttaaaataatacaaaatggattataataacgaaatctaaacacttataatcttgcggatgattttgtgacaaccaatgaaaccgttaatgcgagattacgatagttttttatgaaatcatgatttgtgcataaagttaagcaaatgctaaataattcataaagtgtaagaaacacgtggcagaagaattaataattcgtttgggatatttttggtatatacggacaggccacgtcgtgtcctaaacctcttagcctttccctttataagtcaatcttgtgtcggcttcgactcccaacatacacaaaacactaaaagtagaagaaaaatg

SEQ ID NO: 36561 - DNA, 1555 bp, Unknown
  misc_feature (1)..( 1555): 2750-1469P.txt file - cDNA_ID_3097804; gDNA_ID_2936556; Annot_ID_194245
gactctgttttaaacacttacttatctttgttaaggctctgttttaaacacttatttatctttgttaagggtctgttttaaggagcttattgatgtataagactatgttttaaaaatgttatggatgtaactatatttaaattacatttctttgattcaaaatataattatacaaatttataaaaataaaataagaattcagttaaaactaacgcagcggtgacgaaacgaacatagacacttgcggcagcgacagcggcatgaaaacgaacatgcacacaagttgcgtcagcggcagcggtaatggctgcagtagtggcgacgaaacgaacaataatctgcagtagagtttgccgccgccgctaccgtctgcggtggtgaaacgaacagactaatatataaaaacatatactaagcaaaaaacaaacttttggatacaactacattagatttctttacttccgtgaaacatgagccaagcaaattctgggaaaaaaaaaaatattaacagttaggccatgttcgttttcctacaacatacattgtttgtttgtctgtcagtggattcagcgaccagttacagcgacaatcgttaataattgtcgttgtgttgttcgtttgactgtcgctctagacagtcgctatatgtttaaaaaatttaattattttttgtgctaatttatattttaaaataaaattgtaatttatatatatatctgaaaaaatataaattaatatatttatttactttagttttatcaaatttaatttgactacaattaatttacgttatttgaatttaatttattttaatttaatttaataagaattagtttaatttaactagaactcaaacccatcgtgatatcgcaaagaaaaatattataaatttgtttatatgataatttctttaaaacaaatataactcaaaatgatgcatattataaatttttgtagttatagaaaagtatatatataactaaccggaaaaaaataaaagtaaatattttgacagaaaattacaatatatgaagttgcaataaaagacacaagcgagaaaaaataaccgtcaatattttgttacggaaagttgcgattaaaagacacaactgttaagaatataaaagacatttctttaagtttaatttaattgtttttaattgtttttaattgttttttaatttatatttttttatcgctaagttgttcgttttcatgtcgctagattcaacccaaatcttcttgaccaatattatccactcactggtatcatccaaaacacaatgacttccaaaacacaacgaccaatactcattcactcaacagaaaattcaaagaagaacccgtaagcacttttctatgtaacttcacaaaaggtaaacgccaaaataagtaattcgaacccacggcggggttagcccttcattatcaaggagacgactccaagtcaatcactgagtgcacatgaggattattaaatagccagaacttggatagctttatctaacaccaagagagaaagataagagagagggagtgagagtaagtaagaatg

SEQ ID NO: 36562 - DNA, 3003 bp, Unknown
  misc_feature (1)..( 3003): 2750-1469P.txt file - cDNA_ID_3097835; gDNA_ID_2936557; Annot_ID_194297
ggtatggtagtatgctctgtctcagacatgaacagtcctatatcctgcgattctgccgaatatttttgcaggctggttaaagactttggttcttatttcatgtttgatgataccaatgtgtgattttcgtttggaaccagtgatctccatattcattgagcgtttggattaatgtgtcttgaatcatgctcatcacagtgcagaaaagatgttctctctgatcgttttgggtaaaatggtatgtacacggttggtgctaagtctattgtgctcttgttataacgatgagacagagcagttttgctattgcattcttttcccttttggcattttggtaacctgctatacatatcagtcaatctcatgctatttgcatctaatcactgacaatcatgcaggtattattgttctgttctcaatggaatgttttcacatgtaaaatcactctattctccagattgtgtgatcttctatttatgtcctgacactccctggtttattatatgctttctcatattcttgtacccaccattaacttgtttttttgttctttccttgatccctcctttttattgtagccgcagactcatgaaaggaatctgcatccataaaggtaagattatattggcctctcctggagtcaaaaagaaacttttttagattgttatgtaacttatgtgcacacatgagtgatcatcaaagaagaatgataccaaatggttgcttaacctttttcttcacttaaacaaagggtttattccctctgtggaccgtaaagaaaaatagaaaaaactaaacctagtcttctctttttgctcttgggcatagttctctttataaatttgtagatccactttaactacaagtctttttatatatagggtctaaaataagattgaagttacacttttttgttagttgtttatttgtttatgtcttgagtgcttaatcatggcctaagcgtaatgatgttatagataatatacatcattaatcatttcatgtcttttcccgtatttgcctgaactatcagcacaactgttctcagcaccagtccgttaaatatctctcattatcctcatattgtttcccataaacttctctcactctctctatctttctcttgatatgtcagctactggtataaaacggtccaacctcaacactagaccggttcagagagatgcttcggctaagcaaacagctatcaagggaccttatggtaagagtccgggatgcacaacaagctgcggattaaggttaccgaggaaaacagaagtgacagcagcaaaattgatcaagcatcttggatgcaaatttgcaaaaggtttgcgtctggtggtgatgaggaagaagaaaagatctccaccgtcgaaggtttcttctttttctgggaggtctcagccaccaatcatcccaataaacaatgacagtcatcgatcagaggccatagaagactgcatacagttcatcaactcatcatcctccttcaccagatcaaactctacttcttaagtgttatcattcccaaaccttttgtctcggtcgctcgctcgctcgcgtattgtctattttacttattcgtgagagttgcatgtaaataatgtctacataaatctattatgtgacttctgttgttgtagtacgagtaactgtcttccatctttctcaatttctgtctataaatattagattttgatattcgtatttgttcatgattagttacaaggataagccacttctgttttatcaataaacgaatttcctctttctataatacatatttttctgagatgttcctataattaaaatgttcgtgtgtgacttattttatcattttattaattatgtagtaaaaatgctttagtttaaaaagtaaatttaaaatagtttatccaagaaagttcataaataaagcatggccactgatttgtttaccctaacagttagtagcaccttcagtgaacgggagaccacctaaatcaatctatgtgtgagcgtgtgtgatttgtttagctttaacgtttgatagcctaaaacaacttcttccttttgtgtagtctttttacccaattctatcatatcttttaaaatagaaaattatagcaaatttttggtcgtgttcacaatttgtttgagtgggctactaaaagttgaaatctccactaatcgtttagataatactaaatccatttgttaatgttgatccactgaaatctatatatgtaaatgaaaatcaaactgatttttagcctgagacgaaaatttgtcggcaagtgtgcgatcaaatgatcagtaagtattaagtgtgatcagtcgtttagaccaaaagacaaatttgcaagaattaaaaacatcagtacgcctaaaaagcccgtaatgtcttaacaacgtatgggcttaattctaatgtctaaagcccgtaatatcaaagcccaagcccaggtttataatacatccgacacagccaccggcaatcttcccgccagtataatcgccatggattccggcagtctcaagcctaaaaggctaaaaatattttcgtcgcatacatcattccgttctcagctgatttaaaatacaattaatctgctcccagatttgaagaaccctaaaataaaaaagagtaaaattgaaggctggagattgtgaacatggacggttactctctctctcctacctcggtaatctcgctcagatcctcccacgttcttcctcgcctcttacgcctttgcgtgttacctaaaaaggtcatcaccttcatcgtcgccggttttcctcttctcaaattcggtggatctcatttcccactgacgatcgtactctctcgattcgtatttacgcgccgtgtttcaagctatttcgagctcataagtgttaaagtctcttccttactcttcaatcaatcattcgtatcttcgattccgtgaattgaagagggaacttttctgcgattctgcgaattgaggagggaactttgttgccattctggaacaagaaatg

SEQ ID NO: 36563 - DNA, 3003 bp, Unknown
  misc_feature (1)..( 3003): 2750-1469P.txt file - cDNA_ID_3097840; gDNA_ID_2936557; Annot_ID_194296
tttgatcatcctctgtccaagctacaatctttttgtcttcacgtgtagtttcttcttcttcttcgccttctgatgacgatgaacactcgatctcggtttcgccaccaccactagtcaacctctccgatggatccacaacggaaacattcccggtggttgaaagagtttcttcatctaagctaggctcaaaggagaaaccttcagacacaagaaaggctccatctttcttgaatttctgaagtttgggagattttgcagtattgggaatttcaccatagagagttgttaaaatgactctgtctctctcatcttcactagcctgagaagagtcccaatctttcccaacctcttcaactttccttctagcgtttcgtcgaacacttcgttggtgctttaagtcagccttccttgtttcttcctcctcagatctcttttgggaaaatggtgaaaaccaattatccgttttgatatgcaaaagcttaaaacttggatgattccgaagataaaacacagagcatgcgattaacggagaagagtaaaggacgaaataaaaaaggcgtggaagaaaaatgtataggaggaagataattgcagaaacaccagaaacaactgggtgattccttacgtttctataaacgatgttcgtggaaaatctgagaattttccagaacagagttccgacatctttggcatcgattcccatgttttaaacagttcaaattctcagaacactttgagagataataacccaaagcattctgtctatggcggtttgtgttttgtcctagagaatcaaaatgcttgaaagggaaaaacaaatatggtttaattgaagaagcgaaaattgatcaataagagagaggtcaagctttcatttgaaacaataaccagtcaataaaaaatagatttttcaagggtttttttagattttcgttttggttctttttcagttttcagaacacacggtaaggacggagaagacaaaatagaaaactggtaagagagggcgggagttaaattagttgctttcttacacatgtttccaaagattcttgttttcttacacttttaaccacattttttactggttcagaaattgacccttaaagttcatggattttgcatctcatatctctttcttcaaaagattgggctatcttcttaagcccaccaagacccatcaaatgtctgtaaataacatacactattgacacttcctaagttttctagctaatccttttttttagcaagttgttaacagatttgtgtgagactattcatgattttcaaaaccaagatgaacatcaacgcttaaagcttataatagccactctttcttgttaacttgatgactaaagtcaatctttgttgctcaatcttaactgatacacacacaatcaacgttactcatgatatctaatttcactccttactccttcattgagagttggacacaaaatcagtatgacaagaaattgaggatgatctcttaagaaaaactctaaaagtaaatacacatttctcttgttgtgacacaaaaaggaaagagaagacctcatcaaggagagtgagaagatgtactcaagattaaactcataattaagccacacttgaagcaattggaactacgggtgctactcattcttaagcttcctctgacccttcataacacaaacaaataattacttttccatattaacacatcatatttctacctcttcaagaaattaaaaccagacaaaaacgatcaaacacaacattcaaaacatcaaatttcgacaacaagccagttcctttcaagaaaacactaaccttccgtctcatcttcatcgtcatcttcttcctccaccgcatcaacaccgtacctcgcattcaagaactccacagccgcaggagtcagaacaagcttatcagcgttcaaaatatcaaacagattcagtgtcctaggcgtcaacatcctcaaggttccaatgttcctactcgatttcgccacattctcatccacatcaatcatcaagaacatagctttctccttgggatccaatccccacctttgcatcgcagctaagaaatctttagtcttgggcttctcaaacttctccccaaattcctccaccactatcgcaccaccttccgcagatgccgcactcgataacgccgtagatatcgctagcttcttctccttcctattgattttaattgaccaatccttaggtcttggcccaaacaccacacctccaccgggacgtaacggtgttctctgagatccacgcctcgcgtggccagttttcttctgtgagtaaggtttaattccaccaccacgaacttcaccgcgagtcagtgtggaagcagtacctcgccgcttgttattcaggtccgtcacgatggctcggtgcacaacggcacgcgcggtatcctccggcgccgctttgaggtctagatacgtctctccgaccttctctccttcgaatgatagaatcggtagagtcgctagctgggaagagacagaaagcggcttcgagactctgccggagccgagttttgaaacggaaatgtaggttttagggatttggtgagaggaggataaaaagagagaagatgagaagaaagatagcgaatttggtgctgttgcagaagaagccattgttgttccctgacctgacctatcacaacgaagaagaagaagaaagactgagaaagtgttatccactcttcaaatgcctatcttgtgcttggtgagaatttatgcatctgtttggacataaggatataactatcctgttcatgaataactccagctgtcgctagtaagaaagagtcaaactccaaaagtcaaaagcctcttatatagccagcaggttttttgagacataaaactctgtgataaaacgatgatagttgatgatagctgagactttgatacagatatttgagatacgagcgcacgttagctaagaccaccgcgtaagccaccgtctcgtcttgaaacgcaccgtattcatg

SEQ ID NO: 36564 - DNA, 3000 bp, Unknown
  misc_feature (1)..( 3000): 2750-1469P.txt file - cDNA_ID_3097844; gDNA_ID_2936557; Annot_ID_194295
tcccggactcttaccataaggtcccttgatagctgtttgcttagccgaagcatctctctgaaccggtctagtgttgaggttggaccgttttataccagtagctgacatatcaagagaaagatagagagagtgagagaagtttatgggaaacaatatgaggataatgagagatatttaacggactggtgctgagaacagttgtgctgatagttcaggcaaatacgggaaaagacatgaaatgattaatgatgtatattatctataacatcattacgcttaggccatgattaagcactcaagacataaacaaataaacaactaacaaaaaagtgtaacttcaatcttattttagaccctatatataaaaagacttgtagttaaagtggatctacaaatttataaagagaactatgcccaagagcaaaaagagaagactaggtttagttttttctatttttctttacggtccacagagggaataaaccctttgtttaagtgaagaaaaaggttaagcaaccatttggtatcattcttctttgatgatcactcatgtgtgcacataagttacataacaatctaaaaaagtttctttttgactccaggagaggccaatataatcttacctttatggatgcagattcctttcatgagtctgcggctacaataaaaaggagggatcaaggaaagaacaaaaaaacaagttaatggtgggtacaagaatatgagaaagcatataataaaccagggagtgtcaggacataaatagaagatcacacaatctggagaatagagtgattttacatgtgaaaacattccattgagaacagaacaataatacctgcatgattgtcagtgattagatgcaaatagcatgagattgactgatatgtatagcaggttaccaaaatgccaaaagggaaaagaatgcaatagcaaaactgctctgtctcatcgttataacaagagcacaatagacttagcaccaaccgtgtacataccattttacccaaaacgatcagagagaacatcttttctgcactgtgatgagcatgattcaagacacattaatccaaacgctcaatgaatatggagatcactggttccaaacgaaaatcacacattggtatcatcaaacatgaaataagaaccaaagtctttaaccagcctgcaaaaatattcggcagaatcgcaggatataggactgttcatgtctgagacagagcatactaccatacctaatcagagcatggttcaaacaataaatcaacagtaaagtgattcacattagaacattaaccctaagaacccaatagcttgattcaagaaactgaatgaaggaaagaaatgagagatgttttagaaacatgtacaaaggtacagaaggggtaacaccgaatatcagctagaaagaagcaacaaatcaattcacaaacgagacatacatatagacataacatatacttcaccaaattcatattttgtcatcagccatttcctggtgttctaacaccaacaaatctgatgataagtaaagccttagaaacgccgcacacttgtgaaattcaacaactttttgccatcctcaacattcacggcgataatcacggccatagctgtagtttggcctagctccgaaatcactctcagacctctctgcagcagctctctcttcctctaagctcaatccacccatcgtcttctgcaactgcctgtgatcataaggagagtaatcgactggtgccgatggaccattaggcactccgtagctagacaatcgcgagcccataggtggagcttgtggcttgtactcggtaaccagaaaggcatcaacgggtgctgagggcccactaggcggtggaccgtagttagaaaaccgaggaggagctaaaggaggctgcttgtgatcaatcgatgagaaggcatcaacgggagcagatgggccacttgggaggccgtaattggaggcacgatcgtacattgaacgtggtggaggaggcggataataatacccggaatagtagtgatcagtgaatgcgtaaggagacggagacggtgactgtgagaattctctgtagtcacgctgaggagatggagcggtgatcggtgcttgaggaggaggaggaggaggagggctaggggagtaataatggtttccttgaggggcagaatagtaatctagtggttgagattgaggacgtggcggaggatgctgcggtggagggattggtctgtctttgatcgcgagcttcaaacgaatcttcccctgtggtcgacccgatggacgaaccagctcgagcgagttgatcaattccggaatcattgacccgtccgagtcaatcaaacgagctagaggaaacctaaccgatccgacgagggttttcgccagatccgaagaattggaatgaaaaacctcgatgttgaggaccgattcgtggacagatcgggtgagaggaagagtaatccgctcgttccacaccggtttgatggaggaggaatcatcggagcgggtggagagagggtggtcttggtcaagatacagaacaacgtagggtttcaggtcaccgttacgccagttgacattcttcaggtgcttggcagagacgacggtgacaaccaggtcgagtggctccgacgaagtcatgaatacggtgcgtttcaagacgagacggtggcttacgcggtggtcttagctaacgtgcgctcgtatctcaaatatctgtatcaaagtctcagctatcatcaactatcatcgttttatcacagagttttatgtctcaaaaaacctgctggctatataagaggcttttgacttttggagtttgactctttcttactagcgacagctggagttattcatgaacaggatagttatatccttatgtccaaacagatgcataaattctcaccaagcacaagataggcatttgaagagtggataacactttctcagtctttcttcttcttcttcgttgtgataggtcaggtcagggaacaacaatg

SEQ ID NO: 36565 - DNA, 3003 bp, Unknown
  misc_feature (1)..( 3003): 2750-1469P.txt file - cDNA_ID_3097858; gDNA_ID_2936557; Annot_ID_194292
ttttcttttctggcgggatttcgccattctaagctatttggttcccgccaatgcgctagtgccggcctcaatcgttttaagaattggatggatatttttggtcattataaaagttagagggttaatttgtattaataaaaagaagaaaagttcatttcgaattgtagtgaaagtttagggttttatttgtaatatttaaaagacaaaaacacgcgaatccaaaaccgactttgccctagttaaaatctcgtcgtctccttcgtgttcgagatttgatatcgactaatcgaatcagaggataagagaatggctcacagaatactgagagatcatgaagccgatggatgggaacgctccgatttcccaatcatctgcgaatcttgtctcggtgacaacccctacgtgcgaatggtgatttctcgattccttctctcaaacattcttggattttgctattgcttgttttgtttcaatggctcctgaatcttatttccggatctcatctcttaaccagtctcttgctcgttgatgttttctgtatattggagtggttaacttagtaaatatggttttagggtttagcttgttatcaaattcatcgaaaaattgggttttacatccaaattcgtttagttatagttggatttgattacagctgcggattctcttagctttcagctgcaattttgttttctgaaaatctcgatgttttgatttctgattgacgttttatctgttgatatgtagaccaaagcgaattatgataaggaatgcaagatatgtacacgacctttcacggtgtttaggtggcgacctggccgggatgctagatacaagaaaaccgaaatttgtcagacttgctgcaagttgaaaaatgtttgtcaagtctgtcttctggatcttgagtatggtcttccagttcaagtaagagacacagcactcaacattagtactcatgactctatccctaaaagtgatgtcaacagagagtattttgctgaagagcatgacaggaaggtatgatcatgttcacactcacgattttatttcagcatttgttggtttgagaattttgaagacttactctagctttctcatggtggcttatctaagtgattttgctttttctgttatgtaggctagagctggactggattatgaatcttcattcgggaagatgcgacccaatgatactattttaaagcttcaaagaacaacaccgtactataagaggaaccgagcacatgtttgtagtttcttcatcaggggtgagtgtacaagaggtgctgaatgtccataccggcatgagatgcccgaaacaggagagctatcccagcaaaacataaaagaccgttattatgggtaagcttttttcttctgtatgtttgactttgttgacgtttagttccgttctttattggttgtttcgatacctcccctaaggagtgtaaaatttcatatgtttctgccatagtactattttctccttgatcattcataatatactcgatatttgaaagcttctgatatgtgaattcttggactgaactatgctatgttggctctcatgtagtcttgttacatagtgtcgtttccagttttagttctctttgtaatgtattagtacttttgcatttattcttgttgaagagtttgttttaactgtttctcattttcttttacacgttttcagtgttaatgatccagttgctatgaagttgcttggcaaagctggtgagatgggcactttggaatcgccagacgatgaaagcatcaaaaccctttacgtcggtggacttaactcgagaattctcgagcaggacatacgagaccaattctacgctcatggagaaattgaatctatcagaatcttggccgataaagcctgtgcatttgtcacatacacaagccgtgaaggtgcagagaaggctgcgcaagagctctccaacaggctagtcatcaacggtcagaggctaaaactcacatggggaagacccaaacctgatcaagatggtgcaaaccaacagggcggtgtggctcatagtgggttactacctcgagccgttatatctcagcagcacaatcaacccccaccaatgcagcagtactatatgcacccaccaccagctaaccaagacaaaccttattacccatcaatggacccacagagaatgggtgcagtcatttcaacccaagaggctggtggttcaagcactgagaacaacggagcttcatcttcttcttacatgatgcctccacaccagtcatacccaccaccaccatatggatatatgccatcgccttaccagcagcagtatcctcctaaccatcatcatcaacctagtcctatgcagcactatgccccgcctccagcagcttacccgtacccacagcaacctggtcctggatcaagacctgcaccgtctccaaccgcggtctctgctatatcacccgactctgcacctgctgggtctggagcaccttcgggatcctctcaacaagctcctgatgtttctacagctactggttcgtctcagtagagaagaaatatcgcttaaaaaatgtactgcaagtttcccgctattcaggacgaaggttttttgtattctgaatgaatcattttcttctgctttttaaagtacttcggaatgtattgtttcttcaaaacggttgttaacgaaatctatcagttatagaggcaattggttccatgaagagtctgcagttattggccaatttcataaagaactttgagaatattattatcacaaatttcacatttgctcgaatcgtttatttttttttgagaattctactagtaatttggataaatgcaaataatctgggaaatacaattgggccttttgtgagaagaaaaatcgtataaagctgggccggacgccaaactgaaaaatgtgatggaatttttaaaattcaatcgcgtccgactttcccgaagcttctttctaaatcctctctacatatattccccactcatatatg

SEQ ID NO: 36566 - DNA, 3003 bp, Unknown
  misc_feature (1)..( 3003): 2750-1469P.txt file - cDNA_ID_3097863; gDNA_ID_2936557; Annot_ID_194291
atgtgttacaatggttgcatctgttagggtgcatctacgttatatgggccacacaccctcagtggctacattcaagagttcaagaaactctccaaatctctcgtccttgatatgcctgttcaaccggggcctcaaccgccggatctccttgacaagcaactaagcttcctcacaccagtcatgatggacacaactcctagcggagacagtttcggggatgttatttcggatgttcctaaaaacttgtctttgaagagaggaaacggccaggtgaccgttgtattccggtcagcctgccctagaaacgatctactgacagaaggtatcatcacccaaacccaatagaaaaaataatatttgagttttttttttaatttctcgagtaatatttctttgaaacaagttactatagagactatacttgtgcttgcctgtaagcttttctgtccctttttctctaattctgtgatgaaggataataaccttaaccatggagcatagtcgcgttgatgcaaaactgtgagcttttaaaagtgaaaatattgaaatactaactattcttgctgacgtgaatttctcatgggttattattgctcataaatttctaaaattgcatatgcttatgtctacttcttagtgatggatcctttcaaaataagtgacttgtcatactttgatgctaagaagagatactatgttcatgacagggacgtttacactggtggagagactagagcagaaggacaagacttggaccccggtttatgacgacgatgatctatgtctgaggttcaagtggtcgaggcataaaaagctgagctcccggagtcaggccactgtggaatggagaattcccgagtctgcatcaccaggggtttataggatcacccattttggtgctgcaaagaagctttttgggtcagtccatcatttcacaggctcttctagtgctttcgttgtaacataaacaagtagaaaccaaagtagatacatagtaaacttgtattatactaggtttacctgatgcactgtcttgtgcacttgcatgtactacacaaatgtagccagagagtacagaatggtgtcaaagaactgatgttgagaagtctaatggaatccaatataccttttcatgtcaatgttcacatacagtttaagtatccaggtataggcaactacggttgtgttagtgtataaattatcttgcaaagtggagttagtttgttgatgaatggtcatagtttcaagacaactaattttgctgaactttgttatcataaaacataataagtcaagaaaacaactgattctagaggggggatacaaaggaatctcaccaaaaaaaaacaccaacattgtcaataaatcttcaacattttagaatgaagagaaattgtggatataaaaggggtcttagggattagtgtcttcttcttcttcaatcttaggagccaagtagtaacgaatgtaacccatctcagcaaccttatactccacaaccactggcaactccgacgataagctgattgtcactgtgtctgacaatggagttgcctttgtgaaggaattcatgtacctcagggcaaatgagagagacactggctccttcatctctatcacaattgcatcttccggctgcaatacacaaaacaaaagcctcaatttaacatgttactccaatgaaacagccgtagaggatttgtcaacagtatcataggtttatgcaaagagttagacatgttaataccttgtctacagttgtgttctgcctgagcacaatgttagcggttccaatgtcaccggcagtagaaaacttcacgccttctttagtcacagagatcacaactgcaacaataacatcaggtcaatctctatttagactaaaaaaaacaacccagattgagaatagaaacaatgcagcaatgtacctgtgtcaccaatgctactgagatctttgcaaatcctggaaaactcattggaaggcatcctcacgattgagtggtactcagcatcaggtattcccagatgttcactgtctatatccatcaacttcatctcaaaatcagcaatcttgtcttgcgctgtaaatcatccaacacaaaaccaagttaaaagcagctaggtctaaaccaagtttttgaaacttgaaactatatacaacccctaagagaactaaatcattctattccatcaatcattccaccatttcgtacaagcttaacccatagaaaccagaaattagagtaagtcagtcaattagcaaataaacttactggggctctcaaacatgaaggtaacggtgtcgccgccgtcatcagccttgatggtgatgatgtcatcatttccggcgcatttgagcatcttcgacatgttgccgagattcatccccatggagagattcctgtcgcatctgtagtgttcgaagccttcggatcttagcaagagagacaccagagcaacgtgactcgaatccatagcttggagtgagaacccagtgctggagcagtcgaaattcgcatcgttcaccagatctttgattgattctagaaccttcttcaacaacgagccctgaacaagacgtagctccaacatttcgtcgtcttagatattatcagagttcacaatgagaatcgtttgcggctattttggaaagtggattgacactataaggtcaaggagtccgatttataagctttttcttttctggcgggatttcgccattctaagctatttggttcccgccaatgcgctagtgccggcctcaatcgttttaagaattggatggatatttttggtcattataaaagttagagggttaatttgtattaataaaaagaagaaaagttcatttcgaattgtagtgaaagtttagggttttatttgtaatatttaaaagacaaaaacacgcgaatccaaaaccgactttgccctagttaaaatctcgtcgtctccttcgtgttcgagatttgatatcgactaatcgaatcagaggataagagaatg

SEQ ID NO: 36567 - DNA, 3003 bp, Unknown
  misc_feature (1)..( 3003): 2750-1469P.txt file - cDNA_ID_3097868; gDNA_ID_2936557; Annot_ID_194289
agttgacagaaatggataaagatcatgtatgtaaatcccctggtactctctgtctacctttaagttgagaaaaatctgacaacggattgaaattaagatctagtgttttcagtttcgccgtacttaaacctgcaccaccaagaaacacattcataagtgatgttataagtcagcagaggtaagcacttccataaaacaaagcaaaaaaaggcagccactcactatgactagcctcagagtcattgacaccattgaaactgagatccagtacttccaaatctctgaaatctgttaaacctgcatctcaatgtcacacttagtcagtcatctgacatcaattctttagttctctcttttcttttggaacaacaaaactatataaaggtttgttgacatattttaccttgagaagataagaagctgaaactgttgtccttcaagtttaacactctcaagtttgtcatgtttgaaagttctgccacaccagaacaagaagccgtcaaaatccatctccaattgaattatatacaaaaatgtcaaaaagagaaccaaacatatagaagaaatacataaccttgaggaggaaagacaccttccatgtaattagactcaagatgtagactcctaatcgatgtcgcagcatttaaaaacgggacgatactgttgtcgaacatattatgggagaaatctaaggtagtgagcttatctagtgtcccaaagctcttaaaacctgaaaacaaaaatgcaagggaaaaaaaaaaactaaaattctctttcaaacaaactgtcgaacactttatgtgcactatgtaatataccaaattacagaatcaaactcacgcgccctacccttatttcacacaatcatcaagatcttatattgaactttatacacattcttattcgataaatcagctatggctgatcttagagacaaaaccatacggtaaaaggactctgtttctattgttgccgttggaagagattttcgtgaggttgtttgtatttggttaaaaccggtttaaacctgaaccgctatttcttgttgttggtatccagacattaattagtgggaaaattgagaaatgttcggttagagagacgtaccaaggaagtgatcagacaaattagtgaaccaattccacgaaagattaaggctttggagttgaggaaaactatgaagcaaagacagatttaaagaccgagtttgcgactcaaatgcgaccggtacgagtctatccagtgagagaccgatgacgtggccattaatagcatcactacactttactctctcccaacggcaacaatcaccttcatgatgagtccatgacttgagaatactaagtccttcttcttcttcttcttcggcatcaacgagattcttgagatacgacttgagctgcaacaaacccatccgttcagtttccacacagcttacacatcctttcatttggaattgaattatcattgttattgttatgaacaccaaagttatatgcttcttcggtttaacccaccaccttcttctctcgtctgttctcattttttttttctctgttttttttttgctagaaaaactgataatttgatttgatgcccaaagtttaaagagattgcatagtttgccaagaatagaattgtaagatgtgaatataaactgtacgagtccacgaaatactcaacccatattggacttttgtgttcaactccaaaatgagaattgaccgatgagtccatatccatcgaacgtatgcatgcctaattaccatccaccagtagctatcaacatctctaagggacctttgtgttttgttgcgtaaattaagtaggagagtcaaagctatcctattgatatcttttacgttttttttcttctctattttgcatttatgtttacgtgtaattttaaagatttaaatttatactttacactatttttttagtttataaaagtttaaaatgataatacaataaaaaaaatttaaaataaaaaattatatattttcgtcaactatttagtatttactcatataaagtttattaaaagtattactattttatatatgtaggttttgcatttggggacaaatattcaatttcaggtaaggttaaagctcaaaagcctgatccaactataagttttgggccaagacctgatatgggtttggcacctttaataaagtcaaatgagtcgtcatcattcttgggggacgatcaaaataatgaaatgcatcatctctcccaccaatttcattactttgcttcgactctcagactctttctctcattcgcctcactcatcatctctcactttctcgcatcatattcctttcttcttccacctgactcatatctcctgtttctcttagaagaatcccgtactgagatcaggttagattttagtttctcttctgttgttttgttcttgcccgattgcatgtactcagcatcttgctgattcaccatggctatcttcaaatttctgttttattttgcttgtaacatatatgggggaaaagtgatcttttgtggctttttaggtgtttttagtatataagtatatagttactaaactttattcagtttcctaatgaagaagaatcacatgtattagctgaactgaatttccggatttcatttttttttttttatggatctcttttggcctgtgattagtcttctcagttcggtgtgctcagggaattttttggtgaacttctgattgagaatcgggaatgtcaaactgatcttgtcacaaagattattcatttccataaaaatattaatttgttggaccctatagttatatttatttacacttgctttgtcatgtctttggacggagaatctattaggagattagatacaatctattgatagtaactagtaatttacataattttcagttttactttcccaaagattcagtgttgtgtatgtcagtaacagtgtttttatggcatagaaggtaatgcgaagtggttgagagatttcactatgatg

SEQ ID NO: 36568 - DNA, 3000 bp, Unknown
  misc_feature (1)..( 3000): 2750-1469P.txt file - cDNA_ID_3097882; gDNA_ID_2936557; Annot_ID_194285
atcttactggtttagttgggctttttcttgatggcaacaattttactgggagtcttgaagagggtttattgaagtcaaagaatcttactcttttagacatatcagataataggttttcgggcatgcttccactttggattggtaggatatcaaggctttcctacctatacatgagtggtaatcagctaaaaggtcctttcccttttctacgacagagtccttgggttgaggttatggacatctcacacaatagcttctctggttcgataccaaggaatgtgaattttccatctctcagagaactaagactacaaaacaatgagtttacgggtttagttccgggaaatttattcaaggctgcgggattagaagtgcttgatttgcggaacaacaatttttctggaaagatactgaacactattgaccagacatctaagttacgtattcttcttctacggaataacagctttcaaacttatatccctgggaaaatatgtcagctaagtgaagttggtctgttagacttgtctcacaatcaattcagaggccccataccatcatgtttcagtaaaatgtcttttggtgcagagcagaatgaccgtaccatgtcacttgttgcagattttgacttctcatacattacattcttgccacattgtcaatatggatcacatcttaacttggatgatggtgtcaggaatggttatcaaccaaaaccagcaaccgtagtggattttttaacgaaaagcagatatgaggcgtatcaaggtgatattctccgctatatgcatggtctggatttgtcgagcaacgaactatcgggtgaaattccaatcgagattggagatcttcagaatatcaggtccctgaatttgtcaagtaaccgcctcacaggctccataccagatagcatttcaaagctgaagggcttagagagtcttgatctatccaacaataagctagatggaagtatccctcctgcgctagccgatctcaacagtttaggatacttgaatatctcatataacaatttatcaggtgaaatccctttcaaaggccatcttgttacctttgacgagaggagttacataggcaacgctcatctctgtggacttcctacaaataaaaattgcatctcccagagagtccctgagccaccaagtgtgtcaacgcatgccaaagaggaagaaaatgaagaagaaggtaatgtgatagacatggtgtggttttactggacttgtgctgcagtctacatatctacatccttggcattgtttgctttcctctacatagactcacgatggtcccgagaatggttttatcgtgtagatctatgcgttcatcatattctacagttcaagcgttcctcagtctgcaactgattctgtggattagccaaggtatacaccactggaataacacagtcttaaaatgctttcttagttgatccaagttagatgagaaaaagcttttgtatacaaaatatatgtcttcgatgtcaaatatatacatgataccagtttcaatttctaaacattatctcataatatttgggcctcaggagcccattatagcccataaaacgcataacggctgaatagagtcgtactgtacttgaaattgaaaggcatctactagtagactctagagttttctggattctgttttccaatcttttcatcgttttcgtgtgaagtttaaagaagtttgggacccgtaaattctagaagctctggagatttcttgttcaccactataaatacatcatccgagtcaccagctttgctcagaagtagaaatcgaactcgccggaaaatcgtaattagctatctcagcattccaaacatctctttcgctttcgaaatcaaatcgagaatgtcgcttattccaagcttcttcggcaacaacaggcgaagcaacagcatcttcgacccgttctcactcgacgtttgggatccattcaaggaactgcaattcccgtcgtcgctctccggagaaacatcggcgataacgaacgcacgtgtggactggaaagagacggcggaggcgcacgtgttcaaggccgatctgccggggatgaagaaagaggaggttaaagtggagatagaggacgacagtgtgctcaagatcagtggagagagacacgtggagaaagaggagaagcaggacacgtggcatcgtgtggagaggtcgagcgggcaattctcgaggaagtttaagctgccggagaatgtgaagatggatcaagtcaaggcttccatggagaacggagttctgactgtgacggtgcctaaagtggaagaggctaagaagaaggctcaagttaagtctattgatatctctggctaaagccaattagcttatgggtttcatgtttatgcgtaaagactcttctgattatggctcttgatttgaatatggctctgtgttttggtaatgatgtattataactgttaatcctaataattaagcaaggcctttatattctcgtttcaattgctttttctgaagattttagccgtaaattcgattttaactcggatgggaccaactaaacttaagtttaaaggttgaatttttaatttagatatgcaatttgcataatctgatcttagttttggtatgactgatttgtaacaaagtcttataacaaaaagttgaaatttaatgaaattatttcttccgtggtaaacaaaaaaaaaagaatctcaaaattcgaaactaaataaaagggagtttccgttttcacctcttgggcacaaaacccgcaacgtataaggaaaggaaacagagaaatacagaaacaaaatatataaaaaaaacatttgttccattctcgatccttccggcttgctcaaaaggtaaaattcgattttctagggtttcgatttgctgctttttgatctcattgacgatgattagttgtagtttcttcgatcgatgttgacgtgaatgtgtatatgcgtaggttgatcagacgctaggatttgagaagcaatg

SEQ ID NO: 36569 - DNA, 3000 bp, Unknown
  misc_feature (1)..( 3000): 2750-1469P.txt file - cDNA_ID_3097885; gDNA_ID_2936557; Annot_ID_194284
gtggattagccaaggtatacaccactggaataacacagtcttaaaatgctttcttagttgatccaagttagatgagaaaaagcttttgtatacaaaatatatgtcttcgatgtcaaatatatacatgataccagtttcaatttctaaacattatctcataatatttgggcctcaggagcccattatagcccataaaacgcataacggctgaatagagtcgtactgtacttgaaattgaaaggcatctactagtagactctagagttttctggattctgttttccaatcttttcatcgttttcgtgtgaagtttaaagaagtttgggacccgtaaattctagaagctctggagatttcttgttcaccactataaatacatcatccgagtcaccagctttgctcagaagtagaaatcgaactcgccggaaaatcgtaattagctatctcagcattccaaacatctctttcgctttcgaaatcaaatcgagaatgtcgcttattccaagcttcttcggcaacaacaggcgaagcaacagcatcttcgacccgttctcactcgacgtttgggatccattcaaggaactgcaattcccgtcgtcgctctccggagaaacatcggcgataacgaacgcacgtgtggactggaaagagacggcggaggcgcacgtgttcaaggccgatctgccggggatgaagaaagaggaggttaaagtggagatagaggacgacagtgtgctcaagatcagtggagagagacacgtggagaaagaggagaagcaggacacgtggcatcgtgtggagaggtcgagcgggcaattctcgaggaagtttaagctgccggagaatgtgaagatggatcaagtcaaggcttccatggagaacggagttctgactgtgacggtgcctaaagtggaagaggctaagaagaaggctcaagttaagtctattgatatctctggctaaagccaattagcttatgggtttcatgtttatgcgtaaagactcttctgattatggctcttgatttgaatatggctctgtgttttggtaatgatgtattataactgttaatcctaataattaagcaaggcctttatattctcgtttcaattgctttttctgaagattttagccgtaaattcgattttaactcggatgggaccaactaaacttaagtttaaaggttgaatttttaatttagatatgcaatttgcataatctgatcttagttttggtatgactgatttgtaacaaagtcttataacaaaaagttgaaatttaatgaaattatttcttccgtggtaaacaaaaaaaaaagaatctcaaaattcgaaactaaataaaagggagtttccgttttcacctcttgggcacaaaacccgcaacgtataaggaaaggaaacagagaaatacagaaacaaaatatataaaaaaaacatttgttccattctcgatccttccggcttgctcaaaaggtaaaattcgattttctagggtttcgatttgctgctttttgatctcattgacgatgattagttgtagtttcttcgatcgatgttgacgtgaatgtgtatatgcgtaggttgatcagacgctaggatttgagaagcaatggcgaatagaatagatcatgagtacgattacttgttcaagatcgtcctgatcggcgattccggtgttggtaaatccaacattctctctcgattcaccagaaacgagttctgtctcgaatccaaatccaccattggcgtcgaattcgccacccggactttacaggtcatctctcttctctcgctttctctaaatctagacaatttccctccagatcaatttggtgtttaatcttagattgtgtcgtcgcatttgcatcctctgatatttgaacaggcatgtgattgttagatctgaagatcttatgttatgaaaatgaattctcgttaggggtttattttaatgtaattgtagcaaatgaaatggctcgtctttgttcatgcttgtatgtgtaatcttgactaggttgaaggcaaaacagtgaaggctcagatttgggacactgcaggtcaagagcgttatcgagcaatcacaagtgcttactacagaggagctgttggagctcttcttgtctacgacataaccaagagacaaacttttgagaatgtcttgagatggttacgtgagctaagggatcatgctgattccaacattgttatcatgatggctggaaacaaatcagacctgaatcacttgagatctgttgctgatgaagatggtcgctctctcgccgagaaggaaggtttgtcgtttctcgagacatctgctttagaagcgactaacatcgagaaagcgtttcagaccattttgtctgagatttatcatatcataagcaagaaagctttagcggcacaagaagctgcaggtaatcttccgggccaaggaacagcgatcaatatatcagattcatctgcaactaacagaaaaggatgctgttctacctaattacaacaatccaactatagtgattactaatcaatcaatcacacgttttgagttttctcttctgatctcttaccagttcgtttcttcttttttggtttaatttcagcaagtatagtatacctttttctttccgggtctttgtttttccatatcgtattggatttatgttacaagattttgcttagttgtattgaactgtgatcattcacaccattttctgaaaaaagaaagatttttttagtatcttgatttaaaatctcttgaagacataagtgtgaatgatttccttaggattagtttttggtttggccagtttatatgctctttgatcattgtaatagtagcagccaaagtggtctataaattgttggtcaacctcttcttggctttaatgggttgtaatccttttaacttttttcataatttcaaatcttgtttctggtttcaaaaatcaaagcgaaatatactaaaatagggtcactagggaggtggaagagggtgatg

SEQ ID NO: 36570 - DNA, 3003 bp, Unknown
  misc_feature (1)..( 3003): 2750-1469P.txt file - cDNA_ID_3097890; gDNA_ID_2936557; Annot_ID_194283
gaccttccaccattacgactagttgtcacgatgcaatgaatgtaagtaaattggttatttgtttttttcttaactttttaactttatttcaaattccaatttaagttcaaaagttcaaagaacctaaaattaaacgagaagtgttgcagcaaaaaaaaaaaacagaaagtaaatgaccacgtaagtacacatggatgtatcgtaggcctaggtcgaggtgcatgccaattgccaccatgcacactaaactttggatatttctactaaaataataccaactttatcaaatccatatattaattgtaaggtcatgataactcatacgctatattccaaaaacagaaactgaatgattttgtcacctaccaaatgcatgattctagcaccttcagtattggactattgggagtcaattcaattacagtgattttggttggatcggtgggtacacgaacgagagggcccatttaatcctctccatttccattttaatgagatttgatcagtaacactcatcacaaatatcttattttagtttctgatgagcgatgatggtcttattcacacaatgctatttactttttcccaaactcatttttttccttattgctagatcatgagcaaaactattgattcatgattgtagtagcacttaagtgttgcgaaaccaaattaaagatgaaaaaaaaattgtaggtggtacatcaattaatgtttgcttttaatagggtggatgtaattaatgaagtactgattttccatgaagaagacaagccaaatgagagcttgagatcttgaaaacaaccaatagaagagtactgcctatacatgacatgagcatgataaaatgtttttgtttaaagtacggaatttgatgatcaaattttttgttgttgatcaaaacgtagaaacacaaactatatatcgatcgcccccgtgagtagtacgtattattatttcaaaagtaaatgattttgcagacttgcagttattcatttataagcgaaacgttatcttatgcaatgtttacatttgcaacaccaattagcttcttttttttacagttgagacttgagagacacattaaagcttgtcatcgttcactggagagagtagagtgtgtgagagacaaagtgacctaacttcactgcaacagtagtcggtaaatatccaaacataagagctacgatggtaacacgtgtacggtggaggaaaagagagccctcagattccgttataaaggaggtgagacccactcgccggaatggaaacaaaggagaaacgtagaggtaaatggttgggccactgcttcaccaaaaagccttttctatcttctttttatttttgttttgtggcttttaacggttaacaatataactcctcattccaagacaattacgtgtcctctgtacggctttttcatttttcactttctacttcatagtgactttagggaggcctcaatttttaattactcgaggattatttaggtaatcatgaatgtaactacagctttacaggtaattaaacagatgagatttagttgcgtgaaatctagctgatctggtgcttatatcaaatccaattgatggagacagatttggacttaaattcatgattgtatttgtaatcttatatacgttatagttaaatttctttctctccgtacgtactctaactataattattattaaatgctgaacgcaatgcttttgagtgctgagaatctttttggtctgattcaaaaatgatgtattagtactctgaattcaatcttaacttctgcaacgaatcaatgtattaatttataggagatccggataaaattatggatatatgcacgctacttctttcatttttaattaggtaaatggttataactttattttatatatcaattaaatgattttggtatgagattactagtacactttctttgcaaatgttttaaacacgacaagacaaaaatattacaagcatattttggtaaaaaatatcataagctttcatatcaaaatcattagttatgatgttagattttttttttttttttttaacactacaaaaagctctggtcttaatatgttagaaattttagtccaaaccagcctacagaggatttagctaaacaattcccaagcaccttttaagtgttaaccgaaataacgtaatatgatgttaaaggttacataaaaacaaaactaaagaattttcatatgaaaagttaacgtacgtgtcttagtgtaacctaattttagttcacagtatataaattctttaatgagatgatcgcaaaatcgctgtatacaatttcgtacttaattcgttagtcttgaaaagttgacctaatttagatcaaattaaggttaactacaataaaaatttaactaacgtaatgggattctttaaaattaaaaaatcgttgattagatagatattttatctttaagggagacacagagacaatttggacaaaaaaggtcttcctgagaaagaagtggaccacaatcgtggcgcgaaaggaacttcctcctcccctctgttgccttgtcattgggccacgtatatctccacctgatcgtgatgcttacgtggtccatttctagatactatagtgaccagatcaacggtcaagattgattctaatttagacgaaagaccaacacgtcacgtcgctagagtaaaagattttttgaaggcggagggagaaaaatcaaaagttaaaagtaatttgaaaacgaggaagagaaaaaggaattttaaaatgtttaatgaagcggtaggccgcatgggtatataaatgggcacgctttgtaacgtgtaacgatgatatttattcaactgcgtggtataaccaaaaaaaaaagaaacactattcgactctttttttgtttttgtaataaacataaaataaattttggagagagatatttcgtcggaaattaattgacgttcaaaagattcgttaccggaatatttagtagaggcggcgatcgagttatg

SEQ ID NO: 36571 - DNA, 3003 bp, Unknown
  misc_feature (1)..( 3003): 2750-1469P.txt file - cDNA_ID_3097910; gDNA_ID_2936557; Annot_ID_194277
ataaggtgtaaaactttgagcaggagttccaataattaatcctaattacataatagttgcacattacgcaaagccgggctagctaagagtacaatttaaacttaaactatttcattcccttgccttcaccatttccacttagtagttattttggaagcattcactatatagtagacataagcagagagacactatccctctctttgcttccctttctctctctctctccatctctctagatcactatctctccttctggctcaatcaccacaaactcacaatcaaactaaaagtaaaataaaaccagaaaccctccatctgagtcagaagctctcattctctccctctctcttctgcaacacaaagatggacgagaagtggaggctgtcgaaaaaggatgcattagctgcgtcgtgttcatcttcttcaacttcatctaaatccaagttctctagaagcttctccacaagcgcttcctcctcaaaagctcctgcattcgtacggagctcatccaccaaatgctcagtgccttcatcttcgtcgtcttcaatctcaagaagttcatcgaaaaaagagaaagggtcaataacacaaaagtacagtagcttggccaaagaacagaagggaaggttttacatcatgagaaggtgtgtggctatgcttgtatgttggcataaacatgattcctaggtagatatagatctcatgcatttttattctctttttttgaatgattagatcagtttgattctctactctaagttgccacaagtttccatactagtacattgtaagaagagattcttttttgataatatattactattaattttgataagacagagtcatgtatacagaggtataaataatttaaagtgtgtcgtctgatgaagaaaaaaattgaaaacatcgaacgttttttaaaaaagtgaaattatatgccacaatctggagggtcgatgtgtcgagacgtacaattattttgttaggattaaatcgaatagtcactttcattgtctggcaaaaataatgaaaacaaattcaataataactaccaatgataaatttattttggtcaaagatctgaggtttcttttgtttccggtcaacagatctgagtgtttttcacatacttatttactaatttatttgtcgtcatatggcttttgcaatgtttatgctgtttttatagccgtgattagacttggaaacaatatcttaatggggtctagttaatgtcatggatttacaattatgatgatgatgatgatgataataatctggtcaataaagttgcatcatgctagtagattagaaaattcgcctacaccacaaatattggaatcgtaacttctttttccatttcttattatatatggctaactgaatcagtacaacaaaacccatttagaatagaaaaatccaacgaaaacagaataaattctttaaagggttacataaatcttttcattttgagagatatgagttacataaatcatataacttattttttttcactctttgcatctcgtgacagtattagttttcttactttatttatttattttgtctctttgatagaaggaagattccctattgcctaacctaaatatttccatctatgaatccaaaagaaatttatagtaatatactatatgttaaagagagaatttctatatagtgtataagaatgtacgtacttggacactgttccgtgttactgacatgaatgaaattaatcttctatctttatagccgggggaaaaagaattcgagatattgaagaatccaatggaaagttatgaaccactcgatctttgtctctttttgactctgacgataatgtcatgatcataagaattttggattgtaatcagaaaataagtgatcacgttacaaaattattcaaaagcccttttcaattattgcaagaaaataacaatttatcgtacggagaaactcttaataggaaaaaatatacacaaaaaggcgaaaaaaaatgaaagaaagaaactcagacttctcaggtgagaaaccaaacacaaaagtacaagagagaaaaagtgaacagtgtcagaaacattacacagatttgtattacgagcgaaaaaaaaactgagttcgaaaaaaaagaatgtgtggcgttaatagagacgttggattttgttagagtgaatattttgggaaatctaacggtggagactgcggaaccaagtggctaagtatgaaccagcatttttgtggcgactgttcgttttgatcgaggcaaaaactagccttgcggcaagatctttttagacgttaaaacaaggagataaatcacttgagtataaactagtcttttagcgaatggaataacacaaggttaaaggctttagagcccatacgggcccaaaacattatacgactttgtgtaatagatcatataggtaaaacagaaatttgctttgaaccatacataaaatgcaacaaacctgcgaaactgatactatgaaatctgttaaatttcgtaaatcctatagttgtaatttataaataaaaaaacgcatgtgtatgtcaatgaaaaaaatcccggaagaaatcttaaattaaaaaagaaaattaataaagagtttaaaaagcaataataataaataaacaaaatgtgggaaaataaaatcgctatcgcggagatgatggcacgtgtccattttacgatgtgatctgatccaaacctatttatattcttcgctgctgttctgtcttgaccgctcctctcgatctctgatctccctgtcttctgtctacgcttcgtcgccggccgatttctcccagactcgtcttaccgcctccggtcgaaaccctaggtgagggtaacgagcttggattggtttattgtttttgttctgggggaaatttatttggcaaattcacctaaaatgttgtttctgatgaaatcagattcccggaggacgaaattcgttttttcgccggaactaaattaaggagatttgagaggctatg

SEQ ID NO: 36572 - DNA, 3000 bp, Unknown
  misc_feature (1)..( 3000): 2750-1469P.txt file - cDNA_ID_3097920; gDNA_ID_2936557; Annot_ID_194274
ttcagtatagaccgtaagacgtgggtaacccgtaatcgcatatattatatgcacacactacgttttggtgttatacaaggacgacgttgttaacataaatcaaccgtcacatgagtgagagagcacaataaattttatcaataaaactgacatagtgggacaggaatcacaatgaaatttgtagaggaatcacaatggaatactattttatcaataagagtaaagcattttcacaaaatgcaagatatatattttggaatcatgcctacggctaaatatataagatccaattgaaagaagaggggggactcaagtattccgcttaaacactgtgccttgaataaaactacttgtaaatgacaaattacatcttttggttagacgaaactgaacgttttttataagatggaaattatctttcattggtatagtggttgatgttaatataagagacattgtctctaatttgtctagaaacgtctaaattcaaggagcggacttgtctctcaaacaatttaatgaatcagtggtctacaattctaagagtttttaaaatttttgaaaacattaatatatttttgtaagagggccatttgggagtgtttggagagaaaggagcagagagggacgggggtaaagtgtttcttacgataaataatttgaaatcggggccaagagtagacagctttggtctaataatattccacttgtttttttcacttatgttttcaaaaaattatggctttctcgaaattaactcactccattaattacactaaataaacattgtgttgtactttctaccatttttttcaattggtaaactgtcatgttagttcatcctctaaaagtcagtcacaatctaatttctagtgttgacgtcaccatgttaatcacagagatgatcatgttttctagtatgtatatatgagtacacacattgttacttgtgaagaggaatgatagattttggtgtcgaaattgcttgatttatgagggtcaaagtgaccgttgttccaagtttggctggtttatgtggtcggattataacgttaaacgcatttgcgtggttggaagcatttatgtgcatggttattaggacaagttgtttgttttgctcttgcgttagttaaacaatcaaacatttgaatttttgtacttaacaaagggacaacaaaagtttcaaatctagactcctttctttaacgatatttgttcatggaaaaacatgtttttcaataatcgtgaaatcttcaattggctctaataccatttcaattttcaataatcgtgaaatcttcattaaagtgaaatgtgatacatgattaagcttaaatacaaagaaaacttaaccaaagatactaaccaaactaaaccataactaaaattatatatatacactctaataatgttaaaagattatagcatccacaattcaacaaaaatgttttacccccacccactatatcattgaattatggaccgtcgcactcttctccggtcgtggtgaaccggctttcaacagattaatgtgttttcgactataaggtatgcaaaaatttgctccatatgatcaaagtgaccaagcagattttgaatcagtattggtcctcggactagatatgtataccacacaactttaagccaggacttgaagactttctttaagagtttccatccctcgttatgccatattaacccacatagctttcaatttattcttggagagaaaataactagtgtagcggttatgaaaacttaaaacgcgtccatgactacaaataatacaaagaccatttctatattaaatatagaaaaacacttatatttttcccaacctgacagaaaacaaacaaaacaaaaaaggaataattaacatcaaaagttcaaaaccaaactagttcaacataaagttcatacaaacattgttctgcgtatcctacatgactacatccaaaaaaagaagccgaaacactaaatatatatacacacacaccaacgggacaatataagtcacagaggagtcacaatctaatacacacacaccaacgggacaatataagtcaaagaggagtcacaatctaagcgcaactaggttgccgcttgggaggctgctaccaccgagaagaacaagtctagatccggcggctgaaaatatcccttcttcggtggttccctcttcttcccaaagcctagtagcgatctcttccttctcaccggaggtggacaaggcggatatgctggtatccggcaatcatcacgtgtaggcgtcgtgcatcccatctgataatcatcatcaaccgtcaccgtatctccgtcgtcgtagtttttctcctccatttttgtccgctctctcgcactttcctaataaggttcttaattagattgcttctttattacactagttttggaagtgaccgtagcttgttctggaagttgctaggtacttgcggtctagaaacttacacgtggaggaacgtactgccacgtgctaaagcgtagttatattcaggtgggaatagttgccacacataccccactcgagtcaaatgctcgtttataatgtggcttagttaaaacgaagcccattaagctaaacaagggcccgaatttactggagctaaggccattaaccacgttaaagatttgcgaaataaataaccggttggtttttagttgaaagactaaaccggttgaaataatccacggaacaacaacatatgttggagtctggaacgcgttgatgtcttggttcccaagcagctcaaaagtgtgacataaattgttgtcctcaacaaacaccataaaaatcacaaatttcgttctgggctctttatttttttcaatcaccacattttcacttgttaaaattttgttactttgctctatctgaaaccaaagctgccatctttctccttttgggttttgattagatctccgattttgggtttctatatattatgcgagctcacttttgttcgttctgattatctgacaatg

SEQ ID NO: 36573 - DNA, 3003 bp, Unknown
  misc_feature (1)..( 3003): 2750-1469P.txt file - cDNA_ID_3097935; gDNA_ID_2936557; Annot_ID_194271
cgtgaaggaggagcattgggccaattgggcatatggcttcattattatttattcatttgggttaagttgggcctagcctgaaaatagaaataaaatttggtgaattcatatgggccgaaaaagctgagaacaagcccaaagatggtgatggggaaatcatttttgagctggaagaaaggcaaaaaaagtaatagaggtttcgtgagcaacatgattcaacggtagaagaggtaatgtatattggctatgggaaatgctgttgctggatttttgtatacagttaacttacttggtcacgggctcgaagggagctgagctagtcgcgtacgttggttggttggttgagccgtgcacctaaagcagctttgtaccgacgcgacaccacgtggcggacatgcttttgcgtggacattggacctttgtctctctggggtccctccgatgggtcaaactagcaaaagtcaaaccgtcgaatattcgttcacactgtcacatccaaaatcagacaaaatggtaaattacatcaaaactctttttctatataaacaaaaaaatattgtcgacggttggatttacatattttttaataaaaaaaaagaaggaaaaagagtatgccatgttctcccgtcgattatataggaactacttgttcgtttcttcaaaaattattgggaattaataactctgtatataactagatttatttctaaattaatactctttctctttctcaatatttgtagtttaaggtttttgcatacaaattaagaaaacatataaatttcatttaatttattttttttctacaaaaacattattaattataactaattcaaccaataaaaaaatataatataaaatataattggttaaaatctattaaatacatttaatgtttgcatagaaaaatcaaaacaacatttatattgaaaaaataaaaaaccctttaaattacatttaattagaaacagagggagtagtttttatgccactaaattctgtatatcaatcgttactatcggatccaaatatccttcattttgtttggttgacaaatttcttttcataaaatacaacatcaaattgttttaagttatttagtatcgtaataaaatcttaaattttttcacattttacctaaaaaaaataaaaaatcataacaacgtatttctcaatttacaattgctactcaaagatgttctctttcttttatcaccgcatgtccacatctccatcataatcttccattgttttcaaagctaacagaatttgtttaagagtaaaaacacatttaaaaacattaaaaaatgctaagatggagatgcggggtatcgatccccgtacctctcgcatgctaagcgagcgctctaccatctgagctacatcccctacttgcattgttaaataaagttaccgtatatattattttattcgggtttggaaactttttctatctcaactcaagtttccataatttgaatttcatgaatagcaatcaaattcggcgatttgtgagaggataaaatccgaccaaaaaatctcgatcatcaaaatttgacagttaagttagaaaggcaaataaactttacaatggtaaaaaaaaaagcaatacaaggcgaagaaaagctcaacaatgaggcattattgttgtccttagagaaattatagtgaataataagtgtaaagtgtttttaactcgtgagcataattcaaatccatacataaggcagcagcatctgtaagattattgaagttgcgttagtcaattttcttaaaagatatatgtaggactaaccatcgagtcaatgacaatctttgtcggtctcctctctggatttaataatatgttaattcttatcgaagaagacctcaaaacttgtggacgatatacgagtatagaacgggcccagtcccctaatgaattaagttttgtattttattcaaatttcaacgaaccatcacacacatgttgtggttttcatcaaagtgtaataatcaacgatagtatcccatgcatgatacacgaaaaagaaaaataatctgaatgaatgaaccaacgtacgtagggtttagctggaaagatgctcttaatactcacggacattgtctcattccatcatgcaaataatacttctttttcttttcacatatgcaaataatactaattatgtagaaaaaatcatattttgtttattttattttagtagctacaaattcatttaaataattttaaatcttatagaaaaggatatttgaataaagcctatactaatccgaattttcaagacactggtttttgcattaacgttacgagcttaacgttaagtgagccgcaccgagccaagcctaagtcctctagctggagctttaacatggaggactacaatacaatgttaacgtcagatccaacggctgagagcgattgaacacgcttctgtgatgtgaagggcttaatcttttctatgctgacttcatcatcatatcttctttttttgtagtaccaaaaaggctaaaacgaaaacgatttagagaaatgacaacaataataaaaagtggggataatttttgatttctgatagaaagaaagagaaacaaagaaaggcgggaccgatccgccattaatgctaccacccaactacaaggcttttctcacacactctcttctctcaatctcttggctcagaacaaagaagataaaaaaaaaaggtgagtaagaatttgtctttaattatttcttcatgtgttagttgttaggttacttaaatcggcaaaagagatttgatgaacttggtcatatgctttaaagtgtgcatacatttttggggttgttactagttgtcaaatcttttcctttaaaccaatttgatttccttctcatcttttccagcttccattgattaaaagtttctacctttttcttatcttcaagtgtgatatattgtgagaagattgcagaagcgtgtccaacttggttccctctctctctgaaattactcaatcatg

SEQ ID NO: 36574 - DNA, 3003 bp, Unknown
  misc_feature (1)..( 3003): 2750-1469P.txt file - cDNA_ID_3097940; gDNA_ID_2936557; Annot_ID_194270
caccatacatttcctatatatatatattatcttttgtcaacctccctatatatattttatattttcctgtaagttttagtttcgtatatgatagggttagcaaagtttttgtatatgagatatacatatagctttcttgttggactatataatccctctagatatagattttctaatttcggcagattttgagtaaatatccaaaaaaatctcactatcttgacaagattacaaaataatcttttaatttaactatttaagacaacatgtataaaacctatatcttaactaaaaactctatattattgcaactatataatctaaatgtctattatcttaaataaataaaaatgccactaccactttttgatattataggccaagttattgatcagtaaaacgaggccggcacgtaggaactaggaagtcaaaaaataatatttttgtgatggaacgtaaattcaccaattcaggaccttgaaggggcaagaagccaactaaaacaccagccccaaccctagtgcaaattaccattctatataatgaccccatctacgatttattccttctatttccctttacgtaaagtagcgacgttcgtgaattcctaagaagttagactaacaggtttgtgtggttcttaaatttttgggtaaaaattaggaaaaaagtttatattcctacccaaactttcggcaccagagacaaattaggtttgttcagaaaatcagtcgctcatcgacagacttaacaccacaaaatcatcagaatttctttgggacaaaatggaaaatgttcttcacggctccacctaccaaaatttcgatatcaagctcaaaagcatacacaaactataactaattccatagttacgtaatcttaacttcgaattcaacaacacatgcatgcatcgactgaatcttcaacaaatgcaatcaaacacacaaaattgctaccaaaaaaatatgattttttttttatgatttcaattttcatccggcacttagtccaaaactttttttgtgtgtcaacattttttaaaaaaatctttaaacggatatctgatctaagagcatgttcataggtgatacttacaaaatatttttaagaaattttttagtattatttataatgtttgtttaataaatatatataagattttttgcttttatcaaatgtgaccaatcagaagaaaccacgtcagatgatactgatatgacaaatatgatactgatcaaacatattctaattgctttactaatataaaaataatttttggacttgtgatactctaaaaatatcacccatatacatggtctaatatatggatcgtaaaaaactcatatataatattaataagtagtagaagagcgtagaccatgtcctgggtcgtcgtccaaatgaccacaagaagatttcaaaacagaggaaaatatttctcattaaataagttttcctgacgcataagataacattattacaagattcagaaaaagaaaggtgaaaggataatgtttctcctactatataagatgtgtacatctgaaaaaatatgaatatatttgtaacgtttgactgttattacatgattaatacgatataaatattaacattttttttcaaaataaaagtaatatagtaaggaaatgaaaagaggcatgaagcatgcctctttttttggtcggctgccgtttacaattgccaattgcgatagttactcttcttgcgtgtacgacttttgtttttttttacatattcgccaataatttgacgttttctattagtttgtttgatactctgttgtcttgctaaaactcaataaaacattaaattactttcttgaatgaagctggaacaaatctaacataaatagaaaatgatgggcaagttgatgttattcgtaaatttatttagattatattatataaaaagcaatccaattatatatctcatatatacaatttcttatcttactttgtcaatgtcatatacgtaactaaaacttgcggaaatagaaaatgccacgtgtatggtggacataatccgaatctctctctttcttctataaatagtggccattcccattggttgaaatcacaaaagcatcataagaagaagaagaaactacaatagttaatcaatcaaagagaagtaagagaaatggcagattctaactgtggatgtggctcctcctgcaaatgtggtgactcttgcaggtaaacccctagattctctcttctttacatttatatgcatatatgtagactatgtagttcgagcttcatggtacaaaattcaataaactcttcttatgacttcgtttacaattgtgtttgtgaatagacacaaaagattagttttgtttactttagattcaaaacacttcgggcctatcctgtatatatgctgatcagatgcatgtggttgattaatctttaatctcatcatattaattactaattttttgtttgtttgattaatttgtgtgtggtaaagttgcgagaagaactacaacaaggagtgcgacaactgtagctgtggatcaaactgcagctgtgggtcaaactgtaactgttgatgaaattattatggtctaaaatcatatatatggcagaaaaattggggaaaatatgtgttttatgctaagagatgtgtgtgtgttgttggaataaagacgtgaccgttgtgttgcgtatcaactctcttaagctttgacttttcccagctttgtattttcctatgtatggtaatggtgtgattgtgtaatgttttcatatgtaacgtaaaaaaaatatttatgtgacattgacttttgtgactactaagatttgtatatgtctcctccgttttttatttaggatttaagttcaatcagctaaattaatcataaacaatttaagtaaatattcatatgagaagaagtcaaccatattcttatcgggccttatatgttaatgttaaaaggttacgggccagtaaggtcccaaaaaagaagaagagatg

SEQ ID NO: 36575 - DNA, 3003 bp, Unknown; identical to SEQ ID NO: 36574
  misc_feature (1)..( 3003): 2750-1469P.txt file - cDNA_ID_3097940; gDNA_ID_2926298; Annot_ID_205612

SEQ ID NO: 36576 - DNA, 3000 bp, Unknown
  misc_feature (1)..( 3000): 2750-1469P.txt file - cDNA_ID_3097950; gDNA_ID_2936558; Annot_ID_194330
gctgcagccggtaatgatactttcattttaccttaaacaacaaatctaactttccatctccttttaacgtcctatcatggatccaattgctgagacaggtacattttgttacatcgaccccgagtaccagcaaacgggaatgcttggggtgaagtctgacttgtactcatttggtgtggtgcttctgcaaatcatcacagcgatgccagcaatgggtttaagccatagagtagagaaagcaattgagaagaagaaactccgagaagttttggatccaaaaatatcagactggcctgaagaagagacaatggtgctagctcaattggctttgcagtgctgcgagctgcggaaaaaggacagacctgatcttgcttccgttctgttgcctgcactgagcaagctaagagagtttgcaacagaggatcatgaagtacataactctgatagaacatttcatgtgtcacgtgctcacaatttggttcctctttccccaatatcttcctgtcaggttggtttcttagatactgcaataacacatttctaatcttcacctggaaaaggaataaaattaataaagttcattgattcctgagtcctctctttcaatcatgtagacagaggatgatgcttgggaaaatcctattgacagaaagattggaacttcgacgtaaatcaaagtgaagcgacattggctatctctgagatccgcgataaacttgttcagtttaagcatccgatgccatcccatacccaccacaagaaggtgatttacatgatcacaaacaagccaatgcaaaggaagttgttgtcagtctctcatgaattgtactccaccccaaagttgaatgttgaacttccattgtatcggagttcctatcttgtttatcaaacactttatttttggtctcatgaaaagaaacacatttattatagaagatttgtatccttcttgcaaaatcaactcatctagtcacttttgctatagagaatgccatctgtagcacataaaaaacttttctacgaaactacaaaccgaaatttgagagtatagtcttctttgaataaaaaatggtttgacagcattagctgcaaagaagatgcaaacagtcgcacacaaaaaaaaagttcttcttaaaaccagaattaagggaatacctgtcggagctgcaccagcaatgttagctgacagggcactttgtcaatttgggactatacgcgcttaggctgaacacttagactcgagacttaagagacaaaagcagaagttcacaacagatccacattacatcatggaattttttgtttaagtcgttacctggagaaattccagagatgacgatgagagacaaaaagcttcaagagaaactccagagaggtaaaaaactgattacaactagggatcaagtgtgatactaccacgttccggatcactgaataatcacaaacaagaaaagaaaacagctagaaaagccaagaagcattaaaaaaatcttagaaaagaaagtagagattagatggccaactattaacaaatgagccctcaacatacatagcagacacatagtcatttctctttacataatcacataatcatacagtctaaactatttctctttacaaaatgataaaagatagattgaaagccatttcacctctgagtcattttgatatcaacaccaacatacacgctttctggacaagtgaaaaataagcacaacatataacaaaagctagcatgatcataagcaataactcatggagattcgaatatcaaaaggtaaaacctttattattgttattattatatctataaagaaaggttcgcaggttaacatacgctaaaatgtaaaccagaattctaccctagaaacccgaaaaagctttgatttttatgattttcccatataggtgggctctaaagatcactccggttcttcatatgtgagcataccgcttgaaaacctgcttccccgccacaactgcaccagccgcaattccgccaaaagcaccagccacagccgcagatctcactcctcgtgctgccctaaagaccgctccagttcccagaccagcgacaacactggtccaaacatcgtccttatcagttaccgccaccacaccactctcaatccctgcgtagatcaacccaacaatcccaaccctattaccccaagtacgacctgcctgaccagacgaattcaaaatcctgttgattttcagcttcgtcgtgtctccattttcgaaactcttgataccagagaagatcccagctgaagcaccggctacagagccggctagataacccgtccctgtgtagaaagtgagattttctccccatgatcgacgctgcttgagagactcttccgtgaatagaaattccggagaagtcggaagcttgtatagatactgagatttgatcgggacctggtagttctggtaaggatggtaaagacgggtgttttcgtcggattcatgatcggagctacgattgatcgccattagaagaagacgggagacgttttaggaacggtggcgacggagaaagagacgacggagtcagagaacctccagcttatgatgtggtacagaataagaaaggcgaaatgttttagggtatgtaagattttgtgactaattcgaatttgaccccttatgttttattttgaataatttaacccaagttctttcccgactttacgttttttcattttagaccctataatgtttgacgttttacataatatggtacttaaattgtaaatcctaccataacaacctctttgtagattaatctcattacatataaaagaaaaagaaaaagattttgtttggatttgggaagaagctttgaattaaaaaatagaagcaatagtttttgggggacaagcccggccgacgaatcggcggcgagacgttctttgtcaccgattgacatattcaaaaacgacgaagctaggtaaaggaacggagagaagagtcgataatagaagcgtagagatg

SEQ ID NO: 36577 - DNA, 3003 bp, Unknown
  misc_feature (1)..( 3003): 2750-1469P.txt file - cDNA_ID_3097953; gDNA_ID_2936558; Annot_ID_194328
aagtggtcgtacgtaatttactactgttatgtttttgttcgagagcaatagatttttatttgcgttttgatataattttcatactactagttacgggtacgcactatgctttgattcttaaagatatggagttaaaataatgatctgagtcatctgaccaaaatcaaacaaatggagtgttaaaaatagacttgttatacaagttaaaacatttaaattgtagttttatactttaatcgttgtgggaggaaagtgtacagtaatagcatacgactacgtacggtggtacaatcaccatttcgtggaaatgataaaatgaaaaattctaaataaatataaaattaaaatgaaacgtatataatagccactatatatcaatcaaaggaacagtagtttaataaatgaaatttaataactctttgaatcttcatcatcaatatgggtgtcgtccttttgttttgtcacattatgatcacagggcgacatacccatatgaaactgaaatgcatactataaacgtatacaattaaaaaatatatccaactcatgcatgttgaaacaaaaaatgctttaaatggataatagttatgggacgccactatgtaagtactctctcacgtttttatatatggcccgttcgattgcttaacgaccctaaattgtatttctgtggaaaagtcaaacaaatcaaaaaggccaatgctagatgtttaggtgtaataacaattctctctaattacattacaaggttttgtctgaactccgaatcatgtgcatctttatcttatcttataaaattctaaaaaatatatcggctataagaggacagtgttattacctcctatataattacactgttttccatgttaccatgtttaatcaatataacaacctttgttattttctcattttttattatgataattttggaattaatattgattgcataaacagaaaccaactactgtataaactaatgaagggatattatatatttatataaagggtcgaagagaattcgtaaaatagtggaaactggaaagtataggtcaatgttgtgcacgggaaaaggaagtacataataacactagtgatgggcgaaaaactcgataaaggttcatggaatcatggtggtgagatcccatgtgattatccttccaacctaagaataattaaccatatattcactttgacatatgaaaatactaaataaaatccattagctataatttataaaagtatacaaattacaacacaaaaaaagacgtttggatgaggattactgactgatgatatattgagcaatgcttgatttggcaattgttgcagtctttttactgttttcttcattcaatttgtccatacatttgccgcttggatatcacaccatgcaatgtcttgtctccatctaccatcatactttcatatcattccattttgaaaaatatataacttggggaccagagagtgtaatgctagtgcctataaacatgtgaccaataaacgaaacaaccatgtaaaaagattacgaaacggtgcggattggttcaatccacttccccgcgatctcgcttcgtaaaaagaaaaggagtttctgacacgtcatcatcatcatctcccaatgctaataaaaatggctaatataatattagtacatgattctaaaaataaaagctacacttttcttttcaatggtaatttttaagcttataatttttccaaatactacaaaattgcacctaataaatacaaagactaatggaaaataacaataataaagagatgtcggcattaattgaccgattttaaaataaaataaaggtttatttttaacttacacaaaattgagtggaacaagtgtttttatttgtttgtttgaccaatcaaagagtgatccaattaattgaacgggaaaaacaagaccagttcatttacattataataatataattattgatttttccttaaaaatatttgtattcaaactcatagaatcagtccatttaatcacacgatttatcatttatctgcaaattgtagtattattttttcacctacattacaatttggtgtttttcttttgcaaaagcagaggtgactttatttttggtgatttattagtgagagtgtttctacaaaatactaataaagtaaaaaatattacttaaaatagtactagtttaatttgaagttaattagagagatcagagagaagaagacggagaagaagcatcaccgaaagatccttggcactgctgaagatttctcagtcttaagcaataagcaaaaactaaaagagaaaaatcagaaagacaaaccaaatctgtgtctttctcttaaaccctgtgtttgcttactacgtctccggataaaaaagtcaaataatctgagaaactttcttcatttttgttgcgtcttgatctgccattgtcatcatcgaagttctcagctcataatcagcttcttcctgaaatgagtctatgttcctgaaaccatcgggcggattttgtctctctctctttctccacggtaatttcctatccagatttggctgttttccatctcttgagagtcaaagttgttgttacttggtttgaagatcttggactatcttttgctgctggttactgcgttttccttcttttgttttcttcacattttgctcgcaatattcattggatcaatcggaattcgtggcaaatgcgtttgaatttaaagtttcattttttatttttcctttcggagtttcttgctagatttagtcatacagactcgatattactgacttgtatacactttcgaattttctctttcaaaagtagttcataaagatctaatctttatgttaaggaaaaatctaactgtgttttggtttttatcttccttctgtacagaccaacaacatttatgagacattgagcacatttgagaatcttaatgaagaagaagagttcttgataaagattctatatttgttcttgagtttaagttctcgagggaatg

SEQ ID NO: 36578 - DNA, 3003 bp, Unknown
  misc_feature (1)..( 3003): 2750-1469P.txt file - cDNA_ID_3097970; gDNA_ID_2936558; Annot_ID_194321
gctacgattttcagctttctcaggaaaccgatcagaacattcggacccagcattaccagaagtccaaactcgaaatactctagtcttcttgtgactttctgcctgtaaatgcatcccgacttttaaacaaatactataaagccgagagtagctcttcttcttgtcaattccaagtctttcacatacctggtggaaataatatttaatgccttttcaaaaaaattcagccaaatacataaggtaataccaaaaactgtaaggcaaacccatcaaatgaatacctccatcacagccaagcctttagatccttcagcatcaaccatatcataaatttgattatctattggaagctccaaagtttgttctgttttttgaatactccttccgaattttaggagttgctttttcccagagtagttaaaatcttttgctgaaaatctttttaacaaacggaggcatcgttcaacctgcagaaaagacaatccaaatattttatagccaaataaaacagatcagaaatgctaaataaaggcaattggccaccatatgtggtgaaatgtattcgcatgatggaatgtgatgcagattatagttcaccttattgttcaccacagcatcaaactcctctactacatgagaatctgtcaaccggcgacaaacctgatgtaatccaaaatgcacacgtattaatttttcaaagatatatctaccaaaaagaaattggcaaagtgttgaaagtctctttcctcttgctctataagagaaaaaagaaatatatacttacacttctccaagctctatgccttgaatgtgatcccagataaccgaggtcttgcttaatgtccgagacgactagaacctgcactacaacaaatgagtatagagaaagaatgctccagcttgataaaaaaagaaagaaatgatttgcacttactaaccttctcattagtttcttcaagcttatcacaaattgcctgcattgctggtagaaaatctttaatgagcgtatcctcttttgtactttctgattgtaaactatctccggcgggagtagcctcttgctccaataaagagtcctctttgcaaatctcaaatctctgctgggaacccaaaggcttggcgtaacgacttaaatatatcatattggtgctaatgcatgaggtggttttggaatccccttcaccatcaacttcctttgttctcactatcgctggttgtttaacaactaaacctcgagactcaaggtgcttcacaatatagaagaagtttctaccttcgataccaaactctttagcaagcagattttgtgcaactccattggctctgcatcaaacacatacaacataatattatacgagctcgaactcttaagagtagctagaagagaatacagaatttgcacttaccgagcaacagcaagccgctcgagaacgcgacgctgaatagcggaaatagtcgtgttattggactgagcatcgtacaagccaacgaagttacctcggagcttctcattcgcgaagatcctcaaatcgagtcttagtgcctcttccagctgttgaatcgaagcatcagatggttcgtacacagtgtttttcgccttgaactggagctgagggacggcgagaagatttctccagacatgagccttgacggaaggagaaagaggaggaggagagagccttgaccagagagaaacgagtgggatccctgtatttccttgacaacagatttcctccagtgctgtgcatacaatcgaatccatttctcatcatccaaaaggtactcggttaggtttaggtcaacggaaaatcttccgccgataaattagttagtcagccgattaaccggaaattctcgccggagaggtgtcggaataatttatatagatttgggagttaggcgaagatggcgggatcagaagaggaaacgatcgaagagaaagagatattcgagttcttggtgacgggatcgatctcaaggaactgcgaaataattacgaggtaatttaattagggggtgagacaaagtaagtgacgagaatggccatacgtcagcaagttaaaacattgattcctcacgcttctaaactacgggccgtttttacttccaatcgaaacgacatgctgtttatgcgaattaggcacaaacaacacgaatcttttgcgggtcgggtttgttcgatccagatgtctggcttctctaacctccgtatctctctctgcaaaaagcgtgattcagagtaaatacagaaaaatatatcgtttttataaatggcattttttagaacatattagcttcgctcaaatatctctgtctcaaaagacaagtagattccttttttttacagtatccaataatttgtaatcatataaataatcggtgaaaaagaaggattctttgtttgtttcccgagaaaatatcctcgatttccatctcctatctgtcatcggagctttctacttccgaaggtaaggaaactggatcggaactcttttgaattctgtactgtgtatttgcttagggtttctgggtcttattgcattgttaaggattgcgaatcttatctgaatctgtgtctactactattgtgatgttttaaagctatttgtggaacagcttttacttgtccctttatagatctctttccctcttgggttcataagaacaaaatcctcttccctactttgtacgattcatgactattcagctgaatcgtgttgggttcttgtctgaatttgagtgttttaagattggattattactggaaatgtctgtactaatggaatcttatgtgagctttaaggattagagctctaaaatcaagatagggtcaggtcaacgcatagagaataaattgtgttattgtaactacttttctagtcaacgttttctgttaaattgaatccctttcttggctttgtttccatgtttttgacatgattgtattgaaacaggagtaaaggatcaatcaagagtttgatcttgttagaatagccgataatg

SEQ ID NO: 36579 - DNA, 3000 bp, Unknown
  misc_feature (1)..( 3000): 2750-1469P.txt file - cDNA_ID_3097975; gDNA_ID_2936558; Annot_ID_194320
acagcaaaaacattatgttctataaatcagagatacacatttatgaacatacccgcacaagcttgtacgtaacagggtttccaatttgatttgttgaggaaagtgatccgtttcttgtctgaaaaatactgtcttgaaacgtctctccatagtctttcacatttccaaacattgttaccctattttaacctaccaaatgcaacttcaagcatacaaaaaggcataagcaaatatacctatatgcttaataaatttttcagtcatgcaaaaaactcttacacaatacaatcactgatactcaaaaatcctagctttaccctttcatagagagaaaaatattggggatagagtataatcttattaggattattactatatatcttgtgatagagtttaggtcctatatatctctaatccctcaaatataggacctaaactctatcacaagatatatagtaataatcctaataagattatactctatccccaataaaaaacaccactgcatcttcagaataataaaaaagctttcaactttaagctaccatttatcaaatttcaatggaatttgcgtgttgcagttctcacatcaagtttttggtagattccactcagtttaactcgcatcaaacaaacccactacttaattttcaggatagaaatatgaaaagtcacgaggaaagcagttaaccgagcaacaagtacacaagagagttaccagagaaagtagaacgggaacggagaagaaaaaaatcagactttccagtgagctcgtagtttcatcggcgagaaatctcggaggagaggcttcttgactaagctaaaaaccttggatatttgcaaacttttttgttctgctttatttttttttgttttggctcgctttcggctttttttttccctaatacagtgccatacaggtccggattccaaagctttttattcactcgatttcagaatgccaattgggatccgtatagttatgcgggaagctcctagaggttgccacgtcagcgaatagcgaaatatctgccgaaaaagagccaactacgttccgtcccgactctcgtgcaccacaactgcgtgccgtcttacacttcaggattcgaatacgtgtcgtcttagtctagagttcaaaatactgcactcatgtaaaactcgcacaggctatacaacaacaaacaaacatgcaatgataacactggagaccaaaggtaagaaaaacagaagaatccttaaaccgaaatgtgtaaactttacaacaagtttcttgtaaagactcttaatcatttcaatagagatattacatttgtaaaactctcctttctcctttctcctcaatcaattagctctgaatctgaatatgaatctatgataatcaactttgatggtcttggacctcttggttacaatactaaccggatctaaatctcttctggttagctttcccatcagatttcaaagttccactagattcaccttctgatgaagcatccactgatcttgcaaaagaatgagagagatcaccataaaggctagctactcttctgatattgttgttgagctctttgatcaaccccacgtttcgacccaagttatctggttgtttcgattcatggttctgattgatctcgttgatcaataatcggttttggtccaaaatgtcttgaacatccacaaagctcttctggaaactctgcaacaatttcccatccatattgtgtctgtctccaaatcctgacaacacatctccttccattatcggctattctaacaagatcaaactcttgattgatcctttactcctgtttcaatacaatcatgtcaaaaacatggaaacaaagccaagaaagggattcaatttaacagaaaacgttgactagaaaagtagttacaataacacaatttattctctatgcgttgacctgaccctatcttgattttagagctctaatccttaaagctcacataagattccattagtacagacatttccagtaataatccaatcttaaaacactcaaattcagacaagaacccaacacgattcagctgaatagtcatgaatcgtacaaagtagggaagaggattttgttcttatgaacccaagagggaaagagatctataaagggacaagtaaaagctgttccacaaatagctttaaaacatcacaatagtagtagacacagattcagataagattcgcaatccttaacaatgcaataagacccagaaaccctaagcaaatacacagtacagaattcaaaagagttccgatccagtttccttaccttcggaagtagaaagctccgatgacagataggagatggaaatcgaggatattttctcgggaaacaaacaaagaatccttctttttcaccgattatttatatgattacaaattattggatactgtaaaaaaaaggaatctacttgtcttttgagacagagatatttgagcgaagctaatatgttctaaaaaatgccatttataaaaacgatatatttttctgtatttactctgaatcacgctttttgcagagagagatacggaggttagagaagccagacatctggatcgaacaaacccgacccgcaaaagattcgtgttgtttgtgcctaattcgcataaacagcatgtcgtttcgattggaagtaaaaacggcccgtagtttagaagcgtgaggaatcaatgttttaacttgctgacgtatggccattctcgtcacttactttgtctcaccccctaattaaattacctcgtaattatttcgcagttccttgagatcgatcccgtcaccaagaactcgaatatctctttctcttcgatcgtttcctcttctgatcccgccatcttcgcctaactcccaaatctatataaattattccgacacctctccggcgagaatttccggttaatcggctgactaactaatttatcggcggaagattttccgttgacctaaacctaaccgagtaccttttggatgatgagaaatg

SEQ ID NO: 36580 - DNA, 3003 bp, Unknown
  misc_feature (1)..( 3003): 2750-1469P.txt file - cDNA_ID_3097980; gDNA_ID_2936558; Annot_ID_194318
acattattttattggtcttttttggcgatttgtgtatcgttggttattgggacccattagtttcaaaaagcagacgaaacgcattactagagtactaaaacaacaacatatgttccacgtgattctcttaattcgttttgcggataacaaaagcgcgtttgcttttacttaactcattcatagccgtaacttgctttttagttattaatctttggaaatattaattagtcaattgatttctgacgactataaataatgcagaggataaaaacgcatggttaagagatgacgaattcgcacgtcaagccatagctggaatcaatccagtgaacattgagagagtcaagacttttccaccggtcagcaatcttgaccccaagatctacggtccacaacactccgctcttactgacgaccatatcattggtcacctcgacggattctccgtacaacaagtacgtttatctatataattccccttacaatggattaactaaactaatcaaaaaatgattaaattaaatagtcttttctattttttttcaggcgttggaagagaatagattgtatatgttggattaccatgacatattcttaccgttcctagaccggattaatgcgctagacggacgcaaagcctatgctactcgaactatcttcttcttgactcgtctaggcacacttaagccggtagccattgagctaagcctccctccccatggtccaaaacatcggtccaagcgtgtgcttacacctccagtcgatgcaacctctaattggatgtggcagctcgctaaagcccacgttagttctaacgatgctggtgtccatcagcttgtcaatcactggttagtacttatacatgttaatacacatttatgtaacaagtagtgaatatagagttatatattgacatgttttgttatatttgtttgtaaaggttacggacacatgcatgcttggagccatttatattagctgcacacaggcaattgagcgctatgcatcccatattcaagctactggatccacacatgagatacacgttggaaatcaatgctttggctagacaatcgttgatcagtgcagatggtgtgatcgaaggaggcttcactgctggtgcatacggcatggaaatgagtgccgccgcatacaaaagcagctggcggttcgacatggaaggcctccctgccgatctaattcgcaggtatttagctaaacctttttttgttttagttgaagatttttagctgctaaaaatgtattttttttattgtatataatacctaaatttattttaaattgtgtttattttcagaggaatggcaattcctgatgcaacacaaccacatggtcttaaactcctaatcgaagactatccgtacgccaacgacggtcttttactctggtcagcaatccaaacctgggtccgaacctatgttgaacgctactatccaaacccgaaccttatcaaaacagactctgagctccaatcttggtactcagaatcaatcaacgtcggccacgctgacctccgcgacgctgattggtggccggagttatcaaccgtcgacgacctcgtgtcgattctaaccactctaatctggctcgcctctgctcaacacgccgctctaaactttggacaatacccttacggtggctacgtcccaaaccgaccaccgttgatgcggcggttaatccccgacgagtcggatccagagtacgcgagtttcatctcccatccggagaagtattacttctcgtcgatgccaagtttggcgcagacttcgaagtttatggccgtggttgatactttgtcgacgcattcgccggatgaggagtatattggagagagacaacagccgtcgatttggacaggagatgcggagattgttgaagcgttttatggatttgcggcagagatcggacggatagagaaagagattgagaaaaggaacgctgatcctgaccgtagaaataggtgtggggctggtgttttgccttatgagttgttggttccgagttctgagcctggtgttacgtgtagaggtgtacctaatagtgtatctatataattaagaaggaaattatttataagaagtaaatgtagaaaacacataaataatttcttgtaaaccatgatatataatatataaagataattttcgtaaagttatgccaaaatcaaaatgactagaaaggttaatgtaaactatcttcttcggtattgacctaagtctagcctgaaatttgagatggcttcttgggttctgacctaacttgggtctcaaactaccttctgatcacacggataaagtataaaccttgaaattataaggtgctatgagaaaaaaaaaatgagagatagaagagtacctttattctcctgggaactcaaggtagagaccctcagccattcacttgagagtgaagacaaaggtttcttcttggattttaacctaacttggacctgaagccatcatttcattggtagaaatctaggaacttaaagttggcaagagagatccaatccaacgggtaaaacttttgtctttgtttggtagattctgatccaacgatgcagattcaccaacaagagccagcgacttaatcgagtgtggcttattagttgacgtagagagacgacaaagagacgatatagtttataccatgagtacatgtgtgatgtgtggatcagtcgctctcgtgcgaggacattctttaaacagctgtaataataagctcaattacttagattttcatatatagatttgtttgttaaaatgttaaataaactttttatagaattagatgtcgaaacacttaacatgcactttgccacgtttgaacaaaactcaaatcaataacatcgcttaaacaagatttaaccggaattaaccggaccggtagaaactgtgtttgaaatttaaaagcacactctctctatcgccacacccacaccttctctgcaaaaacaaaagatttccacttttcttaaaaatg

SEQ ID NO: 36581 - DNA, 3000 bp, Unknown
  misc_feature (1)..( 3000): 2750-1469P.txt file - cDNA_ID_3097980; gDNA_ID_2926301; Annot_ID_205707
ttattttattggtcttttttggcgatttgtgtatcgttggttattgggacccattagtttcaaaaagcagacgaaacgcattactagagtactaaaacaacaacatatgttccacgtgattctcttaattcgttttgcggataacaaaagcgcgtttgcttttacttaactcattcatagccgtaacttgctttttagttattaatctttggaaatattaattagtcaattgatttctgacgactataaataatgcagaggataaaaacgcatggttaagagatgacgaattcgcacgtcaagccatagctggaatcaatccagtgaacattgagagagtcaagacttttccaccggtcagcaatcttgaccccaagatctacggtccacaacactccgctcttactgacgaccatatcattggtcacctcgacggattctccgtacaacaagtacgtttatctatataattccccttacaatggattaactaaactaatcaaaaaatgattaaattaaatagtcttttctattttttttcaggcgttggaagagaatagattgtatatgttggattaccatgacatattcttaccgttcctagaccggattaatgcgctagacggacgcaaagcctatgctactcgaactatcttcttcttgactcgtctaggcacacttaagccggtagccattgagctaagcctccctccccatggtccaaaacatcggtccaagcgtgtgcttacacctccagtcgatgcaacctctaattggatgtggcagctcgctaaagcccacgttagttctaacgatgctggtgtccatcagcttgtcaatcactggttagtacttatacatgttaatacacatttatgtaacaagtagtgaatatagagttatatattgacatgttttgttatatttgtttgtaaaggttacggacacatgcatgcttggagccatttatattagctgcacacaggcaattgagcgctatgcatcccatattcaagctactggatccacacatgagatacacgttggaaatcaatgctttggctagacaatcgttgatcagtgcagatggtgtgatcgaaggaggcttcactgctggtgcatacggcatggaaatgagtgccgccgcatacaaaagcagctggcggttcgacatggaaggcctccctgccgatctaattcgcaggtatttagctaaacctttttttgttttagttgaagatttttagctgctaaaaatgtattttttttattgtatataatacctaaatttattttaaattgtgtttattttcagaggaatggcaattcctgatgcaacacaaccacatggtcttaaactcctaatcgaagactatccgtacgccaacgacggtcttttactctggtcagcaatccaaacctgggtccgaacctatgttgaacgctactatccaaacccgaaccttatcaaaacagactctgagctccaatcttggtactcagaatcaatcaacgtcggccacgctgacctccgcgacgctgattggtggccggagttatcaaccgtcgacgacctcgtgtcgattctaaccactctaatctggctcgcctctgctcaacacgccgctctaaactttggacaatacccttacggtggctacgtcccaaaccgaccaccgttgatgcggcggttaatccccgacgagtcggatccagagtacgcgagtttcatctcccatccggagaagtattacttctcgtcgatgccaagtttggcgcagacttcgaagtttatggccgtggttgatactttgtcgacgcattcgccggatgaggagtatattggagagagacaacagccgtcgatttggacaggagatgcggagattgttgaagcgttttatggatttgcggcagagatcggacggatagagaaagagattgagaaaaggaacgctgatcctgaccgtagaaataggtgtggggctggtgttttgccttatgagttgttggttccgagttctgagcctggtgttacgtgtagaggtgtacctaatagtgtatctatataattaagaaggaaattatttataagaagtaaatgtagaaaacacataaataatttcttgtaaaccatgatatataatatataaagataattttcgtaaagttatgccaaaatcaaaatgactagaaaggttaatgtaaactatcttcttcggtattgacctaagtctagcctgaaatttgagatggcttcttgggttctgacctaacttgggtctcaaactaccttctgatcacacggataaagtataaaccttgaaattataaggtgctatgagaaaaaaaaaatgagagatagaagagtacctttattctcctgggaactcaaggtagagaccctcagccattcacttgagagtgaagacaaaggtttcttcttggattttaacctaacttggacctgaagccatcatttcattggtagaaatctaggaacttaaagttggcaagagagatccaatccaacgggtaaaacttttgtctttgtttggtagattctgatccaacgatgcagattcaccaacaagagccagcgacttaatcgagtgtggcttattagttgacgtagagagacgacaaagagacgatatagtttataccatgagtacatgtgtgatgtgtggatcagtcgctctcgtgcgaggacattctttaaacagctgtaataataagctcaattacttagattttcatatatagatttgtttgttaaaatgttaaataaactttttatagaattagatgtcgaaacacttaacatgcactttgccacgtttgaacaaaactcaaatcaataacatcgcttaaacaagatttaaccggaattaaccggaccggtagaaactgtgtttgaaatttaaaagcacactctctctatcgccacacccacaccttctctgcaaaaacaaaagatttccacttttcttaaaaatg

SEQ ID NO: 36582 - DNA, 3000 bp, Unknown
  misc_feature (1)..( 3000): 2750-1469P.txt file - cDNA_ID_3097989; gDNA_ID_2936558; Annot_ID_194313
attaacaacataataaattttattttatatatatttccagccacctaaaagaaatacatatgcttctaaaatggagtaaaattaaagaatttagatgcttaacacgtgtactgtttgaaaatcacaaagacaacttaagaactccctagattttgtgttaaatgacaattcacaagagtttaggcaacgtcttaagtctatgaaccacatattaatcactgtttaaagtggtccctaatcctaattcttgtcccaatgtccccacttattcttaattaactacacttttaatcaattctgtgtgcgtgtcagtgttttgtcgctagaaacattcggatttatgtgtaactttacatttagttagtctcgatcttgttaaagatacttgtaagtaattatcaaatggtttaagatagtgatcagaaagaaaaaagaggagaaggtgggagagcaagttggagtaaatgacaaagtttcatggagaccaagaaaatgtttgctatccaatgatgtcacttcattcggtaacatgaaattctattggtaagtgatgatcattttatattttattttacttacacatcttgtacttgtaagcaagttgaccgatccatagaggtgggatgaattttttactatggatattgcgaagatgtattatctattaattgattacaaaaatgaaacactaaaattaatatctggaatcagaatccactagatccgaatatatatatatatatgttcgcagaaaactgaaagtatttcgatgctaaactaaatgagagttttcaaatacataaaattttatgttaacgaaaaatgatctactgtatatcgttcatgagtataatgagacaactacgtttatatataagattatttcacgagacaactccgtttaaacatatcgtcatgtattcaatcaatatatcaatttaaacacacatttttgcttactacaaataataatatcttttcttaaaaatacattttgaatgcgatttcgctactaaacaaccccttttgaaaccataagaaaatgtgcttcttaaccattgactatcaaaatgtaaaatccggaactccttaaaactaagagaatctgaatctcttggatttgttacgttatttgatagtgatacttgtctaataaattttaacaaaaaaaaagatacttgtctactaaatagatactagatatatatcatatacactaattttttttaaaaaatgttttttaaacttttatactcgcatctaaaatatggtaatggcctttaaaagtcaacccgacctatttggaccgacagaagattgccaaaatagcctctgttctcagacacgtgtacatattattcctctgccatttacgtgtgtatgacatggcgatctttggttggatattgtacgtgatttggagtggtgtaggttggcccacaacgttttcttcataaacgaaaaagcgttcagtggtttagtttttttactcttatttataaaatttcactttccatctgtctactgtctacttctcaactcttttttcagtacgtaaaaatgtatactttaatacgtttaaatatacacttagatctcatagtctagataatcgagagtagaaaaagaactcaagaattcgagagttttaaaaaaactcaatagcttttgtttttacgttgggttttcaaacttcatgcaagtttgagtggcgattagctaagcaatggatattagtcaatagtttgtattttttttttgatgtaagttacaagattgaaaaactatttgccctaatatataagggttaaagacttaaggggacatcgacacgagatcttttcgtggattttccttatttttttcgttctttctttctgactcttttcctttggattttctattcattctttgaaaagaacatagcttctatattaattttccaattttaataatttttcccatattctataagactatagtggatacataattggcgagcaataatacattgcatagtcgatcttcctaaacttggatttaaccggcttgtctatactctactatctttgacgtttagtttgtatcattgtatgttatgagttatgacactgaattgacataaatgttatccgtctaggttaaatgcattctccaaaaccaatattacacaatgttacagaataattattctccaactttctcgattacagattaagaagagactaaagccttataaatataagaattttggattagaatcagataacacaatttcatttattcaatcgacaataaattgagttactaattaatatctgaccgaacaaaataaaagtgaaaaaaagaaagagaagagcaaacgaaaaaaggaatgtgaatactagtcccaacaagttcatattatatatgtaattaacaaaattcatgagaaccctctccgtgtccgtgtgtcaccatagtaaccattgaatgtaatgaatttctagggattcaactagtaaaaacagatcaaactttagtctatatatcgttgagttggctccactgtgtatgagccgagatcaaagccgtgacgttctctccgatacatgggttaacaattaattaactaagttttttggggcttaaacttttaatggtaatacaattaatttatgggccatagaagaatgttggtggactcgtttgcttacgtggggatgtgtgcattaatgtgggtttgtgagttgtataaagaagcaactgtgagataacatctgaacacaaacttacaagaacagtttaaaagtttttttcttacttaaaattctctcttttaagtagtcaaagtttggaacttgaacaccataaaattcatcaattttactccaacttgtctaaaaatctaatcttttttgatcactataataaccaatcttgattcatcaataactcgagttgagaaatatatacattgatctctctgttacagtcaattgtcagaaaaaaagaaacatg

SEQ ID NO: 36583 - DNA, 3000 bp, Unknown
  misc_feature (1)..( 3000): 2750-1469P.txt file - cDNA_ID_3097995; gDNA_ID_2936558; Annot_ID_194312
ctttcaaaataatatggatcttctcattcaaaggacgaaaactgccttgatgatgatctctaagaccgtaacttaaaatatgggttggtgttggcccaaaatcaatgttaagttcccaccaagcccatgccatattctccaatagagtatttaactattaatgatataaatattctaacagtaacaacataagacacaattacaagtttagtgatatatagtgttggaatataattataaattcgaaagaagtggattatgtaatgagaggttgaaacgggtcaaatattagcgtagagcatctgtggcgtttcggttcaatgtaaagaaaatatcatttttgtttttattattaaaaccaagacaagagttatatagtactatatcacttcatgatgatgtgagtctatggtcgaaaattttgagaagcaagtaccgtgtcggtgatattcataacagagcgtggatggtgtctaaaggtacatggtcttctacatggcgagagtggggaggagacaattctacacattttacgggactgtccggcgatggcgggaatttggacccgcttgttaccagtacggagactctcttctttcttttcgaaatcgctgttagaatggatctatgcgaatttaggagaggagatagagattaatggttgtccatgggcggtcactttttcgcaggccatatggtgggggtggaaatggcgttacggtaacatctttggcgagaacaagaagtgtcgggatcgggttcgttttattaaggatcgtgcgttggatgtttggaaggcgcatgtgcacaaaatgggagtgacgacgcggacagctagggaggagagattgattgcgtggtctccgccaagggtgggttggtttaagctcaatactgatggtgcttcgcgtggtaacccgagactagctacagcaggtggagtagttcgagacggggatggaaattggtgttatgggttttcgttgaatattggaatttgttcggctccgcttgcggaactatggggagcatattacggtttaaatatcgcttgggagcgcggtgtcacacagttggagatggagattgattcggagatggtagtgggttttcttcggacagggattgatgattcgcatccgctgtccttcctggtgcggttgtgccatggcttactttcaaaggactggtcagtccggatttcgcatgtgtatagagaagctaatcgtctcgcggatgggttagctaactatgctttttttttaccgttaggttttcatttgtttaattctactccggatattgttatgtcgattgttcacgatgatgtagcggggtctgcgtacccccggaacgttcaagtgtaatttttttagttttttcagttttaataaaaatgggggttcgcccccctcttctacaaaaaaaaatatcactttcaaaaggacccattcgctacccaatttttctaaaccccagaacgttttttttttttccaaaacacaacagccacttggtctttgcaacaatgcaagtagtgtagtggcgtagctaggggtaacgagttaccaaaccggtttgacaatctggttcgatcaattggccgatcactcggtttgctctaatcttgcttcatttagtcccatcaacaacacttattaaactaagtcacatctaaactttttatatctttggtatcattttccccgaacacgtttttttgaacgagtcgtagttttgaagcaaccaacgaacgtattgattattatgggcatccgtgaaaggggcagttcggtcaattgatccatcaattttatttttgaccaaactgattaggtgatcttaagatttttccttttttctttctataggaaagtgggaaaaacgcgattcacacgatactgttgctagtgcgtcgtacagattgcgatacgtgtcacaatcttgacggtctgttctatttaaaccacgtgttttaatcaaaaaacttctgtcggatcgtatcggagactttgaatttttatggcacatgaaacttcgtaggggtttgatggtaggatcccacattggtccacttactattcaattcgcaccgccgttaagtttgttaactaacgtgaggaacgtcgcggtgatgtaaaaaaaggccatgaaagttgtttctattacgatgatgccatcactggagttggtaatgtgctcttgtggaagggcaaattttgtaaatacgatcaaatttcgagtcttttacgaatttgtgacatacgccgtttaataacgtttgccgtcggttctgaaatctttattctttttctcttttatcgttacgcgtaaggaaaacgtgcggtaaattctaaccgaaaatatatataaaaaagtagtccaattttgaaatctggccgttgatggtagacaactaaactgtgccaaacaagaaacaagaggtgaacatatttttatgataagacagggcaataaatttgttgtaccaactcataaaacaatagataaattacttgcacaatgatggattattaacattaattttcttactattaatcatggatgaaaattcctttcttcacactagatatagttctttaactagttaaaaatgcatgcgatggaatattactaaatatgatataatctcatggctttatgtaagatttgttttttggtttttttggttgttgttaataaatttattattgagaagtttaattctattttggtcacaatatattgaaatatttttaagaaactaaaaagttcctatttatttttgttttcattaatttatgagaggctattaaagtcacagaaacttattgggtgaatgagtttataaacacatgagctattgagctagtagcctcttgtactcttccattttacgcgcaatccacgcaccaacaaaaagaaaagaaaagaagagataaagaatatctttaaaaagtaagtgtggagaattctttcttctcaataaacaacaacatg

SEQ ID NO: 36584 - DNA, 3003 bp, Unknown
  misc_feature (1)..( 3003): 2750-1469P.txt file - cDNA_ID_3097995; gDNA_ID_2926301; Annot_ID_205715
ttgctttcaaaataatatggatcttctcattcaaaggacgaaaactgccttgatgatgatctctaagaccgtaacttaaaatatgggttggtgttggcccaaaatcaatgttaagttcccaccaagcccatgccatattctccaatagagtatttaactattaatgatataaatattctaacagtaacaacataagacacaattacaagtttagtgatatatagtgttggaatataattataaattcgaaagaagtggattatgtaatgagaggttgaaacgggtcaaatattagcgtagagcatctgtggcgtttcggttcaatgtaaagaaaatatcatttttgtttttattattaaaaccaagacaagagttatatagtactatatcacttcatgatgatgtgagtctatggtcgaaaattttgagaagcaagtaccgtgtcggtgatattcataacagagcgtggatggtgtctaaaggtacatggtcttctacatggcgagagtggggaggagacaattctacacattttacgggactgtccggcgatggcgggaatttggacccgcttgttaccagtacggagactctcttctttcttttcgaaatcgctgttagaatggatctatgcgaatttaggagaggagatagagattaatggttgtccatgggcggtcactttttcgcaggccatatggtgggggtggaaatggcgttacggtaacatctttggcgagaacaagaagtgtcgggatcgggttcgttttattaaggatcgtgcgttggatgtttggaaggcgcatgtgcacaaaatgggagtgacgacgcggacagctagggaggagagattgattgcgtggtctccgccaagggtgggttggtttaagctcaatactgatggtgcttcgcgtggtaacccgagactagctacagcaggtggagtagttcgagacggggatggaaattggtgttatgggttttcgttgaatattggaatttgttcggctccgcttgcggaactatggggagcatattacggtttaaatatcgcttgggagcgcggtgtcacacagttggagatggagattgattcggagatggtagtgggttttcttcggacagggattgatgattcgcatccgctgtccttcctggtgcggttgtgccatggcttactttcaaaggactggtcagtccggatttcgcatgtgtatagagaagctaatcgtctcgcggatgggttagctaactatgctttttttttaccgttaggttttcatttgtttaattctactccggatattgttatgtcgattgttcacgatgatgtagcggggtctgcgtacccccggaacgttcaagtgtaatttttttagttttttcagttttaataaaaatgggggttcgcccccctcttctacaaaaaaaaatatcactttcaaaaggacccattcgctacccaatttttctaaaccccagaacgttttttttttttccaaaacacaacagccacttggtctttgcaacaatgcaagtagtgtagtggcgtagctaggggtaacgagttaccaaaccggtttgacaatctggttcgatcaattggccgatcactcggtttgctctaatcttgcttcatttagtcccatcaacaacacttattaaactaagtcacatctaaactttttatatctttggtatcattttccccgaacacgtttttttgaacgagtcgtagttttgaagcaaccaacgaacgtattgattattatgggcatccgtgaaaggggcagttcggtcaattgatccatcaattttatttttgaccaaactgattaggtgatcttaagatttttccttttttctttctataggaaagtgggaaaaacgcgattcacacgatactgttgctagtgcgtcgtacagattgcgatacgtgtcacaatcttgacggtctgttctatttaaaccacgtgttttaatcaaaaaacttctgtcggatcgtatcggagactttgaatttttatggcacatgaaacttcgtaggggtttgatggtaggatcccacattggtccacttactattcaattcgcaccgccgttaagtttgttaactaacgtgaggaacgtcgcggtgatgtaaaaaaaggccatgaaagttgtttctattacgatgatgccatcactggagttggtaatgtgctcttgtggaagggcaaattttgtaaatacgatcaaatttcgagtcttttacgaatttgtgacatacgccgtttaataacgtttgccgtcggttctgaaatctttattctttttctcttttatcgttacgcgtaaggaaaacgtgcggtaaattctaaccgaaaatatatataaaaaagtagtccaattttgaaatctggccgttgatggtagacaactaaactgtgccaaacaagaaacaagaggtgaacatatttttatgataagacagggcaataaatttgttgtaccaactcataaaacaatagataaattacttgcacaatgatggattattaacattaattttcttactattaatcatggatgaaaattcctttcttcacactagatatagttctttaactagttaaaaatgcatgcgatggaatattactaaatatgatataatctcatggctttatgtaagatttgttttttggtttttttggttgttgttaataaatttattattgagaagtttaattctattttggtcacaatatattgaaatatttttaagaaactaaaaagttcctatttatttttgttttcattaatttatgagaggctattaaagtcacagaaacttattgggtgaatgagtttataaacacatgagctattgagctagtagcctcttgtactcttccattttacgcgcaatccacgcaccaacaaaaagaaaagaaaagaagagataaagaatatctttaaaaagtaagtgtggagaattctttcttctcaataaacaacaacatg

SEQ ID NO: 36585 - DNA, 3000 bp, Unknown
  misc_feature (1)..( 3000): 2750-1469P.txt file - cDNA_ID_3098028; gDNA_ID_2936558; Annot_ID_194342
attagctttaaaccgaagcatatgcaacgcggccagtggattttgttcctcagtaaaaatctgtcagtttccgcctcgaaatgtgagaatttcggccacagtctactaaacaaacgcactggccagtggctatgcctttggtttcattatcttttgcttcatcttcttcaaaagccatggctttgtgctctatctgtcctcgcatccctcttcgattcaggccaaaacccatttccccttttctctcaaaacctcaaatttgtctcgcttacagggtttactcttccctgcaatctactactccctctaccagaggtaatttcttgctttgtattatgcatacactggttttccagaactatgaattacgtttaaatggattaaattatgaagtgtcgctctctttttaggacaaaacccacaagtttcgagaaagatgatcgaatactataatctccttaactttaacctttttggggtagtcttatctgaggaattgtggttcgtatggcagatgaacttggaactgttagcattgggtttctgggtatgggaatcatgggttctccaatggcacagaacctcatcaaagctgggtaaaaaagttttgatttttatgtgtagacaatctaattcacatcaattttgctactttacctctttttgatgtattgatgatacttacgttgatctttctggggcttggttgttaggtgtgatgtgactgtatggaatcgaactaagagcaaatgtgatcctctcgttggattaggagcaaagtaagagttccaatgcttcttataaagaatgatattatttactccgagtgaggttttagagctaacgtagaagaaaaatttaacgattaagaaagtatctccctttgttgcaggtacaagtcttctcctgaagaagtgactgcaacttgtgatctcacatttgcaatgcttgctgatcctgaaagtgcagtgcgtatgtctcacttttgtttgcgtctctttttcttctactttcactccatattaaaacaaaaactgtattttgctttctgtcagattgatgttgcatgtggaaagaatggagccatatttgggattagttcaggaaaagggtacttactccttcatgagacttatgctggatataacgttctattgctgaaatgtttcaagatatctgtatttcttatgtaactacagaagagttcacagtcgttcttttttaatttcttcttcgaatctatatagtaatgtggtcgatactttctggtaaaaatgggacttgccttgctactgcaggtatgttgatgtctcaaccgttgatgtggcctcatcaatactaatcagcaagcaaataaaggataccggagccttgttcttggaggtaaaggctcttagttaatctatatctagaatcactaaaaaaccttgtaacagatctggtggcttaagtcatttctatttttgatattcataggcaccagtttcaggttccaaaaagcctgccgaagatgggcagttaatatttctcactgcaggttcgtaacagcttactcctcattgagcttgtattaataatcgatcatcacttttgcatatcagattattttgtcttcgcgggtgacttgcctgtattttctaacatggttgaatcatgaatgaaatggagatttatgactatctggcacttgacattttaggtgacaagccgctatacgaaaaagctgctcctttcttagacatcatgggaaaggtatctcttttgcctgtgttttgcttttagttcttttttcttctgcaaatgaaccattttcgttactagtttgcattatatgatccagtcaaaattctatttgggtgaagttggtaatggagcagcaatgaaacttgtcgtcaacatgatcatgggaaggtatcatttgaccatctatcgcttcatttcttggcaaattccagattcttcttctgatctctttttctctttacctatgcagtatgatggcatcattcgcggagggaatacttctaagccagaaagttggactcgatccaaatgtacttgtcgaggtaactaaaacaccattgtccagcagaaagtttcttaccaaatgtgctataaaccccgggaaatttttttctgcaggttgtctcacagggagctatcaatgcgccaatgtactcactaaagggtccttcaatgatcaagtcagtgtacccgacggcttttccattaaagcatcagcagaaggtttgtgtaattgtgttactttctttttttagattctcacaaagactctggagtttgatgagactgtaattgacttttatccgtctataggatatgagactcgcacttggactagcggaatccgtatcgcaatctactccgattgcagccgctgcgaacgagctttacaaggttgcaaaatcttatgggttgagcgatgaagatttctctgcagtaattgaagcactaaaagctgcaaaatcccgagaagcttagctaaagatttgttcaatgtgaaaatgtgtttttttttgctgttgtatgaaaaatttcatctttacaacatgtcaattgataattgttaattttatatgagagcaagttaaaagtgtcaaacacaagtcaacctttgatctcctgatgttgacaaaagcaacaaagaaaagtgtttgaccaacgttgactacaataaatacggcgccgtttcggatattccgatgataagttgataacaccgaatcatttgtttcaaaaaattcttcagtgcctgaagtgttaaaattctcgcctgagctcgttgccgtttccacttcaaccatattggttagggttctttctcttccaagataagaaattttgaatgtttgatgtcataactttgaatcaagtaatcgaaattggagaaaaaaaattcattttttaagtttgggttttcatcatagacagacggagaaattaaaaggttttgttttgactcagctgcagtgatcgatg

SEQ ID NO: 36586 - DNA, 3000 bp, Unknown
  misc_feature (1)..( 3000): 2750-1469P.txt file - cDNA_ID_3098053; gDNA_ID_2936558; Annot_ID_194332
tatacaccaaagaagtgactagtgagatatgggagacttggactcatcccttcatgatcccccataagcattttgatgggtattttgagaaaatgaggtaaagctctaacagcatcctccatttcagatcttccaccgcaaattgaaatcgtgccccaaagaggtatacactctagttcataaacactcctgcttcctcttgctacattaggattttcttcaggtaacctaatgactacctcagaagttgccacctccatattcacatcgtgattcagactcgcaataaggacttctgcagtgggaacctgttctatggttgtctcgtttaggataatggccgtagcaagaactcgcccgttatcagtttcaactgtatctggcaaacttatctcagacctagcgtccacaactattaaaccttcgctaataatagtcgcatcagatactaatggctcatcttcttctgattcctggacagttacactaaaatcagaagacaaacttctcacttcagataaagtcttctcttctgaaacacttcccataatacaatccaccactccattactatatctttgtcttttctgattacacaacatgtcagctgcatcagtaacattctccagctcggagatatcgaaagtagatgagattccagagtcacacatcgtattagctaaacccaaagtaagtgcaactgcaggtgaaatctcttccatgagctggtatgcagcttccaaacctcaactggagcaaaacgattcaaaaaacttcattttcttctctaagctatagtctgatgaactctacatccaattcagcttcccaccgagacccaccagccgtttattctcaccaactaatccagaaagcagtgaatgacgaagaagtatgtacctccgctgaacagatctgacggatctatgaagacggatcctttgtgaattcgtgggattttgatcactctaacgatcctctataactcttgatcttcatcgaatcagaaagacaataaactcacacaaaccctaatttagaaacccacaaaaaaaaaatcagcctttttcagatagatcacacaagagagcagagagaagacacaaaggtgaaaactttatccaaaacaaaaacaaaagtcaggtgaaattgaagagaagggacaacaaacagagagaattgatatcaatcagcgaaatgaatcacaaaacacacagaaaaacctaaaaaagtcgaaacctttatctctcttatctttccaaaacgaaacgaaacatgggttctcctggatctaatgaggtttttacccaaaaaataaaattagaaaaattataagcactccacggaatcccaagtttctttatgtgacaacgaccttcattattaacacgttgctccaatcaattataaaactaatttattaatctattcaataatggcaacatagatgacgcgtgtccttccctcttaaaggtcaagtcttctgtttattcttctaatttagttttttgatccaagattgaaagtatgttcatgacatatgttcatgcatctcatgacacatgtagtgttatcataacgtggttaaaaaatagacaacgaaagacttttctcggagaccaaagtttgaaatgggcctacattaaggcccagtcagcgtcacttatatgggctctagcgtccacttgtttacattaaggtaagaaacttcattagctctgtctcagcttttatactttctgatcaactgataaaggcatggattctttgccgcggagtaaaaccactcttgaaccaccacagttggaaactatgatatgtgatgagcaaaccaaagcaacaacagcagttgatccgacggtctcaggggaaacagcctgaagaaccatcctatcatcagaagaaacagaaccagaaacaggtctgcttcttctgtggccatcataaattccgaagaagtgactagtgagacatgtgagcgttggacttattatcccttcatgatcacacataagcattctgataggtagtttgaaaaatgagataaagctctaacagcatcctccatttcaccgcagattgacacagtgccccaaagaggtatacactctagctcatagacactccacctccttcctctttgctacattatcatgatgacttgtagtaataaggacttgtgttgtgggaaccgcatcatcattcaggataatggacgtagcaagaactcgcccatgatcctctattccacttccattgtagcgtccacaactattattaaattccacactcgcttgtacacggctgtttgttatacgaaaatcattattagctatatattatatactccatatggtttctttgaaatatcaaaggtcctcctcatcagcgacatgaatcacacacaaaagacaaagtccttcaaactcaaacccttttgccctttcaaaaccaaacaggttaccccaagatatttaacacgttcgtcgaaacaattataaaactaatttcaacctttggatttcctcatggtcttcttctttcttctaaaagatcaagactgcctataattccaaatttatctagtttacatatatatcaatataagatgccattacacaaatctaaaaataaaaaatcctctttttgtctacaagatatgatatggaatatcctttaaagataagtcgtcaactaaaattaaaaaaatcctctttttgtctgcctctctgttcgttatgactgtttagattgttggagaaaagaaaaaccttctaattttagcaaagtgccaaaaccattataagtttaaattttctcaacaaacaaaacagctctcctctcctcttctcttcttaattccttgttatcattttcattatcattcggtctccttatttcctccttctgagggtaattgaaagaccgtaccacaatgtctttctagtttctccagaagcaaaagtttccagcaatcatctcgagggctgagaaacaatg

SEQ ID NO: 36587 - DNA, 3003 bp, Unknown
  misc_feature (1)..( 3003): 2750-1469P.txt file - cDNA_ID_3098063; gDNA_ID_2936558; Annot_ID_194335
gactcaagagcagttttactccgaggcaaagactccatgcctttatcagttgatcacaaagtaaaaaatcttctctttccctctaaaataatttaacacaatctgagaaagtttcttatttctaattcatgaaatttcttaccctttctctgcagccagatagagaggatgagtatgcacgaatagagaaagctggaggaaaagttatacaatggcaaggcgctcgtgtttctggcgttcttgccatgtccaggtccatcggtaggtcaaacttgcacttatgtcttccatcttgcctagtgacagaaatatgaagagagttttataggtcaaaattatcgataaattaaacattcagtaaccttatttagagatgaggatcattactacctgttacagtctctgcaaaatcatgagatctcctgaaagtgggtttcaatctgcatcgttttcaggtgatcaatatctggagccatttgtaataccagatcccgaagtgacgtttatgccacgagctagagaagacgagtgtctaatattggccagtgatggactttgggacgtaatgagtaaccaagaagcttgcgattttgcgaggaggcggatcttggcttggcacaagaagaatggagcattgcctttagctgagagaggtgtaggagaagaccaagcgtgtcaagctgcggctgaatatctctccaaactcgctattcaaatgggaagcaaagacaatatctcaatcatagtgatcgacttgaaagctcaaagaaagttcaagaccagatcttgaaacagtgtatgctcgagctcttacactattataattttattatttcttatttattgaaaaaatttccacaagtttacataaaaataagaagtgaaatgttggggggaagaagaattaagaccttgatgcatagctgaagtccattcctttttctcatggacttgaatgtgtatgtttgttatgtataagaagaatagagaagaaatgtttttactttggagtcttgtaggtggatatgttgttgtaatattggagatgtggcttaaggaattgtaactgaaatttatgtcacattcaccttaatacttttctgtaatctattatatataaatacttgttgtgaaagagttattattgtcttttctattgttattgttatacaacaggtaatattgattccaaagtgtttaatgagggatgctgtatcaaacatgaaaactaagtgaagggtttggagaaggatggttgtttaaagctatttcccctgctttttttactaagagagtagagtttaacaattaaaagaaacctaaataagagatcataattggtacgttaaggtttcataattcattagaattaacaaaaataatgagttggatagttgaagaatcaacagaaacccaagtgatgaatggatcaaagagagtcacataaaggagatcataactgatgttttagtgtggtgtattgtctcaaacaatgtgctgagccaaagaaaggatcttgagctgtttcctgaggcgcatctcgtgcgggacaggaccaaacactcgggtaccagtcggttggttgtactccattttcctcttggaaccatgtgaattattctgccctttcttttccttaatgccaacaactacaatggcattgtcatcaaacttgacttggcttccatcagcacgtcctttaggcatcgcagcacgcacaaccacaccgtacacgaccatccctttcttcactttaccttttgggatagcgtctttctttacttttttttgaacaattgggttagcttctttcactgaaccaacaatgatatcgccaagtcttgctcctttcttacctctcagggattgaatgcacatcacctctttagcacacgagttatccacgcatttgagaatcgtccccatttgaatgaatgtcctatgttgttgctgtgaattggaaatcatcaggacacacaattcacaggttataccccacgaatgcatatgaagaaagtttcatcaaggacgtatatttgcgaaaagaggcttgacctgagagaggatgcttccattcatcattccattggaggaggaattcatcaaaccagagaaagcattgcaaagacctccaagcaatgaacgtcctactcatattgtcgatgaatcatataacgacatcaccaacaattagtgacattcacaacaagaacaaaaaagttttaatcttgagtctgcatttcatgaaccaaagcaaagtccatgacatatcacaaacccaaaaactcaaagctcatttcgaaacttatactaaatcaatgttgcaaaaaatctaatttttaaagaaccaaactttatcgaatataataatattaagagatgaaaatgtacctttggagagcttggaagctaaagctgtcgccatttctgcaattcaaaagtttcgatctttagtgtcgcagagagtgaatgaatcttgcgattgcacaaagacaccagatttagggtttaacgtcacacactcgctgtcgcagcgatcatttgggcttgtaatgattttactcatggattaaattatatagtaaaaaagtggtgacgttgtcaaaagtaggcgtgccggagtggttatcgggcatgactagaaatcatgtgggctttgcccgcgcaggttcgaatcctgccgcctacgtttttccttttttttcgtatttaccttattttcctacattttaaaaccaggggccataacattttttccacatgtactataacatttgtttatcacaaaatctgaaattcttaattaacaaaaataaacaatggtgatgccctaataacaaacatttctttcttctttttttttgctacgaactttttacttttgttgattgttcatgcatttacaaagacaaaatccaaagtttcttaatgttatgaaaaattcctaaatcaagaagttaaacggctgagaagaggttgatcaagtggaacaattcaccgatg

SEQ ID NO: 36588 - DNA, 3000 bp, Unknown
  misc_feature (1)..( 3000): 2750-1469P.txt file - cDNA_ID_3098069; gDNA_ID_2936558; Annot_ID_194334
cgactgcgaggtgggtaacatcaagaagaatgaaaaaggtcaagtaacaatgaatacgattttcttaaggcataatcggaagaacaattaacaacattaaaaaaaaaaacttaggaaccaagcatttaagaataaatcctagtatgaactgtttctaattaatgaacttagctgataagccccagatttggaaagatgaagaacgtaccttgaattgttgttccgtaaagtttttgcattgccaaatgcttcgagaactggattagactgcaatgtgccattggggatatacacattaagctgtatacagccatatatggaatcatcctcatttttcatgaaaaaaataaacaaacctctaagacttgctgttcaactgtccttccttctacaccagacctccctcccaaaaaggcaaggtacctcatgagcatctttgtcgtctcggttttaccagcaccactttctccacttaccaaaatcgaattgtttttcccttcattaatcattgccctaataacttacaccgtgaccaaatcagtaaattatctcacgaaatagatagaagtacgataaattgatggacgtgaacatgcacaaacctgtatgcagcatccccaattgcaaaaacatgaggacttagttctccaagtgcaattcccttatattgttccatcatatcagtttcataaatatgaggcagcctttggaatggattaactgcaattaggatattccctgtatatgtctacagaagtaacacaaaacttattagtatcatagcttataccaaatgatttcctttgcagcaacaaaaagtaagagatgttagaaaaaaaggataaaatatcttacgtatatttcattaagttcatatcttgtctcaaggtttcgtaagactccaggctcatgcaagtatgaaagttttgtcatgtcatctacacctccagatggagcttcagtatccttgggaaaatatacgtttgtcacaacctgaaatccatacaacatggggatatgtgaggagaaccatggccaacaaggaagtgtgaacatctatacttgacagcaaagaacttatcatgaaaatatatcatgtgcaacaacatataaaatgacaacgtaaatcatgtttttacgtctcatgctgcatcttatcacattaagctgtttccctatcacgtgtaacggtttcaataaaattagctctcacaacatatcaagataactgccgactagaaagcctgaaagcttcattttatgcactccatatttctgagtataaacttgccttaagacattcagtaaataccaaaaacgttctttgaaggtatttttctctatttattatgttacttggtttgatcaaaacactaaaagcacaataacctacatctaccttgaatgcagaaggtaaaaacctgccgatctagggatataacgggactatgacagtatcccattccaagataaaacgtaacattaatcgacatctaaatttatcaacggacttattcctactcttttttagcctaaacccaaaggtcgaggccacgtacaagctcattgattgaagtaaaataataaagatgtaaccttatagaaacttacggttttccccttcttggttttgacatgaacgtttataccatctattcgagtaacttctccatctatccatgccaaatgtggatcttcaacccacacatgtgaacccacaattatgactggagcagcctgcaaccattgcatttcatttaacaacatcaaaaacatacattgcctctaaaagagtttacaggttcaaggggcacataacatctattttacagctttaggcaaaattatataaacgagattttaattcaggcaaagagcaagcttctagaactgagctagacatagtcaaaccaaaacctttcagaagtaaaaacaaccatagatcaagaattagcgtctccatacaggaaacaaaaaggggtaaagcaagcaaacgcaacaacaacattaacgaaacaaacaagcaaggttttcagttttcaaataaacagttgagcaaagagaccgagatatctcttagaaacataaaatggtatagagatatatttgaatttaccatttgaatagcaagaggggaaagaccccagatgaggagattagagcagaatcaatcaacttgtggagagacttgagagtgataaagtcaatgacttttcaccggaaatctcaggaaaggaaagcccttttttcttctccggtgagaatttggtaatctctctctcttatcgcggtggagagtttcaaaaaaaaaggcgtttcgttggagctccgcttggagaagccatttggggggttttattttgtctcttgtctgatacagattactagtgggtcccagtgctagcttcaaaatggacggcatcggtgaattgttccacttgatcaacctcttctcagccgtttaacttcttgatttaggaatttttcataacattaagaaactttggattttgtctttgtaaatgcatgaacaatcaacaaaagtaaaaagttcgtagcaaaaaaaaagaagaaagaaatgtttgttattagggcatcaccattgtttatttttgttaattaagaatttcagattttgtgataaacaaatgttatagtacatgtggaaaaaatgttatggcccctggttttaaaatgtaggaaaataaggtaaatacgaaaaaaaaggaaaaacgtaggcggcaggattcgaacctgcgcgggcaaagcccacatgatttctagtcatgcccgataaccactccggcacgcctacttttgacaacgtcaccacttttttactatataatttaatccatgagtaaaatcattacaagcccaaatgatcgctgcgacagcgagtgtgtgacgttaaaccctaaatctggtgtctttgtgcaatcgcaagattcattcactctctgcgacactaaagatcgaaacttttgaattgcagaaatg

SEQ ID NO: 36589 - DNA, 3003 bp, Unknown
  misc_feature (1)..( 3003): 2750-1469P.txt file - cDNA_ID_3098117; gDNA_ID_2936559; Annot_ID_194370
attgttaatcagttaatcgatcgagttactaagaagtaaaacatcaacatgttgaatgagttcgttgatagaaagaatatacctatagcacgaggtattctactatattatttgagaagtacattttaaatataaccttaatttttgtaattaattacataataatgctattagtataaattaatcaaaaaaatcatttaataacgtcattaaagttaccaaaattatttaacgacaatatttatctcttaattatagggtttattggatctaaagacgggtcatcaaagattttctaaactgaagcaaaatataccgaatattcaaatatctatttgttaccaaattataaacaaactagattttaacccgcggtacaccgcgggaacaatttattttttaaataaatatatataaaagtttgcaaattgtatctatctataaaatattttattttatagtttacaattgttattaagtaacgtcttgccaaacccgtcccgccaactcgtcctgtaaaaaaaactcatttattttactaatgttgatcttatttatgatatgtttatgaattattgtctaaatattttgtaattttgtagtaattaaatgctatcaaatatctatgcggcttgatgattataattatgccgaaaagcaatatcaaaaatgataattttgtagtaattaaatgatattaaatattttggaagttttattttagtaattaattgtgtagttaaggtagaaagattttgggaagattgttaaatgtcaaatatttaattagaagattttctttctaattatcaaaaacaattattaaatgccagtggtaacgactgtaaataaatctcaactccaggatttatttcacaaagtgactgcaaaaatgtatatatagataagttcgtaaaacaatttaattttttatatacgaaatcaactaaatcttaatcacataaaaattagcacaaaaaaaaagtattcaacaattaaaaaattatcaaatctctatgttatataagtttttatactatattcgaagaaagtgtattataccttttcaatttgtattctttaactaatttaagctaactaatatatttgctaatcttatacctatcaaaaccgactatcttttcttatctctataatatttttgcaagacttttatgtggatttgggtaaaagtgcattcaggtcatatggtacattcccttattaaataaatatggtgcacttctatgttattagctaaaatgtttagattataatttagagtcatatcataaataaaattaatattaataaaataaatggttttttggcaaaacggatttggagggacgggtttttgaatcaacattaataaaaaagtaaaatataattaatccaccgtttcaatacgggttaaatctttaatttattattttttaagaccactaatattaaacatatcaaatcatcctaatttagaaaagattatataaaactaaaaatgttatgtggtatgtataatgttactatatataaaattaaactataaaatataaatgtattagagaatgatacaatttgcaaaacttatatatataataaataattcttaaattttaaaaattactactttaaaaaaaaactacgggacgagtaaagaaattacagaacgagttttattttggaattgggttatatgatggatgtattttaatcaatatttataatatttataaaatattattaatatgctgttttaataagggttaaaacttcagttttttaacaattgtctcatggattcgtggtatagcgttacttaataacaattataaactgtaaaatataaatattttataaaaataaaattagcaagttttaatatatattacttttaaaaaataaatcgtcttgcggtataccgcgggttaaaatctagtattgataagaaaatgtcaaacggtgaatgatatcgactgacgtttcacgaatctaatagatacacgattaaatcgaatatacttagtagtgtgaatgatataaaaaaatatactaatgttttactattgatctagcccactaaccaaatcaaattaacaactaaatgtaagtaggataatttatgagaaaacttaaaaccctcgaaaagataatcataattgttaatttattactattaacataagataattataaataaaataggacagatatgaaaagtgtttatacatcacaaatctacctttcacattcttattttttggggcagcaacctcacagattcttatggaacacaaatgaagaaacgctcaaatacagcgttgagtaaaaagtaaaaacaaaacaaaacacaacacatctcctccactgtaataaaaatagtattaaaaaacatagtaaatgatttttaattaatcaaccctcaaaaataacgtagagatcgaaatacactgaatcgttgacaaatcccaaaacatgcactaaatgttttaccgcagatcgaagaagggatcatcagtgtaaaaatttggcgtcgcattcacaaaactatttatcgaaatcccagaaacgaatttggaacatagtgcgttaatcattcaaaaggtattatctttttctccgaatcttatgcaaaaatttccccttttccgtatcagggctagatttggatttgtgggtactgttcaattcacgaatcgccaatgattggtacttgccctttgagtgttaacacttttgattgaatcgagattgttattaaagtttgatccttttgatgccaatgcaggtctttgttattgaaaaatcgattctttgttctggtaattacttttgtcaatcgattctgtttcttcttcttcttatgcaatgtatgtggaatttgaattctggtttttggttaatgtttgttaggtttggatctgagaaagtgtcgatatgagagttcgatctagagggtttaagagacaatgagtggaatgtcctttggacttgagagttatg

SEQ ID NO: 36590 - DNA, 3000 bp, Unknown
  misc_feature (1)..( 3000): 2750-1469P.txt file - cDNA_ID_3098121; gDNA_ID_2936559; Annot_ID_194369
tttataatttggtaacaaatagatatttgaatattcggtatattttgcttcagtttagaaaatctttgatgacccgtctttagatccaataaaccctataattaagagataaatattgtcgttaaataattttggtaactttaatgacgttattaaatgatttttttgattaatttatactaatagcattattatgtaattaattacaaaaattaaggttatatttaaaatgtacttctcaaataatatagtagaatacctcgtgctataggtatattctttctatcaacgaactcattcaacatgttgatgttttacttcttagtaactcgatcgattaactgattaacaatcaagtgaagatggaaatttactctctttattctggctggtgttggtttggaatccagtatccaaagctcttactcgatcaaaataaattacccgaaccaaccctatattgaatgcataattctaccagttgtccaattctttagccaacaaaatacttttcacccacacggccacataactagcttgctgatgaaaaactattttttttgtttctttgggaaatatattttacatctttcttcgatacaaaaaatgttctctatatattttctaactagaaagatgtgcatttggcaacacttctagaaaaggttttttgcgtacgattactgtgtttggttgcttgtaagattgttttaaaattacctcttaaaacatgtctcggtgattcaaaatgttagacgaaaatagttacattttgatagttatgaaaatcattattcaaaccattttctggtgcgtttgtttaatttgttatgtgtgtttcgtcttattccgcaccatttgcatatagcatctgaaaatacaacaaacaaatcatatatttttagtaaaaaaatccaaaaatattaaaagattaaatagttttagtacaatggtatggtatcattcgtatggttggtgtatgaattgataataatatgtggtacacatttatattatagccgttctctgaaataatacatgtgatcatttcgaagattttatagtatatatcagttctctaagagaatgggcccaaatttgttttattgtctaaaatgaagatgacaagtctattaaattcggtcgtaacttgtaagcataatgtggataatcactcttctccaattattaggtaaacgaactgatgctgacgattatttttttcttatatctttgaaaatcatttcattcatatcatataactacagtattattttaaataaaaaaaaatcttagaatttgatatcattcaaaaaagtgttagttctaatcagggttctaactgttaatgccagtaatgtgaacattaattatactcataattgtatgcgataagattttttttaaactatagaatacggtgtaaactataattagttgaccattcatgcaattattgtttttattttattaatagcaaatttagataacttttaataaaacgaaaaactgattcagaaaactgtatcttaaagtcaggtagatagcaaaatagaaatgacttggagactaaaattgtataattacttcattcaaactataacgtccctatttaaaaatctatcttaatttcattagtgcagggattatgggaattaaaaataaattacatatggaagatggaagcgaaagcgaaaaggcttttgacgtttacctcaatagaaaatttcaatactctcgttgcatgaacatgaagtttacgcgctttgaatattaaattatagtctatagattcactattcttgtttttctttacttcgtaaagaacaaaaatttagttttgtatagagttaaaaaagacaaatacaatactagttcttacaattcactgtaatatgaatatgtaacaaattgtccgtcataagattataataatataattttattagaatgtatttttttttaaaaacataaaccgtgttatagtgatatttttgatactcgttacactgatttacgatattatttctttatataatgatatttattacgtaaactgtataatgtatttaatttttggtgaatttattttacaattagttcaaaattttaaatgagttggaaaacaaatatgaaaataagggtttgattagtttttttaattatgattatttaagattagaaaaagtgttttttaacgaatcacatcgagaatgtctttctcattatccagtttcgattttgtcccacacaaaaaagtaaattaaatggtaaggtttttttttgggttcaactattaaataagttattaactgcgaaatacaactatactcataaatacataagtgaaaaaaaaattcacactaccgaacgtatttattattattaaaatgctcataatattactttttggagtttccaatttttacaaaggttttttaattcattcaacattgtgcttcaacaacacatgcgtctctcagaaatctctccgccccagatccatctctctctcaagcaaacactcttaaacccttttgatttctcctcataattattctcgaaagctccattgtttattagttattcctgcaaattattcaattttaccattttgcttctggtttttttagtcgtctctctctctcttcaatctcttgaaaggtacttgctttatgcacaaaagttataatcctgggtttttttgtactacactgtagttattaatgcctgaacaatcttcttgatctgggtacattttgcagattgagtaaaaatcattcctttttttttctgggttatatacactgttcttcgagttctagggttccttaatttcgtttctcctttttggaaagtctctgactttatgtgttttaatgggtctagttttttcatgtggtccatttaattagctagtggaagaagatggatgaattgtgtaaagattatttttggttctaagtatcaaaaaaatttgggggtaaattgagggagatg

SEQ ID NO: 36591 - DNA, 3000 bp, Unknown
  misc_feature (1)..( 3000): 2750-1469P.txt file - cDNA_ID_3098129; gDNA_ID_2936559; Annot_ID_194367
gaaacatggatcaagtgttgaaagaccatgaccgacatatccaagaagctgtgagaagagcacgaatcgataaggctcgagtcaagaaacttcaagctgacgaagcttcgagccaacaagtcgcaaccaatcatccctcatctgtttctagccgttgatccatcagtgaggcaaaagtaaatgatcaaaccgaacctcatttgcctgaaaccttttaacacggcgtattttgagtgaaaaataattgtattttattgattcaaagattatatatcatcatagaatcaaatcttttcacgttttagcttccctgtaatgtgatattattttattataagaaagctgtagaaacagagttatatatcataatttagaaaatgttccaaaagttgaactttttaatttgtgactttttatgaaatttaccaagaaaggtgttacgagatctttacttgtgaaaaataaatgatcttgtcgagtcaaactttgttggctctctttcactatataaatcttgttatcctcttatactttccatatccaagaaaaaaataaacagaattgcagatcaaaacactctgtttcattcctctgttttttgctctgttttgctctcacgccataacgtgttctgcttacagtttcgacttcatttacttcggaaatggaactgatctgatgacattccatggagacgccgagtacgcttcagagcctgatggtatgagcaagtcaggagcaattggattgagccgtgacaatgtcccattctctcatggtcgagccattttcatcaatccagtcccttttaagcctagttctacttcttcctctgtctactctttcaaaacttctttctatttcgtcattagtcctcgcccgaaaaatcctaatcccggtcatggcctcgcctttatcatcgtccccaacgatagaaacgactccgcttctggtttaggctatctcagtcttgtgaaccggtttagcaacggtaatcccaagaaccatctctttgcggttgagtttgatgtttttaaagacaagtctcttggcgacattaacgataaccatatcggaatcaacaataattcggttaattcaacggtatctaagaaggccggttattggtatcaatcaaaaatcgaaggaaaaaaccggtggttgttcaaggaattgaagctaagtggaaacggatacagggcttggattgagtacgagaacgggaaagtgacagtcacgatcggacgttcacaagaaaaaccgaagaggccattgatcgaagcacgagtcgatctttctaaggtttttctcgagaaaatgtatgtcggttttgccggttcaatgggacgtggcgtcgagcgtcacgagatcttggactggagttttgagaacagtgccaaagactaataaaccggtttgcttcagctttgtttatgtcaaagttgttactggttttgcagcttcgttttctgtcgtgaatctcgtgatgctaaggctagtgatagttgaaggctaataaatgcttatgttatggcctaacgtgccatgtatctactttcagatttctagaaagatttacaataaaggatccatttccatagtaagaactattagatatcgtaatcttctatgagacggtaaattgctgaaaaaccagtaaggcatgtgcctatgtaggcttcaacatagatcctttcctgcaacgatctatgtcaagaattaactacaaatattcgtcatttgaaacatattctcacacaatacgtttcattgagtgaaactcggtatacaaacttaatcacaccatgaaaatagactactctccacacacaaaaaaaatgtaccagtaaggaaatttgaacacatacgtatgacatccaaccatatcatgatacttctttatcatcaagtcgggtaagccctatttcgcctgatttggctctcatctcaaaatttctccgacctttttctggacgagtcgtctcgtcttctttccctttttgtaacctcattgcaagtttgcaacaacaaaaacaatccaatgattacttcattgcatggtttaaacaaaaacaatccaataatatatatacatattttatcaataaagtatatttataagttaggttgatttttttaatatattttttttttatttttttattttatattatttactaagacattctattttggtttaaaaactttagaactaaatggtgatgatttaaaagttaaatggagtgatttaaaagtaaacaaatgtttctttagtatcaaactttgttaatttttaggtcataatcaaattgaatgacattaaagaaaaatctaaccatttaatatacatatatacacataatggaaattgttaatttggtgataataagagaagttaaaaatacatgatttggtaactctatatatttgaaaaaaatttaaatgtgtttggtaaatgactaaatggtttaaagagaatgaggataaagaaaaatgtgtttgacaaattgatagttataacaaaataattaaatagtaaaaaagctgagagaaaaaatgtgggattgtcacataagcactaaaaacttttaatatataaaggacacatagtatattgttaattaagaaaaatttggttttggtataacttaatgaaatatgatagatttgatcatgaatgtggactaacttatatctttcctaacctatatattaggacagactaacttatatacatatataagtttattcaatcaatactagttttaatttcctcctatacactcataacgtttttgttttcagcattgtgggcacagaaaaagtagaaccattttgtgcactttcgagaacagcttttgtcatctaatgccataattcaaattctttgtctctcttctctctcaattattttaagtcttctcgatcttttcaacactcacatcttttaaagttcaccactttcacttcccaaattcccaaaaacagaactaaaaaatg

SEQ ID NO: 36592 - DNA, 3000 bp, Unknown
  misc_feature (1)..( 3000): 2750-1469P.txt file - cDNA_ID_3098136; gDNA_ID_2936559; Annot_ID_194365
ttcaaaatacttgtttcttagcataattctcgaaaagcttagatatatttaatctgcatattcatttagtttctttcataataatcgtctaatttttaggcaaggaatatgtgtaacatgtttggattttatgatcactttaaccactcaagtagatctcaaaattaaagaggatatattgaattaaaaaaaatataaaaactgtgatggttcaagttctgattaattatatcctcttattttagttgttatgttaaattattactaattatttattactaattatttattacttattttatgaagtttatgtggcaaactctatgtgctaatgtgtaaagtcgtgagagagagttaacaatcctttcgattcataataattgttttgttctttagttttttttttccatccatcttgaattcagaaatcaatggtttatcactaaaaaatagtctttttcgtgtgcccagttggcgctatcatatttgacctctatatatgtttgaaaagtcatagttgaagttcactggctttcgtcacactatatattacagcactacttccacttccataacaccaaaaacaaaaacatacacacgtaaacaacaaacgcataatgcagatccacaaactctgtatttttgttctgttcatatctttgttaagctctaaaaccatttccgccgtcaaattcaacttcaaccgtttcgacggaacaaatctaatcttcatcgggtacgccgagctaggaccagcaaccgatggcatgagccggtccggagctctctccatgacccgtgacaacattccattctcacatggtcaaggtctctacacagatccaatcccattcaaatcttccaacaacacatcttcttctgtttactctttcaaaacatctttcactttctccatcactcctcgacggtcaaaccctaaccctggtcatggtatcgccttcatcgtggtcccaaccgtagcctacgagtacgaccaagactcaacccgcggcttcctcggtctagttaacctcacaaccaatggcaatcctaataaccatctctttgcggtcgaattcgatgttttccaagacaaacgttttggtgatattaatgataatcatgttggtgttaatattaactctgttaactcaaaggtttctgagaaagctgggtattggattcagacaagaactagagggaagaatcaatggttgtttaaggaagtgaagcttagtagcggagacaactacaaagcttggattgagtataagaacagtaaagtcattgtttggcttgcacctgcgcatttaaagaaaccgaagaggccattgatcgaaacacaagttgatctctcggaggtggttcttgagactatgtataccggcttttccggttcgatgggtcgtggcgtcgagcgtcacgacatttggagctggagttttgagaacaccgccaaaaacaattagttctgattttggtcttgtttggtttgatttatgtttgttaccggtttaacaattatgtattttctcttgatttttattcaaaagtggttaaaaagagagtacgtataaaatgtcaaaatcaaatttaaaattactttgatcgattaaaccattaaaaaaaatcctgagaagaaaacatgcacactgtcccggaccatcaccgtcaatgatcttcttggacatgcatcattgattttgtataaataaagactcgttaaaagccaaagcacaaccacgtggtattgtggtcatcgtcctcatcaaattgaatcagtttgttcatgtcacaagtttcttaacataagtttttaaaagatattactaaaatttaaaactaaaatattgacaaatccacgatatataaggttaaagctatcacagtttctaggtcgtatcattttctacaaaaatcttgcattacatttcagatggtttggtttcaataaaaaaacagagtttttttttttttttcattgataaatttgtgtatgtaatctaatcatagaaaaagaaaaaacacgtggcgtgtccggacgcatgtgattttgtaatttaccacttacgttgtcgacttgtctcaatccattccatggaaatggaaactcccctctggttattaaatgctcccaccaatacattctctttcctttcaccaaaaccaataatacaaacaattttgtttttctcattcaagattttcaaagtacaatcatttctttaggtactttctcttgtaataaggcttcaaatatgttattcaaaaattattttggtcattttaaattcctattatagccttacaaaaatgtgttatattatttggaccacaacataatttaaacattcctcttgaagaaaattggtcacttcaaaaaagaacaaaattcactttgacctcatggtttacttatatttacatatatggcccaaaaccaaaatacgaaaaaggttttagctttacgttcttttgattcctaggtcgtcgtttaaccacgttgcttgcgtggaaagagaagagaagtgaagattatcaaaaagcgaaaaataaaaccctcactgtgaagtaaaaatcgtaggcccaaaatagatttctcttagccgagaatttaatttttatgaatctgattattgcttttctacgaactcagtttttgcgatgtgtggttctcaaaaaaggatcgtttcttcggtgcctcttagtctctcaagtacttcttcttcttcttatcttcttcttcgcttttcttttatatatagagagagtttagtggtcaagaagcttcctcgtgtttgtctctttatgtaatcaaaggttgcatttttattcgaatatattttctggttttggtgttttctgtcaaagggtcttttaaaaatcttaactttcgttctaaatttctttactttatttcgattctaacttagggcttttgggctgggatcatgaaatgaagtattgcagaatccagaggagtttgtttggtaatcaatg

SEQ ID NO: 36593 - DNA, 3003 bp, Unknown
  misc_feature (1)..( 3003): 2750-1469P.txt file - cDNA_ID_3098140; gDNA_ID_2936559; Annot_ID_194364
cagtatctagattgccttctaggtccctaatctgcacatcgcacctcagctttcgctcgttaactgaaggcaagattcttttcttgtaattatccctaaaagccttgtcattgttccaacgagacataaatttctcaacctatcagaaagacaagacacaaagaaaaactatgaacaaatgctcgaatctcagatactctcacacaatagactgacaagacaaacctcggaatcagcgagctcttcaagatctctaacatttccagaagcagccaattctatagctttcttcataacaacacggctctggtaaaatgcagcattctacaaaacaaaacacaccttataaataaacaatctttaagaaccaattgatgaagaaagaaacaaacttgacatataaggagattcggaaaaatctcacccctttatctcgttgcatcctcaagaacttaatcctttcaacagctttatctctttgattaagtacacaagccatttgaacatccaacaactcaatttccatcttaatctcacttaatcgttcacctaacctgtaaatcctccctctaactacttcttgttccttctctacttcatttattttcatactcatcaaagtctccattgaggcaaccagagacaatctcgcagcctacaccaaaaacacacactttctaatcagaacgtttccaaaatgtaataaaataaacaaaaccaaaaaaggcttacccttttggatttcaatctgttagcaatgtgaatccggtcagtgttacaatgataaacctcatgatcagcttcatcaatcttggctttaatctcagggtcatcgtaagcgaattgcttaacgaagtaaaaacagtaagaactctctccacaccactcttcaccggaaaacacagcttcgtcgtcttcctcggtggtcaccgtcgatgattcatcaccgtttaatttcccggttagaattcgacgcacatcgaagccgtcacacagtaatatcgacgcactcatttggtcctgctccaagaaacacccaaagatcagacctttaagaagatcttcccaagaatcttcagggttttagctgaagaaaaaagatccaatttttaaacggaaaaaatgaaaatttacaaatatgaagaagaaaaaaaacagatctttgagaaatcaagaaagagggaagacaagtttttgttgatcccataagaagaaactgaggaaaaagaagattaaagagttcttgttcatgcgttcacatttcaatttatgtttcttgtttcttcttgaagtttttgtttttttttggtatggaaaattatttattaatttatttctaaacatactattattatactcttattgactctagtctttggtttggtaggtcctttaaggtcaacagtcaaattctatgtgttaatctgaactaatcaaaactactaattgccattggtcattggtattttcttgtgttggaagattttttgttctataagcaaaaataatatttagatttattgattaattttgtcaggtataaccgtggcctatacggaccttactatatgacttgttctagtacaattattgcaaattcaaaacaaaacagaaaaaattggtttcctaatcgcaataaattccacctaaagttgtttgtatttatcacatagttacttagttaagttaaccattattcaatcggttactaaaattggtaactttaaataaaattctataaattttatccaattttagtaaccaattttatttattactaattaataaaattctataaatttgatacaactttacaagctaaagaaatagagaattcttcttaattatggcaacgtattaagagaaaagaaaaaaaagagagaatttgatacaatctgaagaaatagaaaagtttaatggaattggcaaagtacaaaaagagagaaaatggtagtgttgttagttcaagtgttgttatcacatttccttaagcgtatgttacatttgcataagcataacccaatgactacggaatatgttacatttatacatttttatattaatttttttttacaacattttacaacaagcttatgagattgaatctgctatacacgtgcatctacaaacaaacatcatccgctagattatgtaaacaaaactgtttgtttttgtttttgttttttggtgaagatattttaataatcgatgatatcgttttcgcattgcaagatatatttgatattttttatttgtttccgatttcgtgtagtagcttcacaaattggatataacctctacgaaatttccacttctcttttgatgaacatacaaaggttttgtttttatttttggcatattttcattttcattattcattctctctctattatataattctaattcacacaatagtgtttttaactgtcttatgtttcttcaccaaacgtatcaaaccaaagcaaagttctttcttcttcttctcttgcaccaatacagacgaaaaaaaactcaggttccaatctctctattccttcaattcctagatttgattttgcttattgaaatactctgtgagacgttttcttgtaactttttttttttttactttcttatgtgatcatatcaaaccttaaagcaatttccaacgattcttttttgttcaaatctcttttggaaatccataaatgtttgttttgtgtggttttggtgaagagttacttagtctaaggttaatctagctgtttagttgtctgattgattaattaactcataaattctgatcagagatgttttagaggacaaaaacattctctgtttctgaaaattaatgcacttaaagtttatctgaatcttaattttgtttaataggaattagtgtctgatgatgctagtggcctaattcgagcttgagctgaggattttgattcagtttttggtgtcatgcttttgtctcaagatcacaaaattctcttcaatggggtacgtaaatatgtaatcatg

SEQ ID NO: 36594 - DNA, 3000 bp, Unknown
  misc_feature (1)..( 3000): 2750-1469P.txt file - cDNA_ID_3098145; gDNA_ID_2936559; Annot_ID_194363
ccaaccgtatatgatatactccacgaatgcgtgcgatagagccatccaagctgatcctacacaaaacaaaaaagtttcaagctaacaagaacagagtaaaatatgtttttaaaccaggattagaagaacagtacttaccggtaaataacttgaaagcagaaggtaaacttcgattaggtctaaccaataaaacgtttgatttgtttaacatatagagtccaggatcaattattaatggcattgcccgcttcttgcttcaccgtgagacacaagaaactttagaactaatgaaacactaaaagaattcagaaaatgagagaaaaaaaacttactatttccagcctaaggaacttgtgtgctcgataaagttaaggttccggtccaatgtcgaaaatgtatgaatcagatctataaacatagaacagtttttgatagtcttaacaaggggaatatcaagaacacaaggaaaagattgaagcatttaccatcttgagtcacgaggggataatccgaagcactaagattgataaaccaatcccaatccggggttcttttaagaagaatcgcacatgcgtgaagcgtattcgccaccattgttggtccggtataagtcacaagattagctttagttatcatatatacatttcctgcttttgaatacataggatcgtttgaaatgcgagaagctaactctgatctctcatcaaccggtgattcaagatccaagtgaacaatgtattggtttcttggatggtacaatgctctaagagttctccaaaggctttcaagatctcctttagatcctgaaacaaggtaagcgaaacgtgggagcttgtcgtcttcacgaggttgttttcctacaacgttcgaatcatttttggggaaacttgataaagttccattaatcggtggtcgaagtgaagacattaaaccaatgttgaaggaagttgcaaggagaacaacgcagacaagagatgtgataacaaatgaaaatacatatttcttctccatgattacatatttacgtaccccattgaagagaattttgtgatcttgagacaaaagcatgacaccaaaaactgaatcaaaatcctcagctcaagctcgaattaggccactagcatcatcagacactaattcctattaaacaaaattaagattcagataaactttaagtgcattaattttcagaaacagagaatgtttttgtcctctaaaacatctctgatcagaatttatgagttaattaatcaatcagacaactaaacagctagattaaccttagactaagtaactcttcaccaaaaccacacaaaacaaacatttatggatttccaaaagagatttgaacaaaaaagaatcgttggaaattgctttaaggtttgatatgatcacataagaaagtaaaaaaaaaaaaagttacaagaaaacgtctcacagagtatttcaataagcaaaatcaaatctaggaattgaaggaatagagagattggaacctgagttttttttcgtctgtattggtgcaagagaagaagaagaaagaactttgctttggtttgatacgtttggtgaagaaacataagacagttaaaaacactattgtgtgaattagaattatataatagagagagaatgaataatgaaaatgaaaatatgccaaaaataaaaacaaaacctttgtatgttcatcaaaagagaagtggaaatttcgtagaggttatatccaatttgtgaagctactacacgaaatcggaaacaaataaaaaatatcaaatatatcttgcaatgcgaaaacgatatcatcgattattaaaatatcttcaccaaaaaacaaaaacaaaaacaaacagttttgtttacataatctagcggatgatgtttgtttgtagatgcacgtgtatagcagattcaatctcataagcttgttgtaaaatgttgtaaaaaaaaattaatataaaaatgtataaatgtaacatattccgtagtcattgggttatgcttatgcaaatgtaacatacgcttaaggaaatgtgataacaacacttgaactaacaacactaccattttctctctttttgtactttgccaattccattaaacttttctatttcttcagattgtatcaaattctctcttttttttcttttctcttaatacgttgccataattaagaagaattctctatttctttagcttgtaaagttgtatcaaatttatagaattttattaattagtaataaataaaattggttactaaaattggataaaatttatagaattttatttaaagttaccaattttagtaaccgattgaataatggttaacttaactaagtaactatgtgataaatacaaacaactttaggtggaatttattgcgattaggaaaccaattttttctgttttgttttgaatttgcaataattgtactagaacaagtcatatagtaaggtccgtataggccacggttatacctgacaaaattaatcaataaatctaaatattatttttgcttatagaacaaaaaatcttccaacacaagaaaataccaatgaccaatggcaattagtagttttgattagttcagattaacacatagaatttgactgttgaccttaaaggacctaccaaaccaaagactagagtcaataagagtataataatagtatgtttagaaataaattaataaataattttccataccaaaaaaaaacaaaaacttcaagaagaaacaagaaacataaattgaaatgtgaacgcatgaacaagaactctttaatcttctttttcctcagtttcttcttatgggatcaacaaaaacttgtcttccctctttcttgatttctcaaagatctgttttttttcttcttcatatttgtaaattttcattttttccgtttaaaaattggatcttttttcttcagctaaaaccctgaagattcttgggaagatcttcttaaaggtctgatctttgggtgtttcttggagcaggaccaaatg

SEQ ID NO: 36595 - DNA, 3000 bp, Unknown
  misc_feature (1)..( 3000): 2750-1469P.txt file - cDNA_ID_3098157; gDNA_ID_2936559; Annot_ID_194360
cagcattaccgtcaagacacaaaactaccaatccatttcctttgcttctgttacatacgatttatgtataactgtcaagaacgtgaatgcatttttcaatacatatcataattgaatcaatattattgatgataaaaggttacatttgttctgttgtattataatacctttattatgtaaatttgaaacttgtttgatctcgagtatgaattagattcgtgacttcgtgtacgaaaacaataagaaaagagagtcaaactaattaatttaggctaaaaaccataatggaacaaacaacacacatgactgaaacaaaacagcacaagtgctctttgaaatcatcaaagtgcatgtacatgagttgtctcttaaaacaaaagttttattcaaacgttgcacgtgtggtgacggtggaactagatccttctttgttgccattaaagccggtaagattcacacaccggttacgcttactacgcaacggaacctggcgactgtaatgtgctctctctacctctacgtgtcattatcaaatgttcatgacagtcgtttcatcaccttctaagttgattaacttactcggaccgtgaagtccataacgttgagccgttgaccattaacccttttttactagctcgttgacctaaacaacaacagaaaagttggaggaaataatgatactataatcttataaatatacaacttatattgaaatatgtgagaaataatgatcatgtattgttcattaattatatattctgatcattgattctaaattctatgccgcacatgacatgcaaaggctatgtaagctatgaagcctatacgtgttgacaaaaatataaaatacgcattagcataaaaacaaaaatcaaataatagaaaacttatgtgaaaaaattaatgaaaaatattttacactactaatcgaattggtttagttaccgaagccgcgttttagccgaaggcgaagccagagatcgaatctcatagatgtgcgactccacggccgtcgtctagctttcttgaacactaatctcataattgtaattatatatatatatatttatatatatatatatcactacaagaaaaaggttgtcttggttgtaaatcctctcataattttttttattaaagtctaatttttaggatttatgactttttttaattttgcagtttaaacttcaagttttagaattgagagtttatatctttacaagtttagagtttaataaatttgttttagggtttataattaatgataattatttaatggtttagtttataaacttttttttttactatattacgaaattttccttcaatgtagagggtagaactcatcatatttcggtctcacatcttcatatggaaactgcaatatgtcaaaacgagatattttcctactccacattataattcaggatacatctttgcttttctttgacaaaactaaattattttttttaacgggcagctttgaaaaaactaactcgatttagctaaattagttttagtagtgtataaaatactatgcattaaacaaaagattcaagtcatgtactatcctccatacgcataaccaatcataggcattgatggacatagtcctagacgtttgggtattcggttctcgttctttaggatatcaactttaggatccatatagaaaccaaataaattttggtccggttttggttttgttaagatctcaactttagcttcagtatagaaatcaaaagaattttgattcggttttggttcgagtaccattcagtttaggcatgttcgaatatagttgaatcaagaaccgatttggaatatcttttttctctgattctaaaatacttgatcgaataaccaaataactaaaaaatctagttgagactctgtttggttccattcgacgttgttgtttttcggttcttgagtatttacccaggatggatccgtaattgggtacaataatttaatatatttacaaggatattgaagccatttaccacactaagcattccaagaatacataagcaaagagagtaaatatggtatcatccaaagaatgaccaaaaagaagactggaacaaccaaccaaaaatgcaagaactgtaagctaataacacacataaaacattgattttcaacaaaactaacattgtttcaatactaaacgagcaaacaaacaataaatgacgaagaaaaaaacatacaaatgtccctgtcttttagaacataacctaagagactctttctatgatattactttacctattaacatacaaaaactggattttgtattattgtatataaatgtactagagtagagagagtcaagaagctccaaatctgacaagtatgatcgcaaactacagttcctagaatcgaaaaaatattgaaaatagagttttgaatatggtactcaaccaaaagatgaaagtgctactaaaacagaaaacttggtaaggagatcaagaaagatccattgcatatcctagaatataacatactaatcatcaatgtatgatgcatgattcgagaatggcatttcacatgtttgaactcataaaccaaaggtttagagaatacgcgatacaaatactacctaatttacactattggagtctcttttacgtttaaaataactgtcgtttgggacaaaaccacattatattatgtgcttgagaggattacgggttttgacccaaaacgtaagtggtaaccttcaggattacggtttttgttaggtcttcgcagcgaacgcgttttgcttaacggttactaattactcgattgaccgttgatccatcagatacaccaaccggacggtcctgaatcgtccacgttttgcggttaatgttaggcctactagattaaagtgaggcccaatacggcccattaattcaaaattcaaattttaaaccccaactttctttctactacgctccgtcttctccatctctgcgaaattcttaccgttgtttctctccttcgtcaatg

SEQ ID NO: 36596 - DNA, 3000 bp, Unknown; identical to SEQ ID NO: 8876
  misc_feature (1)..( 3000): 2750-1469P.txt file - cDNA_ID_3098164; gDNA_ID_2936559; Annot_ID_194357

SEQ ID NO: 36597 - DNA, 3003 bp, Unknown
  misc_feature (1)..( 3003): 2750-1469P.txt file - cDNA_ID_3098208; gDNA_ID_2936560; Annot_ID_194420
cgttctccacaaacatatgactgatttgtttgtaacagagaggtgtataataaatagatcgtcccggtcccgcataatcttacaaacttaccgtttagaattgattatcaccgtccgatatctcacagttgcaacctgatgaaactaaacggtccagatctctcgaacgttgtcagattttcttattttttgtcaaccctaacaagaaaaggaaacaatcgaaagtttcctttttttttttgaagaagcgaatgcttataaatgaagacctccaaacatcactcattctctcttcttccttgagaaatttaaatccattatcattctctcttcttcttcgataccataacaaaataattcttcatctttcattatctcgttttgtctaaacagaacgatcgttttagaccggatgctctcgtcttctcagcaaacaaacaatcatcgtaggattgatctccatcctctgttgtgactcatcttcacttaaatccaaacgatttcaaatccggtcaacgacggacaaccgaaaaaataattgaatttttggccacacttagttgaagtgttaaatatttaccacttgttttttttaaaaccaaaatgtcaaaccgaactgaacatctcgtccttttggtctgtagttttgtagtgatatcataaagttttgacatatattagattaaaaacttggctaaattttattttattttcacaaatattattttaaggattcgaattgcgcattgacacgttcttggtcacttatttgtttcaaagaatttgatgatattatcaaccttaataatattctgtaaatctgttattcttaacttagtcacttcgtaaaagtctactgcattatcatttcataatttagttgttgtggcagatctttcgttcatacgggccaaacgcgctcggtagaacacactaaatggacacatatttaaaagagaataaagatccaatgggctttgaataaaacataaacaatattaaaaaaatgcggtgagcgtggatcgaacacgcgaccttcagatcttcagtctgacgctctcccaactgagctatccccgcttttgctttggtttcattaatcactttattcaaaccctaaattcatgattatcttctaattttatacggacaaatcagtaacactcagcaatttgagttcttgtggttgctaaagtttttagtcttatctttccttccaaagacaaaactaaggaagcttcaatgtctgtagtagcaattaacatgaacacgatcaatcacttgtccaaaacctgtaaaaccccaaatatccaatcaccgatttgcttcgatcgcaaacccttttcatattctctcattcctctgtttccaaaaaccctaaatggcttctcctcttactcttcttccgttagtcgcagatcgagattcatcattcccaagagacgacgattctctgtttccatggagtggcaagactgctcgtaaaaatctctcctttatcctcttctctgcttcgattccactttatttgtagaaattgatatgattctgttttcaatctttgttggtttggagaaaacagagtaaagatggaggtcgatgttccagtatcagtagcgtataatttctacttggatcgtgaatcttttcctaaatggatgccttttatttcatctgtccaggtggatttgattttttgatctatctctcaaagtttcaatctttgaaagcttcttgctttagattttaactcggtttgtgttctgttgttaggtgttaaaggacaagcctgatctatcacgttggtcactcaaatacaatgcttttggtcaagacattaagtattcttggcttgctcgtaatcttcaggcaagaatccatcattctgttttagatcaatgctcctctgtggtacttagactaattgtgtaaaactgttggctttttgttgggttgtttattgtgcagcctactcctaatcagaaaatccattggagatctcttgaaggtcttcctaataagtaagcaagagatcataaaggttcaatcttactctaatgtattatctgtttgagcctaacatttggtacttaaccaatgcagaggcagcgttcgattctttcctaaaggtccttcatcgtgcatcgtagaggtaaagaacactccattttatcacacatcatttgatcacaatcctactagaatagttctctaatgcttttccttttttcttgcaaatttgtttcatcttttagctaaccgtatcatatgaagtccctgccctattaacccctgtggcatcggtgcgtatctttttaccttaaagtctctatgtcaagctgaatgtcacagactgtttttcttattaccttaactttccccaattcaggtactacggccttttatagaaagcttgcttagaggtggacttgaacgatttgcagccttggccaaaactacttaaaaaggttagcttttttattctaaactccacttaaaccatttcattatctgaaaaatcaacactttgcttttgcaggaatatatgtatgcatctttctcttggtatatacgtgatttgaaaactataccagatctcataattagggagatctctattgtaacttttgtatgattaaagtgacaaatatttctttctatcataacagaagttgtgtggtttaggtcaccaagaaaaagagaaactcaataaaccaaccagaaatcttgtttttgatttgagtgaaaccaaaaaagaacaaaacaaaaccaaacaagaaacaaagtcacggcaaagagagcttttctctttccaatgttaacttatttgtctaaacacgacaacacactttgcgtggagtgtcctaacacattcaagagaatgggtgctgaaaagtctctgttcctaacttgtctctttggaaaaacaaggttacatcttaaatctttgaacactcattttgatcaactctaaatctctttctctcaagatcaaaagagatg

SEQ ID NO: 36598 - DNA, 3000 bp, Unknown
  misc_feature (1)..( 3000): 2750-1469P.txt file - cDNA_ID_3098223; gDNA_ID_2936560; Annot_ID_194415
caacggcgcaaaacgctaaacaaagtttccactttaaccttatcttgccatcttcggcaatgtgatctctaatcgctctgtttcttgtcttgttgattcgatcaagaatcgcgttttcttgaagacttagaacgtgactcacgacgcggttgagtagataatcaagaaatacgacgccggttgataccaagacgatggtcaagatcttggtcgttgaagttgacgggacaatgtccccgtaaccgactgtagagaatgtgacgatggagaaatagaaagcgtcgacgaaaagattggtctcggttccggagaattggtctcgaaagaatgagtatgtgcaaaccccgaaggttaagtagaccaagaggaggatcatggctagtacaagaatggtccatttcgattttgatacggtggtgacttgagtttcttccggtgaggactcgttgggatggagaaggttctcattgagaaggttctcttcttccatttagaaaacgctcttctttctcttcttcttcttggtagcttctgaagagattatcaaatttgaaagaaaaggttttttggttttttgacgactgagaattttgatgttcatgatctttacgttgcttctctatctatcttccgggttttgagttttgtttggttaagaaatttatccacagatcagggaagtaaaacatctgattaatgaggcccatcaaaggcccaaacaattatctttaaatatcgaaatccaagtcagagctttgtattggattaaggtccatagggatcatgactacataaaagttgtgcgtaaaacgctacgttttgcgttttaagatgaaacagagttaatggaaatggtatcatcttccgtacacaataagatctcgcggggaattgggaatcgcaagaaggtaagtggcccccatgactactactactacaacggatatactactttaaattactaattatttgttcttatttcaaagtggtaaaaatattctcatgtaattaagtcagtcatgtgtgatgtgttttgttgatgacgcaagcagtgacgctttttttttttgttcgagttgttttcaaaacttggagatttatcgaaaaagtatgttaacatttttttccgattatcactataattaatctcattagttgttttcttttcttactatctatagtacttacaattgcatgtaaacatgccaaattataattagttgacaagtttatttgttcttgtcttataaggagtagttactagttagcacaaaattaacttttaattatgacgttggttttggttagaaacctttgaatataattatcactttattttttaataattggaccctcatgtttttccttattacagaagacaacataaacagaagaataataatcaagttcattatttgcttgaacaaaaataatactaatatacatacattatgacgagtgtgagttaatcaatagccttagcggccaagaaaatggatgtcttaacgctcacaaggtgaaatatgttttactacaatatataaagttgacttttttgcttagttgccaagcaagttagtcaacttccggtaaagtggaaattctcccagtcttcgttaatttgtttgaattatctacggaattgtcttcatctaccatttaatattgtaaacactgtttgttaacaataatcggaggggataaatcaatatgcaagtggttccttgatcatcatgatttttgtttttggtttttggttttagaacaatagcaaattaagtaaaataatgtactttatttctaaaaaccagatagtaactttattttaaatattaaaatgtttatatcttttatttttatgtttgttaaccaacatgcaattgcgaatctgatctggtttattgaaactacaagtgttgatcatcgatctaaattaacgtaagatttcgatttttgtatcattgaatcttccaatctcttacagtggttactaaccacactccacgctctctttacttggaataaacaagttttcatattaactcacgagatttttattttttggtgattccataatatgagatttgtgaaattatcatgttcattgttcggaaaaagtaaaaccaactacacaattctgtctgcctaacatttttcatatacaagtactagtgaacaagagtaaatttataacatgtgaatttagagaatgtcttcctaaaaagaagaagatttatgatattttagtaaacacttcgaaaatggataattattatgttttttgaccatgacaatagtttattcccactctccttgcttctcaagcaattatcgcaaaccccaagaaacaagagttgcatataaaaaggcaaaattctcatatttttctgcagaaacaaatttgactctagaaaagttgaatatattaagaattaaacaaagattagattaacaacaacagctacgctcacgtctgtcttattcccacagagtttcaaaaaccttttcgcttttagcagcttctcgccacatctttcaggtctgttctcttttaacttctttcctttttaatttcagatttctgattggttttagggttttaattagatctctgattttacgggcaagcaaaaagcatgtgacactttcccttaacagactctgtttcatttgtgattatttctgggaactctctagattgaaatttaacataaaggacaaatcttttcagaaatcacaagtgggttttttggatttatattagtaaactctgagattgtcaatataggactggcactggattgaaatgtttccttaaattctttatttttctctgggttttaggaaaaaaagttaaaaaagctttatttttcaaaacctgaagaagaaagctcgtaactttatagttctttttggttatataccgtcgatttcgatctgggtattatcagttttcttaaaagttaaaagctttctgatttttgtcagcgccgaaatatg

SEQ ID NO: 36599 - DNA, 3000 bp, Unknown
  misc_feature (1)..( 3000): 2750-1469P.txt file - cDNA_ID_3098228; gDNA_ID_2936560; Annot_ID_194414
ccacaggactagacctcggcagccatagccagcgagcaggccaagacgaaactggaacggcgagtcaagaaccactcccaaaagtatcactcacccgaatcgcggctctaaacaaacccgagatcccggttcttcttctaggaaccgtagcagcagcaataaacggcgctattttcccgctttttgggattctgatctctagagtcatcgaagcgttcttcaaaccagctcatgagttaaagagagattcaagattttgggcgatcatatttgtagctcttggagtaacttcgttgatcgtctcaccgactcaaatgtatctgtttgcagtagctggaggaaaactgattcgacgaattcggtcaatgtgctttgagaaagcggttcacatggaagttgcctggttcgatgagccacagaattcgagtggtacaatgggagcaaggctctcggctgatgcaactttgattagggctctagttggagatgcattgtctttagccgttcaaaatgttgcatctgctgcgtctggattgattatagcgttcactgcgagttgggaactagctcttataatcttagtgatgcttcctcttattggtatcaatggttttgttcaagtcaagttcatgaaaggattcagcgccgacgcaaaggttcgtacatcaaccggtttggttccattttttttaggctctgcaaaaatcctttgttttttttcttgtgaatcgaggaacttactctggttttggattactatgcagtcaaagtacgaggaggcaagtcaggtagcgaatgatgcggtagggagtataagaacagttgcgtctttctgcgcagaggaaaaagtgatgcagatgtataagaagcaatgcgaaggtccgataaaagatggaataaagcaaggtttcatcagcggattagggtttggattctccttcttcattctgttttgtgtctacgcgacaagcttctacgcaggggctagattggttgaagatggcaagactactttcaataatgtcttccaggtgaataactgtcttaatcactgctcaagtactgttgaaaatctctgtgacctagtaatgaagaagaatggatcttgcaggtgttctttgcgttaacaatggcagcgattggaatttctcagtcaagtactttcgctccagattcgagcaaagcgaaggtcgcagctgcttcaatcttcgcgatcatcgatagaaaatcaaagatagactcgagcgatgagacagggacagtgttggagaacgttaagggagatattgagctgcgtcacttaagcttcacttatccagcaagaccagacattcagatctttcgtgatctttgcttaaccattcgcgcaggaaaggtaaacaaactcttaaaccaagctgtatcttaggaatttttaatcttcgattagactattaaacaaactctttttgtttttctcttagactgttgctctggtaggagaaagcgggtcggggaaatcaacggtgatctcgctgttacaaagattttacgatccagattccggtcatataactttagatggagttgagctcaagaagctgcagttgaaatggttgagacaacaaatgggactagtgggacaagaacctgtcttgttcaacgacacgattcgagccaacattgcttatggcaaaggaagcgaagaggccgctaccgagtctgaaatcatagccgctgcagaacttgccaatgcacacaaattcatctctagcatacaacaggtaatggaaaaaaaaaacagaacaaatttgtaagaactgtgtttttcaaagtttcttacaatgcaagcaatacaatttttagggttatgacacagtggtgggagagagagggatccagttatccggaggacagaaacagcgggtggctatagcacgagccatcgtgaaagagccgaagatattgcttttggacgaagcaacaagcgctcttgatgcggaatcagagcgagtggttcaggatgcgcttgacagagtgatggtaaaccgaaccacgatagtggtggctcaccggttatctaccattaaaaacgctgacgtcattgccgtagttaagaacggtgtgatcgctgagaaagggactcacgagacgttgatcaaaatcgaaggtggggtttatgcttcgcttgttcagcttcacatgactgcttctaattgatgtgatatatagttttggttttatgaaaagctaaaacttcagttttggcttgagtcaaaaactagccaatgtactaaaggttttgtatttatttttttgttgttgtttgtatacaagttaacgaagctgatatatatatcttgtctttcaagaaagtatgcatacctgtttcttgaatatctttgttgacttttgtgcttagtcaacttccggttaaatgaaaatcctctcagactgttaatttgtgtaaattatctacggaattgtcttcatgtaccatttaatattgtctgttctatacttgtttcctttttaaaattttttatgattggggtttgtgttttaatttgatctctgattatacgagtaacccaaagcccaaaagcatttaagcatggggactccttttccctttaattaacattatctgtttcatccgattactattataaatcacaatttacttctttaataactacaacaactcttgtctctccatctgtcagttttaaattctccttctttctcttaactaattatgtttacgtctttacgattaattaaaagtgtataaaaaaaagaatcttattcattgccgagcaactacaaatcaaagtgtaaaactataaaactttgttactaatataaaattgacttacaaatcaaagtgtaaaactatacaactttgtaactaatataaatttgactaatttcatttttgtttaatcttattttattttcactaaatctttatacttaactactaatctaatattacatattagtattttaattaatatg

SEQ ID NO: 36600 - DNA, 3003 bp, Unknown
  misc_feature (1)..( 3003): 2750-1469P.txt file - cDNA_ID_3098247; gDNA_ID_2936560; Annot_ID_194408
tgcacaaggccgactcatataaactgtaggcccatgaaaacgaagcccatatatataaatgggacgatattcaaatttttcttcgatttaggactttggaaaccctaggcgtcctagtcgattgcgagatccaaccttatctctctggtaagtttcttgctcctgatctctctcgctatttcttcatcggaaaatacacgatttcggctgtgttccaatctcttttcctaggtttggttaggttaggtttttagaagaagattcgtcttgaacgatgaagaagcctacgaacaagcaggctaaggcttaacattggtcttttgggacatcattaactctccggttccagatggttgtgaccctcgtgtggtccgtccgagtattaaacggcttttggagaatgaaggctactgtggtcctctcaccgtcactgctgttggcaaactagcgaacgtccctactgacaccctgagagcactctattccagtggaatccatcttatcatctcccccttcggcggttagatatcttctcgaaacagaggattctgccttgtggcattgctctgtatgctgccttgatcctcctgcccacggctttgaaaatttcatcacacatctatcaacgggagattataaagtgatggtaattaatcaagtgtttgtttcacacatctacctgtttttttttttttgcctttgtttgacttgtccatgttcatttaatgttccagctgagtttacctaggaatactgtgcctcgtccgccggttgatctctccagggggagtaagctaccaaaatcatgttttactttgtttgcccaccatgctttaccacaagcttcactttctcttttatagttgcatgtgactgcttatctgatggagagcgatatgatgagtcgcgatcagccctggacagacgagcggcctccacttcctacagatttatcaacaagactcgctaaattgaaagacttggaggctgtgaagtacgagggtgagtcgtttgtctattgggacatcaacttgtgtccgcttcccccatactgtgatgctagtctggtcggtccgcgcagcaaacgcttcctgaagaatgaaggcttctctggtccaagaagaagcaaattatggaaaaacagacatatagattctatagagacacttaaagcgatagggcgatcttatttgatgtattgagagagccacttgaagccttcaccatatcccatttttctaacaatgctgcacataaacacctccaatggtctcacattcgaatcagttagattcactttgcctttaccagttgtgaaattggagaggccaagatggaatcgaagctcgtcctcagatgcagcgtaaggtatgtcgattttgtttcctaagatgaggaatgggacagtggctaaggattcgtctgagagaagtgcatcaagctccttttttgattctgcaaatctctcctggtcataagcatccactaagtagaccagagcatcaacctgtgaaaaccactcaacaagaatcaataccctttagcttcgagagacgacgagtaaagagaaaagagacaaagaggaagaagaaaacttgtgtggatattctaagcaagtattaaaacggcaagcagcgtgtagattctgaagttattgtctgtacaaacggcaagaagtgtgtagattcctgtaataatgaaacggcgccgtcgtgttagcccacgcactattgcaagcttttggaccgagtgagagggcccattgagaggagatatttgcttagcaagtggaatggtctctttcaaatactctcttatcttttatttttttctacaacacacataagtagttcaaaatcgaatggtataatattagtgattagtaaccgaacttcgggatttaaaaattgttctttgtttacttcaacctacaaatttttaaattcagacgaaaagatatttctatttgtagcattttttattaatttttgtcaacgtattttctagtaataatgggaggattttgccgaccatcaatattgtttttttttcttttcttttgatttttgtggatgttaataataatcagccgaaccaaaactccaacgtagtagataagatcagaacagaataagataagcccaaatgtctgcgtccaagtgtactttgagagtgggaaaaagttaaaagaattcttatgtgtgttcgcatttagtcttctttatctcaacgtgtgcaaaaagttttgcatcgccatacaatacataactctctttttttttcatacaaatacaatacatacttaaacattgtgaatgactataataaatttttgtatctcttagaaaatttgaaaataattaattgtttaaatacatataacgtatactatatttagaatgttatactaaacaaaagataggtgacaaaaaaaaatacagcgaatgcgttgacctgtgtgatctcgtaaccatacaaaacttttttttgtatatatccgttgttccagctttcacaatttcttaagtaaaatcagtctttgtgtttctaaatacgttgttcaactaaccactaagataattcgaaatccaagtattttaaaagtaataaacagtcaaaattcaaagtgacaactatagtatttatctgaacagccaaatcaaaccacagcacaaagaaaagtcaaaaacatttggtcaaagcttcaatgttgggaaattgttattacagcttacattattattagtaaaataatgattatatattaccgaagagaattaaaacaaattaaggaacaaaggaacagaataaagggtaaccttgtaaattctaccttttaaagttgaactctttctcttctcattcatttgttctttcttcagagaaaaacaaaaaacagagcattttttttggtcaagagcaagaaaaaacagagcatacttttgcaaaaagcagagcttggagcgctttcttgtcatctaaaattcaaaggcagagacgatg

SEQ ID NO: 36601 - DNA, 3003 bp, Unknown
  misc_feature (1)..( 3003): 2750-1469P.txt file - cDNA_ID_3098254; gDNA_ID_2936560; Annot_ID_194406
aatgcgcatgactaatgttgcaagttgagagcatcgtatgcaacttgcggcttgcctcgattttagcgaaaagcgtacgataagttcatattcatttcacctttttaataaatattaaaatagagcagtgttattttttaatatgttatctgattaactataaatatcattaagtattcaaattagttaaaaattgttagaatcagatctttgtcgtaaattggagatggcataaaaacgaaaccaagagcagaatgtaagttactttaaataaattagttttatttaagaaaagttactttcaatagcggtaggctaataagagattcgtgcgtatgtttatttgcatgaagtaccggacaaaatcagaacatgagaagtgtcgaaatatcacaattgtatataagttattttaaaaataaaaaacaaaaaacgaatattagttccgataaaagagaatatttcgatacagtaaaagtgttttacatataaatcgcactagaggtaattaaatacataataaatgtgagctgtatatatatataattaacattattacttacgtcattttcacagagaaaatagtgaaaagtatttagtagttagatcgggggcacacacaaaaataattgaaataggtgtttttaacttaatggataaaagagagagaaagaaataatctgacccgtccgatggattcccacaaggaggcattgaaagaagcaacggtggtgatgacttgagggaaactggtggctgcagggtaaaccccaccgaacttagtaccgggtcccacatttgaaacgccgtgtaaagcctccgaccaccactcgtaccctttgattcctagacgtggtatcgccgccgcagtgttccctaacaagctcactttctcggccaatgtcaaccgtccgatcaaatctctgactctctccggtataggaactgaaagctggcagaatctcagtgtagctgttgctgcgtcctttgtatcgcaagcaaacgtttcacggctatgaacgcaaacgctgctgctgcttatcaagaagaagagaataacggccaagaacgccattttgtggagaatcatttctttaaaacaaatattatttactcctcttcctagtttcttttgggttttatggaagagagaaaaatggaaatgtgatgaaagacttgtgagagtgaagtttgcgtgttatgtttatatagagaggcaatgataatggtatgataaagataatgagtagagctctcttcgtgaattttctttactctatcaaggaaatatcatttttctttaatatatatgaatatttcgaaaccaaacatatttagatataaagaattggttttatatttaaatttacatttaatttgaggagaagacaagttgagagatttgatgagtgaactaacctgccattttggatatgtaaatggttagaaagtgttggaagacagttgtcactatgtgggtcctggttcttaagagacttttttatgtgcagttaaatagatttgattataattcgactttgttaatcatataattagttacttgaatttcgttttattatgttaggttttcatcgtaagaaagaaaaatgttggtttatatctgaagcaatctgttttgcaattagttttctttttttctaacagaactttttgtttcccacttgacaggtaaacaaattaacttggcttgtacgagatgtcacaccattctaaattccttaacgatctttattttatttttgttcttttttcttacatacatgtggccggtgaagtggaattgcacgaatcatttcttatatagatgtagatatgcgaatatttataatagaggagtaatttttttgtactattgcatcctttgagcagagtaaatggatgtggaacaaattttgcggataatcaattatatacaatgttagaacaagtatagatcgaatcttttctggttgagtattaatgttttagtcaatacatactgtttaatttgtttaattacccttgtaagaatctttttctggttgaatattaatgttttagtcaatatatatagtgtttaatttgattttttagaaaagtttagtctggatttaccgttttcattgcatatggtttgtatgatccttttatacatattttgaataataaaagatgaccacaatttgaaaaacaaaaccgtgaataaaggcagataaaaaccgtgagaataggaaaggataaattaaattttattcgagcgactaagaggtcacgaagaagaaggcaacgtaataagtaattgaaaaaagaaatagtagtataagtatgggcatggtgtgtcggaaacagacagcaacttgtgctcttgttacttcggtgtcccaaatctcacactctattggctcatatcttcggtgttcaactgttcattatgaaattattactactaaagtaataactcattattggttattgcgatccttgggaaacacctaatcagcaataaaacttccaaaactttatttttaccatataattaaaaacaaaacgccacggactgtaacttaattaattagcaccacagaatttgtatgttctaagttttgagtgggaaaacccttgagtaacgcattgatcataagaagaaatgaaagtagtcaatggaatataagggtactgaaaagaagagtcccgaccaatttcatgaacaaattaaagtagtaactttaatcctaacccatctgttttgtgtcccaccaaaaaacatacagtcttgtgtgtctttgtactactagctatgatctctagagccatatcaaagaatcgtaatcccgaatatataatgctaagatgtgactcgtgttggtcttgctaccaccaaatctcacaaccatctaatcaaatccctatcacactcacttgctttataatgaaaccaacatcggaaagatttcaagaacgcaaagtagtgagatcaagagagaaaaaaggggagttacaatg

SEQ ID NO: 36602 - DNA, 175 bp, Unknown; identical to SEQ ID NO: 536
  misc_feature (1)..( 175): 2750-1469P.txt file - cDNA_ID_3098254; gDNA_ID_1591745; Annot_ID_151460

SEQ ID NO: 36603 - DNA, 3000 bp, Unknown
  misc_feature (1)..( 3000): 2750-1469P.txt file - cDNA_ID_3098260; gDNA_ID_2936560; Annot_ID_194405
agtgacttgcctacgaaatccgatatgttgtacacagtgatgagcaaaatgggataccaactttggagaagttgggacttcaaattctcagctataaatcctggaaatatcgataaggtaacagagtagattattagcatacccgaagctggccacttgattttcctcccaaccatccatattgtcagagtcgaatgcaaaggttgatgaaacttgaggtgttgttgcattactggtagcttgtgtagcacgttacaagaaatgaagcaacataggaggatggtagagctgactatgaaataggaatgagcactggttcgcatcccctgcggtgtttgtggcagcgaagctttagtcgcaatcctaaggagggagatgataatacctagcaaaaacagagataacctaataagcttttgacaagttcaatgactcaactcattggcttaactatatatctaagtataagctcaaagttgtgaggatttcaaatcggaattgtgaagaaaccaacactagcctatacaaaacatgtgtcattctgtttaatttacaagactaacgttttacataagaggaaactaggtttacctgaagaggcagtgccggcaaaaattgcttgcatgtactgtctaggaagctttccggctgaaccaatcaaacttcctccaaccactccatcagctaaaccacagagtacgactgatccaaccatcaacatgtaagaaacattctcacccttttcacctttccagacccaatctataaggggagaaatcatcatggcgatgatgaacatggaaaaccccaagttcatcctcactctgtagctcatccttgtgttccaagtcatcatcaaaaccaaaacaagaaccgaacagctcatgtaagccacagtgaaagtcttctctacatgcttgtccgggtacaagtagccaaagtaatcaacggcagtgatcaaagcgttccatggtattaaactaccagcacccaacaagaaatggatcacgtacgcaactctataagcgtctcttgtctcaacttcatcaacaatcactttctcatcaaccattgtaactccccttttttctctcttgatctcactactttgcgttcttgaaatctttccgatgttggtttcattataaagcaagtgagtgtgatagggatttgattagatggttgtgagatttggtggtagcaagaccaacacgagtcacatcttagcattatatattcgggattacgattctttgatatggctctagagatcatagctagtagtacaaagacacacaagactgtatgttttttggtgggacacaaaacagatgggttaggattaaagttactactttaatttgttcatgaaattggtcgggactcttcttttcagtacccttatattccattgactactttcatttcttcttatgatcaatgcgttactcaagggttttcccactcaaaacttagaacatacaaattctgtggtgctaattaattaagttacagtccgtggcgttttgtttttaattatatggtaaaaataaagttttggaagttttattgctgattaggtgtttcccaaggatcgcaataaccaataatgagttattactttagtagtaataatttcataatgaacagttgaacaccgaagatatgagccaatagagtgtgagatttgggacaccgaagtaacaagagcacaagttgctgtctgtttccgacacaccatgcccatacttatactactatttcttttttcaattacttattacgttgccttcttcttcgtgacctcttagtcgctcgaataaaatttaatttatcctttcctattctcacggtttttatctgcctttattcacggttttgtttttcaaattgtggtcatcttttattattcaaaatatgtataaaaggatcatacaaaccatatgcaatgaaaacggtaaatccagactaaacttttctaaaaaatcaaattaaacactatatatattgactaaaacattaatattcaaccagaaaaagattcttacaagggtaattaaacaaattaaacagtatgtattgactaaaacattaatactcaaccagaaaagattcgatctatacttgttctaacattgtatataattgattatccgcaaaatttgttccacatccatttactctgctcaaaggatgcaatagtacaaaaaaattactcctctattataaatattcgcatatctacatctatataagaaatgattcgtgcaattccacttcaccggccacatgtatgtaagaaaaaagaacaaaaataaaataaagatcgttaaggaatttagaatggtgtgacatctcgtacaagccaagttaatttgtttacctgtcaagtgggaaacaaaaagttctgttagaaaaaaagaaaactaattgcaaaacagattgcttcagatataaaccaacatttttctttcttacgatgaaaacctaacataataaaacgaaattcaagtaactaattatatgattaacaaagtcgaattataatcaaatctatttaactgcacataaaaaagtctcttaagaaccaggacccacatagtgacaactgtcttccaacactttctaaccatttacatatccaaaatggcaggttagttcactcatcaaatctctcaacttgtcttctcctcaaattaaatgtaaatttaaatataaaaccaattctttatatctaaatatgtttggtttcgaaatattcatatatattaaagaaaaatgatatttccttgatagagtaaagaaaattcacgaagagagctctactcattatctttatcataccattatcattgcctctctatataaacataacacgcaaacttcactctcacaagtctttcatcacatttccatttttctctcttccataaaacccaaaagaaactaggaagaggagtaaataatatttgttttaaagaaatgattctccacaaaatg

SEQ ID NO: 36604 - DNA, 3003 bp, Unknown
  misc_feature (1)..( 3003): 2750-1469P.txt file - cDNA_ID_3098269; gDNA_ID_2936560; Annot_ID_194403
agtgagcttcccctgaaggataaaagattcacaaaaagcaaatttgcagtgagcttcccctgctgtggtttactgtacaataaatctcacagtcccctttccttacatgcttgaaaatggaaaagaagaagaaccagcaggtcttggtactgacctcatcgacgatgatacgattccacttaatagagtgtaaaggagacattgtttcgtccactccttcatccttcctatattcattctcaactatgggagatgttgtcaaaacaaagtcgtaattcattaacttttgaacattcttgtctctcttcggcccatggtattgaagaaccctggtgcttcccggggatgtcaaccgagaaatctcatctaaccactgagaaagagcaacaggaggaacaagcacaagggtgtgcccaactgcttccctagatttggctctgtcaacttcccgtctggcaagaacgagagagatggcttgtattgttttccccattcccatctcatcagcgagaatgcctcctcttacggctgatagttcctgtattgtagcccaagccaaaaactccttttggtactttagtagcggtataatcaaatctagaggctgctcagcagcttcagcaatgactgcattctgctcatcaaaatcatcatcctctgtcatctgaaccttttctttcatgatctgccattttcttttagtgtttgcaggagcggcaggatttggtatatagtcattagcattgacctcacctgtgtgagcaagacatgatgaaaataaacaggtgtgagcaaatcgagcatcaatgacgcctaatagaaacgatgcggtaccttgaacttcaccgccgactgaatcatcatcatcaggaacttcttcttctttgagattctcgtctatttcaaacaaaccaacgaataattttggtaaggaaacatgagataaattacagtttcccacaagaattgcattctgggaaaacaaaaattggagagaaattatcgatccccaacagatcaattgagcccagaaatagaaaccctaattcacttttccggcaacccgaagattaagaacgaaacccaagaaagatcaacacggagaaatgtcaaaggattgtgaagaagattaccttggctactagacggaagaatcgcattcttgtggtgagagtgtggctccatcgcgacgcccaaatctcaaaaatctcagagtgagttaggttttattgatcttccgctttttttatttctcttcactatcttgttcttatacgagagactgattttgctgtgcaatctttccagaatggcgggaagcaccaaatcacacgtgtcgatttcttcgtgctggggtgaagttttttttttttacgggctaaaaaaccaacacatttttggtttatttcggttttttaaaacatttctgaaataatcgataaccgaaccgaaatctcttttagagaagcaccggtatttccacatcagagaattaacgaataaaaacatatgacaatgtaaacaaattcgtaactgaggatcgagaacagagaatcaatctcgaccttagcgtgtgagtaaagctatcgtaacgtgttgacctccttgggccgtccccgtccacaacgtaacgtgtgcacattcgttctttgagacgactttggtctcagatccaacatggactgatcttaaaccagccatcttgtaagacaataatattcataatcttagatcagcttccacacatcatatatacaatttagttaagcttattaagcacgagaccttacacccacaaaactcaagattctgtatttaccgtaataattatgttcttaacagaaaacatatatctccgttaaagctatagattgttttcacatatataatttgaaatgtatcatgataattacgttgttgatcagaaggagaaaaagaagaagaaagagttaatagctgttagtttcgtgcaagaagctgtagatttcatttttggatttaagctcacgaagaagcaaccaacatgacatgcaatcacacaacactacaacagtagaagacaaggcgcgtgagcatcccgattacgccacgtgtccaattggatagagcccaaaatcttggaacacgtcacatgggttgtccacctatatccatttacaccttgctacgactctgacgtggcagtcctcttccttgtcgtccccacgtggacattcttcgaaacttccattttacaacttgaaaacattttaagtcatatacgcaaatacattaaaactgaataacattttttgtaaataaattttaagattacgcgtaatattttataatgtttcctttattaaattattaaaattaaataagtattatgtctaaaaatattaatttcgaaattctttattaattattaaaattaaataacatgaagtatttctgtctaaaaaaatatgaatttcgaaattccttagctttaataagtcggcaaattttctgtaccaactcgacaaacccatttctcagtgggtcccacgtggggtaacacgtgttacacagataagtcacacgcattacacgtatgtttaaacgacgacgttccaacattcgctgaggaaattatcattttaataatttatttcttatactatttatcgtcgggaaaatatcgtaaaaaaaaaaaaaaaaatcacggaaagcaaaagaaaaatgaaaaaaaaaaaagtcttctttttggctatttatttaaaatagggaaacgaaaatatagcattaaatagatctctctcacacagaagtttcttcttcggcgatctgttcggctgataaacaattttttcttctttgctctttgctaaatattctcaattctaaatctttctgtgggtacaatttcacattctaaacaaaattttaagatcgttaatagttttaaattgtgaataagaaccccaaagagacaaagagacattcccaaaagcaaaacagaaaataagttttctttcgatg

SEQ ID NO: 36605 - DNA, 3000 bp, Unknown
  misc_feature (1)..( 3000): 2750-1469P.txt file - cDNA_ID_3098288; gDNA_ID_2936560; Annot_ID_194399
attaggtagagaatctttgctttaaagggttcttggtcgtgtaacatcttttagtgttttaccacctgaaactgatccaaaactcctctgtatttagcctcttccagagtctgtggcgcttgtagaagacattgttgtggaatacgtcacagatttggtagtgagctttttctttttgtgaatgattcatgttttacattacaagcggagagatattagctaacaagtgatgtttcaatggcagacacataaagctcaagaaattggttcaaagcgaggaagacttctagttgatgatttcttgtatcttatccgcaaggtaaaaattctttttaaaaagtacacaatcgatgattgagatggtttatggttttgtattctatatccgaaactttggcgtctttgatttatgcaggatttgccaaaactgaaccgctgtagagaactgttggcgatgcaggaagagctgaaacaagcacgcaaagcttttgatgtcgacgaaaaggaactcgttgattgatcttgcttttcctcaacgggaggaacaaatgctaggtaagaggaacctcatggatgccggactagggacagcgttttaggttgtaatcagaattcgaagcacagtagcaaaaaaaaagtgtgttgacttaaaaaaggtgaaaaaaaatcttgcacaaggccgactcatattaaatgtaggcccattagaagaaagcccattatctagcatcccgtatatatctacggacgacctttaatttttcttgagtcaggaatttcgaaaccctaaaaatttagaataaccacccgatttttgtttctttcattaaattaattaccgcaataattataaaattagtcatcattataagacttttgtttttctctaaatttttcgtcatctttctgatattttgattcattattttaccatggaaacaataaataagaatggtgatcaattaccaactaaagaaaatcattgtgatcaattagagatagagcaaataaacaacacgagcatgaagaagaaaaagtcatcacgtgggatgcacatgttctccgtcgtcatgttcatgcttcgtcgccgccggggagaaaacccttcaacaccaggttctggcggcgagtcgttaagtccgtacgtaaactccgtttcgaaattacgataatgccatcgtcaacttttactaacacaattgttctccctccggctcctcctcctctgccagcgacagaaatgggaggagacgatggtgataatgataatgaagatgatgatgattccgagggtcgtttatcagagactatggaggttttcacggcggcttcatcttcatcatcatcaggaatctcgggatatggatcagccatgtccttatatgatgatgatattgatgaggaagaagatgaatgttatagtgatgtggaaggaggagacgatatgattgatgagaaagctgaggttctatgcaataatgaagatgcaaaatcaggtttacactgatcgttgcaaagccaaagggatatatagtgatgcattaatgatcttattaattatggttcgtatcatctatcaagtttacgtcatcatcattcaggttttaatttcttggtcatttttggtttttgtattataatttaatttaattccttttaactttttcttcatttttgtttctgtaattagtgagtgtatttgaattcattaatgagaaaataggagaatgaagtatatctactaaattctatttgtgtttgtggggaatgttaaatttggtttgcagattaaagatctcgttaaatattttatgttcaatgttttcaatcggaaattggtcatattaatagcacatttgaccaattcattgaatcgagttcttttcgaaaattgaagactttgataataccaaccgtttatattatgcatggacatatgcgtaagtgaaaaatcatactgagcgatggtaacaattacacagttgattccatttcgtgaaaaactcatagaaacaacggtgacaaatgaagtttccatagccaagaattggatcctcgccatacgattaacctaccgagatgaaccaacggtgatcatctctctaaactccaagaccaatcctcaagatgatgcaaaaatctcgactcttcaactatgcatcaaaaccaaatgcctcatactccaactacttcatatgaaacaaaataccaatctcggcgaatgccttagtgatctatttcgtgatgagaggtttgtttttgtaggaataggtattgctaaaactgtcgctaagctcggtgggctagttagagtagtggttaagaaagttgacgttcgtgatctggtaaaggtaaattttccatttagttatggtgagaggtcaagggttagcttgaagggtatggcttgtgagttgttgggatttggttcgtggaaaccgaagagggagatttgtccgagagacttggctaatgaagttcttgatgtagaggtggttaagttcttgtccgttgatgcttatgtttgtcatgaaatagcgtttaagatgcttaaataccaggcccaatttattgtaatcagattcataaaacattactttactgagcaaacgttgggccgatattgggctaatttatataataaagcctctttattaaagtcaaaagacaggtcagcattagtaatcactatattactaaaatcgcgctataccttttgtagacgttgcgatttcaaattcaaaagttgtggcaatatcgtgattaatactaaagcctaagcccaatatcgtcttttacccgtagcctcctcgaatcccgacgtcacgttgtataaattatatcgcatcactccaaaaccctgattctcctgctccttcgtcttcttcatcttcctctgagaaatcaaaaactcgatcgatcaattcgttgttcgtctacatcgattccttcagaacctagtgatcctctgttttggttgattcgattaagctaaccatg

SEQ ID NO: 36606 - DNA, 3003 bp, Unknown
  misc_feature (1)..( 3003): 2750-1469P.txt file - cDNA_ID_3098317; gDNA_ID_2936561; Annot_ID_194446
gcatattaaattctttacctaatttaattaaaacagaaatataaataatcgtttacactatcttcgaaaaacatttgtttttacaacttagaaatgaagaaaaagaacatgttattcttgaattatctcaagaagttgatcaacagaatatatataagtttttttttttgataatatagttaccacttacatgattatgcatttaacaatgattttatttttggatttatttttttctatttaaaactcatttggacacctctacacaattaagaaactaattacattttaactgcaaactaattacactttaaattacttaccaggaatatgagcaagacgaggctcagtgaagtgaccattgcaaatgacgactgcgtcgaatatatcttcgccggagacaccacttgagctcctaaattgaactctccatttacaactattctccgccgtcggctccacacgaaaaacctccgtctcgaatcggatcatctcttcgatcttgaactctttggcgaagtcttgaagatacctcatgacttctctgtgatccgggtaccgtctcgggtccctggactcatcatcgggacgggtcacgaacgggaagtcactgtaacccatacactctcgtggaagattggtgcggagggattggtagacgctcgagtggacgacggttcgatcagggtcgatgcttagtaagtctggctcaacgtttggagtgcaaacccaaagtcctcctacttgtttctgacgctcaaagatggtgacggtgtgaccttcacgacgaagctctcgagccgcaacaagcccggcggctccggctccgatcacggccacgttacgtgagctgattgaattaggcggtggtgtcatagtatcagtcaaagtatttgtttcctcgaagagtgtgtatgacgatcactataaatataagtaaatggtcttgaaattggaccgtttataaaagttttccaaatttcatacgtatgggggattacaagttcgatagtgtaacttctttctcacacgtgtacaagtatacacgtgtccatgaccgtatacttctcaactttatatcatcaaatcatgtaaatttcatttgtgaaagttattcactactctatttctatatccacttaaaaaataaatcaacactctctaattatttaggtcaattgaagaggaggattagtaaagagaaaacaaaatgtggaaaaccaagaaaagtacaattttttgtaatacttcgagaacaaaaaaatccagaaaccaagacagtagtgttccattttatacatgaaagaaaaaaattctatccccgtacaccgaacgcttatagcttcgagaatagagccatctcataacttaggcaagtacaataaaaattgttttaaaaacattattactacaaattagcaattttagagatgtgctaataagttaaggtagatagataacaataaatatgtgtgggggaatgctgcaattaagagaaaaagatgggggaaaaagctggaaactgggctacaaagccttctacttgtcccaacactatgtttggtcctcttctttctccaacccacacagatctgaccacaatctcccactacatgacacagctgacacaacaacaaactctctttttttttctatcataattaattctctatgatggtcagttgtgactaaatgactaaacaacccaaattcgatcataattaggggtaaaaaggaaaaaagtgaggaatcctaaaactcacacctaaaaatcttttgtcaaattagtaataataataaatttgtttttttcttataaagttaaaatattataaatcacagaaaaagatagctgatgttgcacattaaccactcagagaccattttctctctctgtattttctgagatttgagagagtctcctctctcttctctctctatatcgctcctcatgatccgattttttatataatttataaaaaatttatgtgataattacagatacacgttatttgtgtgtatattgatagagacaataaccattggaatctgaccatggatctcttttcttcttgagatatttttcatttctttctcctgttctcgtctcccagatctgttcgtcaatcttaccattggaaagcttcaagcttcctttttttctctatctgggtaattccttaatttacagtaaaatatttatagattgttattctttttatagttttttttatgtaaagtcgaagtagtactatgttttatgttcgtcatgaagttgatgcttttacttttcctcttatagttcttctgttgaattcaggatttaggaatatgtttatatatctatcatcaaaatgtgaatatatgtgcgattgtttctttttatggaatcatcttctgaataattttacttatttgcatgcttttagagttttatttataagcagaagcctgaagatttttgtgttttggatattatcaatgtacactaggtttaattttcatctaatggcttttagaatcaaaccattacagaggaaacataatattgattcttttttttaagatcaatatggatcatttgatagtttatccaattatgagcattgatgttgttttactttcatgggggttttgatagtgggagggtttagcagaggtttttagtatcaaacctatcataggaacagatcaccgagaattttgtgtccaattatgattatatcattgttctttgtttcaaacatttaagtttcagaatgacctgtttatatgctcttgtagccaatttccttgtgttacatagaatctgtcaggggatgtttttgccttgagtaaactcttattcatgaactgatattagaatgttcatgttgatccttttttatacagtttgtttttttggtattgatcatctcattttgttatttgtatttgcgttgttggcatttgatagggacgggaccgttgtataaaagagttagaccagacgacggcacaatg

SEQ ID NO: 36607 - DNA, 3000 bp, Unknown
  misc_feature (1)..( 3000): 2750-1469P.txt file - cDNA_ID_3098328; gDNA_ID_2936561; Annot_ID_194444
gatataaagttgagaagtatacggtcatggacacgtgtatacttgtacacgtgtgagaaagaagttacactatcgaacttgtaatcccccatacgtatgaaatttggaaaacttttataaacggtccaatttcaagaccatttacttatatttatagtgatcgtcatacacactcttcgaggaaacaaatactttgactgatactatgacaccaccgcctaattcaatcagctcacgtaacgtggccgtgatcggagccggagccgccgggcttgttgcggctcgagagcttcgtcgtgaaggtcacaccgtcaccatctttgagcgtcagaaacaagtaggaggactttgggtttgcactccaaacgttgagccagacttactaagcatcgaccctgatcgaaccgtcgtccactcgagcgtctaccaatccctccgcaccaatcttccacgagagtgtatgggttacagtgacttcccgttcgtgacccgtcccgatgatgagtccagggacccgagacggtacccggatcacagagaagtcatgaggtatcttcaagacttcgccaaagagttcaagatcgaagagatgatccgattcgagacggaggtttttcgtgtggagccgacggcggagaatagttgtaaatggagagttcaatttaggagctcaagtggtgtctccggcgaagatatattcgacgcagtcgtcatttgcaatggtcacttcactgagcctcgtcttgctcatattcctggtaagtaatttaaagtgtaattagtttgcagttaaaatgtaattagtttcttaattgtgtagaggtgtccaaatgagttttaaatagaaaaaaataaatccaaaaataaaatcattgttaaatgcataatcatgtaagtggtaactatattatcaaaaaaaaaaacttatatatattctgttgatcaacttcttgagataattcaagaataacatgttctttttcttcatttctaagttgtaaaaacaaatgtttttcgaagatagtgtaaacgattatttatatttctgttttaattaaattaggtaaagaatttaatatgctttggttgacatattttacatgttattttaactataagaaaaagtcttattccactagctaattcactattaatcagaggtaatcggagttaataactcattttgaaatcccaatgtgtgaatgttaagggcgagaatgttttgtaatttcttttgtttcaggaatagagtcatggccaggaaagcaaatccatagccacaattatcgtgtttcagatccattcaaaggtcaagtaatttacagaagtccacaaattactttgactatatcgtcttttcagttttttaaatgttttgttatagtatagattaggttaagattaacaatgttattgtttgagatgtgtaggtggtgatagtgataggatatcaatccagtggaagtgatattagtagggacatagcaatcctagcaaaagaagtccatattgcagctaaatctgatgcatacgcaaaggaaagttcgatttatagcaatctacattttcatccgacggtaagtaaataatgaaaacataaaaacagagaaaataacaaaaacaccatttaattttaatatatgattacttgatttcttcctccccaaccaccctgatatgttatagattgaccgagtgtatgaggatggttcggttgttttccaagacgggaaactgatatttgcggatgccatagtacattgcaccggctacaagtattgcttcccatttcttgaaacaaagggttatgtgaacgtcgaagataaccgtgttggaccattatacaagcatgtgtttccaccggcgcttgctcctggcctctcctttatcggtttaccttccatggttagtagattttatatatatacgactgattatgatggtattatttctttgattcgaattgatcttgtacgtaatctttgaaatttcataatactcaatagactttgatttctcattggactcattacttggtttgaactttgttcttgatccaggcattgcaattctttatgtttgaaatccaaagcaggtgggtcgcttcagttttatcgggtcgggttaaacttccctcggaggagcaaatgatggaagatgttatagctttctatgcaaagcttaaatctttgggtattcccaagagatttactcattttctaactgatccgcaatggactccaatgttcgaaaagcttaagccacatgaagcagttttgatctcacaaagtgagtatttcaactggattgcggaacaatgtggttgctcgtccatcgaacgttggagagaggaacagtataacatagccatcaaaaaagatgatgacaattttcgtgatgaatgggatgatgatgatcaaattatacaagaagcgtaccgagattttgctaaattcaaaccgagcaaagtttggtctacataaaccaatctttccaaagaaagtgcacttcgaagatccaagagttgatattcccatgttgaaatgaataaaggttgaaaaaacttttttgcagtccaaaaaataaaatgaaaatgtcttcggttggttccaattccaatctaagggtgattggcaaagtttgacttatgtaatatcctttatgtatttggagaatatattagcactactttatttaaaataaatattctttatcaaaaaagaatatatgaacactcaaataagatctcgatttagtcaattacagcataattgttgcaacacgttaatgtttcattttctgttcttttttgttctctttgttgcgtatctccatgtcattaaattgctaacactcgtttttagttgggttttaatttcatttcttaattaagactaaaaaattgattttttttagaccgaaccggttaatccgaaccgaagacgttcctatataaacccaattttgagaacagagcatcatcatcacacaaaaaagatg

SEQ ID NO: 36608 - DNA, 3000 bp, Unknown
  misc_feature (1)..( 3000): 2750-1469P.txt file - cDNA_ID_3098344; gDNA_ID_2936561; Annot_ID_194440
taaagaaaaggtgataaaaataatatatttatggtatacataattattattattttcattctagaaaaatagaaaaagtttagtaacaacactaaacaaggaagaacttattatgagttagaagaaaagaaagatattgtgtaaaaataattagatttatttcttaaaaatgcttaaggtattccttgtagacaaaccatacacacataaaacaaagacgtcctcttttgcttttaatgagcatctgatttttcgaacatcgacttctagaactgaaaatagtgactaaccccgactactctaaaaattgagcaggctcttggcaaaagttcaactatacgacgtgcattatcaatcaataaagcaagcacttatcctcttttaaattttctttagtaactttgttataagtggcttcaataattcttcttttgtctcgtcaaaaagggctgcttttcaatattttccacaacatttctaaatattttgattagatcgtcgaacggtgctactggctcaccattgaactgcccaatagaacatttgagagaacaaataatattatattcaagagatatgctctcaatcctacattataataattgaggagggacgaataatcacttcatcacagaactgagttcaatcttctcatttactatagtttggtctctctcaatgattcttctcgtgtttcataatgtactgcatgcgttccaattctataactaattaggggaggaaattgtattataaacaaatatgggggttcattttacagaataaataatacgagggtggctttgcaaagactgtgaaaaatgttactaacgaacaaggacctctaattatgatccacatcctctttttcgatcatgctattttggttactaacgaacaaggacctttaactatgatccaaacctcgaaaattttccacttccaagctacaattatgctagtttggaaccagataatttgtcttcttcacactgacgctgcaactccctctcacatcatcggctacaaattcctcactttaattgtcgcttaaattgcattttggtctgagaaaacgaaatatgttcgttttaagacataccaaaaaaaagttttgcacaaaagaaaaaaaaaagacataccaaaaaacaaattgttgcataaacaactacaaaaacacattaaaattacaaattaagtagtatatttttaaaaatatatatgaaaatatataaaacatctaatctttagatttaaaaaaaaaaaaaaaaaagaatatatatgtacaacaattcgaccatacctaagcgaaaacctaattggtagattagtctttgtgaagttccaagaggtttgatataaatatataatctacggttgtagtgttttgtccaaaaggcaaaagtgtccataaagcaaatgaagaagataaaatagagacgtcgtttccatttttcaaactactttggtaaagggtttgtttgcaacttgatggatatttttccgatttggcgtccataattttcaaagaacaatgacgtagtcatttcatatttgccgtctcctcatagctttttactaattttataatatatatactcaaacagtaaacttaattttatgtattttatttttgaactaaaaccaaatatacatgatcaaacttaatttaaatcgtaaaagaaagctcactttcaatattttgagatgtaagtatataaaacttactatttataatctgaaaacagaccttttaagtactacttatattatataaataaactgatttcacaaaactattcgaataatattttagtttacttttcaattacttttatatttttgctataaagaatatgttatgggacataaaaattaaaaatgtcttatcttttctcttgatctcttctattaggcatatattacaaaagagagataaccgatgtgtctatacattaaaatgttcatatattagccctttcagaaagaaaaaaaaaatgttcccccagatcaaacaatagttagctaaatcattgattggaaaggtttttaaaaaaaagaagctgtgcaaactttagaaacaatttttgttttctaaatttgggatattactcatagtctgggataaacaaattgttgaatatattttctaatttataaataaatattattcttggtaagaaaattagatatttgtgcatatatatgcaacgatattagtttatatgatgtgaatactgataggaatattttatgatgccaatctacataaatatatttattcctacacatattataacagaaaaagtttcttttttggtataccatgttgaatagtacacatgatcctggacactgttgggtgatagatacattgggctgcactttaaaagaagtaaccagtcttcttcaaaaactaaaaaagatacatataaaggaaagttaattacaatgaatcattaaagcttaattaatgttaattcaatcatttttcattaaaaattgtggaagcacatccacttgatcaaatgatttaaagctctatatcatgttttttttgtaacaaatcccataaaatgtaattgcaaaattttatctgaatatcttcaaatttgataatcagttttagttcaaattctggtagatcagtgatagattctaatttttttatgtaactacaagttttatagtcacttttagagtgatacaaaattcattaagttctttatattctctgataaaaacaactaaacatgactctcaagcctgaaggtatgctacctacttaattgagtttaatattcctacgagattacggaagaattgtccacactgaagtgacacgtcatcgttagagttacctttttcctcgtatataatatacacatcgttataatcgaaacacaccatcacctcaattctctcttcgttaacattacaaatttacaatctcttcatctttcttcattagatcacaaaacttcactataacctaacatg

SEQ ID NO: 36609 - DNA, 3000 bp, Unknown
  misc_feature (1)..( 3000): 2750-1469P.txt file - cDNA_ID_3098358; gDNA_ID_2936561; Annot_ID_194437
gtgagtcagttctctcagttgttatgtgtcaggggaagttatattcacaatctctccaagaatctggcttctctgcagaaggccatgcgaatgctcaaggctcggcaatatgatgtgataagaaggttggaaacagaagagtttacagggcgtcaacaaaggctttcccaagttcaggtatggcttactagtgtcctaatcattcaaaaccagtttaatgatctgcttcgtagtaatgaagttgagcttcaaaggttgtgtctttgtggtttctgctccaaagatttgaaattgagctatcgttatgggaaaagagttatcatgatgttgaaggaagttgagagtctcagttctcaaggattctttgatgtggtttctgaggcaactccgtttgctgatgtggatgagatcccttttcaacccacaattgttggtcaggagataatgcttgaaaaggcatggaaccgtctcatggaagatggatccgggattttgggtctgtacggtatggggggagtaggcaaaacgacactactcacgaagatcaacaataagttttctaaaatagatgacagatttgatgttgtgatatgggttgttgtgtctagaagttcaacagtccgtaagatacaaagagacatagcagaaaaggtaggccttgggggaatggagtggagcgagaaaaacgataaccagatagccgttgacatccacaatgtccttaggagacgaaagtttgttttattgttggatgacatatgggagaaagtgaatttaaaagcggttggagtcccgtatccaagcaaagataacggatgcaaggtagcattcactactcgttctcgagatgtgtgtgggcgcatgggggttgatgatccgatggaagttagctgtctacaacccgaagaatcttgggatttgtttcaaatgaaggttgggaaaaatacactgggaagtcacccagacattcccggacttgctagaaaagtcgctaggaaatgtcgtggcctaccattagcactcaatgttatcggtgaagctatggcatgcaaaagaacagtacatgaatggtgtcatgccattgacgttttaacatcatctgccatagatttttcaggtatggaagatgaaattctccatgttttgaagtatagctatgataatttaaatggggagctgatgaaatcctgcttcctctattgctctctgtttcctgaagactatcttattgataaagaggggttggtagactactggataagtgagggattcataaatgaaaaagaaggcagagagaggaatattaaccaaggttatgagataattggtacccttgtccgtgcatgtttgttgttggaggaagaaaggaacaaatcaaacgtgaaaatgcatgatgtggttcgtgagatggctctatggatatcatccgatcttgggaagcaaaaggagaaatgtattgtgcgagctggtgttgggttacgtgaagtaccaaaagtcaaggattggaacactgtgagaaagatttctttgatgaataatgagattgaagagatatttgacagtcacgagtgtgctgcacttacaactctatttctccaaaagaacgacgtggtaaagatctcggctgaattctttcgatgtatgcctcatctggtggttttagatctatcagagaatcagagtcttaatgaattaccagaagaaatatcagagctggcctctttgagatatttcaacttgtcatatacatgtatacatcaactacccgttggtttatggacattgaaaaagctaatacatctgaatctcgaacacatgagcagtcttgggagtatattagggatatcaaatttgtggaatttgaggacattgggactacgagattccagactgttgctagatatgagtttagtgaaggagctgcagctcttagaacatctagaagttataaccctagatatatcatcaagtttggttgcagagccattgttatgctctcaaaggttggtggaatgtataaaagaggtagattttaagtaccttaaggaagaatcagtgagagtattgactttgccaaccatgggtaatctccgcaagctcgggataaaaagatgtggaatgagggagataaagatagagaggacaacttcatcatcgtctcggaacaaaagtcccacaactccatgcttctcaaacctctccagagtctttatagctaaatgccatggtcttaaggatttgacgtggcttttgtttgctcctaatcttacttttcttgaagttgggttctcaaaggaagtagaggatataattagtgaagagaaagctgaggagcattcagctacgattgttccttttaggaaattggagacactacacctgtttgaattacgcgggctcaagagaatctatgcaaaggctctgcattttccgtgtctgaaagttatccacgtagaaaaatgtgaaaagctgagaaagcttccattggattctaaaagtgggatcgcgggtgaagaacttgtcatatattatggagagagagaatggatagaaagggttgaatgggaggaccaagcaactcaactccgtttcttaccttcatccaggtggcggtggagagaaacataatgaacttcactttcttctacaaacttttgttgtcatggtctaaagacatttgccggtgtgtaaatctcttccttgtctcttcttgtttgcataaccgttctcatcgttcttttggttagtgatcattggatttgtacttatctctttctctaaacgatgagtgtttgtttcggcttcatagaaacattacacagagactcatgagaaaatgaataaaaacttgcaagttcctaaccattgtaataaaataataattaactgtcttatctcgttgacagttttcggataaattagaaaaggcgggacccacgttaattggaagatatcaacggctggatctgcttactcagatcaacttcagcgaaaaaaatg

SEQ ID NO: 36610 - DNA, 3000 bp, Unknown
  misc_feature (1)..( 3000): 2750-1469P.txt file - cDNA_ID_3098363; gDNA_ID_2936561; Annot_ID_194436
tgtctaaatacacagcttttctcttcatcaataaggatctgtatcaataagagaactaagtgtccatgttacttgaacactaccctgtttatcttcctgccctctttatctttttcgtggcttgttgttcatcatgtctgagacttgggctacaagataagagactttagttttaagactaaaagtctaaaaccaaatccttttcatgttgtttcgtctgaacttcggtctttttttctctgtaattgacttagtcggttctcagatctctgagtcatgattgtaccgataaaccaaaattgaaccgattgtttttgtaaaaccaatcgggttctattaaagttcaaactaaactaaaaatttaactatggactgaaaataaataaaaaaattcttagacaaaaaaaagttggacataggccaaacactgtttgtttgacaaattctaagataaatgataaaaagatgagtttttttagggcgagaaagacggtttaaatccaaaaaaaaaattgggaatttatgtgtaccaaatgataaatatcatgaagacaatgaagaggatcaacataaacttatcaatctcagtcagatgcattatctgatgtctagtcacttctctatccaccttctttaatgtcatttagtaattttcacacaagcagaaacgtaccatgttataaatcttatcttctaatgtttacaaattcgtacgtcttacatttagttgttgacaaaaaaaaaagataattgaaatttagttcaatcatttttttcctgtgtgattgcgtttttcctttgacgacatgttgtttgtgattaattattgtgggttcataccaataattatgaaatacctagattattttttaaaatatagctcgatttaaatgtagtgtcattacaattcgacttatttgagtgaaaagagtgactgactgattgcttatcctttttaattattgaaggagataattattattacttttttgacgaaaattataaggttctcaaattttctcgggctatttttttcgtaattttcttttctatgattattattgtttagcaacatatagtagattctatttcaagagggagacagagcacgtggtgtccgccagaaacctatcgatcatgtacatgtggatctagttttcccacatcctccaattatacaagatcttgtcttttccaatttgttgatctaacgtatatgactgtaaattccattagacaaccttaaagagattagttagtaaagaaagatggtttcatatggcttttggattgtgtttgcgtttgttatcgtcgtttctaaaccgtgtttaggtacttagcgagatagatgtaaaaaaatataacaaactgcatagaatataatcgtatcgatcgttttcttcttgttccttatcgattgaatattcgttacgttcaatattttcatgagaacaaatatatgatcttaagtagagttaagaaagaaaataattaattcagattttactagttggtagttaccatccaatgcttcaattcccacatgcaactgatatgtggctacaagaggtttcacgtgttaaaataattgtttatttttgttcaaattggcgtttgttcatttcttttcaccattattggacaccgattcctgtgacacgattgtgattgagacaatgttttatatttaaacatttttttcatgtgcttgaccaaactaacaagtggttaaatgtatattcaattgcaaaactagttttcctaatgaacctagaattattgtttattacattcttagcccaaatgaatcacttatttgctagcttaattaggccaaaacagaagagatttgtagttcattactaaagtttaaactaagttcggtcatgttttttggagtctttctaaacaaattatattaattcaatgttattaaatcagtttaaattaagttggtcagatgacatactaatatcactattacacggaagtcaaaatgttagaaaactaaatatgaattagtttcgtgtaaaaacaggattagtttcgtattagagtcactaatcttttcatcttcaattctaatcagttaaaatggtcataaaaatggccacagtacaattcacacatgttcagtctatcgtttgggattgctgattgatttctttcactctcagatttttaaactattctccaaatcttgaagtgaaaaaagtagtacagaaatcaatcagcataatcataggattgtgttcaatgacctggtttcacagatgaaccattaaccatataaatttatttattaaattttattacatatttgtattcaatgcacaaaatgagaaatcatattaggaactacatctaccatgccaataaggaaatccaccaagtcaattttctaaaatttctgatgactgtatatatctatctacggatatgtataaaactacgtggacaattcaatgtaaaattcatatcattgtcatacccattcaaacaaacgaaagactaattaaccgataagaacaatataattgtattccttactaaattcttttactatattttccaatttttgagaaatttgttacccttcgtttcatgcataatcccattgtacagtataatggtaagaaaaaaaaagtagaaatataagaaaaccttttttctttcttttgaaaaacttaaatgatttttctaataacaccgcacaaatacaaatagaaaattacagatctaatttgtacaccaaaactcttttttactttggaaaaaaaaaaacttttttacttttgacatttatacccaattttctctcttccagcgaagcaggagacagtaaaaggaataataaatccaacaatttctctgagattcaactttaagaaaaaaaacaataatcgatattacaaatatatatataaagacatttgctctttctcgtgtcatcaaatctcaaaaagaaaaaaaaagagaaactcgaaaacgagaaaaatg

SEQ ID NO: 36611 - DNA, 3000 bp, Unknown
  misc_feature (1)..( 3000): 2750-1469P.txt file - cDNA_ID_3098367; gDNA_ID_2936561; Annot_ID_194435
acagctgaaaaggtaaaaagttcagagacaaaatcagaacagagttacctcacaaccaattgcaaaatttggattatttagaaatttttattttgccagtttgtattccacgtgagattttccacatgctaaaaagtttgtataaatcattggttgccatagaaaagtaatcttgattgtataaaatccttttatgaatgcaaagtttggatcttgtctcaaattggataaagccagtggggtatacgaactaagctatatttctctttggtacctaaaactttcttatgtataaatagaatccaattatttctgagttattctcattttgaccccaataaactaaagttttttgcatttctgtacaggtccattgttctacaagggatggtaccatttcttctaccaatataacccaaacgcagccgtatggggtgacattgtttggggtcacgccgtgtctagggacctaatccattgggtccatttgcccatagccatggtcgctgatcaatggtacgactccaacggtgtgtggaccggctcagccacatttctccctgatggctctatagtcatgctctataccggttccaccgacaaagcggtgcaggtatgtaccccgaaattattcctacttgcactcaattttaaattgttggaacaagataataaaattgtagaaacagtattcataagaaagaattaacttagaaaaataaaacacacaataatttcaaatctaattttagtttttgtaatttacaaccaaattactcttttctaaatataaaagctaataaaactctactaaaaatgattgaatccaataaattgtcaaatctaacaagtatttttgttaaagatatattaccaaactagtacgtttaacttttaactataaaaactaattcgatgattagtaggtcgatccaatgatatatatttatgtgtgaaaatgttttcttagaacaagaaacgagatattaagactttttctttggtttgaaactttaggcgtagtagagttaatatagccagatttttggtatgttagatactgaacatgtaaattaggtttaataattgtatcaatgattgtaatttaatgtttttaggtccaaaaccttgcctaccctgaagaccccaacgacccacttctgttgaaatgggtcaagttcccggggaacccggttctagtacctccgcccggtatcctccctaaggacttccgtgacccaacgactgcatggaagacatcagaaggaaaatggcggatcacgattggttccaagctcaacaaaactggaatctcactcgtgtacgacacaatcgactttaaaacatacgagaaacttgacacattgttgcaccgagttcccaacactggaatgtgggagtgtgttgacttttacccggtgtctaagactgcgggcaatgggcttgacacatcggtcaatggaccggatgtgaagcatatcgtgaaggctagcatggacgacacgaggttcgatcattatgctgtaggcacgtatttcgattcaaacggaacatggatccccgatgatcctactatcgatgttgggatgactgccagtttaagatatgattacggaaagttctatgcttcaaagtcgttttacgaccagaacaagggtcgaagagtcttgtggagttggattggtgagtctgatagtgaggcttctgatgtacaaaagggttggtcttctctccaggtatgtgttgtttccttgacgtaacgtgttgtcaaagttagtttttttgtgtgtgatagttgcttgtaatccaagtttctaagatttgtgtgtatacggttatcagggtatcccaagaaccgttgtcctcgacacaaagacaggaaagaacttggttcaatggccagtagaagaaatcaaatctcttagactaagcagcaagcaatttgatctcgaggtcggtcccgggtcagtggtaccggtcgatgtaggttccgcagctcagctagacatcgaagcagaattcgagattaacaaagaatctctagacaaaatcatcggaaacgcttcggtagtggctgaagccgaggaatttagctgcgaaaaaagcggaggctccaccgtccgtggtgctttagggccattcggattctcggtacttgccacagagagcttgtctgagcaaacaccggtttacttctatgtagctaagggaaaagattcagagctcaaaactttcttctgcacagacacctcaaggtatcaatgtcttaaaatcactacacattacaatctatgccataatacattcggttatgtaacacacaacactttcctatgacaggtcatctgttgcaaacgatgtcgttaaaccgatatacggtagcgtcgtaccggttctaaaaggggagaaactgaccatgagaattttggtaaataactgaatcatatattaaccttatatactttgatgtactaattccattaactcattacattatgtttttgttattttcaataggtggatcattcgatagtagaagcattcggacaaggtggaagaacatgtataacatcaagagtctatccaacaactgcaatctatggagcagccaagctcttcttgttcaataatgctcttgatgcgacggttacggcgtcgtttacagtttggcaaatgaacagtgcttttattcatccttactctgacgaagctgtccgtgctctctcccgtacctgattatttttacttccttctcattttttatacatagatttatctgtaataattaatggttttttccgattttatttgatatttgatttagaaaaaaaaggcactgaaacatcattatcacaatttacaattttggagaaataaatttgtttaatagtttttttcatgtaatatattaaaagtcagaaccttcggattagcgcagagggtttgagaaacagagcttcttttttttggctcatcgtcaaaacaaaagtgttggcgatg

SEQ ID NO: 36612 - DNA, 3000 bp, Unknown
  misc_feature (1)..( 3000): 2750-1469P.txt file - cDNA_ID_3098375; gDNA_ID_2936561; Annot_ID_194434
cctactatcgatgttgggatgactgccagtttaagatatgattacggaaagttctatgcttcaaagtcgttttacgaccagaacaagggtcgaagagtcttgtggagttggattggtgagtctgatagtgaggcttctgatgtacaaaagggttggtcttctctccaggtatgtgttgtttccttgacgtaacgtgttgtcaaagttagtttttttgtgtgtgatagttgcttgtaatccaagtttctaagatttgtgtgtatacggttatcagggtatcccaagaaccgttgtcctcgacacaaagacaggaaagaacttggttcaatggccagtagaagaaatcaaatctcttagactaagcagcaagcaatttgatctcgaggtcggtcccgggtcagtggtaccggtcgatgtaggttccgcagctcagctagacatcgaagcagaattcgagattaacaaagaatctctagacaaaatcatcggaaacgcttcggtagtggctgaagccgaggaatttagctgcgaaaaaagcggaggctccaccgtccgtggtgctttagggccattcggattctcggtacttgccacagagagcttgtctgagcaaacaccggtttacttctatgtagctaagggaaaagattcagagctcaaaactttcttctgcacagacacctcaaggtatcaatgtcttaaaatcactacacattacaatctatgccataatacattcggttatgtaacacacaacactttcctatgacaggtcatctgttgcaaacgatgtcgttaaaccgatatacggtagcgtcgtaccggttctaaaaggggagaaactgaccatgagaattttggtaaataactgaatcatatattaaccttatatactttgatgtactaattccattaactcattacattatgtttttgttattttcaataggtggatcattcgatagtagaagcattcggacaaggtggaagaacatgtataacatcaagagtctatccaacaactgcaatctatggagcagccaagctcttcttgttcaataatgctcttgatgcgacggttacggcgtcgtttacagtttggcaaatgaacagtgcttttattcatccttactctgacgaagctgtccgtgctctctcccgtacctgattatttttacttccttctcattttttatacatagatttatctgtaataattaatggttttttccgattttatttgatatttgatttagaaaaaaaaggcactgaaacatcattatcacaatttacaattttggagaaataaatttgtttaatagtttttttcatgtaatatattaaaagtcagaaccttcggattagcgcagagggtttgagaaacagagcttcttttttttggctcatcgtcaaaacaaaagtgttggcgatggaacgaactactgtaatactgttcgtcttcttcttgctctctgtagcaatgtgttctcttcactctttttcttccgtagcaatttcattcagaactcaaaagtacgtaaatacctctctcgttcatcgcttatctcctataggatatcgtaattatcctctaccgtgggcagtgacgtcaattgacgaaatccctcctaatgctgttcgccggaaaatagaccggaattggagaggtgggttcagtctcggcgtagatttaggtttatctcgaaccggaatcgctattagtaaaggctacaccgttaaacctctcacggtaactttcgaaatttctcgacctcgttgcgttttcaaattcagtaatgaagttgatatgaattgggtattactattaggttttgaaatcgagagggcaaaaactcgagaccaggcttttagaaattgctgaagaagaagaggctgatgaatttataattgggttgccgagatcttctgatgggaaagagacgattcaatcgaacaaaattcgttctgttgctggacggctcgctattcaagccgccgagaggtgaagcacactcacactcacacatttatatatcgatgaagtgtgatgaaattggtaaagttctgtgctttgcaggggttggagagtttatgtatttgatgaacatggaacaacgtcagaagcttcagatagaatgattgtaatgttagtttcgtttctgaatctctctctgttcttagtttagcaattctggttttgatgtctataaagtttttttttttatgtacattggtatctatctatcaacaaccttaaatcactgaactttcatgaaaatttcgattacggtgtgtctgaattaatgtttgagcattatggtatttcaggggacttagcaagagtgaaagacagaacagatcagatgcatatgctgctgtggtaaggcgaacagtaaacaatctcgagttcgtgaaatgtaactgctatctttcttattgaatcttatgttacagatattgttggagaggtatttctctacacaaggtttaggaattgagattatacttcccaagagtttagagcttcaagcaaagatcaagaacggtgcacctgtagaccccgacttcaatccggaaaacctcgaagagtattacacattctaaagtagtttgcgttgtgaaattcttgtgattttttttagttggattcatttcacgcagacatcggtatataagcaaagcaataagtttctgttcatgaccttgttactgaattttgttgaaagccaaactaaagatctgatttgttttgtttctactgcttctgtgttctttgtcacaaggaagaacaaagtcaaagtaaattgtgaaagacttggaattggaagagaatagaaaaccaagaacaaaacaggtgaacataagtgacatacgtgtgcacaccttgcccaagcaaagtggataaagttcgaaatccttcacacgtgcaaaattcatctcttcttctacaaagttgaatgtatcatttctcccctgcaaagttttagacttttaacaatg

SEQ ID NO: 36613 - DNA, 3003 bp, Unknown
  misc_feature (1)..( 3003): 2750-1469P.txt file - cDNA_ID_3098380; gDNA_ID_2936561; Annot_ID_194433
tttttttgtttcttttcatttatggattttttttattaataaacacctttactatttgctctggtatggtagaaaaaaaatatgtatcagttataatgaaattttgtggaacacgaataagcaaaattcgtttctgttagttttttgtaagaaaaggtagatgatttttttagtaacacttaaaacgatcacattcacattttttttttataacacagtgcattaattaattaataattggattaagaaaggtttaagagaacgggataacgggaagggacccacgtgaccaaccggcctgcaacaggaaatgatcgatggctcgctcacgccggaccaccacccgccacgtcaccacatcattccgtttctccccccctttgtgggtccctctttacacttaccaccttgctcaagttccgcgctctttttttcttttcttttcttttttcttcttcttcgtaagagcagaacaatatatttggggtaatcaatggcaaaaattttgatttaaaagttgaagttaagactttagataatatatttttttaatgttgttttatgctcaaaatagtttaagatgaatctttctttccagtcaattggaccaaaacggaagctgtctatggttacttttgaagtttccaaaggatgaaaatattcatatatgtaataatgtaaatagagagcaataattactttaaaaaatatctcatagaacaggttttcttcaagaagatacatacactttcatattatttttagtatgtctccacatttcgtttcatcagaatgattatgtgaatacaagtacaaaattgtaaatacaattaaaaattgctcataggtcctagattaccgaatcacatggaaatgatgtacagtatatatatttgatatttcaatattaacgtaaagaatttgaagaagaaaaaaaatgaaaaccaactcctataagaaaaaatgttaattcacattattggtagggatcatacactgtttgtctcttgatgattttatttaactcatacgaagtacagaataacttataactaaattatctacaaattttaatgatatacatatctctagataatatatatgatctctagataatatatatgatagtcttgatagcactaattgttgtgtgcattggtgttcgaacttcgaataatacagtgacatgccaaccttgaatttaagaatcatcatgcatgttgatgttttactgagatatctgaataactctggatgtatagatctttcaacaaagattttcttgcaaattaacctaccatcaaaccagcaatatcgttgggttctaaactagttgagtacttgagttacttttttttttttttttttttgacatctctagtttagcaagacaattttaggacataaaaaagaagtccaaattaaagtaagaaaattaaccttaatgttgatgatcaagtatatccatcaagagctggtgggtggtaatggatgttgccacctctctctctctctctaaatcttacttgcccctttatcctcctctctcttctccccccaagcttttgcaacaaataaagtcccccccccctctctctctaggttcaaaaggactcacaagagagagatagtatgattgatagggaaagagagagagatgaaagaaagtaaaatatataatagattattaggacacgattgtcatcttttgatttgtgtcttgtgtgctctctctttcttctcttcctcgattgatcttctttatataaccctactctctttctcttttcccattctttctatcattctccctttctctctcgggatctgatctctctttccagtaacctattcccgaggagcactgtcaaatcttgtccactctttgatcttatctcgatctctttctctttctagtcttgtgtagtcttcaaacttgtgatgttatctatatagtaatcacgagagagaatcatacaatagctgaaacataaagctttcttagaagctttaaaaaggtctcatctggattatcctgtttaatttctagagtttcttcaggtaaaaccctaattttatgtcaattttctatttattaccaatcgtcacaaataatattggctgttttttcttctttaagtaaaacttgatcatcatctttaatcatccttgatcataatcttcattaatcacctaaggtgattcaccttgatgatcatcatcatcatgtccatcccatttcatactcaatgttgctgatgttacaagcaaagcaaaatatcatctaaacctaaaatatcttattataataaaatagacataagtagatcaagctggggtttttttttgttaagttgattaaaagttttcataagatgttatacaataatctaaaaaagaatctcttaagatggatcatcctctctttaaaaaaaaaaactactcctcttcatcttctgatctttacttgtttggttatagtacttagatggaaatataagcagaatcaaatttaataatcgatctagtctatttgaagctgaaattatgcatctcattaaatcaattaactatataccatcatacggtatataattgggtttcactgattttactttcttgaaaattcagttatttaccatgagtccatgactttaaactagtgagtttaattaattatctcgaacctacataactaaccatgtgaatagtcttcacatatttctttagatgtaagcatgtaacacaactaattcttgtaattaataaatgtctgacgataattcctttcgattttgaattcaacctcttatatattcagcatagtacgtctaatcatatgtctgtcgaaataatcaactaattcacaatcacactatgtaagatatgtaactacctagctatatataaccttcttatgttcataatttcatgactttgttttcgatttgtttggtgattttcttataggcagattattaaccgatcaagaagacaaacatg

SEQ ID NO: 36614 - DNA, 3000 bp, Unknown; identical to SEQ ID NO: 34608
  misc_feature (1)..( 3000): 2750-1469P.txt file - cDNA_ID_3098398; gDNA_ID_2936562; Annot_ID_194491

SEQ ID NO: 36615 - DNA, 3000 bp, Unknown
  misc_feature (1)..( 3000): 2750-1469P.txt file - cDNA_ID_3098403; gDNA_ID_2936562; Annot_ID_194489
aaaaaacattattttaaaccacacgcaacaagtaaaaaaaaatatagaataaaaatgcaaaaataaattccacaactttgtaaattccacaaattacgataacataaattcgacaaattcatgatcaagtaaatcaatcataaacaaaaaaacattaattttaaacacactcaaagatacaagaaaatgctaaaataaactccacatcttcatgatcacataaattaattataaacaaacaaaaaacattatctttaaaacacacgcaacaagtaaacataaaaatacaataaaaatgcaaaaataaattccacaacttcatgatcacgtaaccatattttggtctgtaaccatatcaagcggttaaaaaccttaaccattaaccgtaaaaatatataggtatggttaaccatacggttaaaaccttaactgttaattaaccatatggttaaaaccttacaaatatattgtaagtgtgtataatgcaaaagacaaggatcgaatgttcagataatttttttgttttaatgatagtgcatatgaaaaaatctatgttaaaaaaaaacaactatgttgtaattaagaaaagttgatctacaatatatatttttatcttattaaaaacagtataaacggtcggataatttgttaaattttgcctctgatattactcgtatcgtaatcatcaattaaacataacttatttttttatttttttttggtcatgcctaagtttgctttctctcaaacacattttcaatttagattctttttgagcagcactaattttaactcaatccttgtttcaatattctcttgctaatataattttgagtgtcacagtgaacctgtaaaatatcgtgtgatcaatttttacattgtttttacgtctgcatattattttttggtttgtaaaggtttttttgaattcagatatttcatttacatatcaattagaataaagagtcaagtcattattttttctcgtcattagagagatgaattattcatgttcaatcttttcgtaatatggtaatatcgccatcgcatgtctgcgcttgtctctctacatccttgaccaccataatctgagcttttgaacgcgattatttttataccgtaccgaacgctgcaaccatttgatgagtctctaactgaaatatggagtgtgaatcaaacttactttttaactgaaattgtggtattgattcctacaaaccaaattggttcttaaataaagatatacaactaaaagctagtgactgcaattgttctcgttttttctctcctatcaacgagaatgacattgttaaactcggagacttagtagccattagccaccgtagactgcggcatacactatatagcaatcttcatttgtatcacccatttcttcaactagaacgccgcttgagcaaatcagtcctccatccactacctccacattcacaatctccacttcaaacaaagaaggaagtaatgattgtgataacatggtagataaagctgactccaagactaagtaacacaatgagagatgttttcgcacaaacaatactggatcaaataagtaaatggtaatgctcgtttctgtctacttttcacaacaccaatcttaatccaatttcacagtaacttatatctagtacaaagccaaaatttcgaactcaaattttccacaataatacttgaaacaaagaactcaagtttcttctgggaagacaacaactttgtttagaaattctatgatcgaggaggttacctgtggaacttactatgggaagatggacttaacattctccaaatccagctgctggtaaagagaatgaggcactccaagcttaatctgaaactttatttctccaaatgaaactccaggaatcgaaccttcgacacattcaacgccaccaagtcaagttaaaagtcaacagttttcaaagatttaaatctagatccgtgaaagagtctctcattacgtaaaagaagtttataaaaagaggacgacgtgaccattttaaaatatttttgattttcttctaatttttatattaaattttaaaattaaatagttatagtaaaactgaaattttaaatttttagacacaataaaataaatgttaataaaattaatttcatatcatctaaaacttaatagttaattgagatgataaagagaaaattggaattttattttagttgtgagatcgtaagtatgaaaataataatatttaattgtttagatattaaattacattatttcgtgtatttttcttccaaccaaaaacaattgggtatgaaacgtctaaataaaaattaattgatgttttttataaaaaatttcaccataatatttaccataccatatctatttaatatttatcattaaaccggttatactatatgttccgctaacacttccgcacaaattaaataacaatttatgaaaatttgcatccaatcggttttgaactttagactcgtaattacttcatacaaaactcttttaatttattttcttattgcaatagtaaatattaatactgttcattttttacataacatgaactattatttttgtgttgctatttttaatattttctaattatttcgcaattagtaaaaatcgagaatacttgcatcgttttattatgtcaccagaaatagattttattttaaaacaatttagaggttgcatcaattagataggcaaaaaaaaattgagtgctagagaaatcttttacctttttcgtaaatttagatgcttcttcatcactacaatttctctcctgtcactctcttcttctacgctcttgtctttatatccgatctacctcgttccctctcaaatccctaaatcgtctcctatatcctttcgcaaatggacaaacccaagatctgaaaaagtttttgtcttttctctcccaatcgcctgattcaagcctaaagctcggtttttttcttctgggtatttaggggttaagtgtattgtagaaaagcatg

SEQ ID NO: 36616 - DNA, 3000 bp, Unknown; identical to SEQ ID NO: 36615
  misc_feature (1)..( 3000): 2750-1469P.txt file - cDNA_ID_3098403; gDNA_ID_2684605; Annot_ID_193239

SEQ ID NO: 36617 - DNA, 3003 bp, Unknown
  misc_feature (1)..( 3003): 2750-1469P.txt file - cDNA_ID_3098459; gDNA_ID_2936562; Annot_ID_194475
cagatgcaaattccccaaagcatttagttctatggatcggtcaacagagagaataaccctagatatggtaactttagccttcaatttgaaatcaaagagaataaccatagatcgtaactttagcctacttgaaaccttttaaatcaatatgaaatccaaattcctaaaaaaaaaacaaatcatggaaaaagaaggtatcatgcactgacctcatcatcgttgtagtttaaaacctaaatgtatcttactaatcctttcctattctaagctttttctttaacctggacaacaaataatagaaaacaaaaggcttaattatggatgtttttttttttttttttttgacgattaaaaataaaccagctctatatataatttaataaacttttttgtttgttttataaaaaaaccaccaaatatatttatttatttttaaagaaaaaccaccaaatcatttttttttgataaaaggttaaattttacaccattttcgatttttgacagatattacaaagaatactagaaacggaataaagcaacctacataacttaaaaacaccgattccgagtccgcaaagctcagaaatttgcgtggttgccacagaaccgaagaactggaatcctcatcctagttaccacgagcatatctatttgaggcccgtccacaaaacctcaagatagaaacctacaacttctccgagaactaacgcaaaaacgcattgacaatcatggacttctacaccaactcaagagaaagcgttgccaaacagacctattcgccaaatcttttcaaattgaatagaaccaccaatctttattttaaagaaatgaccatatgatgtaacttttcaaattttacctaggcatgcttttttgagcaggcaatttctcttcagctccagcagttctctccgcaaggaaaggatcacagtttggcatgcataatgaattagggatcgtcttcgccaaagaactcttacaaatttgttctcattgtttagcggagttcttgtgtttgcttggattgtttaggcttagagcatcctcaatggaaggtttttagatagttcttatgcatatgaaagtagaatatgaagagagagaattagaaaaaactcttagctaagaggcttgatgatttatatatgagacacatgtctcttttatattggttcaattttctaatatggttaatgtgctggctttcctcccggatgagcttagagaaaagcttatcgatgagcaagaaactagagagaagtttcagagattacacagttatgtgcatgctctttcgactgaagtcgcaatgaagcggttttatggagctctgactacaaaggaagggatttctggttcgggtgttaatgccacaagtgactggggtagctatgttactgagctaagctctcttcttgaaaaatctcctaagattgaagttaaattggacacatagatgagacttgttctctaatggttattgccaagcaatagcaagattagtagtgtctagtttccataccaaactgttggtaagcgcggttctgtttggtctagtaaaacttgcttgccttgatatgaattatttgtaatttcgactaaatctcacttgttattcaactgatatgttgcttataaagattccttttgggagttggggactacagtaagtcgggacgtagcgtaacctgacatcaccttcgtgtgtttttaacgccaatatcatgcatgacacagaaaacaaagttcgtttcacttgtcatgtaataaaatgccttcgtctgtttttgttcgttcataacttatatctcaaatcatagttccaatcctcataatccacaaacgtcggtttagatcatactaatgttttagtcgttttacaatctaaactgaatactaaaccgactaaattcgataccaatagctctgggcatttgggtattcgggtcgcgtttgggtcatgtctttcgggttggattcggttcggatttacttcagatctgaataattcgggtatttgttgaaaaactcgataaataaccaaaactatttcggattgaatactacttacccaaactttatccaaatatatccaaatatacataaaagtatccgtaaaacccaaaagacctgaattataacaagtttttctttaagataataacatgaaacaagatgtaaaccttattttgagcttgttccataatccaatcaatgtatatatgtcctcatgtgtatatatatgttcgggtataaaaaatactcacggatatcgggttctgttcgggtaatacccgatacccacaattatttgaaaacagaatccgatcaggtaattagttggaaccgaagtagaacggattcagatatttcaggtcagattcggttcggttcttcgagttcagatataatgcccaggcctactaaacccgatgcataaacgacccaatatcttcttcttgttcacttgatttattaagctccaacaattaattgattattcttattcaacaccattaatgtataacataactctcatccaacacctacttaatttgatgatctaatgaagttgatgttgagtaaaaaagaaaacaccaatatttcctctgttttttttcctccttaaattaaaaaaaaaaaaccagaaaaccgaatgatccataaagaaatcgggtcgggtcagatctagcggccgactcctcctatacacagatccagaagcacacacacaaccgtataaagtttaatctctgccggaagcgcgtcgccgatcacgcgcattcatctgcatcttctcctttctctcacctaatcacatttttgtactttaatggcgaaatcgatctaattcgtccgtgaacaactataaccaaactcttcccccaaaaaaccttgcttcaaccatacttcacacaaatccttcaccaccactcttctcgcgtctctgtgtatatatatatttggtagagagtgctcatcgacgacgacaatgctaaaatg

SEQ ID NO: 36618 - DNA, 3003 bp, Unknown
  misc_feature (1)..( 3003): 2750-1469P.txt file - cDNA_ID_3098471; gDNA_ID_2936562; Annot_ID_194472
gattggctgctactactcccatactgatgaagcatgaaaagccgatgttgaatgctccacgccatcgcggtggtgctacttccgatagatataccggagccgcctagagtgttcacatttttttttttaaaaagagtatagtttcatccgtatttatatttattaaatgtgatagatatgctaacacattaaataaaattgtttaaaccaaaaccgttcaaaccgaactagattttgtttaaaaaccgacaaaaacaaacttaaacctgatctaaaattgttttagactttattttttggtgaaaattaaaaactgttttagacttttgtgtaactaaaattttacaaagtaggatacataaatatatatataaagtcgaatctaaaaccgtaattttatcaaacctaacgagttataaattattgtgtattggtttcaggtttaatatatagtgataaacccaaaataaatcagaaagaacaacttaattaaccatataccaacactcaaacgaacaaaaatatgctatgggctctagtgaaattggaactatatatagctacctggttggtgaaaccgacaccaaatcctagcaaaatccgaccggagatgagcatggcgatgttagcagctaagccattgatcagagcaccaaagaggaaagtgaaaccgccaaggatcatggtggttcggcgaccataagccgctgtgagacggctagccactaaggaagctactaagccggcaacataaaggctagatgtgaaggccgtaagaagttggctgtcgtagacgcagtagacattcgtcttagcttccgaagcttttttaagaaccgatggaaagaatttctcaagaaacggcttcatagtcgtcacaccccctttgttaaattataatcaaagataaattaactaatatacttgtttaataaaatgatccttttatgttcttgaatttgtaacctgagattccgatgtcatagccaaaaatgagaccacatgaggcagccacaatgcaactcatgacaactgcggctgtgatcttggcatcaatgtttccggcgctggagacatcaagagccaatcctccaccggccattttgcttatgtcttacgcatgaagtgttttttttttgtttttttttggttgtaaaaccaaatgaacaaagagaatacattaaagataaagaaggtttttaggtgagtcttttagttagttggcgtggtgacttgatggtactagtgtgcagccacttatctatgcatatgtcggttaataacgtcataatctaaaaggacttaagaaactttcaaagcaagaaatgagtttttgatttttgtgtcacataaaaacagtcgctaaacttacttaaaccgattcaaatattagacacacaaataaacatcgaatgttatagtggtgtcaaaatacttaacgtcacaagttatcacgatggtttttcaaactgatgctattttgttcaagtcggtttagtatcgacgtcaaggtcaataagaaccgacgtcatgcgccgcttttttgtagtggctacaccacatattttatttggtgtagtgaactaatttgaattctccaaaacaaaatgtaaatgtaataaactaatttacattcttcatacgcagttagtaataatagatcgagtttggtataacatccttatcgctgacagaaactgatgaaagaatccagatagaagataagaatatgaaaataaatagccacacaaagacaaagtttacataatggtggtttgtcacgtgttctaccattttggtaggaagaattaaagacgtagttttagcctcagtgctttgaattctagtaccgtataaataagtgtgacgacatttaagctgactaagaaactaatttggacattagcatattataaaatttccgagatcatgtagataaatctaaatgtgtaatatttgcatttgtaccatttgcgcatggatccattagaaatataagaaaattgagaatgaaacccatcaattagtttggttcgtataaaacactaattaatatcatatacaataagtccatgactctttgttttgtatatctattaatttctccataatatctttgaggtatgaattccaattcgaacccaccaactcattttcatagaaaggagtctttaacaatagagctattggaacttttcatttgaatccaccacctctttttcactttaacgagtctttaacaatagagttatattggaagttttcataattaatggcttctaaatttaatattaacacattcaaggccacaaacacttgcttgtgtagcttctattgagggctggctctgaatataactcctaattattaattgacttgtaataaggtttagatttttttttcttaagtacgtccaatttctacacctttgtatgtattgaataagcaagcagcttctccaatttctacaccttttgtattgaataagaaaacactttctccaatttctatactatctttgacgtttcaacctaactatactcattacaaatcttcaatacgtattaaagtgtaatgaggtatattgtttaatttgtttgaatggtataaaccatatatatatgtttctctttcgaggatgctactatagatcttgacataattgtaaaacaaaatatatttaggtttcaactagagtgcgattttttaaattcgtgtttgtatgtatatagcaaaatctaaatatagacctacgttaaattttttaaaaaatgttatgatctaaaactaacaaaatgtatagtaatagaacgctatattttaagacttaaatctccaactacctacttatattgactactttttagatttcagtctaccaaaaaatatatatacattcacaagaatatcaatctatctataatacactatataaattatcctaatccctcaccaatctctcaaaacactaaaaccattatcttctccaaggaaagaaaaatg

SEQ ID NO: 36619 - DNA, 3000 bp, Unknown; identical to SEQ ID NO: 7198
  misc_feature (1)..( 3000): 2750-1469P.txt file - cDNA_ID_3098503; gDNA_ID_2936562; Annot_ID_194464

SEQ ID NO: 36620 - DNA, 3000 bp, Unknown; identical to SEQ ID NO: 10477
  misc_feature (1)..( 3000): 2750-1469P.txt file - cDNA_ID_3098512; gDNA_ID_2213653; Annot_ID_132493

SEQ ID NO: 36621 - DNA, 3003 bp, Unknown
  misc_feature (1)..( 3003): 2750-1469P.txt file - cDNA_ID_3098545; gDNA_ID_2936563; Annot_ID_194514
tggtggctgcttgggttccttcaaggcatgattggctgcgaaccagacctttgggtgaacttcttgttaacagtctggggaggcaaaagatgtacagctactgcacctgtatgtttgtactgatttcaagactagctaaacttaaaaaaaaagaaatcgagattgctatgcttacttttctaatctctttgtatcatcttgtgtcagatgatttgcagtttttgcattttggaacatcaagtgaggtattggatcatttaagcggggatgcttcaggaattgttggtcggagacacttatgttccatccctgcaactacggtttctgatattgcagcatcttccgttattttgtctagtgaaattgcacctggtgtctccattggtgaagattcacttatatatgattcaacagtttctggtgctgtacaaattggttctcagtccatagttgttggtattcacatcccgagcgaagatcttggaactccagagagtttcaggttcatgcttcctgataggcattgtctttgggaggtcccactagtgggacataagggaagagtgattgtgtattgtggtctccatgacaatccaaagaactcaattcataaagatggaactttttgcggtaaacccttggagaaggtattgtttgatcttggcattgaggaaagcgacctctggagctcgtatgttgcacaagatagatgtttgtggaatgcaaaactgttcccgattcttacgtatagtgaaatgctgaagttagcgtcgtggttgatgggtttagatgatagtagaaacaaggagaagattaagttgtggagaagctcacaacgtgtaagcttagaagagttgcatggatcaatcaactttcctgagatgtgcaatggttccagcaatcatcaagctgatcttgcgggtggaatcgctaaagcatgtatgaactatggtatgcttgggcgtaatttgtctcagctgtgccatgagattttacagaaagagtcattaggattggaaatatgcaagaattttctggatcaatgtcccaaatttcaggagcagaactccaaaattcttccaaagagtcgagcataccaggtagaagttgatcttcttcgagcatgtggggatgaagcaaaagctatagagttggagcataaagtatggggagcagttgcagaagaaactgcttcagctgtgagatatggttttagaggtaaaaatctagccaccaccgtttggtataacacctttcataaacctggatttaactcttttatttgttcttcagaacatctgttggaatcaagtggcaagtctcattctgagaatcatatttctcatccggatcgagtttttcaaccaagaaggacaaaagttgaactaccagttcgggtagattttgtaggaggttggagtgatacacctccatggagcttagagcgtgcaggttacgtcctgaacatggctataaccttagaaggttcacttccaattggcacaatcattgaaacaacaaatcagatgggaatctcaatccaagacgacgctggaaacgagctacacatcgaagatccaataagcattaagacaccatttgaagtcaatgatccattcaggcttgttaaatctgctctattggtaaccggcattgtccaagaaaattttgttgactccacagggttagcaataaagacatgggccaatgttcctcgtggcagtggtctaggaacctcgagcattctagctgcagctgttgtgaaaggacttctccagatatctaatggagatgaaagcaatgaaaacattgcaagacttgtcttggttctggagcaactcatgggtacaggaggtggctggcaagatcagattggtggattatatccaggaatcaaattcacttcaagttttccaggaatccctatgcgtcttcaagttgttcctttactcgcctcgccacagctaatttcagagttggagcaacgcctccttgttgttttcacgggtcaagtaagtagcaaccactgagaggaagaaaagattttttgttagctacagagtctcattcattttatgccttttttatataaacaggtcaggctagctcatcaagtcctacacaaggtcgttacaaggtatttgcaaagagataatctcctaatttcaagcattaagcgattgacggagctggcgaaatccggtagagaagcgttgatgaactgtgaagttgacgaggtaggcgacataatgtcagaagcttggagactgcatcaagagctggatccgtattgcagcaatgagtttgtggataagctttttgagttttcgcaaccttatagctcaggattcaagctggtaggtgcaggtggtggtggattctcacttatattggctaaggacgcagagaaagccaaggagttaagacagagattggaagaacatgcagagtttgatgtcaaagtttacaactggagcatctgtatttgaaagatacatacagtgtcagtgtgtcatcatcttgattcttgtaaattgatatatttttttgggacctttggaaaaaataaaagcagaagaatctttcagatttgcaattaaaaacgatgtcgtgtggtaaacaaaatcctttgcttgaccaagtcgttctcttcttgcttctggttggtttacttcatagttcaacgaccaccaagctgtgaagtgaccgtattacccctgcctggaatcaaggtcaaaaggccccggaaaatcagtacgttggtagcatttggatttggagataacgccgttaaaagactctgtaacgggtttgctcaacagctctctctagttcgtttatcgaattagataatgccactccaaaaaacgttactttaccttacctatctcgctgacgtcagatcccaccgttagagcttacacttgtaacgccgtttcctgcattttccacaagcaaggtaaaaaaaagctttgtgcagagagagagagaagaagaaaaatg

SEQ ID NO: 36622 - DNA, 115 bp, Unknown
  misc_feature (1)..( 115): 2750-1469P.txt file - cDNA_ID_3098557; gDNA_ID_2936563; Annot_ID_194534
tcaagttatgagcacgtctgggaacatggcacaccatctattttgacaagataatattatacaatacatgtataaaatacgtacacattcatcgttataaactaaacccaccatg

SEQ ID NO: 36623 - DNA, 3003 bp, Unknown
  misc_feature (1)..( 3003): 2750-1469P.txt file - cDNA_ID_3098557; gDNA_ID_1620738; Annot_ID_166312
gcttcaaagagaagaacactaaatggaagatactagaacagcccttaagggagcttctatgggtggttagagaaggagaggcttatgttagaatgtctttagagcctaaacttgggttttgggctaaggctattgtgttgcatagcaatagagattgcacagagcttcacatacataacttgctctcttgtctaccgatcatcgtcgaggctattgagacagcgagtgaggtttcagggtgggatgaagaagagatgagcaagaagaggttggtgcattctaacaagtatatgaagcaatggaatgactctcagatgtttacctggaagtttgggagagagtatttggtgaccgaggatttctgcaaccggttcgagagtgcttggacagaggaccgttggattctgatcaaggagcttcaggagaaaaagcagtccggttcgagcaaacatgaacggaagatggctgatttccttttgaagcatttgggagatggaaatgagagccccaagctatttccttcttctcttctggataacacaaaagattaccaagtgaaaaaaagattagggaatggaagtcagtacaaggagattacctggttaggcgagagctttgcgcttaggcatttctttggggatattgatgctttgcttcctcagattactccattgctatctctttcacacccaaacattgtatattacctctgcggattcacggatgaggagaagaaagagtgtttcttggtcatggaactgatgaggaaaacccttggaatgcacatcaaagaggtatgtggtcctaggaagaagaacactctctccctcccggtcgcggttgatctgatgcttcagatagctttgggtatggaatatcttcactcgaagagaatataccacggagagttgaatccatcaaacattcttgtcaaaccaagaagtaaccaatccggagatgggtatctgcttgggaagatttttgggttcgggttgaattctgtcaagggattctctagtaaaagtgcttctttgacgagtcagaatgagaattttccattcatatggtattctccagaagttctagaggagcaagaacagagtggaactgcaggaagccttaagtatagtgataaatctgacgtgtatagctttgggatggttagctttgagcttctgacaggtaaagtaccatttgaagatagccacctgcaaggagataagatgagtagaaacattagggccggggagagaccgctttttccatttaattcaccaaagttcataacaaacctgacaaaacgatgctggcatgctgatcccaatcagcgtccaactttctcatcgataagcagaattctccggtatatcaaacggtttctagctttgaacccggaatgttacagtagtagccaacaagacccgtccattgcgcctactgtggattactgcgagatcgagacaaagctattgcagaagctttcttgggaatctacagagctaaccaaagtttcacaggttccttttcaaatgtttgcatatagggttgtggaacgggcaaaaacgtgtgaaaaggataatctccgggaaccatcggaatcaggaagtgaatgggcttcgtgtagcgaggatgagggtggggcaggatcagatgagcagttgtcatatgccaaggaaagaagattgtcatgctcctcaaatgatgttggtatgagcaagaagcaggtttcaaatcttctgaaaagagcttctagcctgaaaccaattcaaaaaccaggtgagattatcatcagccaatatatatatatatatataggctccctaacaaatatgaacttggttacttgtactaatttttttgttttgtgtcactagcctttggattctgttcagggacaactccgagaggacgatcaaggcatccgccactaagcccttgtggtgggcaaagcatgagagcaaactctgagagtcagctgatattgataagcccaaggatacgacgatcaaactctggacatgcctctgactctgagctttcctagtctgcagggaaaaagaataggttcataatagcaagttcaaaatgctgtacaagtcaaaagacatactaactcgtatgtggtgacacacactccactacatatctatcgaaaacgataaaattcttctttattcaaagtttcctacagatactactaggctcgtatattgttcaggctagtgactgattgattcagtagctactagctacaatattatcttaaaggaaacaaatcatatgaggcaaaattatgtgcctagactgtagaggctcaacgctgaagtgaagtaaactaggcctgctccactatttctacaatctatcaaacaccatcaaattacactaatcaaattttgggcttcgaatgtggataaaaacatcaaaaataaggaaccttgactaatctgcctgaaaattaccttaacaaaaaaggggaacagcgattccgccggggactagagacatggcgtggttcggagctttggctctgtctctcgtcaatttcaatatctccgccaccgccgactccgtcacatccatcctccgacgcttttattatgtcattgattgtgatatgaccaaaaagtccccactctagttttagatgaatgaagctatgatttcttttttttttttggtgataagtacgttattatgattttaataccaacagatttgtcaaatataacattataagcaagtggagtaaacaaactaagcagctgatttgtacaaaaaatactttacagctataacatttgtcattgtcaccctaatataaaatacaattccaacaactaaaatacatctctaaactttttaaagatgatgatgatgaaaagaattcaagttatgagcacgtctgggaacatggcacaccatctattttgacaagataatattatacaatacatgtataaaatacgtacacattcatcgttataaactaaacccaccatg

SEQ ID NO: 36624 - DNA, 3000 bp, Unknown
  misc_feature (1)..( 3000): 2750-1469P.txt file - cDNA_ID_3098563; gDNA_ID_2936563; Annot_ID_194533
tggaccctttagtccacatggtggtgttcacacgaggtggcctagtgaaattgattctgaaatgggtggtgcttttgctcgtgggtatgttcaacaagctgtgtctgatactgattcacgtcgttgccatcctctagcaggcggtgcgccttttattgcttgtcacagttgctttgagctgctatatgtgcctaagaagaagcttcttggtcaggaaaggcaacaaaagatgcaatgtggtgcttgttctgaggttatcacgttcagagttgttgataagaagcttgttttctcatcttctgccctgggggaaactacgaaccgggtttctgtagaggttgaagatagaagctcaccaatccctgtggtagatgattatccactcaatgatgaagaaccaagaatacaccaggaaacgaaaattgtccatgctgtatcgcctagtgatcactcaaacgatgaagacaggtcaagcatttctagtgagccgcggaaacaggtcgtcaagtctgttcgcagcagagcccaaggcgcgaaggttcctcctcctcctcctccggaaaagtccaatcttcttgagctctttgagtattctaatgtaaaccgagctgcaatcacttacggaatggcgcagttagggtactataagcaagaatcatacacgaaacaagactccctgaaatcagaatcagtagctactgagacagatgtttcttataatgagtactatactaacaccgaggagtctgaagattcaaggatctcaaaagccagcaaagaagggagacgaccaagaaaccgaaagcagagtagtgagcacagtttcgcagaggtcacaaataatatcagttctaacgaccaaaacaacgagcagctagaggtttgggtgaatgggtatctgataccagaagatctggttattagcgctgagaaacaagctgggccagttcaagctggcaaatactggtatgtttggggttacgttttgataaatctacgtcaaaagaattgatcagtcgttcaagaaaccatctttatgttatgattctgaccaggtatgattaccgtgctggattctggggagtgatgggaaacccttgtctcggtataataccagtaagaactttcacatctcttctatattgctttgaattccagtacactgtttcataattctttgtattgattggtacttgatgaggaaatgggaaacaattgttggttgatgcagccatttatagaggagtttagtcgaccaatgccggataactgcggtgcaggaaacacgagtgtgtttgtaaacggaagagagcttcacgagagagacctagagttactatcaagtagaggtcttcctcgaggcaagaaccgttcttacatcattgatatagcaggaagagttcttgatggagactctggtgaagaacttaagagtcttggcagattagctccaacgtaagcacaacacaattccatgtaatcaaatttttacatcaatcatttagttgattctgaaattttatggttgaaaattgaatcagggttgacaaggtgaagcatggatttggcatgagggttccaagatcattagtctcgtgaagcttcgtcagctttgttttgacctctctgatttgtaaattattctttgtgattgatatataacacatctttgcttatattctgacccaaaacttatttgctattctgtttttgggtttagtttcttttttgggggttctcttacaatgttccattctttctcttactttttttttttttgtctaagagataaaccgtatggttttatatcttgtgatctggtttatgtaaattgatcattttttattgtggataacctgttgcctgttgggaaataaaataatatttgtttgattttgtgacaaaagataaatgtatatatttatagatctgtccaggctgtgtgtacttgttaaatcgttttcaagaaagaaaacacactggtatggtagatccaaaatcaacttcaagtaagatgggtccacgtagcaaatatttaaagcccatggaataatttattcacaatgggcctcgtggtcgtggtgtaccctactccatataaaaaaacagagtcgataatctagtctgtctaaaacgactaattcatgtctaaagattagtttatgttttaaatcaccgagaactaattctaccgtctagatagaacgattttttttttttctctagatagaacgtttaaaacaaaattagcatgaaaattaccacggttatcagaagacaaaatatattttttcgtctaattagatgtgtaaagcataaactagatactaatttatatactcacaagtagttttagttacaagtttcaaccattaaatctaagtgcgaggtctctgtctttagttgaaaaaagagagagagaacaagtctctatctttgctcctgataagtgataattaatcaataaatactgtaggaccatccttatcgagtttcgtttgatagacactacaaatacaaactaatcacctaatttccataaatgtagagattactgtaatcctgtctacgttggaaataattaatggtaccatgtcacccgtaatagcaatggcttaatcatgtttaaagagacaacaagtacacgattcgcgctttacagttgtataattgtaactttaaaaacaattatggatgcctaatcattagattattttcttcttctgaatatctctccacaaattaaatgaagccacgaccgacataaacaaagtggaaacaattacagtaattcaaacacatgcaaacaaaaaaactcgagttaattattactaacatgttttagtacttctgagaaaaaaagaaaaaaacaggatccgctgtgtcttttttataatgatgaagttcctcgctttcaacgccaaccaaaaacctccagaaagctaattagggaaacatttgaaaaaactcagtgatctgctcttctctctaattgcaatg

SEQ ID NO: 36625 - DNA, 3003 bp, Unknown
  misc_feature (1)..( 3003): 2750-1469P.txt file - cDNA_ID_3098583; gDNA_ID_2936563; Annot_ID_194526
ctcacactcagtacagtgttgaaatagttaagctgtgtctgacctagttatctccacggacgcagatgatatggattcaggggcacctcaggaggacaagtgcggcgagatgggtgaacctgccttgctttgtgagcaatgcagatttactgtccaaggctttgaaaacttctccacgcatctcaagagtgaagaacatgcacatgaagtaagcatcctagccaaaaacgcagacttgttgtgtccatttgagtcaacaacctcttaccgcgagtttccctttctcacttaattcttccagttatgttttgcctaaatttgaccccatattttgttttgtcaatgagcagtctcaatactaccgtaacgaagatgatgaaaccgatggagacgactacgtacgagactctgaagacgacgaagaagagtagtaagagttgtgtgtgtgttaatgttatcttaagctatctaatcctttttatgttcaacatcttctaaatcctcgtaaactctggttttctttgtgtgttaactgataataatggtgttatcttaagctatgagtagtagtaagagttgtgtgagttaatgttactgatttctccaacgaatttgcttttttggagattttgtcccaatgaactgcaacaacaaaagcaactggtgagaaaatgatgacttgtttgaattgtgttagagttccagatacatatgctagagatgcaactagaaactggtcatatctcagcttaaaataactacaaagagcataacaagctggctaatacttaaaaatgtaaaatcagattcaacagaacccaatggttttgtgtgtgttttcagacctttagatttcgcaaagcccaccagaaacaatggttgcaaatactttcttctttctcagttctagtaaactataagccgaagctgtttttgcttgtattcgtttgcccatattgtgatggtctttaaagattgggccttctttggttcatctaaatttgaagctttttccttttgttaaatttgttgaaacagtcaaagttagattaaaccaggacaaatgaatgaaacgataaattcataactttttactgccagcattatcagaagaatgtcgttaatgttgtctttttttctttcacttccgtctgttttttttgtggtattggttaattcgaaaagattcggaacctattggccggcaaaaaagttatccaaatgaacaaaaagaagaattacacgtgtcaagttcacgagaaacgacataatacgtgaacatgaaaatgacagacaataaaccaatgaaaatatgacacgtatattggtttcctattatttaaccgtatttagctcattgtcgctgtcactaaaaaggctccttgtttttatcttgaagcagttaataatttacgccaaagtcgtcttttgcgtttaagttcgcatgcctagctagtgccaaaggtgatcctatccgataagctttgttttgggtaaatttttatctgataaggttactgtaattatcgtcaattaccgctcttttaagtactatattatcacttaacattttttaaaaaatatgattgcagaaaatgttatatataaactaaatccctattttatcataacgtcaatttcagacaattaatgagatatgtaagcataaaccatattcatattgaacaagaaaacctccggttacaattatatgtgttgtttaaaatggttacaaaatcggaagattgttcgttatgaaaaccttaaaccataattaatacatatgttagaagataattagataagtaatcatttaactagatttatctaaaaagtgattatgttgtttttgtttgagaaaaccaagtaaaggtgagtcttttctcctttgggaaaaacaaaagtagaattcaaaaaagaaagaaatagaattcactaattatatagtaatccattaatattactggttagaaagcgtaattagcggcggtggttatcaaaagtgacttccaccatatgtttcgaaagcttgagtttcacgaagaagatggaggaggggcaactttagactagtggagatgaatcgaatgatgatttattgtagattctttgtggtatctcatctttccttcgtatgaggtgtgattcacaacaaatacaatttaacaaaaactagtttgtctacattcggtatgatataattaaggactttgtctcaaacagattaaagttcttgtttcatgattttagattgtggatgccttgtaccaatcttcttgtagaaatgccttctcctcctagaagagaaattacaccttacgtgtcgtacatgactacatggaacagtcactttgcagataggatatggtgttagacatttagcttgatacaattaattaatgtttaacaacaaggtttaaaggcaacgagagctatatctaataagatgtggtctaagacatatgagacctgatacatggagaatcactcatttataaatttctggtatattaacgacattttgtgtctaaaaaattagctattataatgaatatggtctaaaattgaatttaaattaacaaaactatctataaagtttgaaacgatcttacctaatcaaaacaaataattatctaagcaatctgttttgttttgttcggattatataggtccccaaaacgtcatacaataaaacttgcttaaatattttgtttttttgttacattaaaaaattagtatcttgttgtgtttttgtttggtttgaaaagctgaaaatgtgtgaaggagaagaaggaagctataaaaaagagtttaggtacaaaagtaaaaagttattatgtcggtgggttcattaaaagaaaccaaaaaacataaacaagtaattttgttttggcataacgaagcatcttcttcttcttccttgtatttattatccatttccagagattctcccttgtgagataacaacgaagaacgaaagagagagagagagagagagatatg

SEQ ID NO: 36626 - DNA, 3000 bp, Unknown
  misc_feature (1)..( 3000): 2750-1469P.txt file - cDNA_ID_3098596; gDNA_ID_2936563; Annot_ID_194523
gtttgttatgagaggaagactggtaagtgccaccactaatggaggaagaagtgggttcttcaatgccgtgaacctaaaggcaagtgatttctgcggagaagatcttctcccgtgggcattagatcctcaatcttcttctcactttcccatctcgacaagaacagttcaagctctcactgaagtcgaagcctttgctctcacagctgaggatctcaagtctgtcgcttcacaattcagacgcctccatagcaagcaactccaacatacttttcggttcggtcactcccatcagcttctttggctctgttttcggttttggatcttcttaaccggatcttgattatatatacaggttttactcagtgcaatggagaacatggagcgtgtcttttatacaagcagcgtggaggagatactgtcggaggaagttagccaagtcactacgcgatgaagaagatcgtctccgagaagcgctcgctagtcaagataaagaacacaatgctgcaaccgtgtcgtcgtccttgagccttggaggcgctctttacgcgtcgcgtttcgcatcaaacgcgcttcacaatctgaggcacaatatctccaaccttcctcctcgctacactcttcctttgctacctcaaaaacccaccgagcctgacttcaccgccaatcatacaactgacccttagatctctcttgcatgtgtatagtgtgtggaataaagtgtaaaaacaatggtttgaactttgaaccaataaaatgtaaaaaattgtttatcaactaacagaaattgaaataatggctggctcttatgcgccgcttaactttggctacttcagttcagcatcacacatggaggtatagttagagactcgatctgatgatcaatgcattgaggaaagtgggaaaagcatatttagctttcaagctaatgcatagcaaaactggggttggttatgagagaatggctagtgttagaaggtctgtcaggtttaggactttacttaaacttgttttgactcccgagtttaaagaaacttttttgcgtttatgtcttttcttgaagaaggaaacaatcgaaagtttcctttttattttggaagaacctaataatgaaaacctgagggagaatgctaatctccaacaacatctcactcattctctcttcttccttgagaaatcaaagcaaaccaaccaatgtttccttttggttttgttcggtataatatcaacgtctctttcgtatgtcggttttcagtgtttcctttttttaagtcccgctcctgtataaagcagaccaacatattgagcttgcgtttatatatactacaagtaaccctagagtactttcatctcttttttatcaacaaccacctgagagaatgctaatccccaaattcatctcttcttccgtaagattgatcggagtggaagataatgttaaaccttatcactcttcatgatcgtaagattaacctgttttcggaaaaatctattaatccatttcattgttcatttttatggtcaaccaaattataatctagtttcatgctaaaatttcgtatagagattatcatttctaaagaatgaaagttacataatattcaacatatgaataatatatttacaaaaatttacgagtgaaacgataaatacattacttcggaaaggaaaaaagaattacagaatgtatggacaaattggccatttcgtttggttacttgtggaataggataacgggaggaggcagctttacgtggtccatctagcaccgtctgattgcagtcaggttaagaaagtgtgcggctccgattcgttggaatacccattttacgtgggacccatttaagacaaatggtcccgcatctttgtttcttctttccacttgtgacccctgccattgccaacattactggacgacaaaatcgcctgctctcattttcttcatacataaaaaaaacctttatttattttattatgataaaatttgattttgcttacaaaaacgtgtatgttaagagtccttaatgttcattgtgattaaaaaaaattaatgatcaaagaacgtgtgattgtttgaactaattatagcttgcttttatatggaaacatacaaaaatatctggaccaacaagctcgtgcttcaaacaaaatacacatttttgagccatataatacctaataacgtgatttcttagactcttttaactgggcagttaagttaccatttctgcatttacttttttaaaaaactggttctgacgcagagagcatgaatttgtgatagaagtagaaaggggcacaaatagaataatccaaaaagcagcgaacaacaagcctataaataagacaatcacttaggcccattaacgactttagaggccctaaaaggtaagaaatcaaggtgaaacaaggaaggaaatttcgatcaagacaaaaatacgaaaacacccatgtaaagagaagataattacaggaaactgccatgaacgtccataaaaagccattctagccatctgactattgaatctccgcccttccttccttatcactctctcaaaccttttttttaacacactctctgtgtctctctctcacaccgtttctccagtttcagcttttcttcgaaccactaaacaaactctcttataaactctttctcatcccttattctctttttagaattttcatatatttttcttctgttagctcccgctattcctctcactcggtaattattgaaaaaaatttgaatatctgttttccaagttcgtgttatatatatgtttcagtaaaccattttgttttggataagattttgaacgtttatatcgtatactttagttttagttttatgggttctttatgaggtttgagtcctacaaaattatacatttgaatgcatatttgacaatgagattattgcaattaaccaagttgaatttgttttcagatattatttgtttatttcaataaaagaaaagaaaaaaagctctagaagaaatg

SEQ ID NO: 36627 - DNA, 3003 bp, Unknown
  misc_feature (1)..( 3003): 2750-1469P.txt file - cDNA_ID_3098604; gDNA_ID_2936563; Annot_ID_194522
taacaagatcgtgagatctaaaggtcgtcgtgatgatttagtaataagataaaaaagtcgtagcaacgtttttttggtttaaaatgtaaaaagaagaccgtgatgcattgtttgtaatgtatacatgaataaaataagtacttatttaacaacgtagtgtattagattatctttcgtcatgtatttgcatgtatattttcccccatgtggaatgtttcagtttgtgttatctcaagagcgaaaatgtgccaccaattgtggggaaattattgggcatcattaattaactactagtagtatataaaacgagcttttcacttttcacaaaataattatagttaaaataagcaaattatttcatgacgtaaaaaaagaaagaaaaagaagctaccacaccacttgcatatttcttaagtgtctgttatccaccgaatctaaaatgtcgcttttgcattcccacaatcttattagatatttgtattcccagagtaaaagtataattcaaacatttattattattattataggaattgaaagaaaattaaattttcaaaaagaccgcttacttgtttattatatacacagagaagagaacagtctcactcgccactttcctcgagaaaacgaaaaaaaaagatggtaggaagaagaaaagctttactcttttctctctgtttcttcttcctctctcttccttccttctcttcccttccatccttccaaaccctattccccaattctcattcccttccttgtgcttctcccgtctcattccaacccgactccgactccgagtcactgctagaatccgaatttgaatccggatccgactccgagtcttcttcttccattactctaaacctcgaccacatcgatgctctctcctccaacaaaacacccgacgagctattcagctcccgtctccaacgtgactcccggcgcgtgaaatctatcgccacactcgccgctcaaatccccggaagaaacgtgactcacgcgccacgacccggtggattcagcagctcagtcgtctctggtctctctcaaggaagcggtgaatacttcacgcgcctcggtgtcggcactccggcgagatatgtttacatggtgctcgacaccggcagcgacatcgtctggctacaatgcgctccttgtcggagatgctactctcaatccgacccgatattcgacccgagaaaatccaagacctatgccacaatcccctgttcttcacctcactgccgccgattagactccgccggatgcaacacccgtcgtaagacttgtctctaccaagtctcttacggagatggttctttcaccgtcggcgatttctccaccgaaacgctaactttccggcgaaatcgcgttaaaggcgttgctctcggatgtggccacgacaacgaaggtctcttcgtcggagccgccggtttattaggactcggtaaaggtaaattatcgttccccggtcaaaccggtcaccggtttaatcagaaattctcttactgtttagtcgacagatccgcttcttcgaaaccttcctcggtcgtcttcggaaacgccgccgtatcacgaatcgcgagattcacgccacttttgtcaaacccaaaactcgacactttctactacgtcgggcttctgggaattagcgtcggagggacacgtgtccccggcgtaacggcttctctttttaaacttgaccagatcggtaacggtggagttattatcgattcgggtacgtctgtgacccggttgatccgaccagcttatattgctatgagagacgcgttccgggtcggagctaagacattgaaaagagctccggatttctcactcttcgacacgtgtttcgatctctccaatatgaacgaggttaaagtaccgacggtggttttacatttccgtggagctgacgtatcacttccggcgacgaattacctgatccctgtggataccaacggcaagttctgttttgcgtttgccggtacgatgggcggactatccataattgggaatatccagcaacagggtttccgggttgtatacgacttagcgagttcccgggtcgggtttgctccaggaggatgcgcttaataattagatctgaccggagccggtacggataatgtacttttgttttctcaatttaatgcttagacttgttttttttttttttataaatcggacaagtgaatctttaagcggtggagttgaatacgtgttgataaaatcttcacgtgttgtcggctgtattattagtatcgtctttattttacatctcggaccaaagagagcgtgtatgattttctaaaaaattggcaattttacttttagttatccaacaaatgacaactgcggaaattagttagatcaaagattattcaatataatttccaagtcagacaaatctgattatctgaggatggtagagtacgtctataatagtataaattaagatagattttggtaaattactgtttacgtaatacatagggcagatgaaaaattgtgttggagttgttaatcagacaaaaacgaagattcagcgcgaagatagagacagtgctcctattacatactcctgcatgcactgattacttcatttttttccttgtttattttcaagcactttattggtttaataatctactttatcacctaattacattgaatacgtgttaacttgagcttagagtcttcatatgttacttagttcattcgttatgagtttaaaaccctctcactcaacctgtactatgttttgcatagttggctaaacatgagatatcttagcagaaactgagaacacttgtcaagttcaacatttgcggatatacaagtaacgaaaaacaacacttgaaatttaatgaaaagatgttagaaagtataaaacattaatgaatataacatcttaacgtaacacacctatattttccattactttatataaccctcaataaaatagtttataaatctacacacaaaacctcatcaaaaaccatg

SEQ ID NO: 36628 - DNA, 3003 bp, Unknown
  misc_feature (1)..( 3003): 2750-1469P.txt file - cDNA_ID_3098613; gDNA_ID_2936563; Annot_ID_194520
aagctgatatcggccttgtctagagagcaaacaaattcagttcagtcaagaacatcatcaggtagatagccttttgagagacagaagaaggtggaagtaagtttgtaatcaagaaccggttttgaatggttctttttttcttctaggtatcttttgtttttacctttttttggttatatacctgtaagaatcctccaaactaggattttagaagttttattgacaaaagtagacattatcatttactcgttttacagtggacaaagctgggaattaagtaattaacgataatgttgtatctgttaaagtcgtagactagctcatgaatcagtctttattcattctgatatgtcctatgtgttggatttggtgaagtgtttaatcgacaagtcagataagtgttatggattggtcacggaattgctcaagaacaacaaaacacagctgattcattgcttgtgaacaagaggaaacactatgatgttcgtgcacaccatttttagtgttcaaactaacataaaccgttatcgcctggggaaaacaaaagttttaagaagagaaacaggtggaaaatgtaacaaaaataaaaataggttccaccgagacttgaactcgggttactagattcagagtctagtgtcctaaccgctagaccatggaaccgcttgatgtttagattgcagtaaatacgtttttaatatgtttctctattgtgagtcaaagggtaatgcgatgtttctttctagatttcctaagctaactcagtcctaataaaccgattaaaaagaacatgaacaaagcatgcagatcataaaagtgtcacacaaagagagagatacatgttagattgtttttttttcttctcttaaatgataattaatcgttctaacaaaaacttagctactagtcttccatgatttgttatatattgagacaacaaagaccatacggtataatcaaaagacttgttgaatatagaatataagattagatgattttggtgctagcctccctcttcgctgttctcattcttaatgttcttctatggagatggctcaaggcttcagcatgtaaagcccaaaggcttcctccaggtccaccaagattgcctattttgggtaaccttcttcaattggggcctttacctcatcgggacttggcttctctatgtgataagtacggcccacttgtctacctccggcttggaaatgtagatgctatcacaacgaacgatcccgataccatccgtgagattcttttgcggcaggacgatgttttttcatcgagacccaaaacactcgccgcagtccacctagcgtatggatgtggggacgttgcattagcgccaatgggcccgcattggaaaagaatgaggaggatatgcatggaacacctacttacaaccaaaaggcttgaatcttttacaacccaacgggctgaggaagctcggtatctaatacgagatgtcttcaaacggtccgaaaccggaaagccgataaatcttaaggaagtattgggtgctttctctatgaacaatgtgactaggatgctactagggaaacaattctttgggcctggatctctagttagcccaaaagaagcccaagagtttttgcacataactcacaaattgttttggctgttgggtgtaatttacctaggagattacttgccattttggagatgggtggatccgtccggatgcgagaaagaaatgagggacgtggagaagcgtgttgacgagtttcacactaagatcatcgacgagcacagaagggcaaaactggaagatgaagataaaaacggagacatggattttgttgacgttttgttgtctctacctggtgagaacgggaaggcacacatggaagacgttgaaattaaagctctaattcaggtattataaattcgcgttacgttcataataaatgcatcaaaaaatatttgacaaaataatgtattcgttgtaaatttgaataggacatgatagctgctgcgacagatacgtcagcagtcacaaacgaatgggcaatggctgaagcgatcaagcaaccgcgagtgatgcgtaaaattcaagaagaactcgataatgtcgtaggatcaaatcgaatggtcgacgaatcggatctagtccatttaaactatctacgttgtgtggtacgagagacgttccgaatgcatccagccggaccattcttgatccctcacgaatccgtccgagcaacaacgatcaacggctactacatcccggcaaagacacgtgtcttcatcaatacacatggattgggccgaaacactaagatatgggacgacgtggaagacttcaggccagaacgacactggcccgttgaaggtagcggacgcgttgagataagtcatggaccggattttaagatattgccgtttagtgccggcaagaggaaatgtcccggagctccgttaggtgtgacgatggtgctaatggctttggctcggctcttccattgctttgaatggtcttcaccgggaaatattgatacggtggaagtttatggcatgactatgcctaaggctaaaccattacgggcaatcgctaagccacgattggcagctcatttgtacacataactttggtttaaattgaataataaaagcatctacattggacatattaatggggtgtcttctaccataataaaatattaagaaaattaaaatatgacaatgtctttaaactagagacattcaatgaaaatgtctatgagaagacattatagtgaagtagattttctatttaaagacaacctcatattttaataattatattttagtttttttaataatttcttacgtgggaagacatccaatataattgtgcaatgtggatggcctaagaattcttaaagttcggttcgaccggctaagacaaatttcggttattgatttgttagttttcttttaccggtttagcagaaccctacatacttgggttctgttcttgatctcttgtggtgaaataaaatg

SEQ ID NO: 36629 - DNA, 3003 bp, Unknown
  misc_feature (1)..( 3003): 2750-1469P.txt file - cDNA_ID_3098618; gDNA_ID_2936563; Annot_ID_194519
aaatctcggtggaagagacttgattcaaatcttctttactggtaaaaatatattcttctcaattcctcattttctgttggtggagtttgatttttgtcatttaattgttgttaaagaaaataggggcaagatctgagatctctgggtgttccatgcaaaactgttatactccgccgtatatttgcatctgggtcacacttctaaaccctatcatttgacttaagaatcgatttctgaagatctgggtttcttaaaagtctttcctttttgttgggatccaaacaacaaaagaaaagaaagcagagatgaatattggtcgcctagtgtggaacgaggacgataaagcgattgttgcgtcattactgggcaaacgagctctcgattacttgctttccaactctgtttccaatgctaatctcttgatgactctaggaagcgacgagaatctgcagaacaagctctcggatctcgtcgagagacccaacgcttctaatttctcttggaactacgccattttctggcagatttccaggtcaaaggccggagatttggttctctgttggggcgatggatattgcagagagcctaaagaaggagagaaatcagagatcgttaggattctaagtatgggaagagaagaagaaacgcatcagactatgagaaagagagtattgcaaaagcttcatgatttgtttggtggctcagaagaagagaactgtgctttaggactagatagagttactgacactgagatgtttcttctttcttctatgtatttctcattccctcgaggtgaaggtggtccaggcaagtgttttgcctctgctaaacctgtttggttatccgatgtcgtcaattcgggttctgattattgcgttagatcgtttcttgctaaatctgctggcattcagactgttgttttggttcctactgatcttggtgttgttgagttaggctcaacttcatgtttgcctgaaagtgaagactcaatcttgtctataagatcattgtttaccagtagtttgcctccggttagagctgttgctttacctgttactgtagctgaaaagattgatgataacagaacgaagatattcggcaaggatttgcacaattcagggtttcttcaacatcatcagcatcaccaacaacaacaacaacaaccaccgcaacagcaacagcatagacagtttagagagaaactcacggttagaaaaatggatgatagagctcccaagagattagatgcttatccgaataatgggaacaggtttatgttttcgaacccaggcaccaacaacaacactcttctgagtcctacttgggttcaacctgagaactacacgaggccaatcaacgtgaaggaagttccaagcacggatgagttcaagtttttacctttgcagcaatcatcgcagaggctgcttcctcctgctcaaatgcagatagatttctctgctgcgagttcaagggcttcagagaataattcagatggagaaggaggaggggaatgggcagatgcagtgggtgctgatgaatctggtaacaacagaccaagaaaacgcggaaggagacctgccaacggaagagcggaagctttgaaccatgtagaagcagagaggcagaggcgtgagaagcttaaccagaggttttacgctctgagatccgttgttcccaacatatccaagatggacaaagcgtccttgttgggagacgcggtttcttatataaacgagcttcacgcgaagctaaaggtcatggaagcagagagagagaggttagggtatagctcaaatccacctatcagcttggattcagatataaatgttcaaacctcaggtgaagatgtcacagtgaggataaactgtccgttggagtctcatccggcttccagaatcttccatgcgtttgaagagagtaaagtagaagtgataaactcgaacctggaagtttctcaggacacagtgttgcatacgtttgtagtcaaatctgaagaattaacgaaagagaagctgatatcggccttgtctagagagcaaacaaattcagttcagtcaagaacatcatcaggtagatagccttttgagagacagaagaaggtggaagtaagtttgtaatcaagaaccggttttgaatggttctttttttcttctaggtatcttttgtttttacctttttttggttatatacctgtaagaatcctccaaactaggattttagaagttttattgacaaaagtagacattatcatttactcgttttacagtggacaaagctgggaattaagtaattaacgataatgttgtatctgttaaagtcgtagactagctcatgaatcagtctttattcattctgatatgtcctatgtgttggatttggtgaagtgtttaatcgacaagtcagataagtgttatggattggtcacggaattgctcaagaacaacaaaacacagctgattcattgcttgtgaacaagaggaaacactatgatgttcgtgcacaccatttttagtgttcaaactaacataaaccgttatcgcctggggaaaacaaaagttttaagaagagaaacaggtggaaaatgtaacaaaaataaaaataggttccaccgagacttgaactcgggttactagattcagagtctagtgtcctaaccgctagaccatggaaccgcttgatgtttagattgcagtaaatacgtttttaatatgtttctctattgtgagtcaaagggtaatgcgatgtttctttctagatttcctaagctaactcagtcctaataaaccgattaaaaagaacatgaacaaagcatgcagatcataaaagtgtcacacaaagagagagatacatgttagattgtttttttttcttctcttaaatgataattaatcgttctaacaaaaacttagctactagtcttccatgatttgttatatattgagacaacaaagaccatacggtataatcaaaagacttgttgaatatagaatataagattagatg

SEQ ID NO: 36630 - DNA, 3003 bp, Unknown
  misc_feature (1)..( 3003): 2750-1469P.txt file - cDNA_ID_3098622; gDNA_ID_2936563; Annot_ID_194518
agctaaagttatcattcttaaggaaagaaaaatttaaggtatcacaagaaaattcacgtcttcgtacggtgatttgtaatcccttaagcaaaagggcagttgataaatatcacctgaagtctatggtttccacattttaacccatcacgtcactacatattaacaaggaaccattgaaatttacttcaagtaattaatactaatatcgcaatcaatttttttattgaaaaaattggggaaatagatagcaagaggagttacgaaactcactttcttcttacatcagatgagaccatacacggctttactatcagttttgtctccgggtgctttcgtgtaaacaattttaacacttgttcgtttttaaaacagtaagtaactgaaaatatatatgtatatgtgtgtgacgtatatatgtatatatatatttctttttttattgagcttcgagatttgtttttttgttcatacgatgagctttaagttttggtcggttcttttttccttttcgtgagttgttggtagattaaagtagtcatcttatgatttgtgttttttttggttgttaccaaaaaggtgacgattttgttgacgttaaacacggaattcattgtaacatgaatatatcaactataaacgccaaaatgggattttcttttttttataaggtaacaaaattaaggaaaaactattgttacaacttcaacttgcaagtatgtttctgaagctagagtttacagtcacgtgtgaaaatcaaaccaatttggatcattattgaagataaatgaatacttgatatattgttagtacaaatttaaacaaagcgataggtttagtggcattcagaataagttcaccaagaaccggcactactttatccgggattaaatcaactcttacaatagagttaactggactaataggccgatttgttgtggtaaaacaaaaccaatgaaatatatgataagattgagatttaagaattcaagactgagtccgttgaacagcccattctaattctgattgctagataagggatagatggggggcattattaaggtttgggaaaaaggctgatatcacgtttgacctagcacatatgtggcccaacattacaagaattccatagaaaaccagtattgtaatatcggcccatattatattcttgacgacttggagatattgtaagtcgacgtcgttgtttgacttagatgggaatgggacccaaacgtctcgaataaaggatagtttaaacacgtgaatcacgcggtccccactttttgctgtgtgtttctcaccgccatacatatattatacccactcgtgacttcattttccataattactatatatactaattttttgttttaactttatcgtttgttaaagatttttccaaaataatatagtcattgtatattcattttcgcagagccgtagtttatattttgatgataattttatgacttaaagagtgaaagctataaatatattacaattcaattgtggttgcgagagaataaacaaaaagagaaagagaaaaaaaaaacgttacagaagagaaagtgcagagctgtgcaggcgcatttgaaaatgaaattaaaaagaaaaagagatccaaagaaaattaaatgcatctcacgttcttctcattctggtcatctctcctaaatccacgtgaacttcacgtgcttttcacgccctcctctctatcgacttggcgtttcctttcttctaaaggagttgaattgttttgtcaacatttatcaagttatttagtaatttgtttttttgttttgtttttaaaaaaattatttactcccgttgtagaaccaccatcaataatattaccaaaaataataatcaaggatctaaactaaaataagccttttattttgtataattctgaaagcatttgaaacttaaggaacaactctttagtctttgcaacaaaacaaaacacaacaaaaaccgaatatttaagcctaacttgaatgtgaattgatttggtcaaaattcccggtgcttgaccaccggtcttagttggcatactttgcaattatgtaaacaaaaattttaaaaattgaaagcaaacttctaaatttgggtttggtttcccctttagttatttccatgaacatgagaatctaatctcgagttgtcagatagtatttgtttagatctacaccagttgagatagatctgttgcaaatttttaattaatcaaaacccataattgaaaattatgtcaatcaattattgacaaaaaccatgacataatctaaggggttttcaatcgtcgtgtatcaaagactcgagacaaagactaaatcgaaccagacccggtttaagtttctaaactcaattgtgtagttaagtagctaaccatggttcagatgaaagtctttttgttttgttttttgttttgtttgttggggtttggtcttttaataaaaaagagcacgaagaacatgcgtcggactctctctcttccttgaattcattcaattggccacggcgacaaaacagggagccgatacagcgaaactgatacatctttttttattttctggattcttagggttctttttcggggaatttaggtaatttgtttgtccattttggtggggtttgggagatttaaaatttgtgtttttttttgggtcggattctcaaaaatctgattttgaggagaaaatctcggtggaagagacttgattcaaatcttctttactggtaaaaatatattcttctcaattcctcattttctgttggtggagtttgatttttgtcatttaattgttgttaaagaaaataggggcaagatctgagatctctgggtgttccatgcaaaactgttatactccgccgtatatttgcatctgggtcacacttctaaaccctatcatttgacttaagaatcgatttctgaagatctgggtttcttaaaagtctttcctttttgttgggatccaaacaacaaaagaaaagaaagcagagatg

SEQ ID NO: 36631 - DNA, 3003 bp, Unknown; identical to SEQ ID NO: 26735
  misc_feature (1)..( 3003): 2750-1469P.txt file - cDNA_ID_3098651; gDNA_ID_2936563; Annot_ID_194508

SEQ ID NO: 36632 - DNA, 3000 bp, Unknown; identical to SEQ ID NO: 10477
  misc_feature (1)..( 3000): 2750-1469P.txt file - cDNA_ID_3098656; gDNA_ID_2936563; Annot_ID_194507

SEQ ID NO: 36633 - DNA, 3000 bp, Unknown; identical to SEQ ID NO: 10477
  misc_feature (1)..( 3000): 2750-1469P.txt file - cDNA_ID_3098656; gDNA_ID_2213653; Annot_ID_181661

SEQ ID NO: 36634 - DNA, 3000 bp, Unknown; identical to SEQ ID NO: 10480
  misc_feature (1)..( 3000): 2750-1469P.txt file - cDNA_ID_3098661; gDNA_ID_2936563; Annot_ID_194504

SEQ ID NO: 36635 - DNA, 3000 bp, Unknown; identical to SEQ ID NO: 10480
  misc_feature (1)..( 3000): 2750-1469P.txt file - cDNA_ID_3098661; gDNA_ID_2213653; Annot_ID_181658

SEQ ID NO: 36636 - DNA, 3000 bp, Unknown
  misc_feature (1)..( 3000): 2750-1469P.txt file - cDNA_ID_3098717; gDNA_ID_2936564; Annot_ID_194570
tatgtttatgtcgaaatggtcgattatagatatacatttgtcaagacaatataattatacatttgagaggaaatcgatcacttactagagtttatacaaagaatcgattagtgggggtttttgagtgcaaaattatagttattcgtataaaagtattattgtgctttcttcttgacattgtagggaggtgatcacagacatatcattcaaaaaataacaagaagaaaactcggatttctatagtctttgatattagtcgcgtttatgcataaattttttgattatcacaaaaaaaattacggaaaataatggaaatttatataccatgtatatggtcatggaccggaaaaaaaaaggaggggagaaggaaagtttagaataaaaacagttaattaacggacaaactactttgtacgtttgaagaataatgtcgctgtctacgtatttatatcatgattacatccactacgaaaattctaatctttatacatgaattggtgaatatgttgtatatacatgtttttgatgattctagccgacattaaaggattttttaataaaaaaaatagagaattaagacagctcgttagaagcaataagaaccaatggatcatttccggagcccgcccaactttttcctatccggcttcaacatccacaagaaatatattcaactacaatacaacaaagtgtcacgagatttgtctatttccaatcttttgcttctcaattatttatttcactttgctatataatctataaaactatgaaaacgctttacattatttcataaaattatgtttttcttttctatctcatgcgtcggcatagttagtgttacaaaaagtacaattttaagcaattttaagaagaaaaaagagggtggaaagctatacaaatcatttgtgttactgttttggattagaatcgatcaatcgctgtcgtcacaagatcagtcatttgatctttctaggtttgatcttgaatagaattgaaaattctatatatcgatacatgatttatgagtttgtcaaggcatctttaaataaatattcgacgagtttataatcaatatatgtatatgtaaatggagctgaagaccttgcaccaataatttgttttcagaagacattacgaaataaacaaaataaatttttctttactataataatttttaaatgaatttaaatatgaaatattaatatcatttatataactattcatctagatatatttcaatccgaatattagaatttcagtatttaaccagaaaacaaacaaaaataagaatgatatatttattgttgacactaacaactttaaacatgcgtggcctacaaaatttaagtcggccatgtaaataaacatgatcggtgacgtcatcgtgttctgaacaatagaagtacgacgaagaaagaggatgaacaaagcgacatttaacagtggcgcacacacgcatcaagaatctaaacgcaagagatttcaaatcaatctttcaacattatatttcgtgttctaatcatttcgtacatgtaataatatctattggtttcttaatatcccttatcgttagcatcataatttataggtcgtcaacaatatcatgaactattaaaatattatgttaaacaaaataagaaaataaaattaagaaggcgtgtttttgagaaatgaaaaatggttcttacctaaaagtttttagattaattctctctttataaaaacctttctaatatttaaatattattttgtctatcaaaattgtttaaaattttatgtaagagaccgttaataaagatggtctatatcaaaattaggattaccatataagttaacgtagcaaaatgtcagacaaacaaaaagttgacgtcgcggtatttttgcatggggatcggaaacgagtaaacaagggttactaatgaaccttgtattgactttgcttaattagcttggagactaagaggactttgtaactagcgtcaataagatgctgataaatttggattttataacataggaaacatgagatttcttggaacatatgcgagaggcgagataatagtgccaaatataacgatatatacctaccgtggtaatgtgtctctctcttccaccatttataaatatcataaatctcatatattactcaaaaacaaatcccgtcaaaactaaacacaacttagataaacatttagtaaataacaaactctaattaatttaatgtcaaaaataataattaagatcactcaaatattttttctgaatattaagaggtcatggattaaattccgtaattttttcagacccgaaaccacatgacataatattaatttagtctcaaacactcttattgtatgttgaaagttaacataagataaaatgaataaaatctcaaatctgattacttaaatacatctattaaaaaaaattttaggtatttgaattatgtttgaaaattaaatatgattaagtcatagttcaccatataatctatactagtactatagattgatgtataaaagaacaaaaagtcaagaattttctcgatacacaagaaggtaattaagatgaaaatctgcaaaaccttaaaaagatttgttttattatgttttttgcactgattttcaaaaatgttatcacttgaccattcagaattcatataagcatatcaatccaaacattagtcaaattttcgacatagatgaaaaacattataagtttctatcttttaaaaaaatcaaatggagaaaaagacaagtcgtaaaaacattagaatatttgtaaaaccaagaagtctcttaaaaagcctcatgcccaaaacacacacatagatagaactccataaccaacagaaaataaacacgtgtcgtctccacaaacttcaaactctattgtctctctgttcttcttgtttgctataaaacacactcaaaactcctctaactctctcaaaattctctttctctttctccatttctctcttctcaaagctaaacaatg

SEQ ID NO: 36637 - DNA, 3003 bp, Unknown
  misc_feature (1)..( 3003): 2750-1469P.txt file - cDNA_ID_3098721; gDNA_ID_2936564; Annot_ID_194569
ttgcaccaatgaatggaggatatgcagaagaccatgaagggcttataactttgttcagtgctcctgatcatcctcagtttcaggtatgctctattggatatttgtattggctatcttcacttccacctgttgtagtaagctcttgcggttcaacaaaaatggttactcgctggcaggatttcttatatcttgtagatgttgtaacttgtgtttgagcctcaacacaaacctgagtacctgttgtctcgtatgcaggatacagaggagagacacaacaacaaagcagcctacataatattacaaatccctgaatgtgaggagcttaaatttcaaccgcttgaagcagtatctccgaggccaaaggtagtactacaatttaattacgagagtcctaattttaatatcttttagtttattcttaatatgttctgacatctgcaggctgaggcgtactacgactttagacgcctgattcatccacccagtaatttagtacacaatattacgaattctgttgattcaccatcctcagtgcctgatgacaaagataatttaatatcttctgaaaatgtggaatataagtccatggatctctctgaacagatggaagttgatgaaaaagatgatgttgattccaagtactcagaatctataactgatgaagttgcagcttttggaactccagcatctggtgatagagatatggttgatttttcagataagactgaaaatggttctaaagaagctgaccattccgaaactgcagagattagtaaagatttatctgatacagttggaaaaccggagtcttgcagcagaacaagaggtacatatgaagctatcggaactgatgcaaagctaaaatctaacactcctgaagctattaatctggaaccgcagccaggttgtgatctgtatgtgcctgattctggaaattctacagaatctaggaccgaaaaagctgcagaagaggcttgtgttggcagaataagcatagatgactgtagcaccactggtgatgctgcagtggaattagaaattacatatgatgagaaactggatagagtggtaactgaaatcacagggaacgatgcagctgaatgtatgacagacggtaatagagacatagccaccgatggtgctgagaacttggaaccttcgactagcaaacttaattattcagagcccagtgaagatattgatgattctaccatgaagttcagacataatactagctgcgttgctgattctgatcttgagactgtgaatggtggggttaatgcagactgtagcagttcatcgaaatgtctaaccagcaagccagtggtggctcatgacaagtttacaaatcttacaaaaccttctcatgataaaggttatggagagtctgcagataagccagagagagtaattaaactggttacatattctaagcgtaagtcatctgacaaaaaacacatgattgaatctaatgaagatccccaacagaaggtcaatgattctgtcgattcaaagaacaaaggttctcttgacaagtcacaatcagttccaggagatatggactcatgaaatcttgttccactgtcttctttccggctgaggtaattataatctctcttctgaacacggtgtctaggcaagcctcactatctgtttataacacggtgttaatgactgtttttcaactttggtggttctgtggttagttaattctggttttacgagttctgcaacatttcatttcaaaaacacgcatcttcttgccatgaacaagacttactattacatatgattgatacacagatcccagctcttttatctcacacgtctgagtgatctcttaattgattttgcagatgatgatgaacagctacatggctttggatgtgtccttaaagacaatgtacagtggacagtggtcataatagtctagctggttcaaatccaaccggatccggtttgctaatttaagcttagatcagtagggagatggtgtaaacattattccccttctcttgaattttacttttctcaatcaaagtttatgtagtttagtggtacttttgtaaaaaagaattgaaagtattaagaattacagtgtgtttgtctttcatcattgaaaaataaaatttgtaaacggtaaacaaacaaaaccataactaatccaacggagaggcaaattcgtgggttgggtcaaaacgaaaagggtataatcgactttgccacacgataagtcaataactagattcactcgttgaaaacgcagcgtttttgcatcctaagctaaagaagaatctgcctttgcgcgtcttcaggttttcttcattttttttattttgtcgaatctctctctctctcttcaacccctcttctcaatctagggttagggtttcgattctgctagaggttttttttctcccaacttatacttctaagccctctcgtcataagccttgttgactcttcttcttaatttgaagaacttcgtaggctaagcatgtcgtgattatcccaaatttctggtaaatttgatttctgctacttctactcgtcattttattctgaattcgtctttgcgttcgaattatttcaagcaattagcttcatcttcgtgtgaaatttcaatgttttaggatttgatttggtgtcataaagaacttatttttctcgtgattttgcatcttcttttaagtttttctgggctggtttcatggctcctttatcgtttcacgtgaatttcagtgtcgattcgattgggattttgagaatagttggggacgtttctgtattgcaaaagaatctgtgaatcttttttattcttctgatataattttccaaggagattaatcgttgtatcctactgctgtagcttatttgtttaagtttgatattatttcttcaaaacaatcttcacaaatttctcatgttcgttcttatgttaatttcaggtgtttattcaaactccattgttacaaagattttctttgataagttaaagcaatg

SEQ ID NO: 36638 - DNA, 3000 bp, Unknown
  misc_feature (1)..( 3000): 2750-1469P.txt file - cDNA_ID_3098735; gDNA_ID_2936564; Annot_ID_194566
acaacgccacgctatactcttttgcatgcacctcaatttgaacatcatcaagtctctctctctctttttctgactttgatccacgaacctaaccagcttgcgatctctatttaatcggtcctcgacgcaacttcaacttctactacatccattcacatcaaatcaatacagaaagttttttctatatataaatataaaaggtaaaatgccagggatcacactaggagacacggtgccgaacctagaagtggagacgacacatgacaagttcaaacttcatgactacttcgccaattcttggaccgtcctcttctctcatcccggtatatatgttaatatatagatcttgagttcttgacttctgttgcaattccttttttgttttcttgatttttgttgacggtcacacaggggatttcacacccgtgtgcaccacggagcttggtgcgatggccaaatacgctcatgagttcgataagagaggcgtgaagctccttggtctgtcttgtgacgatgtacagtcacacaaagactggatcaaagatattgaagcctttaatgtataatttaaatctcatgcatgcatataccagactagctagagatcatattttggttttgattaatttgttacatatgtatgatatagcacggaagcaaggtgaattacccgataatcgctgacccgaacaaagagatcattcctcagcttaacatgattgatccaattgagaacggaccgtctcgtgcccttcatattgttggtcctgacagtaaggtaataatttcatatattattgcatgtatgattttattggttaattggatttgtgatatatagataaaattgagcttcttgtatccgtcgaccacgggacgtaacatggacgaagtattgagggctttagactcgttgttgatggcgtccaagcacaataacaagatcgccactccggttaactggaagccagatcaaccggttgtgatttcgcctgctgtgtcggacgaggaagccaaaaagatgttcccacagggtttcaagaccgccgatcttccgtcaaagaaaggctatctgcgtcacacagaggtctcttgaaaagataataacaaaagcctactatataacgtacatgcaagtattgtatgatattaatgtttttacgtacgtgtaaacaaaaataattacgtttgtaacgtatggtgatgatgtggtgcactaggtgtaggccttgtattaataaaaagaagtttgttctatatagagtggtttagtacgacgatttatttactagtcggattggaatagagaaccgaattcttcaatccttgcttttgatcaagaattgaaaccgaatcaaatgtaaaagttgatatatttgaaaaacgtattgagcttatgaaaatgctaatactctcatctgtatggaaaagtgactttaaaaccgaacttaaaagtgacaaaaggggaatatcgcatcaaaccgaatgaaaccgatatgaaaccgcatcaaaccgatatagcgtgaaccaaaatgtggattaatgacatttagaccggaggaacataagtggggactatacggcatcgttttagtgtataagtgaattcgcatattcacgagttccccgtattcaccggttgttatatcgtcgattcatcgtcgtcgacggcgagtacttgtgacctccacacccagattaatcttctataactgattttatcgcttagacgatcacgatctcatcgattaactgtgagtataatcgattcctcctctttattttgtgtgttgtatcgatttacgataattttttggaggaacatctcctttcggatcggttttgttgggaatttatatttctttgccatggttttatcttgatttggtgatttaccttgtgtttgttctggtgtactatttagctaatttagtataagctttcagatgattctaggaaacttttgtgctactgttttcggtttttggtgatagaactatgtagttttaaggaaccatataaaaatttcgtctagaaatgtttctatggttactgatcagtcatcagtggtagcgatatgaaattggaatcctgttttttgttacacggttcgattcagatgctttcgattcaaatcctgtttaagcagctcaggttctttagaattcttgttttttaaatgcttcttgcctgaatgtaagggattttttttgctattgctttggttcctgtgattgtttttcttacctcctctgatgttacatgatcagcatttgtgaatttggattcttggaagctaacacaattcttaggattaagtttcgtatggtctgagactttgagttcttgacgtttggtctgaggaactgttggaactcattgattttgtatcggttctgtagcttcagttcggacttgatcatctcaggaattggaaattgtttttttttgatgttacaatatttcggagtcagataattttcaatttcttattttgtttatcccagtcagaggtcattgtcgaaaaagtacggattgatctggatatagcatgatggtttgagttgtataaactgggttactgagctgttcagattgtgctagattctagttttactttgatgtttggaaattatgtgcgcgtctttgtgttagtgaacattacacactgaaacatgaaaatccatttgctttgttgagactccatctagttacaactgatagctattattggtatatttcttatggtttgagcttgtgatcaattttggtggggtaaatgggatgttaatattgctcttgaggaatatatgtgttgatcatgacaactacgaaattgtgaatagttcattgatttactagattttgtttattaggctcgctgagtgatttcttttacatgctctacaacttcttggagaatgctgtgatcgtctatgcatttctattcgcagctaacttaaactcttttacataattttttactttaaaggacaaatg

SEQ ID NO: 36639 - DNA, 3003 bp, Unknown
  misc_feature (1)..( 3003): 2750-1469P.txt file - cDNA_ID_3098738; gDNA_ID_2936564; Annot_ID_194565
ttcggtttcgccctgaagcaatgaccttaccgtcctcaagaaaaacacatctggtccacacaaaccagaaagaaaacgcattagttatcctatatgacattaattgatacactggtacgaaacacaaattggtatgaagccaaagcaaaaaaatagagaccccacgggaacttcaagagcctccagagcaagtttagcctgcaggcatagggaaatcaactcaaaagcaacaaactaacttttgcagtattatagaaccaatactagttttacctgatgcagagcaaaacccatataattatgagaatcctcacaatggtcctcttccattaacttttatagttggcttggccagagaaagtaaataacaaaacctgatagcaaagattcaaaaatccctagttatatagctaagtagaggatcaggatactctttggcatatccattctaaagagaaatttctcaaagaaaactcttttttttttacttgcaatgttctcagtttatatgtgtctaccaaaactgaaactaaatagtaaaatacacgtaacagaggagtgtcaggaatacaactaatcacattatgctctcagggatgaatcagatcaaaaagaaaacaatgcttgtgaattcaacagaagagctatgaacataagagtcacaaacaccaaaaagaaaggtaatagaattggaactgtgattattctggatgaagcaaagaatcgaagtaagaaagaagagacaaaccaatgatctactcgcttactcagaccgcaacgatcaacaagcttcctcacaatcgtctctgagaataaaaaactaaaaatatcaatcctaaattttgtgaaaaacccaaaccatatgccagccaaaacgtcgtcgtttatggatataaaaagtttaaaagaaaatcatgatttattgaagagtgaagtaaaacataatttagggttttgttcaatttcggtttattcgggtccaattagtttccgtgtgtaaggccaaaccgaaccaaaccaaaaaaatcaattctttttatttacatttggtcagagagttcacaaatttaaaggttagatgccaaaacaacttctgatttttatatagacgtcaatatacacacatcatctaattcttggtggtaactctgtatcaattcaatagtacagatcatcaagtgacaaatatagagggaaagaagaatggtttcatcatatagtttgacactttggtatgtccaaaggatttgcctttttaccgaacaaaagatcaaacatgcaaatattgcatcaccataactatattccaaattaggtgaagaaatcacgccaaatcggcaagaagaataagaaaacaaacacatttgaaagtcatgaacaaggaaccaactctctctttgttttgtggtcgaagtaataaacgctttaaacatttctcatcgagcattatgcagatgaatgcagctacgaaatggggagaagatagtatcttcaagatacaatgccaagaaaacttatcgaaaaccaaaaaaaaagtgatcatttcatgccaatcgatcaagataccttagtagaatcagtcacaaatttccgtataaaaagggtaggacacaatgaaggagaaacaacctcaagaaacagctaaattgggttatgttgctcttacaggttttgacattgtgtaaccaagatcaatcagctttctaatcaacactttctcagcttttgcctacacaacaacacaaacaagaaacaaacaatgagtattatcgaataaagctagtccctttcacatttctataatacaatagctcaagtaaaaagaagaacctcaagcaagggattgtttttagggatgttgcaagccagtattatattgagaccagtcttcaacactagaacacagaaaaatacactgaatcatcaagaaagaaaaggatttgaaattgcaagaattgttataatcagagtctaacctaatctacgcgcaatgccagatccagtgttatcagatgttccaccaagtaccgatgtaacactcactgtattgctctgccatagaaacaaaaaaaaacatcaatttaaacagaaaccctaaaaattgctgctttagttagaatcaaggtttttactgagctcaccggtcgtgttgaagcggctgcgtacaaactcccaaatttggcggaattgcaaccgacccatacgtaaatctgtagttcgattaagtccaattttagttccgacgaagctcaaagacttgagaattaggttaaaaggaccaagctaagtttattggcgggaacctgtttcgcgagacggatgatctggaactggatagtaacatcatcgaaaacttcagtgaagcacgaaacttttacgccgtttccgtctctttctacgtcgtcggattctccgatttggtcggcgatgttcacctgagcaacggatcgaagaacttggtcgtattcagtctccattgtctcccaagtccgagaaaagtcaggtcctctttggctcttcttcttcttatgaaaatcaatttcactttttcatctccggttaaatctgatttggtacggttaaatacggtttagaccggctcaagtttttagatggtataaatctcaattgcgaaattcctctttctccgtcgttgctcttctccggcgatacgagcatctctgatccgagcaatttcacttcctgaattttccgaatctgatccctggttcgtttctcttctctctgtgttaaattcagcatccattgatctttcgtggggtcaaatagtagttatctttcttcttgcgcatgtatacgatttgggttctctatgcttgagatcgaaacagatctgtataatttgttatggatttaatcgcctatttcgtggatttcaaatgttgggttcagattttgatgttgcttttatccaatcataacgttttctgttgtgatttaagagcagttggattaatctgcttcgttcttgatatgtagatg

SEQ ID NO: 36640 - DNA, 3003 bp, Unknown
  misc_feature (1)..( 3003): 2750-1469P.txt file - cDNA_ID_3098749; gDNA_ID_2936564; Annot_ID_194562
taacatcctttcatacatataaagagtaaataaaacatagatattagaatattattgaaaataaacacgagataaggaatatcagtttcaaatttatcatttgcaagttgaggatgatggttaggtaaaatggtcgaatttacaagtcggaccggatctgcaaatgccgaagcgactgtaatgcgggcaaatggcttgaccaggtcttaatggtaagcccttgtcattgagagtacattgaggctcgctcggcgttatattcttcgggtgatggtatttgcagttttgtttcagataacagtttccagttctaagataatagctgcactctggttcgcctggacgttctgggaatttttcttcagacatattttctcttctcctagtattatattgtttgcatgtacttgtatatctcttctacctataatctatatatattaccagaagaaaatctagcattgaatactaaaatgacatgttttgaagaaagatagtatcatctttaatatttattgttttagttataattgtatttaaacaaaattataatatcatgatgctatatttatattttttcatttaattattacttaattaatatttagtggattttattttgctaatattttagataaatacattttaatcatataaatcttcttaacataaactacatgtgacataagtcgttttcttaaaattagattattattattttgacagcaaaaactccacctttttttttgaatatttaaaaaaactccacctttattaagcatgttcctaaaattaaaatataaaagtaatgaatacaaaagttaaatatgaaaatcactaataatgtaatcggaggccggatcgatctggtgacccaatcacaaaacttgtgaaccattattcgatcaatcaatgtaccgtgtgagccaaggctctttatttctaacctaagaattttcagatttaggttttgaggcctattaagattaaatgaacggtattttggtaaatgataactatatctaaattgatcgatccctagacaactctctcaagaagaagtagaagaaatcaaaagtttgatcaaaccctatgatagaaaatgacgacgacaacgcaactggcacttccctatgatttgctattgggctgcattgcacacgtcttctagattgtactatcctaatctttccttagtctccaagagctttcgatctctcgtaacttcaccggagctttacaagacccgctctctcctaggccacgccgagagctgtctctatttgtgcttacggttccctcctgacactaatctaaccctcgttggtacactctctgccaaatacctaaccgaatgaagaagaataattcaagtggcaaaatttacgtcccaatcctaatccaaccatctcccacttctcctcctccacaatcgcattcctcgaatcatatggttaccgttgtaagatgtacaaaattggcggggatgtgccttcttcttctagagtctctgtcttggattggaagtctcacacatagaaccaaactttaagcatgcgggtggaccggagctcctcttcctccactgtaagtctacttgaggggaagatatatgtagcaggaggttgtgaagatcgcaattctgtggactgggtttaagggtttgatccaaagactcacacttggagctctgtgactagccctagcgcggtgatacggaatgaaagtgtagctgaacacaaaagcttgggacttggtggaaaattctacctctttggttatgactcagataagtctgcggtggtttacaatcccaaagaaggtagatggaacccggtaggattatatattaatataagtaatgaagtgtactatagttgttttgttgtgtgatagacaacgtcttgttctataggtttcacggactcttccattggtatgactataagggaaacttttggaagcaagtgaatggtcttgggccaggtaaagatgaagaccaatactaaagcgacgtcatctaaggcacaacggtcatcttcaaaaaagttggaagaaaacgacgaaacaaaaacatagcaaggaggtgatgaaagttgcttgtacggagaaagtagcgattctcgcagccctcgatacgtttgacaacgcaagatgatgacatctgtcctctctctagggttttttcgattaacccattctcttgtctataaatactacaatgttctaccgattccttttagcttcctttgcgttactactctgcttcctctgcttgtgagtttccctttgtaagtgcgattagtgttacattttaggtttttttctctaagttaggattttgttttgctttgttacggtttttgcctttcagtgtgtgattagtgaacaaatgaggagcttttagtcacgtattagggtttgttacggatttttgcttgtgcattttgctttttcagtgatcaatgaggagcttttagttaggttttagcgtttaatacatcctcctttagttttctcattatttggtaaagaagctatcacattggttctcgatctagccacatttctttttgtcattaaaatatcttcttttgctatttcttcgataaaaatgtcgtcttttttagggttctttgttctaagttgttgggatttgtttagctcttgctttggtatgttacgggttttgcttgtgcattgccttttatttttagtgtgattagtgaacggtgaggagcttcttcgttaggttttagagtttaatcctcctttactgtagtttgctcattctttagtatataagctatcacattggttctcgaatttgccacaaacgtctcatcgatctgtttttacttgcctctgaacaataaactctttgttcaaaccgcttcactttggatcccttcttagttaatgttctttccattttctctgttcacatttcattaatgtattttattgaccttggaaattttcagggttaagtaattgcagatg

SEQ ID NO: 36641 - DNA, 3000 bp, Unknown
  misc_feature (1)..( 3000): 2750-1469P.txt file - cDNA_ID_3098756; gDNA_ID_2936564; Annot_ID_194558
tttgcagatccggtccgacttgtaaattcgaccattttacctaaccatcatcctcaacttgcaaatgataaatttgaaactgatattccttatctcgtgtttattttcaataatattctaatatctatgttttatttactctttatatgtatgaaaggatgttattaatctaaggatcaagttaatcaccatggtatcaaattttcatttcatgtaacaaaattggatttttcttttcaagtttacccaacaaacaaggctttgtcgtctccaaattttggactaatggtacatagtgaaagccttaagaatcaacccaaaggagggtcttaccttattttaggagctttgtccataccaggaggtacaaaaaaaaaagatcacaacaacagacaatagatgccaaactagtttacaagtgcaatttatgcaaatgatgagactaaatgctaatctttactttagccgagtgaataatttgaagtgaaatgaacctaccaaaaatttaacaacctctcatatcatgatcttgggagtggacactttagaatcttccttggctgtgtcacctggaagaaagaacataaaaccagttagtgaacacacagctaatctccgaaaggcggcttctaatcatgttcatatctatttcccttcatgttacactctaaatcatatcgattctaaccccatttctctttgaattcaatacgtgcgtcaggttttctttatcaaccccaccaatctagcctagtttgtacttgcacagatgtaaattgatgtatcaaacagtgatacctaaccacacattctcaaaccagtaagccctcttctgttgttaaatctagggaaagtatttgtttgttctacaagtgacatatagacaaacatgactactctagtttgtatagatatgtaataaacaaacatctaagagaacaattctatacagataattgctgatacaagcaaaagagagggctgagagtaatcaccagattgattggttgtggtggtaacttcaccatagatggccttaagcgtcgacaaaggaacaaccgcggcattacccgcagaggcagcttcagcaaagagctgctgtttccactcccacatggtgagtttcattgccttattagacttgaagagtgactccttctgctctgctaaggcctcaacatacttctgctgtttatcagatctcaatcccaaaaccacaaacgatactcctagacacgtgtttatcacagcattgttgttcattgcttccgagagaaacattgcaatcttgttcgccattcctgtgtagtcaaatccatcagtcaaaggaatacatattagcaactatcaaccaaaaccatgcactgtgagcacaacaaactcaggtaaagctgaatatgaacacagagattgttgtatctaagaacattcaaacattagttaaatgatgaaatcaccaaattttgttggaatcgataacaaatggtgtcattttggctacatactctatattatgtggagatggtgatgctgattttacaattagagatcaatcagatcgatcaataagctaaacaacgaatccaggaaacaaataatgaaattgaagcaagaaaaacaaggaatctgggaggctaaatcggaatgagtaacgaagtttaagaacgaagaaaggctcacccgaaatgaaagatgcgttgacggctacggcggcgaggtttgatacgacggcgacgagagagaaatcgcttccgttccaatactaaaggttgttttggggatatgactgtaattctaaaacaatgttaggggtatttaggtatttcaacacttttgccaagtaagtaaagtacgcaacagtgatcattaagatatttgttttaaaagtgttaaagacgatcattcatcatcaacactaacactttttcaaattgtcgtctaaagtctctaaaaccaccatcgaagtcttgacagagagaattcgaatcggacagagaatttcttccgtagtttttcttgtaagcgaaaaaggtaaataaaagctttttcttcttcctctgttacgagtttctctttttggtactttccttaaatgtcaaaaacccttttttaagaaccgagggtttcgaatttcaggttgattttgatgattaaagggaatatcgtaattgatttcatgtttttcaagtttgaaatctgtatcctaggttaaaacctcgttgacttgtgaaaagtctaggtctacggaacataaaatgtctctttcttgttgttggtgtttgagattttgatcggttcatcatgtagatgaacaatgaactatgtacttcttctgatatttggctttatttatgtgaattttttttgatttttcataattctgtttttgtaaatgctcaaaaaccttatccttataactattcttatttttgtttttactgataactactctgtgaagttctctgaaagttttcttctttttggttattactatgagaaaatcttgttttgcaacaccatttactgaaaatttgtgtctgaatatgttcatgttcgtgcacacggcatgattagccaaatgcacaagcttactcatttgcacatcttagagaaattcttccaatcttttctttttggaaactatttgctagcttttgttggtaacataagtgcctttaccttgtaatattaagcttagatagccgaatcgtgtttgcaaaactgtttattgtgcttgtattttaccttgtttatatatatagtttcataaacaggagatactagaatcttactctgcaaagctgttcatttttctgtgtctattcttcatgcctatagtttggtgcaaactgtttattagaggtctgtgtctgaacaatctctttgttatcaataagtttcagaagctgctcaaaccttgtttcttaccactgttttgttgacattttgtcttttctcttttagaagtttagttagctcgtgtgagagaagggtgtaatg

SEQ ID NO: 36642 - DNA, 3000 bp, Unknown
  misc_feature (1)..( 3000): 2750-1469P.txt file - cDNA_ID_3098761; gDNA_ID_2936564; Annot_ID_194557
tgatcggcgagggttcttatggaagagtgttttatggtgttcttaaaagcggtggtgcagctgccatcaagaaacttgactctagtaagcagccagatcaagaatttctttcccaggtagatactataaagtatatcactgcattttttatcttgtacaatatcgccaaaaacagcttaacctagttcttatgtcctatgtgcaaatagtccagcatcaaaccactcccttgggaatgttctgtctacttttgttttgttactgacgtagaagcttttaacagatatcaatggtttcgagattgcgacatgacaatgttactgcacttatgggctattgtgttgatggccctctccgtgttcttgcttatgaatttgctcctaaaggatctcttcatgatactcttcatggtgagtgattaaatgtgaaccgttgcttagatatggattagtcactcaatacttaactatctagaaagtaagatacaggaggaagaaactaatgaaacgtggtgactctttggtgcaggcaaaaaaggtgccaaaggagcacttagaggtcctgttatgacgtggcaacagagagtcaaaatcgccgttggtgcggccagaggacttgagtacttgcatgagaaggtgagccctcaggttatccaccgagacatcaaatccagcaacgtacttctgtttgatgatgatgttgccaaaattggtgattttgatctgtctgatcaagcccctgacatggctgctcgccttcactcaactcgtgtgctaggaacctttggctaccacgctccagagtaacgtctttttcaagattttctttaccttgaaaagatttttttcagtttctttcattcagactaaaccatgggttacatgtcttcattcaaaaatgtttggttctcatgctctaatgttatgagtcactttttcattcacatggatttcgttcctcttatcactttttaattacccttatgtgtctattgcatctttgacgaatctatgcttacacctttttgtgtaatgtatttcagatatgcaatgacaggaacgttgagctcaaagagcgatgtgtacagttttggcgttgttctgctggagctcctaactggtcgtaaaccagtcgatcataccttaccgcgtggacaacaaagtctagtgacatgggtatgtttagtgcgatcttctctgcttctaattctggtttgccgcatcgataagagaggcttttaagaagaccaaatttataataaactcatttagtctgttgaaaattacaaaaattgggtcaaaacctcaaaagaacttggaagaaaaagccctccataattaggcctatagaattgaaacttgggatgttataacaactgaagacgctggaaaaagccagaattttgtacgaatagattaatgtgactctaaatgtttcctagaaatgagataatacggttgctcagtaataaagatgttgtgtgttgtcgtctcaggcaacccctaaactaagtgaagacaaagtgaagcaatgcgttgatgcaagactactcggagagtaccctcccaaagctgttggcaaggtattaatctcaaaattgctttcctctcattgtttcaataatgcgtaaaagatttaacttaagtgtataacttaaaagaccagtttatcttgtgagtgctgacattagaaccaacgtagcgaaacaaaacaagtgataagcgcattcatctacatgattgaaacatttcatgagtctgattttatttgccatatggtgtgatataatgatcagctagctgcagtggctgcactctgtgtgcaatatgaggcaaatttcagaccaaacatgagcattgtggtgaaggcacttcaacctcttttaaaccctcctcgttctgctccgcagactccacataggaacccctactgatcaaatattcaatcccccatatctcatcttctgatcatgatgattcatcaaatgtgtattattcattttggttctgtattgtgtaaatttatgggaccttatctcattaactcttcattctcaagtcccacttttcaagacatgtgtatgtctctcctctatatcaatatattttatgttttcctgtgaattcagaaaactcattactaaattctgatactacattttcattgagatgatgtttttgctacagatcataggaatttgcaatacatgttgctatgcgatgcgacggcgcctagagaaatctagagatctcctctgtttcagtgctttggctgcctgggggaatttgaatgtgattcactgaagctgtattttaagtatttgactcatattagacttgttccaagtaaaatagcaacaaggcaacaatggtcatctagttatttaaaaagtggttgacgatcattaagacattttcaaaattctcatctaaaatggtaaacaaccatgaaagattcgactcccaatagagagtttcaagttctctctttctctttctctcctttcctagttttttcttgtagcaaaaggtaaaccttatgcttcttcttcctctgttgcgagtttcccttttggtactttgcttaaatatcaaacaaccttttcaaaaaggatcttcctttcgagggttagaaaggagttgattgtttctaacttttcatgtttgaaatccgtatccctatgttatatctcgttgacttatgaaaattctaggtttagggaacataatgtctcagttgttcgtgtttgacaatttaattgcttgagtaataaagagagataagatcattgatcttaccattttactctcttctctttgtcttagataggcaaatcttgttttcaaaactgtttgttgtctatattatcttacactttcataagtaggagatagaagcttaaggtgctatcaaaccctttttttataccttttgtcacattttgtcttctgtactattacagttaagttagctcgtgtgagaaaagggtgtaatataatg

SEQ ID NO: 36643 - DNA, 3000 bp, Unknown
  misc_feature (1)..( 3000): 2750-1469P.txt file - cDNA_ID_3098767; gDNA_ID_2936564; Annot_ID_194556
agcagccagatcaagaatttctttcccaggtagatactaaaattaaagtacatcatttcagtttttactaaccttagcttagaccgtatatatggatcatttgtttaaatggtccagcatcaaaaccactcctttggaaaatgttctgttttatgatatagaaaactttaacaggtatcaatggtttcaagactgcaccacgaaaatgttgtagcacttatggcctattgtgttgatggccctctccgtgttcttgcttatgaatttgccacttatggaactcttcatgatgttcttcacggtgagtgtggttaacgtaaaccattgctcggataccggatcactcactcaataaaaactaacatacaagagggaaaaaactatgcaatgtggtgtttctttggtgcaggtcaaacaggtgtcataggagcactacaaggtcctgttatgacgtggcaacgaagagtcaaaatagctcttggtgcagccagaggacttgagtacttgcataagaaggtgaaccctcaggttatccaccgagatatcaaagctagcaacatacttctgtttgatgatgatattgccaaaattggtgattttgatttgtatgatcaagcccctaacatggctggtcgccttcactcatgtcgtatggcactaggagcatctcgttctcactgtccagagtaattccttttaaatatgttctctatcttgaacagtttgtttgattcagattaatctagaggctatatatagacgtcttctttgaacattttgagttatttatttcagacatgcaatgacaggaatattgaccacaaagagcgatgtctacagttttggcgttgttctgttggagctccttacgggtcgtaaaccagtagatcgtaccttaccgcgtggacaacaaaatttagtgacatgggtattgttaagcgtaatcttctttgtttctgataatggtttgcttgcaatgacaagagaagcttttaagatcagtctgtaaaaataagtaaaaaaaacttcaagaaatcttggagtaaattaaaacccttcttaggcatatagaaatgtaacttaggacgttaaagttaacaagaaagtagctggaatttgtgcaaatggataaaacttttatcataaaagtgaaatattgctgctcaatgataaacatgttgtgtgttgtctcaggcaacccctaaactaagcaaagacaaagtgaagcaatgcgttgatgcaagactacttggagagtaccctcccaaagctgttgccaaggtattaatcgcataacattgttttcctcacattgtttcattgcagcaaaaatgatttaacttagaagactagtttatctgctggcattagaatcaaagtagcgatatttgttgtccgcattcatctctctgacaactgaaacatttcatgagcctgatttcatttgctatatgcatatggtctgatacaatgatcagctagctgcggtgtctgcacgctgtgtgcattatgatccagattttagaccagacatgagcattgtggtgaaggcacttcaacctcttttaaactcttctcgttcctctcctcagactccacattggaatccttattgaccaaatattcaatcccccatatctcatctacgactacttcatgatgattatcaaagtgtattattcactttgaagtatatttatgtaattttttgggaccttatctcattaaatcttcattttaagacccacttttcgacatttgtgtatgtctatattttatcattattatgttttatgtattttgtgatgtagtttgcaatacacatcaaaataaataagcaccaaattttgtttgttcaaggtaaagtcatgagttaaaaaaaaaaaaaactcgtttctaaattctgatactacattttaattcagagattataataggaatttgcaatacacatcaagatatataaaaattaacagaatttactcactgttgttagtgagattataataggaatttgcaatacacatcaaactaaataaaaagtaacagaatttactccaaattgaaacagaatttactgtgcgagacaacaaaaaatttattataacagaatctaatccaaattgaaacatcaataaaatgattttttttttttttcaattttttgtttgatactttttaaaaataacatttaagtcctcgtcaatgcacgcatcaaatttgtattatacggtattatctaataatatttcgtattaaatacgtatataattttgattttgaaaagttgagatatatagttttggaacataatgggcccattaattctaattatttcataactaatttaaaaatatgctgaagtaagtcccccgtcaaggacataaaaccataaccgttagatcaaagatttacgtcctgcaaattcatctccaccgtcgttagtttcaccaatttcattatttctcttatttaatattcttttcttaataataaatctctctcttcttccgatatgcagagagcattatatgcacacagtagcaaagctctctccaagtttctgactcacttcacctgcttcatcgattcgccattgaagctcttacgcatttatcatcggcaaaacttcttggagttatcggaaaagtttcttcatcaacggtggttgaagtatctgatccctctcgctatgttaaactagattcgaacgtttgttcccaaagccgagattcgcatttcggcttctcatttcgaggtaatggtttctctggatctgatttgtgatctatcgatttctcctttagtgattttaggatttttgggggtttttgtgtgtgtaaacttaaatctgaagtttccgattgattttgttttggatttcagatttcgtttatggaatctctggatcttatgttgtgtgtgggattatacttccctatattgtaactatcgaaagaaaactgcatctacggtgattgcggagaggagaaaaaaatg

SEQ ID NO: 36644 - DNA, 3003 bp, Unknown
  misc_feature (1)..( 3003): 2750-1469P.txt file - cDNA_ID_3098823; gDNA_ID_2936565; Annot_ID_194613
agagaaaatattttattgtaagaaggagatacactgacactgatacggaaatacgatcgcaggactagtctttttatatatcctcaataagttaaaatttaatgactcttttttgacaatttaattttatactatggttttgctttttggacacccaaccaatgataatagtacaaacatatagtaatggttcttttggttttctttagtattcaaaatttagaaaagaacctagagaatactttgtttgttttgtctctcttcctatgaaaacaatgattagtttgtttactaattgccatccataactaattaattgtggtatcgaaacaatattttcactatatagaaacttgcacgaagataaagtgactgatccacttaaagatactgaatttgctatagaatatactgaacatatttcaacttactataatttaacgatgccagatataacgcaatattcgacttcatatttgaggataaagttgattatattacatggatatggatttatctaaactagtccatgagaagcccactaatctttttaagaatacacgtgaaagtcacgcgccgtcaaagtaaaagaataacagacttatccacacattaacgaggttcgtggatcccgaacaaaagaataacaggaaaatggtcgagaaccacgtgaaaataagatgagtcatgtgccctaacaggactttttacacaatacacatagtataggggggtatatatgcaaatattttaattaagttaatagcttaattcataattattataaaattgagggagctattagtgtttactgcagacaaaggctgatttggaaagatcaacagagtcagataactgtccccgaacaaacaaacatacgaagtgcattattttcgacaaatgaacgcaacgaacatttaaattgtatttgtcccagcaaaattaaaatttatttaatccaacacattgtatttattccaacataattaacaaactaattagatatggttagacatatagtttaactaacccaacacagcgtctttcatcaatcttatgctaggaaacaggagaccattagtttatcttaaaacaccttctttttgtgtgtctaaagtctttaagataatattttaagactcaattttagtcaagatcgcaaatcattgataagaaaggatctaagacttcaaccaacgaatgaatttagtttaactcaattattcagattcaactgcatcgatcagcatatgaagtatgtagagatgtcaaaacccaatttactaacggattaaaaagcccacaggttttccttttgaacttcagtgaaaactttggtagcttagttaagaagcagaagactccagctgagaggaaatgggcctaaaatagcccacacattcgactgtcttcaaatgggcttgagacggcctgatattggtttggcttgatattggtaaaacctctgattgagctggagtattctgtttctgttcaatattggtcacacaaattcagtagtagtatacaattgggcatgatcacagaatcttcaacttcaagtgccaaaaattttcttttatgttctcaagcaaaacatactcctacgccatggccacagttcaagaatctgctcactattagtacgccacttcgtcgtcagaagacaaatgttttgcctgataacttcagcagacacttacatagaccatgatcatcatgttcaacatcttataaatctatgtaaaaatgatctcaatcaactaatcaacacaccacttacacatcaacaacaactacctacactagtcattaatctcatgccataactttccaagattatcacaaaatgtggcaaaagccacaacctttctttcatttgcaattaccatttcataggcattgttgctatgtttctctcaccagtgtatatctatctattatccatcacaaattcatgccaaactcacaagctaaagatttgtccttgagattcgctactacttgtatcattgctctgagatcctagtctcactctcaatgaaaccaaatagatcttaaagaaagcataaccaatagcattcagaagaaaattcacatacaatttttaacagcctaagcagtatctcgacttcaattgaaaagacaacaaattcaaagacataagctttaccagaaaagactcatcatttcttcttccctttgggacctttacttttcttagtaggcataatgatttctcctttaagcacaggaatctccataatctcagaaagcccagcgaacctcttacgaaacttctcaacttgatcagcatcaaccatcaaagccgaacgattcccgaggtaaaacggatggttacctgaccatacatcaaccacatactctttctttgttcctcctgtagtcatcaccagctctccattgcagtaaacctttgcgtcttcgtggaattcaggatgcaattccttcttacgacacgttatctgaaccaccgtattgctgcttcttctcaccgattgttttcctcctttcactgccgccatcaccggctaattttgaaaaaaaaacacaaacaaatttagtgattttggggaaggaggagaaatagacgaagaatgagaaatcgatttcgagcttacctttcttaattgcagagaaggaacacatgggctaatctgaagaaacgagttcgggagagaaaccgccatttttgtcttcaggagctatcttcttcttttttcctggtgatagagaagaaacgaagtaacgattgatggataagagaatgaggatgatgaagtgtattggagttacgtttataaccctaaatactttgaagatatgtaagggtaatatggtaatttacatagagacttccttttgttctgttgatacactcttcgtcaatctaacgcttcttcatttttctcgagagaagcaaaactacatatatatatacgcacatacgtacacagttcgaaggttttagctgcgagtatg

SEQ ID NO: 36645 - DNA, 3003 bp, Unknown
  misc_feature (1)..( 3003): 2750-1469P.txt file - cDNA_ID_3098831; gDNA_ID_2936565; Annot_ID_194610
tcaagtggtgaaggaaatggtggacaagatgggttacgaagtatgtttcgtggtttcagtttctgctcttttatttaaatatccttgtctcgtgaagattgtgtttcatgaaaattttctgaactattctacaggttagacttgttagagtcaccaaaagagttcacgaggcatattttgcccagttattcctttcaaaggtctgcaactggtctcttatatacaacttacattcagccttggaaacttaaatcatttcctatgtattaaggctggttttgggacgatattgcaggtgggtaatgcctcggagtgtgtcagctttgatcttaggccttcagatgcaatcaatatagctgttagatgcaaggtattacatagctatgttaattaatcagctgaggtaaatacaaatgtgtgtttggcggttgaaaattgtgttgatcgttttgtagatacctatccaagtgaacaagtaccttgcatatagtgatggaatgagagtcattgagtcagggaagatatcaacaccggcaccagcttcagatggtttattatttactgaacaagaccggtaaattttcagacaccttaaagatcaatctttgcagatcacatctttttactgtgaatttgagtgccataaacttttttgactttgtgcagaccaaatggtcaggcttgtcttgatacgaaagagttcaatattttgagcaaaatgatgcaagccgttgatgaagagcgatatgatgaagccggtaagctttgctctagtctctatatccacaatgtacactttattagtggttacataacttactgctatgattggtggcccagcatttgagaccaatctgatttatgtatgtaacagaaacttttatagcttttcgtaaatcttggtctaatctctaatgatcaatacactgttggttatatgatttgcagctgagtggagagacaagcttggtcagtttcgggccaaacgtaacttgaggaaatacacatgagagaggtaaggagatataaacgaaaatgcatactaaatgacgttatcatttctcgatacttatgtttctccttggggcagctcgatcaacaattattggctgtgtacataaactaagaagaaagtcattggtcggaatcaaagtggaggaagaagcctgaagtgtcgtctctgtatgatggagatcgaagaatgcttctgcactttacccatttccctaaaaaataaacaaaaaaaaatgtataatgtatgtatgtagcgtgatgtgtacatattacttattaatctatgcaaattaagctcactctaattacttttaagtttccttttaagtcttatgttcgtcgtatttgttttcgtgcttctttctttttataataatttaattatatatttttgttattacttgcagctgtttgttgtttatcatagaagcaatgtggcatatggttaacatgaaatttgaagaaaagacaaaatcactggctttgccgacatatctgcagtgtctttgttttgtttgttagtactgcattgtctaaatctaaatcgtgacaataaaacaggataattatttttcattatgatgttctttggtaaatatgtctataaatattcttactaatttacaaatatatatattcatgtaaattttattattcaagagatcttacgcagacatggttttcacagtaccattaagattatattcaactggtttgtattatatttaatttataaataaaaattgtcaattgataataaatggaaagaaaaaattaaaatgaaaaaaaatccatatccattcaaataaaatatctcgcaacatacgtttcatacgacaaatagtgtgacaaactgacaaccacttgtcagaattgggctctcaatatggggaaaaaatagtcaatgttattaaaaagacaaaaataaataaataaaggaaaatatatctaaaatcaataagagattaaaaaatagaaataaatcatgtatttggcacataaacaagtcatatatcgacaaaagcctaagtttggtagatgaatagtgattttaaatggtacataagcaattcaaatatgtatagacaaataagcctaattttataacatttttttgttttatattacaaatctaacatttttttaattcaaatatcccactatcctttttgaatcaacagaaaaacatctcattaaactaaaaaatctcagattttgaacatgtttaggtaaacaaccatcatctcgtcgtttcttttttaccaaacatcaattttactaagttatcagaaaaacatttttcttttatcaagaattattcaaaaaccgataagtttacatgaaaaaagaaagtaatacagatacgcgccttcttgattaaacaatcaatccgaatattgttataacgaataaaaaaatatattaaaagaaagaaaagaaataaagaaagatcgaaagtagccatttgaatattgatatttgattcttaacaaatttatctcatatagtaagtatccgtctcactaaatttgaaaatacattagtcgatatataattattaactaattataacggtatttagtaacggtatttaccgtgcgcggggactcatctaattaaaaaactaaattgaaaaaacctcaaaaaatagtagttaccacttaccagcaaacattcaaaaaaaagaaaacagagtatgactgattttaaagtttctaagaagaaaagaaggaaaaaaatcaccgacgagtctttgtgtttccggtcacaattaatgaaaaccatttctagtctaacttttgttgtaacgcaagttttgaaacttattaattaaagaagactaataattattataaaaccccatcatcactttacttctccctcttacgtctctttcaatttcctctctgcagaatcgcttctctctctctctcggctccgccgattccgagttccccgattctcggattcttctgaagatttctcatg

SEQ ID NO: 36646 - DNA, 3000 bp, Unknown
  misc_feature (1)..( 3000): 2750-1469P.txt file - cDNA_ID_3098840; gDNA_ID_2936565; Annot_ID_194606
aggtctataatcgttaatacaattatacaacgaaagaaaaaatgatttttaagaactagttttttgttctgttcttgttccttaaggtgaataggtaatgataattttgtcttgagcagccaagaattgatcattttgtctcccaatgtagatatcaaaacctttttttgagccatgagcactgcgactaggccttcgtcttcatcgactaccatctgagaaaatcctgtttctcattcacagccaacagaaagattagtgcttcggttgaacaggaagaagaagaaagtttcatggaaagacgggacggtggacaacgagtttatgcagaagaagagttcaaagaaatgttgtatctttcataaacaaaagccctttgatgaggatgacagtgaagaagaagataacaacaaccatcaccatcaccatgaacactccgaatcttgtgaggcatcttcttctaacgattctaaagcatttgactaatgaatcagggtttcgtatcactatatagaactattgaatggagatcattggagaatggagaacacatattcgttttgaggttttggtttcattttcttttcttcccattacccaacagagattgagctatatgtacatgtaatcaacctccttaaagctctgttgaaggaatcacaaagttggtttagtaatgagatacttctgtcagacatatcgaactaaaactttcataatataatcaaaatatctcatttaatatcttatataaagattcaactaactttactattttttcaaattgcatggatcttacttcttagatagtctttatgtacaatcataacagtcgataataaaattttgacaaagaaaatcacttttaattttcaaggatcttttcaggcatcagaacagtgctttatatcaacttttgcaaatctatcaagaaaatagtggtcatggatgaaatgattaacttatatgttcaatgaatcgatatatagtgtgttgattagtgatcttgtccttatttggcttgttgcaaatatactctgtgaaaggaataaaaagttgtactcacgactctgacttagcgtaagaataaaactcttcttctgggcagtaatatgtgtccactattttacaatcgatccgaataatccacgtacgaaagctttaccagaatcagttctttagatagttgcttcattttgttttattttatttttccttttctttttggcatctaaacacttttacttgccataataaatgtttggatgggccaaattgccaaaaaaaacaatcgaaggaacagtcgctgccatatattatgctctgcaaaggttgttgagcgattaattggtctggtccaagctctgtttgtaatgggccctaaaataaagcccattctttaaatactaattatgacaaaatcaaattctcttgatgaaacaaaaacatcatcaagattggctgattgggacttccatgaccatctcatactacacacaaaaagaaacgtatttattttaccaaagatattgattcataaattaagctaattgaaaactaatactaataattaaaatcattcttacaaaaaaaacatttttaaacaattcgaataaaaacaaagttacaagcatgagcgcgcgtgagtttgaaaataaattggtctaacctaagtagctgacaagttttggcatttatacttgtaagtacataacattgattaatgttatttaatccttaacactaatttataacctaactgatgagagtgggtgaacgaatatccttataattatgagactctcgttaaactctttttttttttttttttctatatgagtgttgacaaaaaaagaagcctttatataagtaataattaaaaataaatgtatttggagggcatcaaagtttttggcttttgcggctaatggagaaacagtaacacgtagagcgcactcctcgtggtccttcaaaccccaccaacctctcttaatcactactaaacccaaattcttaaaataattaatcaccaaaacttggaaatggtaattaaattaatcttataaatggtaattcaaattgaaactctctccctgatgttgttttgtccaacatttaaactcaagtaatgtttagttttcgtcattcatatatagttgattatgaaatagtgaaatgtagaccaaactttacgaaaaagcaaaagtaatataaaaataaaaaaagaaaaagaaagttataaaaataaaatgaaaaaaaaaagaagaagaaaagaaaaagagaggagggaacgtggcacaattccccgtgcgtgtttcttcttccccagacgcaaaacgcagacgcacccagaaactaaaaaaaactgcttcctctctctctctctcttcccatcatcatcgtcgtctctttctcagatcgattttcggttatgccgatcaacggttaatctccgccgtttgatttcatcgccggagaggatctttctccgtctacgtatgccctttcgtatacgcgtttcgtgttttgattttccccgaaacctttcgttgttctggtgagaacctggcccatgtttttgaatctaatctactatatcggtttctcctgtggtgatgattgcgaattgaattagaaatcgtaggttgatttcttgttgcttgtgtatttgttagatcatttctctgatgaaattcgtgttccttggtcttgactcagttattcaggtcctgagtttccgagttcggtttatctcctctctcgtaggagcttttcattgaatgattaatctcagatcgttttggctttttttttttaataagaacttcagatctttttggtttcttaagctttatcgattttgaagtgagtcttgtgtgcttactgcagggttactgtgtgaggaaggacgtgcaaatttgtttggaagttgtgttaagttaaagcagagtattggagatcgtctgatagagaagagaatagttcttgtgtaaggttatg

SEQ ID NO: 36647 - DNA, 3003 bp, Unknown
  misc_feature (1)..( 3003): 2750-1469P.txt file - cDNA_ID_3098854; gDNA_ID_2936565; Annot_ID_194601
ttcgtgcagacatatactgtgccattgtcacttcatatatttcattttggaatatatatcaaagatataaacattgtattgctgttttattcgaagtcatatcaccgaattagtatgtgttatgttttggatttgctatggataagtaatgatccaaagcccttaaaatcatgatgtgtatttatatattacttatcattaatatataaatccaagtcatgcagttatttattttccaacactagacataattattcccaagcatatgagtataaaacagttggattgattctgatatgaggtgtgttatcacttatcactctttaattattaaatcagatggtttataacatatatttataaatattgaagataacaatgatattattgacataatttactatgctgcaactttaattttaattcattttaaaacacaaatattggctgatcttttttattctattcatcggctcacttttttttttttttttttttttttttgtcaaacattcatcggctcactaatttacaaacaaacacattttttgaaacatactggcccccacacgcgtcctcttctggttatatcgctatcattacattttcacaaatttcaatatggatattgttcataaagaaaatagaaagaaaaaaactagaattgacccaattgaatacaaaatatagtacatccgtttcacgaaaacacactgtatataatatgcagattacatgtggcaaggagtaatattgttggctgattcactctaatgtcatttttgataaaggtgtctcgcagtaatgtcgcttagtaatgctagctattttgggataattatatgttatgaagaaagcatatactaatctcatcatcagtggccaaattttaatcttacgtctatataaacttatttataccactaagaacaccaagacgtaggtttcatgctcaagtggcaatatctgattatttaagtactttttttgtttaaaattaaaaactgatcggattttcgcagttttttagtcattgtttataagaatttcaagtccaactggttagggctgtagacttgtaggttttcctttttttttttttttcttattgtcgagaaaacctatagagtctaaagatttcagatttcagatttcacatcgacaaagagcaaattatgaagaaagaaaaaatgcttgtagaaccaaccggcatagtttttttgatttagttaaatttatacgactcagcaacgcaaatagaaaaagtttaaaaattgatattgaccattatatattatataagacacaaatccgcaaaaagaaatcaaaacatgagaacaagatgacaataatgagatatgaaaatttggtaaaacgtaccgatctctattatcgtgcaaaggtattaatgtttggattagcatcaaatagataccaacttgctcttcactcttcttatagaaaaatatggtaccatatcgacccaccaaactaatcatcatcgaatctagctaggcgttaggattgcacattactcagaaatccaaaatataataagtaatttaacgaatttatataaataataaccacgtacggagtcaaattttgttaaaccaattttttgacttcacctattacatatcattcgtagaatcatatcttcgtaagtacaaaaaataaatagggagtttttgatttgagactgaaaataaattaaattttgttaactaaaaattataaaattaatctgtcgatgaagccaaagagagaatctaccgactgcaaaatactgcataagaagaatctaaaaaataaaaataatctttttttttttttgtttgaatggttttttatttaaaaaaaaaaaaacaatccattttgagtttgtgttattaccgtgcaagtcaccacgtgaactcacttcttcatctcaggagagaaaagggcccactatgattctccgtatccaaatgtggaccctgctctttcactacacacgtgtgacctcatcctctcccacgtgaatatccacgtggcgttcttccgttccgtttctcccatccctcccatgcctctccccatgactctatttatcccaatcctctcttcctttcattaatttatcagttaaaattcctcttttttcctagtagtatttggagttttcatatcaaaaagtttagactaaccctaaaaacattgatagaaaaacttatcattttaaacgttcttggggaccaatcaaaatggttaattgtctagtgcctgttcttgattcttcagacatggttgcaaaagtccatagtcaaatcaaggttatatgtagcttcaacactgataacacgtttattaacaaaaccatatcaaaatggttgttttttgcattttcagtcttgacgtatacactgccatttttgaattagtcaaatcgttacgtagttggtctacgatgtctcgctgaaacaaatacatacgtgtgtatatacactatgcaagtagtatagttaacatcataattgaccctaaggaaaaaagttaatgtaaacagtgacacgtagatatcacacggttcttttttggtttttgttaaagatgaacttgttaataaagaatatgacgtgatcttctccggtacaactctttgtcctataaatagagaactcttgtcttcatattctcgacacacacatataaacgcacaaactcgttaaatttgtacgaatataattttttttaaaacactcgttataatatattaaagtttcacccaaaccgaaaaaagagagaatctgtgcatgttgctcagaaaatcttcaaagcgtaatctgggcttacgttagctctcacgaacccccaaggatcttctatatatgttttttcatttccccataaaatctttcattatctaaaaaatattattatcgtatcttttttcttctatatattcttcctcctcaatcttgattcttgtttcttgagtattctttgatgaatcgtgaaatg

SEQ ID NO: 36648 - DNA, 3003 bp, Unknown
  misc_feature (1)..( 3003): 2750-1469P.txt file - cDNA_ID_3098867; gDNA_ID_2936565; Annot_ID_194596
atttgcatttatgatctttagtaattatcactgtcggggatgtttaaaatggattagatcaaacgctttgttctgaactgaagtaaaaaaagatctttagtatttgattaaaatgatctcttaaagaaacagtttttttttacaaatttagtttattatcaaatatccaataaaaattcttaaccgaatgaacaagttaaaaataaaccaacatttaatatatataatataatatggaccaactaagttatagtatggaccaattcttgagttgaaagtccatagattttaacatggtattaaagtttagctaacttgagaaagatgtgttgttcgatatataatttttggtccaatattagaattttgtttgaaatagacggataaaagcattattttaaggagaacgtgttaaaaatttcacatatacacttcaatgctctacattatctttcttggttttctcggatcagcttacacgtcagctttttacatataaaatatcatcttttaatttgatgtaaacaagaagttcattaacagaatttcatatcttatttaccttatacaaataaatttcattaacaaaagaaattcatatacataaggaaaaacacagtgcataagcgactttgtctcataatcgttatctggcataggttagtctaccatgtggattcaagatttcgtatttgaatccattagttaaatcatatatagcccgttattggagactggagaccatatataagccgagatataatgatgttgggccggaataaacgggccaggtttgttataaaccacgccatatagtctatcaagactcgcgaggattacacgttagtacaaagagaagctaagaagaagatgcaaagaaaaccaagagaatagtcaaagacttaaaagcccatagaaacagagacatataatagttacacattgaccgttacacacaacgtaacatcccgttttctttatacagatacattgcacttgatttaatagttttccccatgacacatttttagcttcgagacaaacaactgtcgtttttatgttttttttgatatggtaagaatctgctttcacactatacagacaaaccacatatatagatgtgcacatatataagtacatgtaactggtgtttatttacatatatatcctagttcacggtgactatatttgtatatatatgtagtttgtatatgataacttaacaattaaagagagtctagtgacacctcaaagtggggaatgaaaggaatcccaattagaatagccaccggaaatacaagtatcaaaccgagaaatatcattatctccttcatgaacccatggaaatcctaacgacattgtagcttcttcccatattgaagaatcatccattaccggcaaatccacgtttatatgctcccatgatatctcctctgtcactcttccacatgatgacatctcgttggatgaacacggcgactcagagtcgctgctgctttttccaccggtgttgctgcttggtgtagtctgggacgccggagacgacgccgttttagggtaacttcttaaggactcagggaggttgagatgagcctcaggcccatagagcttacgagctgcggagtcataagccaaggcagcttcacgggaggtgtcgaaggtaccgagccaaagacgagctcctcggttaggctcgcggatctcagcgacccatttgccccaagtgcgttgtctaacacctttgtaagtgcaagacgcgttatcgggtccaccttttcctctcatacaacctttcctcgaactagcttggacggttcgttgtttcttattagcaccaaccatcattacttttggctctatggatgacatgtacggatgttgataactcgaaagtgatattatgtgacgacttttggtgagtgataaggcaaagacatgaggtaatggttaggtgtgtatatatactagaagagagtgatgaaacgtggcgaggagaagatatagctggcgcagacatgacggagggtcgtgtcgagaggaggaagctggtgttgtgtttgtaatcctaacacttgtctcgagagacccttctttttttggcaacagtaatcgtaaaaccagcagagagattgatgagtttgagatttttccaaaaaaaaaaagaaaagagagagagagatatggataaggtcatccgcgattggggaaatataaaaagatttatcactatgaattaatggctcgtcatgtgaatgcttctatctaatatcaagctatggctttattcatcagaaaacaaaatcaagctatggctttaacttaattataatttcaaatagctaaaaagaaagaaaaaaatacatgatttttcttatatatacaaacttttttaattaaaaagcctttagatttataaagcttttctctatgagtcatgtaatctctccttttgtaaaaaaagaatcatcatctaatgcataaacattgagaaagaattgtagttttttttttaattcgttcatagagtcaccattttctttcttgatgttatccatttctccaggctttttaattgccacgtgggaaattatagcaaagtacaagtatgaatgtgtgtaagggtcagtcatgtggcggcaatatgtccacgcaaattaaacgtacgggacccgaaggttcctcgataagagacaaacaaagttcactgaatcttacttctctgtcttagaacatttgtggccgagacacacgtgaaaaggcggcctttttaaccgataactacaaagctccggttccaatttatctaacttattttttgttctaaatattatctctagtattctcagatagaactttttaaaaatttgaagtcgttcaatgtcaagtagattattatggaaattgcaaaacataatttaccaaatcaatgtaattgcaactaaaatccattaatttgttttggatttttttttttttgaaaaaataaatttagcaagagaaatg

SEQ ID NO: 36649 - DNA, 3000 bp, Unknown; identical to SEQ ID NO: 2185
  misc_feature (1)..( 3000): 2750-1469P.txt file - cDNA_ID_3098875; gDNA_ID_2936567; Annot_ID_143726

SEQ ID NO: 36650 - DNA, 3000 bp, Unknown; identical to SEQ ID NO: 2188
  misc_feature (1)..( 3000): 2750-1469P.txt file - cDNA_ID_3098881; gDNA_ID_2936567; Annot_ID_194650

SEQ ID NO: 36651 - DNA, 3000 bp, Unknown; identical to SEQ ID NO: 2188
  misc_feature (1)..( 3000): 2750-1469P.txt file - cDNA_ID_3098881; gDNA_ID_1620500; Annot_ID_158843

SEQ ID NO: 36652 - DNA, 3000 bp, Unknown; identical to SEQ ID NO: 2188
  misc_feature (1)..( 3000): 2750-1469P.txt file - cDNA_ID_3098881; gDNA_ID_2936567; Annot_ID_143721

SEQ ID NO: 36653 - DNA, 3003 bp, Unknown; identical to SEQ ID NO: 22152
  misc_feature (1)..( 3003): 2750-1469P.txt file - cDNA_ID_3098888; gDNA_ID_2936567; Annot_ID_143715

SEQ ID NO: 36654 - DNA, 3000 bp, Unknown; identical to SEQ ID NO: 2192
  misc_feature (1)..( 3000): 2750-1469P.txt file - cDNA_ID_3098892; gDNA_ID_2936567; Annot_ID_143713

SEQ ID NO: 36655 - DNA, 3003 bp, Unknown
  misc_feature (1)..( 3003): 2750-1469P.txt file - cDNA_ID_3098898; gDNA_ID_2936567; Annot_ID_143712
caactaggaaattatgttcccctgtgtttagacctatattcaattattatagaattttcaagagcaataaaaaaagaaagatccaactaagaaagataacgaacacatgcatgagattgtggtgcatgtaagtgaaaataagtcgtaataatcaccgacaaaacgcgttaatacttattatagatccttataaaacgagtccaaatgtcttccttcttcttcaagcaaataagcaatcaattgtgaactcaaagctttcttttctcgacctctctttctttcatcacgaaaaatttatacttatctcaaataaaataaaaatatatatatatggatatgaagggaacatacttagtaacggttattctcttggttagtacgttaagtgtggggatgtgttctaacggttggataagagctcatgcaacgtattatggtgtcaatgatagccctgcttcacttggtaaaaaggccattaaactattgtttaatatacgtttttgttacttcaaagtttgtatggtaaatttgttttttagatacaattttataggaggagcttgtgggtatgacaatccgtaccacgccggattcggagcacacacggcggcgctaagcggtgagctattcagaagcggtgagtcatgcggtgggtgctaccaggtgaggtgcgactttccggcggatcctaagtggtgtctccgaggagccgccgtgacggtgacggctacaaacttttgcccaacgaataacaataatggttggtgcaatctccctcgccatcactttgacatgtcctcccccgctttcttccgcattgcccgtcgcggcaatgaaggcatcgtccccgtcttctatcgccggtaacttattcgatgctataggagtcaattgcttttttatgcatatagtgttcatcctttttgataagttaataaactgaaactatacattaaagtatattttggagttttttttttttctttttaaaatgtaaggtagagaacattatacaaccctatcattattttaagttattaacattattgtttaatttatttcatctacatatcattattttgctataatgatcattagcaagctaggtcattatatattatagcaaaatttataaggaaagaatggatgaagtttagatcaacatcacattataacatgtacatatacgtacgctcacaaacagaaaaaaaaaaaacaaaaacaaggccaatccttcaaaagaatctggaaaaaggtttaaatggactttagttaaataaaaatatagcatgtaattactgtgatatttatgcaaaatatctaatagttttgtaatgtgtatatatagggtgggatgcaaaagaagaggaggcgtgaggttcacgatgagagggcaaggtaacttcaatatggtaatgatctcaaacgttggtggtggcggctcggtgagatcagtagcggtgagaggctcaaagggaaagacttggcttcagatgacccgtaattggggtgccaactggcagagctccggtgatctccggggacagagactctccttcaaagttactctgacggacagcaaaacgcagacatttttgaacgttgtcccttcttcttggtggtttggccaaaccttctcttctcgaggaagacaattcgtttaactacaaaactaagtcgtgctctggtcaaaacgcaattctttgcttatttctgaacttgcccttgttttaattgggcagtgttcctttgtttctcttttattgctaaataatttcatgcttaattttatttaacggaacggtttctcatttatgtatgaagcattactcgacaagttaaagagttttgcagaatttatattaatggaaataacattttttacaagttcatttgtcaacaaaattatcagagctaatagacaccatgaaaaaagactattatcagataaaagcttcataaaacacagattagtatataaatgtaatgttacatgctagctttaattgaaaaagaacgacattgtcaggtacgtaacttgaaataactctttatcttcttttttttgtcaatgaaataattctttctataaaataataataataataataataataataattctttcttacataaagataaaataaatatataaaaactataataaataaaacagagcaataaatatataaaaacaatttttaaaaaacaaggtgctggcccatgctttttaaaaaacaatctgttgatttttcaaatacaaactaaatatacttagaaagttaattaaatatcactaaaacctacttttgggaaggttattaaaaatttccctccaacttgggaagaatgtttgtgagagattaacaaaaaatagatgaaggtttcacaccacattcagttccttatcaacagattgatgtgagcttttaatgaataaaaagctgttttctttttgtcatcaatttcttctatacataactctggtccattttttattcatgttttaataatataacaaagaaaaagtggaatcattgtatttttaatgaagtggatggcgttacagttgcagtcttgcagatctcaaagagaataagaacaaaaaaaagcttgattttaaaatctattcaaaaaacagaacaaagatttttaaattaggtttaatactaggattaaaggaaccatttaaaaatggtcataagaaatctcaaagcccataagaaccagacatggattcttttcatgtgccatggatgatataagattgaacagaaaccatttaattttatcttttaccaaaaagaaaataacttttaaacagaaaaagacataaatacccttcaagtgctttcacactctcttctcgaacaatgaacacagagaaagagagagagagaagacacttagtaaagaaggtctgtgtgctgttctctccgaaattcctttttttggtctcgagggtttttcagactgtgaagagacatagctgtggcaaagatg

SEQ ID NO: 36656 - DNA, 3 bp, Unknown
  misc_feature (1)..( 3): 2750-1469P.txt file - cDNA_ID_3098909; gDNA_ID_2936567; Annot_ID_143709
gat

SEQ ID NO: 36657 - DNA, 3003 bp, Unknown
  misc_feature (1)..( 3003): 2750-1469P.txt file - cDNA_ID_3098939; gDNA_ID_2936567; Annot_ID_194654
caatatgcataatagtcatatattaaatgtttgattcttcacattaaaaccaaaaaaaaatatatattaaatgtttgaattgccctggcatcccacttgctttagcttgggacttgtttagagagttataattaaaatccagattatcgaaattgtcttcttatttcaaatttaaaactagttggtaattagttgattggcatgcagatcttagttagtagtgttggtacttttccattgcgcctagtccaaaaaagattgtttttttttccaatacatattattactgatttcatattaaatttgaaaattaaaacattgaaaagtcgagtttacgaccaaaacactttgaacgacatttggattgaagcaaataatgatattctagtggtcatcatcatattggtccatatcaatgatatttttttgatagaaacacctttttactactgtaaaatgtgtgaatactcacaacgtactaaaaattataggttcgacgatctaattcttccccaaaactttcatatagcactagaagtttgaaaactcttggttaaagaaaataaaatggtactttcaacagttacaagtgtctgtatataatataatatattcaatttatacgtagtccagttgtgattgcacgataacaccgttatatatttggtatctttatcaatcaagattgttatatgttgatttttcaaactaaaccataataatattgacatacgggataagcccactattcagtacccacgttatgttgaagataacacttacaaataggggtccctaacaaatagtttagagtgtatatatttggtaagaaaactattttaattatagaactcttaagttttgtaatatatcaaaaaattgtgcgtgtttgtgttgttgttgagattctgaacgtctagcaaaaaagaagtggtgtgcaaccatgtaaagcactagaaatctttgtgaatgcaaatagaaggatgtctcttgatctgatggatgtgactaaaaaatgatgtaattaaattgactaattagaggtaagcatttattttagttggtacaacgtgtgtaaaatatggtccacatttctcctttttttttttttctttttttctttttactactttttctatttgtttttcaaacaaagtgctctaaactgacaaaactggagaaatagtaggctgtatttgattttgtgaaccaaccaaaaaacctttgtatttgatttataatattgtgtgttttaaacataaagaaaaagatatgagataaggaatctcatggtcagaagtcaaaactagaaagtcataaaataaaccactcctaagaatctgataagtaaacaaactatatatttgcacactaaacgtaatttagtggtcgaaaaatatgcatgggttataatcatcttatgacgttggaaaaaaaacaagaataaatcatataataatgaaaatataaaagtaatcgaaacttaaaaatgacatgaaattggtcgatttgtttgtttccataatatttattatctaaaattcaaaaaatattctggtggtgcgattatctcaataacaaaagcgtgacatgtgacatctgaaacgtaaaacttttttttttttcccacacccacccggccatctttttccacgtcatcaatttgttaccttctctggcgatttctgtgggccctactgccccgattgccacgtatgaatatatcgtccataggtatcacacgtgtcgattattcattggatatttaacaagaacagtaaccacacaaaattaataaaatcgtattacagcatacaagatgaaattagaaaatttcttcaacttttttttgttttgcgatattgtcttgataatgtattatagtaagatatagcgagtatttgattttatgtgttagtgtaaatggcgaaagcgatatatatcttgaaattatgtacaaattttttgttttgttaagatatatcgttttcgacgttaattccagcctcctctccattgtcgtagttcgtccgtgtcgcgaggctatacataaaagtcataaacgcagagaaagaaaattgatatttaattcaatggttaattgtagctattatgtaattagcaatgactaatctaaccttatgcagtttggttaatttagtaattatacacagactcgacatgattagtcaggctttgtatatgtgtcgcattgtcgccacattaagatcctttagtgcaaccaaaacacactaaactcggctgaaatatggggcatcttgtaccttttaattatcgctgattactgattcacatcaaatatatggttccaaattattttattaactcaagtgtatagtaatgtttgactcttttttctgcaaatgtttcgaagacaaagtgctattaagttttatcaaaactatgatgttttgtagttttagatgattatataacgtttgtcaatctgtcttttaatttacttaaatcattagggcaggtaactatatttaaataaaaaacagagattgtgtatgagtttgaaataaaaacgtgttaaaatggaaaaaataaaccatgccaagtatttactttactacaaaggaaaaagtatacagaatttttacatgatgtcgtatgaattacatcatgtaataatagtaacttagatattctgtaagaaaattagatttgcataattacgttaatatccgagggtgtatataaataagaaagaaagaacagaggattaaaacccacaaattggcgttttatacatccccatttaaaaagaatggtaacgccgactctgtgaagcatttttcagcactcctttcctttcccccacaaactaaacaaaaaaccattaacaaaaaaaccattcacaaaaaaaatagagagaatcatctgagagagtagtagtgatgatatgatcgcttcttctcctacaatctcagaaacctccgatcacggttttagatatcttctacaacggatacaatg

SEQ ID NO: 36658 - DNA, 3003 bp, Unknown; identical to SEQ ID NO: 36657
  misc_feature (1)..( 3003): 2750-1469P.txt file - cDNA_ID_3098939; gDNA_ID_1620500; Annot_ID_158854

SEQ ID NO: 36659 - DNA, 3003 bp, Unknown; identical to SEQ ID NO: 36657
  misc_feature (1)..( 3003): 2750-1469P.txt file - cDNA_ID_3098939; gDNA_ID_2936567; Annot_ID_143725

SEQ ID NO: 36660 - DNA, 3000 bp, Unknown; identical to SEQ ID NO: 2185
  misc_feature (1)..( 3000): 2750-1469P.txt file - cDNA_ID_3098947; gDNA_ID_2936567; Annot_ID_194656

SEQ ID NO: 36661 - DNA, 3003 bp, Unknown; identical to SEQ ID NO: 22152
  misc_feature (1)..( 3003): 2750-1469P.txt file - cDNA_ID_3098951; gDNA_ID_2936567; Annot_ID_194644

SEQ ID NO: 36662 - DNA, 3003 bp, Unknown; identical to SEQ ID NO: 36655
  misc_feature (1)..( 3003): 2750-1469P.txt file - cDNA_ID_3098960; gDNA_ID_2936567; Annot_ID_194639

SEQ ID NO: 36663 - DNA, 3003 bp, Unknown; identical to SEQ ID NO: 36655
  misc_feature (1)..( 3003): 2750-1469P.txt file - cDNA_ID_3098960; gDNA_ID_1620500; Annot_ID_158831

SEQ ID NO: 36664 - DNA, 3003 bp, Unknown
  misc_feature (1)..( 3003): 2750-1469P.txt file - cDNA_ID_3098973; gDNA_ID_2936568; Annot_ID_194691
gagctcgtctgtgactacttaatgagaagaaccgttcgcagcctctatcaaccagttgtcttgatcgacgtcgatcttaacaaatgcgagccttgggacattcctcgtaagtaattctgtgtttacacaacatctcgcaactctatatcatatagtttaaaccattccatcggtagctattaaatccataattcttgtttccaacatgatctggttattgtttcttctacaattcgagtatatgtggtgtttagaaaaaaaaaaaaaaaaaagttcaacttgcaagccacctgcaaattagtattttgttccttactaatttctcgtgaaaagaccatttagctgcacaattataaatgcttagttcacattcattagacgcatatagtttattaatttagaatgaaaacgataccgtccgtttacataataaaagaacaaatcatcctaatcttgcagacgtgttggatgcctattcgatgactggttggttaagatatgaatatatgatacggatagaaaccatttggatattattgaatatgtcattaagatgaagactatttctgaaaagagaattctgtttatatatcttaatcttatcataaagtttctaaaatatgttggagaaaataccccctcccttaatagaaaactaaaatccattaatgtatgttagtatgtactatgtaatatacaaagaaaaacattcaacgcccaacttcttatcaatagttaagtttgatagtatataaaaaggtcattttcagaaacggcgagagtgggagggaaagaatggtacttttacagccaaaaagaccgtaaatacgcaacaggctacagaacaaaccgggctacggccaccggttattggaaagccaccgggaaagatagagcaatccaaagaaacggtggtcttgtgggtatgagaaagacacttgtgttttaccgaggtcgatcccctaaaggtcgtaaaactgattgggtcatgcatgagtttcgtctccaaggaaaacttcttcaccactcccctaattctctcgaggtattactcgtaaaaccgattgggtcatgcattaattagtccctctctttagtccattttttcctgcaaaataaatgtctctttgaaatgtaaatatagtcgaaattcaaaagtcaacttttctaaaatactccacaatagaacaactgatttatttttatgtcgcataaaaaaactaaagcaacatttagtattacattatatatcggctcattagttctactctttcgtaaatagctactatgtgcttttgaatgtaaatactaaatatcaaatgacgcatgaatgaagcaaacagccagagatgtcgcaatcatattatcccatgacttaaggcaaaagttttgactttatctttctttcacattcaacctaaatgttaaatgtctttaagggattttgctgacgattttgcaaagatttatttgtggctgatttaagatgatctatgacttggcgcacatatctactcttaaccataattttgacaaaattagttttgctgggacaaattaatgaaaacaggaagagtgggtattgtgtagagttttccacaagaacagcaacggagctgatatagacgacatcacaaggagctgctctgatgcaacagcttctgcattcatggactcttacatcaacttcgaccatcatcacatcatcaatcagcatgtaccctgcttctccaataatttgtcacataaccaaaccaaccaatccggtttaatctccaagaactccagcccattgtttaatgcttcccctgatcaaatgattctcagaactttgctaagtcaactcacaaaaaaagtcgaagaatcacagagtcgtggagacggaagctcagagagccaattgaccgacattggcatcccaagccatgcatggaattactgattatgaataaggcttaccagatatatcactatgtataagtatcatattcatgattcgaaacaatttattcaaccctcttatgtaaactgttataccattatattagcaatccaatcatatatagttgctaaaaaagcaaaaaatcattaaatttctgttatataatattttatttacgttatataatatgaaacggtaggtcgtctcgtcccataaacaaataatccaaagttacttaatcattatgaaaatagaagaggaaaaaatcttgaaaatttcccttcaatgggaaagtaacgcattaccataataagtaatttccacttggcttttcgacttttcatgtgattgactttgtggaagagagagaaaacaaaaaaagtaaaagcttcttcggtctggatatttatttgattgggtaaaaccgtaaaagtgccactggtgttgtgttctgtccgttggattttaatatttccgtttttcttttcttactggaatctattagtaatatatattttgccataattcataggtcggtaaaaaaaataaagatcggcgtatcgtaccaaaaaaggatattttgtttaacccggtcattatcctacgcgcaccgacctttctcattctccgtcgtcgtccttcttttgtctttcgccgtttctttccttattcggcatcgatttttccggctttgatctccttctccgtcgtgttattgcgaattgcccttttcggattgaaatcgttgttttcccccaaatttcaggtttagttttttttttttttcaattgtattggtctattcattctgagctagggtttgtgttgaaatcacaatttttccccaatttgatttaattggatggtttcgcgaatccgggcaatgtaatttaatttataacttggtgtaattcacgagttgtgtgtattttgttccgtatttctgtttattactgcgaactcaaatctctttttgtttttttttgttttaattgtagactccagcttattgtggtggtgatgatcgttctttggcaagtgtttgaatcatattgagaatg

SEQ ID NO: 36665 - DNA, 3003 bp, Unknown; identical to SEQ ID NO: 36664
  misc_feature (1)..( 3003): 2750-1469P.txt file - cDNA_ID_3098973; gDNA_ID_1620573; Annot_ID_160904

SEQ ID NO: 36666 - DNA, 3003 bp, Unknown; identical to SEQ ID NO: 36664
  misc_feature (1)..( 3003): 2750-1469P.txt file - cDNA_ID_3098973; gDNA_ID_2936568; Annot_ID_143737

SEQ ID NO: 36667 - DNA, 3003 bp, Unknown; identical to SEQ ID NO: 33382
  misc_feature (1)..( 3003): 2750-1469P.txt file - cDNA_ID_3098997; gDNA_ID_2936568; Annot_ID_194700

SEQ ID NO: 36668 - DNA, 3000 bp, Unknown; identical to SEQ ID NO: 2668
  misc_feature (1)..( 3000): 2750-1469P.txt file - cDNA_ID_3099004; gDNA_ID_2936568; Annot_ID_194693

SEQ ID NO: 36669 - DNA, 3000 bp, Unknown; identical to SEQ ID NO: 2668
  misc_feature (1)..( 3000): 2750-1469P.txt file - cDNA_ID_3099004; gDNA_ID_1620573; Annot_ID_160907

SEQ ID NO: 36670 - DNA, 3000 bp, Unknown
  misc_feature (1)..( 3000): 2750-1469P.txt file - cDNA_ID_3099004; gDNA_ID_2936568; Annot_ID_143739
ggaatgtgatagatgacgtgtggcacaacaaccacaatcctcttcatgctgctggttattttctgaatccgatggcttactactccgatgatttccatacttatcaacatgtatacaccggtcttgccttctctctggttcacttggtaaaagaacctcaccttcaagtgaagattggtacacagcttgatgtgtatagatacggtagaggttgctttatgaaagccagtcaagctggtcagctcaatggagtctctccaggtgagtgaactttcttgattttttatatatatatagtaatattgttttatttgcagacatttaagtttttgaatctctttgcagttaattggtggactcaaaaggcgaaccagtatcctgaactgcagaatctcgctgttaagattctgagccaaacaagtgaaggtgcttcaaggtacaagctgaagagaagcgtagcagagaagctgttgctcactgaaggaatgagccactgtgaacgaaagcatctggaagagttggctgttgtacattacaatctccaactacaaagctgcaaagcctaaggaagtgaagagcagtgaagatttgttttgcatatgtgactccattgatcacaagctttagacaattcttggatcagagtactttttacccaaataagttccatatttctgtattcttgcaaggatttgcaaaaacatgagttcgtttagaacaaagaacacccaagagattgtgttgcaaatgatttcagtttttttagtcaagttttgtgatttatatatccaagtctcatctttatttatcacattttttgatatttcaatgcattattggtatcgttcaggtaaaacaatgatcaactatataaatatttagtttctactagaatcgaagtataagttccaaagtgaaaagatttaagacgcaacacaattatttcaacacaaaagtatatagcaccatgattttctgggaaagtgattctttactcgttggttttcaaatttcgaatataaaatttgaaggaaatattgaatatcaaaatgtcaacaaagaaaacaaaactcagaaaaaggaatcaggcaccagtccactaagctctgaccagaaagcgacaaaaaaatgtcttagtagttgtataaacatgtgataatgggatgcttcaaggtttggttttaaagtgagtttggttttatttgcttctctcctttttaaatcactttttactttgtcattttttgagagaaaaagacgtcaaaatccaagtgcccgtgtaaattgaaactagtgttacagattctccactgttctgttccacagtatctttgtcttgtactctgcccaattctctaactcattattttatttcatagcccataataacaagaaaaaatagagtcttctttttgtagttaagcattaaatgctgacacatatttgagaagtttttgaatttcaaattgagaaactttttctaagtttggaaaataaataagaggttttcttctcttgtactcttatctagtagtactatctagtaaggcagagagatagatattttttctgggggagaatctagcagaagaagcctactagggtttggtttcttgagtcacatagatcttcttctctatctgtctctcttggattcttcaatgttcactttcagtcattggaaaaaaaggttcgcttttgtccccacttctcttttctcttcgaattttggttgcagaaaattgattttggtcaatctttttgaaagtgtcaatctttttttgaccattgattttggtatattcttttgttgaagccaattagatatatttgttcgtcttttagggatagggtctttagcttcttccttctttaatgtcttgtcttttcaatggaagttatcattatgtatatttcaagctcaatatcttatctttcaatcaaattaccacaagaaaataaagaaattcgaccttcggattacacaattttttttaaactcctcaacaaatcttgaattgcatgttaacagactgcatatttgtttaagctgctggtccttgtgttaatctcgaacgaataactgattaacctgtcaaaacctttcagtgtgaaatgttgaccatgtgactggttttgccgtctggtcgtttttgaaaaggacatgttgctgcacttattttgtgtaaattataattagatttgtccttattagatgttcacaggtgtaacagtgtcttgtcttgcctcttcatcttgtacttggactccatgtgctgagaaaagcctttgtcaacctcaaaaatttgtttagtgtcttgtgcttagtagacaacaacattggtcttttcctctaaatgttatcttatctcatttattatgtgaatatgatttatgcagggactatgtaatctaactctttttgtacttgagagaagaagctgaagtacatttgttcatcatttggttttatagtattaataactgccaaactccagagctttaagatgtatgactctcaagttttgaaatctaagtaaggcttaccatttcttcctctcttttcaacttctggattttgattcagcaactccttactagttgactgaattttgatcagatacaacccatttctcagacgttcgcattctggaaagaaatttcagggcacagttaccatgtcagaggtgtgaagatacattgtatttattttcatttcagaaactaactgttgaagtcctagaaaaaacattaagagcttgcttgcttaatttgtacagggcagagaaacttgcgaagaatctacgagtggtgaatcttttccatatagatttcaacttgaagaggatgtgagtttctgaactcaataagactagtaatgataacgtggaatgtgtatactgtatagttctgaaagaagtttttatgttacaggtaaaaagattgcaactgcaactccaacaagaaatagatttgcatacatttctagagagtgtcatg
